United States Patent 9,328,346 (POLYCOMB-ASSOCIATED NON-CODING RNAS) - sequence listing, part 69

SEQ ID NO: 12984 - RNA, 350385 nt, Homo sapiens
ccggcuccauccuccgccgccgcccgagcagcugcggggccgccaccgccgccgccgccguugcagguaacagccaccgcccccaacucuagcccccuccccgccuggccuccacucccuccgggccccgggccccgguccgcccucccugccucccucaggcgggggauggcggcgggguggggugaggcgggggcuucuggguugucaccgcgccgggggcgugggcgggggcugggucaccggaggcuucggguguggguguggaggccgggggaugcccagcgcgguugacaccgacaccccccgcuuuccggggaaagcuggggggcggcggugcgcagcgggccgggggagggguguucccggccuagcgguaccgucugugucugggcugccccggcccggcgccugcugucugcgcaacucucgcuccuuccccucgccccuccccgcccgggccgcgcggcguggggagggggcgcccgccuggaccgggggcggcggcgagguuauauaacgcguggagcgccggugucaguguguuuggguuggggggagggagccgucugccgcgcgcccuggcgcugaggcugucugcgcgugggguggggugaaggcgaggaugcacaggcguccccggggucuccuuccuucccccacccuuccccgccacuggcgcgcaggaaaagacggcacugguggggugggggggggggugugugugugggagguggguaacgugcuugucuguguuuuuaauaguagugggguuuugauccgcuugggaguugugugcuaagaauagaaaugugcggaagaugcuggguuuggcugauccagugaugcugucgcugcuggcggcggcggcagcucuggcugcaaguaaacagaccagccucuuccuuguccaccuccuccggcgcaucgguccgcaucagccaugaugccgguggggcccuucagagcccaaaguugaagccuagcugguugcuguguugacccugacgccgaggcggggucaccaucccuuguuugggauuucccgggaaucuacaguuagccuagagauaaagaaucucguuggggccagguuuuuccaauaccgguauuuacuguuuauguucugaaagcagaggaaaugcuuacccacaagucaaagcugggaugcucacauuucuuccaucaaaauaauguuguuaugaaaauaaaaccaacucauuucaccaauguggcauuuugguugaaagccugguaguuugcaauugaugaaguuuccaaauagaaagucaacagugaaaccuaugcaucuauauuggguaauuucuagccauaauaaaguguucacacuuugauuuuaguugaggcuaaaguaaaaaauaauggcuuuuuguaguuaauacauuggcaguugucucaacaguuuagacauguguuccguauuugguaaagcauggucauauaugucuuuuaguagaacuauacaucacuaggcaaccacuggguuuugucagugguugaagcugacaaaugagugaaacucauugguuuagguuauguauuuacuuaggaaaacgaagguggaagagucuaauaaagaugguguaggaaaugaagauuagucuucagaacuugaguaucacuugcaaaauauguauaaacgaauacaaacauuccgggggugguugucuaaaacaugaaaauauuuuauaauuaaaauagcaacuuauuacuaaguuacuaguuuuccaagguuuaugacuuaaugcacaauuauaugcaagauauauauccggacuguaauuguuuuccuuuugccaguacauuaucuugacuuggaaaguuuaccaaggagauaguacuugaaaguuuacagggagaugguacuugaagaucuuuuuguuuuccuuacuaggguugaccccaauaucuuugauuggcuugagguuccaguuuuaaagugagggaggacaaauauuacaugaaugagacuguugaaauuuagaugaauguaggguuuuaguuuucaguuguguauuugcauugugguuuugcagcauguuuucuuacagcguuuuaaaaauaguccaaaguaauccugcaaaaauugugaaauuauuauuuguauucauuugguuuucuuuccauaauuauuacuggagugaauuguuuuccaauuuaaaauuaauuuuuggcuuaauaaucuugacaucgacucuaaauuguauaugucagaguacuuuaagguuuugcuuuggacuuuuuaaaaauuaauuucauagcuguaaaauauuuuaaauaagauuauauuuaacaaauacuggagugugaacugugugcugguuuaauuaaaaacuuuuaauauuuacauuucauucagaaaaucacugucagaaggaaucuguuuucagaaucacugcaaaucuaaauaaacguguugauuaaacuuacuagggaacaaauggacuuagcauagagacuuguggaaaguaaggacuuauuuuuuaagcuguagcuuuugauguaaacaucagaaauuuucucauaaaaauucaguggaaauuuccagcuaucuggguuucuuuaaaaugaggaaccuguuuuacaaauugauuuuguagaaguuuagccuuuacuuaaacuuuguguauuuucgugaaaagauagcuauguuuucuuuuguuauuauaucuuuuaguucaagaauuuguccuugggaagguaaggcaaucacuguuaacaacuuguuaguuggaugcuuagcaugauuugauaggagcuugucuuuauagugugauuaaguuuugaaguguuaaaaagaaaaauuuaaaacuaucuuagauuugagcaacaaaaugcaagaacugaaaaaccauuuucauuuugagcaaaucagucuugugaucugacuggcauuuuuauuuuuaaguuaauaugcauuaauaauacaauuaauuuuuguuagaagauuuguguuacuccagguuucagcaugugcaucaguauuuuaaauccuggucacacagcauaccuucuuuuggaaagauaguccugaaucuuccgacaacaaauacuuuguccugaucuuuuacaugggauaggauuagauucaguuuagaguuaaugcuaaccaaugccugguaagcaguugccaugugccaggcacuguucuaugugcuuuaccuguauucauuuaaucuuucaaacaaccccugcuacacuuuugaaagugauuuucacauaagaaaaacuuauuguggcauucuaaaaauaccuuuuauuuaaacuuuccuaauucugcaacacuucuaguguuuuucuuguuuguaccuauuauuacaguuaacagugauaauucuaaauuugcaaaauuugguacaauaauuuccauagcaucaaguuaauaaaaguguauugacuggcccauuaacaucaccuuucauuuguuuaaaaugccaaauuaaauaacucaaauguuuacagauuuuauuauagcaucauagucuuuaaucaaauuagauguaaacucauuuucucugccaaguaaucuuugaauacuaauggguagauaaaauuaauauaugcuucuugacuuguugauguguuuuuuaguucuguuucuuuucaguacucuaucaccaacuacagguauuucucauuucuaaauauuaugagaggaaaguaaaaagauuuacuagaagaaaacacuagaauugcaaaugauaauuuuucuucccuauauuagauaauuccuauauauauauggauggauuuaaaaaaauuuauaauuagggagauucccaagacagauuuuaggaggauuuuacauguauauuggaaucuauauuagaaagcuucugacuguauuugggggacuaggggaugggaggggaaggaggacaguauuuuuccaauaauggagcuuagcccaaauuuugucuuaguugaaaugcuguuugaauguuuuaucuuccaauuaucaaacuuuugaggacaugaacuauguauguauaaucaugucuuucacuuaugaugccaucuauauaugaaguagauacuccguagauuuuaacuugcagaaucauaaauauuagcucuggaagagcuauaaagcuauucagaguucaucuaaugcuauacuuucauuuuuauggcuccggaaacugaggcacagauaauuaaagugaccuuauacagcaucacucuggguggggcagggacucaaguuucuuggucuuucuggugcucuuccuaauacaccauugugaugaaccuuguuagaggauuccauaccuauuggguagcucaguuuaaucuggggguaaauucugucaagcugauucuugguauuuaauggaccauauaucaauugcauuuuauauguauguauggauuuuuaaaaauuuaugaugaggcucccaagacagauuuuaaaaugauuuuacaugcauauuacaaaaauauggccaacugugcaaccaaauucuuuuucuuuucuuuucuuuuuuuuuuuuuuugagacagguucucacuguagcacccaggcacggucaccacucagcauagccuagacuuccugggcucaggugauccucccaccucagccuccugaguagcugggacuacaggugccugccaccacucccagcuaauuuuuguauuuuuuguggagauggguuuugccauguugcccaggcuggccuugaacuccuggacauaagugauccuccugcccuggccucccaaagugcugggauuacaaacuaauaucccuuuuugacacucuacagcaacagacucauggugauuuugaggagucucagccuuaccuauagguucugccugugaccucauaauacaugaggcugguggucuugcauucagcuacauagcuuuugucaggcuauuuagucaggcugucuagagaauguuuagucuugauuccugacuguuaaaugguuaagcuccacacuuaauuugcauugaagaaugaccuguagucuaauuuagcgcuagguugggagucuaacacugaacuuaacugcuauguaucauuuaucacaaaccaaguugagagaguauguuuguguaguccaucuauccauuuuucuaguuaucuaaaauuuaugauaugauucuugaccacauaacacugguguaccuggaccacauuuuuugguccccuucugugcaaauggauuuacuaauuuuauguuggcauuuuccuuuuuaguuugagagugacaauaagcaaugacccuguaaaacucauugcuguauaugggaggguguuuuugaggacuuucccgcauacaucuuaugaagaagacccaugggauaaauucgauguuugucccaggaaaaguuguauuucuucugaggaacuuuuuuugcuuuuuaaaaaaauuugugcagcguggacaauauagcgggaccccaucuccacaaaaauuuuuuuuaaaaauuagcuaggcauggugaugccugccuguaguccagcuccucaggaggcugaggugggaggauugcuugacccccauuggaggcugcagugagcuaugauugugccacucuacucuagccuggaugauggggggaaaccccaucucaaaaaaaaauuuuuuuuggauacuguaaauaggaaagccuguuguguuuuguuauuugcauugucuucccaagagcuccaugccaaauuugugacguaucuuucccaaguauguaugccuuuacucugacuucuuuuuaucuuaaggcaguauaguuuuggaaugcaggcucuggagucagacagccuggguucagaucuuggcuccacauuuacuagguguguugaaauugagcaaguugguuuaucugugugagccucaguuuccuugucugugaaauggaauuaauaguauccucauaagguuauaaagaucacauaagaauaauagauguaaguacccguaacaguucuuggcacaucuugaguacuaaauauuuuuuucuacuuucauauucccuuuguuucacuuuacuuuauaauaaguacauaauaugaaaucaauuauuuuuuaaucuccuuaaaauauuucuuggaacaggcagaguaagaauacguaaaugaugaguucuugguacguuguauuuuauaucacuuaaaguauucacgacugguugugguggcucacuucuguaaucccagcacuuugggaggcugaggcggguggaucaugaggucaggaguuugagaccagccuggccaauauggugaaaccccguuucuacuaaaaauacaaaaauuagcagggcgugguggcgcacaccuguagucccagcugcuugggaggcugaggcagaagaaucgcuugaaccugggagguggagguugcagugagcagagaucgcgccacuguacuccagccuggcgacagagugagauuccguuucaaaaaaaaaaaaaacaaaaaauuuacaauugcuucugaaauuacagggauuuagggcaauuaacuuucauucucuucccucuucaccucaaauacacaucaccaaacaaauuuucucuauuauuuggguaggcgugacugguuuucuuaagacuuuuuuguugcaaccucuuagguuaaaaguuucacuaucauuugaaauuggucacaagacuagggaagugcuuucauuauagaacuauuuaauaaauaaguuccccaguuugaagagccagacuuuuaugugaggucaggccaguugaagacauuuacaaagaauuaguuguuuguuauugcucugugaguugcaagaauggaaaaaaaauucuuucuucaauacuuccuuccaggcugagucaucacuagagagugggaagggcagcagcagcagagaauccaaacccuaaagcugauaucacaaaguaccauuucuccaaguugggggcucagaggggagucaucaugagcgauguuaccauugugaaagaagguuggguucagaagagggguaagugcuccgcaaaccaaaaauaauacgguugguaagagugcuagcagugaguggugucuuagaaguugaucuuuuuucugauacuguuaaacugugucaugcuaugucuaguaagagagaaaugauauauuuaacguguguuaggaauuugcuuguuauuaagggauuuuuuuguaauucuugauuuugagcauuuauaaucuaguuaaguuagguuugacuuucugguauguuguguguagcguguuacagaaaguguuguauuuuucuguggugucuacagguucuguaaucuggagagauaucuuuagaaucauuuaauauauguaaaaguacgauccuauaugcauuuaaucacauguaaauauauaaauaagagaauuaagccaguuugaaugguuguaggggaauggcuuaaaguagaaaaggggaaaggguucacccgcaaacucauggauuaaucccauaaauuugguaaguaaaguccugacguaaaaggccaaaugaggacaaggauuuuuuguguguguauguuuauguuuaauuucguauuuuuauuuuucaucaucuagguuuaauacaccuuguucacuccuacuuuagauaaauaacuuaagcacauuauuauuuuuuauuauuaaaggaagaacccuucgauguaaagcgguuuaucaucugugagaucaccugcuuauguggucaauauauuuauuagaaauuuagaguuuagauuaguugcuaggcaacuacuguuuacccacauggccacgucgaguaggaugaggacuguuccauucucagaaccuuuuaguuccuguauaucuacuuuaugguuacaaguucccuccuaauauugauuuuaauauuuuuugaaggucuguaguaaauaccuauccugaaaagcuguugucauaguuaaaugugauuauggauuauuuuuuaaaugagccuuauuaagucguaacuuacauaauaaaauuaagcaauguaaagucauaauuugaugaguuuugccagagauacacaguaguguaacaaacacucugaaaacgauauagugguuauuuucauuaacccgagagguuccuuuguucucccuugcagcccaguccucaucccuuaacccuggcaaccacuuuaucugcuguuacuauaauuuugcuuuucuagaauuucauauaaauggaaucaugcaguacauaguuuuuuuauggcugauuucuuuuacauagcauaauacuguuaauauucauccaugucuuguauaucauuagcuuuuuuuuuaugguugaguaguaguucauggucuggauauaucacaguuuaucuguuaaucacuuguuggacauuugggcugcuucuagcuuuugguuaguacgaauaaagagucuggacauuagagugcaugucuuuguguaauguguuuucauuugucuuggguaauaacuuaggaaugauauugcugggucauaugguaaguguguguuuaacuuuauaagaaguauauguuuaacaaacugcccagcuguuuuccgaugugccugaccauuuguauugucaaguguaauuucuuucaaugucauucuccuguuauaaauuacgaaagcauuuucagauuucagugcuuuauaaaggcuuuuuugauuuacuuuuuaaacguauuuauauuauucuacuuuuuuuggagggggauggcaaaucacuugaaccuuuuugaguuuuacuuuacuaaucucuaaaaucugcuuucacaagaugguuuugaggguuaaaugagaugaugguuguggauuuauuuugacaguucuaacacaauguaagcuguugcuaucuccacauauuuaucaaagguuuaggaugauucuuuagucuguuuaauuaauuauaucuuugaaauaccauaauagaaaguauuuaguccauggacuauagaaaaaaaaaugaauaagaauuugccaucauuuuucuaauaauguguauguguuuauuuugagauguguauguguauguguuucuaauaauguguaugugcuuauuuugagaugaauaguugcauaaacauaaaaauuugaauaacacacaaagguauaaaaugaaaaauaaaaaucucccuaucuuuucuaccuccuuugucagagauaaucauuuuagaacuuuuuuuccuauuuuuaauugucucaucauuaugccaguuuuuuauauaauauacuaaacuuuaaccuucaguaaccuaauaucuccccauugugaaaaauagaaggauuuaacuuuuaauacugauccuaccuucuuccuuuuauuuuuugguugccuuuaugauuaaacuuauagcuguuuaacaguuaacuuuagaguguucagacauugucucuaaacuugccacuuuauaaguuguaaaaaaaaaaaauuagcuuuucuccucaucuuucccuugaauuccucacauucccuuuccaguuuuucaacuguaacauuuauuuuauaugucaagguuuauaauaguuauacuugcugauucugaaaagcaguuaaaauauuacauuauauaaauaauaugacuaaacaaagugguaugaugagauucuuagagagcaaauggauuuauuuuauuuuacuuuaaguucugggauacaugugcagaacgugcagguuuguuacauagguauacaugugccauggugguuugcugcaccugucaaccugucaccuagguuuuaagccccccaugcauuagguccucaugcucucccuuaccuugccccccacccccagcaggcccuggugugugauguuccccuccuuguguccguguguucucauuggagaacaaauggauuucuuacgcucucuuuguacuccagagcugccauacuuuaauuugguuucuaguuuggacuguggcuauuuuuccuggauuuucuuuauuuuuauuuuauuuuauuuuauuuuuugagacggagucucguucugucacccaggcuggaaugcaguggcaugaucucggcucacugcaaccuccgccucccguguucaagugauuccccugccucagccucccgaguagcugggaugccaccaugccaggcuaauuuuuuguauuuucaguagagacgagauuucaccguguuagccagguuggugucgaucuccugacuucgugaucugccugccuuggccucccaaagugcugggauuacaggcgugagccaccgcacccggaccuuuuccuguauuuucuguuuuuuuuuuuuuuuugagauggagucauguucuccgucucaucaacaacaacaacaaaaaauugauauaauaaaguuauaauauaguuauuacuuugaauauuagucuuuuuucguaagacuauaugcaucaauuguuguuaucuccagauauaaucugauuuguacuuuuaaugugaguaaguugcuuuucaguaaauaucuucuuggaaaauaaaaaaagggcugaaagauaaauauucauuauuacguaggauaaaugcuuuccuaaccuugguuauuagugauauauuaauagugauauccuauuuuuuacacuuuucuggacaguugaaaaugauaaguauuaauugagauaacacauuaccauaguauuguugguguuagaaauggcaauaaaagaaacaucacggagcaaacaucaaguaaaguauugucugcguuuuccuccuugauggauccaggacagcuccuuacaacuugguugcacaucagcauaggaggcaucucuguauauauuaaauacuuacuaaaugaucuuacucaaagacgagccuguagguauguucuaggugacucuaaaucucuaaauuggauuucagcacuucucuuaauuuuuucccuuauagcuagugguaauauuugcuaugaagguacuuaguguauuaauaaaguaggaaauuuagccaguuuaaaaggucuaaauuauagaauuaaauaaauugcaauaguauuaauuaagggcuuauuauaauuuauuaacuuucauuugcuuaauaaaauuucauaaaaaccuaaguagucuuuuauaaauguggaaagcuaguuccuugauaauaaguuaaaauauaauguauaacuagucaauucauaauguuacuguuuugagauugucauaaaucuaagaggugauuuuuaucauuaaaagcauuuugaugaaaauguuccaugcucguguuacuuuauucuacuuuuuguauuaguaucuaacaaacugaacuuucauguuguauucucuauguguaaccaguuuuggcuuucaaauaacuuuuucccuuaguuuucuuuguacugacuuuguccuuugaauaauauuuuucuuauauuccaugaaaugguuuauuuagaugaacuacagugucgguauuugguaaugccaggauaaagauuuugugucuaugaguugucucacaagauagcuuaauucugcugagcaaaauauacuuuagcaacauaaagauugugaacuugguuaugcuguaagaugugauucuuguuaucuagucaaauuuaacaaguuguuacagaaaacaauuuacauuuuugaguguuuaucuaaguccaggggucuuuucuucuccuuuauuuugugcaugcauguguuuuuuuuuguucauuuuuuauucacaaaaugacuuuagaaauaaguuauaaaaugauuaggagaaagaaaaugacaguaugauuuccuguuuacuacccagcagcaagcuuuuuccauagagaguaaagagcugugguagugacuguguaaaccacaugguacauuagagaagcucacuuugacuguugagguuauacauggagaguaaacauaagaaaauuaaauuuauuuucuaaugguauugaaacucugagauuuaacuaauguauuuacaauacugugaaauuagcuuuucuuagaguuucaauguauuauuuuugaaaguuucaaccaauagaaccacauggagcaaaccaucaaauaagcuuucauauacauuuugaaguuauuuauagaauuguaaaguugcuguuacacacacacuugcuccuucucaaucaacaaucaaguuuuauguauugauuuuguaaguugaagucucaugaaauucacuuauuaauguuaguuuaaagauuuucuacauagauggucaaguuaucugcgaacauccacaguucugcuuuuuccuuuccaaucuuuaugccucugauuucuuuuucugaucauauuucacuggauaggaccuccaguacauuguugaauaaaagugguaagaguggauauuuugcuuuauugcucaucuuauugggaaagcauuuauuuuaccacuuaaguaucacauuagcuguuccuuuucuguugcugcccuuuaucagguugaaaaaauucccuacuauuccuaguucggagaguuuuuaucaugagugguggucaguuuuuucuaaagauuuuacugcuucuauugaaauggucauuugauuuuuuccuuuuauucucuuaauauggugaauuacuuucauugcuggaauaaauuccauuuggucaugguguauuuaaaaaaauauauuaccaauuuggacuuacugauauuuugcuaaggguuuuuugcauuuacaagaguauugaucuguaaauuucuuuucaguuuugauacagugguuaugcuggauucauaaaauagguugggaagcacuuguuucucauaagguggauuguauuuuuucuucaguguuugacaaaauguaucagugaagccauguggguuggagcuuucuuugugggaagauuuuugaugauaaaugagauuucuuuagauacaaggcuauccauauuuucuauuuccucuugugucauuuuugguaaauuguauuuuuuaaggauuuccuuuucauccaagauguucgucuaaguuacugggugcaaaguuuuuaauauucccuuauccuuauuuuuauuuuuuuaguagagccaagauuugcuccauugcccaggcugaccuugacguccugggcacaagugauccucccaccuuggccuccccgagugcugggauuacaggcucccuuaucuuuugaaugucuguaagaucuuagcgauaucuccuuauuaaauccugauauugguaaauuauauacuugcucucuuuuuuccuuugauaaucuugcuaggaguuuauucauuuuaugaaaucuuuuuuuuuuuuuuuuuugagauggagucucgcucugucaccaagcuggagugcaguggcgcagucucagcucacugcaaccuccgccuccuggauucaaguugauucuccugccucagccuccugaguagcugggauuuacagucaugugccaccaugccuggcuaauuuucuacuuuuaguagagacaggguuucuccauuuuggucaggcuggucuugaauuccugaccucaggugauccacccgccuuggccuuccaaagugcugggauuacaggccugagccacugcacccagccaacuuuuuaaugauuuuuuaaaugauccauuauguggucuuaucauuuggucugucuguauuuuauuuuuuggggguauaguguuauaaauaucuagucaagaugauugguaaugggucauagucuucuaugucuucacugacucguuuuuuuuuuuuccucuaguucugugacucaguguuauagucuccagcuaugauugugaauuuaucuguuucucucuuuaguccuaccuuuuuaauuuuauauauuuugaagcucuauuauuagaggcuuuuuuguuguuauaucuucuugauguauugcuucuuuuauccuuaugaaauguucaccuuuuucucaagugacacucuuuaucuuggaauucaguuugugugauauuaauauaguaacuccugauuuuuuaugauuaguguuugcaucuuguaucuuuucaacuguccuauuauauuuagucuuuguuuuguauuuaaacuguuucucucguugacagcauauguuugggucgugucuuuuuuaaaaaaucuaauuugacaaucuuuaccuuuuaaaugggaguuuuuaggccagucauauuuaauguaauuauugauaugauugaguuuucuguuugugucauguguucuuuguaucuuuucccuauuuuuuugccuuuguuaggauuuaguaucuuuucaguauccuauuuuaucucuccuauuggcuuguuauuuaugugucuuauuuuaaagcaauuuaaaaauuuauaguuaauguuauuguuggugugguugaacuuaggcauacuguuauuuuuuuaaaaaaauaccucucuucauacuuucuuaucuucuuuugaguuaauugaauuuuuuucaguauauuccacuaacaguaugcauucucaacaggagugguaauucuccuauagggcaaucauagguucuuggaaaaggguacagaauauccuuuuauauuacaauuguuuguggcucuccaaucacauuauauaaacagauauaucuuugguauuaaaauuucuugguggggaccgaagugauuuagagggaguuuucuaaagaggcuccuuaggugagccaaggaaaaaccuuugauaaacaguucugucaucauuuuagcuugcauugcuuuuuuagguauuguucuaagguaguggaauacagaauacauguacagguuuguuauauggauaaauaacauguuguagggguuugguauacagauuauuucgucauucagguaauaaacauaguacccuauagguaguuuuaagauccucacuuucucccacucuccacccucaaaauacauccucaguguauacucucuaaaguacaaccagggugauuuugguccccagaggacauuuggcaaugucuggagacauguuugaaaugaugugggggugggauugcuacuggcaucuaguggguagaggccagauaugcugcugaauguucuauaauggacggaauaguaucccauggcaaaaaaauuuccaguucaaaauguuaguagugcugagguugaggaacucuauucuugagauuacaauauucauucuuaauuuauuacagucuauguaggguuaguauuuuacugcuccauauaaaauauaagacucuuccaaugcuauauuuauauuugcccccacuucugagagugccuugugcuguuguucuccuguauaguauaucaccauguuauaaacucuguuauaauguuauauauuuuuugccuuauucauacgucuuuugaaaaagagcaggaaaaguauggucauuuacacuuauauaccuauuuucaguuaaaaaauuuuuuuccuauagauuucauuuucugucugauauuuuuuuucaccugaagaacuuuuccuuagcuuuuuuuuuuaaacuuuuaguuuccagaauacauuauugguuagauguuauauggguaaauugcguguugaggggguuugguauacagauuauuucgucauccggguaauaagcauaguacccuauagguaguuuuaagauccucaccuuucucccacccuccacccucaaaauacacucucaguguauacucucuaaaguacaguguguacucaaauguguacucaauguguacacaaaguacacccucagcguguucuugaaacaucgaguauacauuguccauguguacucaguguuuaccucccauuuacacgugagaacauguaauauuugguuuucuacuccuucauuaguuuacuuagguaauacccuccagcuccauccauguugcugcaaaggacaugaucucauucuuuuuuuauggcugcauaauauuccaugguguguauguaccacauuuucgucugcuguugaugagcauuuagguugauucugugucuuuucuguugucaguagugcugugaugaacauauguguacaugugucuuuaugauacauguaugauuuauauuccuuuggucauauuuucaauaauggaauugcugggucuaaugguaguucuguuuuaaguucuuugagaaauugcugaacugcuuuccacagcggcugaacuaauuuacauucccaccagcuaucaaauuagaauccuguacaauuuaaaaaauccuucaaaaugaagaugagcccagccacaguggcucaaauuagaauccaaacuaucaaauuagaauccuauauacaguuuuaaaaaucguauauguggccggcuaauuuuuaaauuauuuuuuuauagagauggagucucaauauguuguccaggcuggucucaaacuccuggccucaagcgauccucccaccuuuuccucccaaagugcuaggauugcaggugugagccacuguggcugggcucaucuucauuuuugaaggauuuuuuaaauuguauauaggauucuaauuugauaauugugguuuuuuuaucauuuuaaauaugucauuucauuuucuucuggcugccaugguuucugaugaaaagucaccuguuguuauuuugacuugcuguuuccuuauauagucaugugccauugauaugguuaggcuucgugucccuacccaaaucucaucuuaaaaauuguaaucccuacgugucaagggagagaccaggcggagguaauugaaucacgggggcaguuucccccaugcuguucucguguuaucgaguucucaugagaucugaugguuuuauaagggguucuuccccuuuaacucggccuuccugccgcccugugaagaaggugccuucuucccccucaccuuaugccaugauuguaaguuuccugaagccucccuagccaugcugaacuaugagucaauuaaacuucuuuccuuuguuaauuacccagucucuggcagguuuuuuuuguuuguuuguuuuuugauauggagucuugcucuaucacccaggcugaagugcaguggugugaucuuggcucacugccaccuuugccuuucagguacaaacaauucuccugccucagccucugggacuauaggugugugccacugugccuggcuaauuuuuguauuuucauuaagcgacgggguuucaccauguuggccaggcuggucucgaacuccugaccucaggugauccagccaucucagccucccaaagugcuggauuuacaggugugagccacugcgcccggccucaggcaguucuuuauagcaguaugaaaauggacaaauacagccauauaaugauguuuugguccauaacagauugcuaaugaugguggucccauaagauuauaauaccauauuuuuacuguaccuuuucuauguuuagauauguuuagauacacuaauacuuaacauguuucaauugccuacaguauucaguacaguaacgugcuguacugagaucucccucucacuuuccagcuauuuuggcagcucugaacucugucucuucaaacuaguaagacuuucugaguucuagccauuccacucuaguuucaaggaaugggagagcgccuugaguaaaaagccacaucagugcgaaucucauuuguagcucccuucuuuacagucaguuuccuucaauuucugccugcuuuugcagcuuuucuacugccuucaaauugucauucuuuauauuuuauacagaguuuauaauuuuauauauagaaggguuagucugauacaaguuacuauacuacuacuggaagugaaauuuugcuagguauguguuuuaauguauagauacacaaauuuauuuaagcuucaugauucacauacugcuguauuccaauuuaauucuuaaauuaugaggagaagaaguuugugagaaguaggaguacaguuuauaaaaauuuaucagaaauuaugaguacuacaaguuaugagguguaugaaacuaauaguuuaaaccgaguuugaaucacuuaucuagaaagauagcuuuuucuuaagcucauauguagaauuucaaccuagaagugacuuuaaaaguuaucuagucuuuuuuuuuuuuuuuuuuuuuuuuuuuuuuuuuuuuuuuuuuuuaguuuuagggaugagucuuuuuauguugcucaggcugaucuccaacuccuggccuucaggaguccucaugccucggccucccaaaauguugggauuacaggcaggagccacuguugguggccucucuagucuuauauccauucaucugacagauuucaaaacugaggccauauuucaaguuagguauagagccaggauuaguaccugagauuucuuuuuugcugaucuuagauacuucagauuuuguuucuuucuugacguuuaggaauagauugaauuucuucaaaaaauauuuuguaucuuguugggggggaggggcucagaaguuuuggguggaaagauuuaaaauccucugaguauggaaaagggggaguaucuuccaccuuguggaauccucacacugugugaguaauauuauucacugcucuacuucccaguggagaaugcagagaagcuguaccucuugaacuuguguuuucucucuuugaguaacuguuuccauaguuucuauacccuuugacauagagaaacuuucuuuaguuuguguucgcauuuuauaaucaaucacauuaccuuuugaugugugauagcccugcaccuaccacuaauuuucuguguuuuugguuaugcuaguuuuucggcuuggcauguuuuuuccccucugucuuuuuaagugaaaaaucuccuguguccuucaaagccaaauuauuuacccagaucauggucuuacaaaauuagaaugauuucuuuugucuguauaauauugcaacaauuuccugucuugaccuccuuaugacuuucuauugccuuguuauuacauagaucuguuauuucuccuuuccauuguaaccuccuugacagcacugugucuaauacaacuuuauauuuuguacaguuuguaauuuuccuucugaaauacaguucaccauuauuuugagcacgguagucucuuaaucaguaugugauacaaaaauggggaagaaaauaaugauucuagaaguucagauaacaguaugucacagauauuagggcaaggaacuagaacugggacagcugaggcaagguaggaaacacagacuagaucacaguuaugaaagcagccuaauguucaggagagaguuucgguaagggcagcacuggaauucuagaaccauguuguauaucugucaaauuuuuguguagcaaaacagaacugacaggguaggaauugguagauuugacugaaugguuauuccugacaaagauaguggguuguacccugauugucccagaauggacuaguaaauaagguaucuaaauuagguaaguagaauaaaagauugggaauauuguaguuuuuaugguuuggaagauuaaugcguauuuuaaggguaauuuuugcuuuacucuuagaacgguaaaguaccucugauuucaugaaaccuaacuuucuaagccuauaagaagaaucuuuucuacuguguuucuaauggaucacuuaucuuagauauugugggcaacuaaaguugcacuguaucuguuucauuauuuaacagcucugagcacugguggucuuuguuugcccuccugagcaauauaaaacaaguucuguuuuccaguuuauaggccuucggauuuuucgagauugcuauccugucuucccuaaaaucccucuuucuaagcaaagugcucucaauucuuuauuauguuuauaauuauuauaagacacgguuugcagcccucucauacacgguacaguugucccccaguauccacgggggguugguuccaggacuuccuggagauagcaaaaucugcugaugcucaaaucccuuacauaaaaugguguaguauuugcauacaaccugcacacacccuccuguaugcuuuaaaucaucuuuaaauuacuuacauuaccuaauccacugcaaaugccauguaaagauucuauguaagugguuguuacacuguccuguuuagggaauaaugacaagaaaaaagucuguaaguguucaguacagaugauuucuuuuuccugaauauuuuugaucugugguugguugaauccacagaugggaaacccacagauauggagggcugacuguauugguaucuuacuguggaaauagcucaguuugucaauguuucucuuacagcguagugcccagaagugaaucuguuacugcagaugugaucggugcagggaaaaagcacagugagacuguuagccucuucucauagucugucacuguaggggccuucggugcgauuaaaggcuguagccacuuuuucucaguuuuacucuuuaagggaacuuuuauuauguuuugauuauauaaaucauuuauaaagucaguuuauuguccagauguuaccaguuuacauuccuagcacuaauaugugaaggguucuacuuucuuauaccguagccauugcuggguguuacucuuucuaguuuuugccauuguauugcuguuuuauuuuacauuucuuuguuacugagguuuaacguugcuuaaaugaauuauuauucuuguucuuaguuaaguuuuaaauaugaggccuauccuuaaacauguauaaauuuuauguucuuauuuauugguaagagcuuuuuguguauugagaauaccuuuauuugauuaaucuuuuuuguugugaauauuuuucuaguuugaauauaccuuuuaauguuacgguauauuuuugccuuguaaaauuuuuuaguuguuaaguaguuuaauaugucagacuuuucccauucaaggagaccauugaggucauacuuacaaacucuucaccuuuuuccuuugagcaucauuaugaugaaaacauuuuguauuaucuaaguaauauauucuccuuuaaaagagccaagcaguaaauauauaggguaucgugugauuccuuucuuccauauucuuucucagaaauaaccacugccaaguaugucaugccaauauaaagcuaaaauuuuuaagaaguacuuaagaacuagaagaaaaugccaaauuauagguaguauuauccccuugucaagagauucggauugaagagauuaggcagggauaggaagggggauaauuaagaaaaugagacuuuuacacuuuauucuguguaaacauugcaucuuucuguuuugccucacauuacauaaaugauaccguaaucacuuacuaugucuuggagauuuauccaugccaugggaaccuggaacucgaaaaaagugacuaguuugacuuaacuugcucuuagugaaucuauucuuacuucuuguccaucuacaauuucaaaguacaucugaugcuugaaacaagacuagaguuaggggcacagaccaccugcacggucaaaaaugcgcaaaucacuuuugacucccucacaacuuaacuacuaauagcuugcuguugacuggaagccucgcggauaacauaaacaguccauuaacacacauuuuauauauaauguacuguauuuuuacaaugaaguaagagaaaaaauguuauuaagaaaauguauuauuuuucaucaaggggaaguggaucaucauaaaggucuucauccuugaugucuucaagucaaguaggcugaggaggaagagaaaggguugguauugcuaucucaggaguggcugaggcagaagaagcaaauccagguacaaguggagucauucaguuaaacccauguuauuaagggucagcuguaccuauauaugucauuugaguguaaugguuaagaggaugggacugaauuccaaauccuggcuuugccauuuauuagugucugugggcacaauccuuaaucugucuuaaauuucuggucuguaaaauggagaugauaaaagugccuacuuuauauggguauaggaauccaagcucauaaugugugauuagcucuuaucagacugcaugggacauauuaaauaguaaauaacuauuuaauaaucuguagaauauuacuaguuugacaucaacuuuacuaauauuuaguauuuaacucacccauuguuuacuucuauauagacagucgggauacuugcccuuuuaaguuuuguuguuguuguuguuguuguuguuuuuaaaacauucuucagaugcuuuuacauugaucaaaaaucacugaugcugaccggaacucaaagugauaagcuacuugcuaacuaucaauaucaauguuuucauuaugauauuucucuuuggagaagaccaguguaaaagaggaguugaucaguauuccuuuccugucaacugaccuucauguuguacucucuuccucaggcuucaucuuucuuaauuuaaaaauucauguuugucuguaguaauuacaaaaauucauuauaggauuuccaaguucuaauaguugcuuucuagauuuggucuucauuaugauacugcuccuauauuuuucaacacuuuuucuuaaaugaaauaguacuaaagcgacaaguacguacauacauuuuuuuccucucacucaggauuggguaagaccaaauagucauauuuuaauucuuugguuaaacuuuaugauuaaaaaugcuugcuguguaagaauacuaauuuccuuaucuuacacaguuaggagcuaagacauuuccaucuaaaauuccugggucaagaaauagaggcuuaaguguauuuuuuuaauguggaauacaaaccaguagaaaagcuaaaaaugaaaaugaaaguaacaaaaauugggaagaaagggcagaggguaucuuaauuucucaaucuuuauaguaagaagucauuugaugugguuaauaggugauaaaucaagaaacauccacaaugccaaaaauauuaaaaguggcuguuuaugagaaguggaauggagaaugaggucuuguguauaugugguccuguguguaugggaaugguggaagagauacuuuuauuuuugagucuuacaugcuuuuauguacuacugaguuaucacuuucuaccuguauuaguuaauaaaacauccuacaggauuccaguuuauaaagauaaaagcauaguuuuauauguugauauauguauaaaaaugaauuggauggaaauauaccaaaauauaauaagugguuauuucuggguauugaguuuuuuccuuccuuauauuauuuuguauuuuguaaaauuucugaaaugcauguauuuuauuaauuuauauaaaaauuguuaagagaaguuauuuaggacuuccuaacauuuaauuuaauuugucccggguuuaauuuguugucacacuuacuuggcaucagaauguuugcuuuuuguuuguacaauuacuagaacuuuuuuaaauuaaaggaauuguacaucauagucuuugcaugcuuaguaagguuggcauucugcugaaaauaacagaaaaccuagccaacaguaacaacaaaaaaggacauuuucuuuuuuuccacuuaaggguauaggugggcgguuauaguuagcagaucaggauagaaucaucagagauugaagcuaucucugguucaucaccguuagcuuguuugcuuuucauauacuuguugcuucaagguuucaagauggcuguaguaaugggcauuacaucucuguucaaggcagucaaaugggagauggcuggugucagccacacugucccuuauauuaggaaugcaaaagcuuucuccgaagcucgcuaucagacuuacuuuuccagaacuggguuaugugccacuccuagcuguuagaaggugaauauuuggcuuucaauuucuguagcgggagauggcaagaguaaagggguuugguaauugauguuguguuagacaaccagcagucugcuacaaaaaguuuuggcaaauguaacuaauguuuguacuucaguucucaaucagauacccaggagagacaguagccuuucuagaggucagauugaaaauuugacauaccaacauucucuaaaauuuacucuugucggguauuauucugaaauguagccauuuugucugguccuaggaguacuagguuuaugcuccuuucuuuuuuuuuucuuuuuugagaugaagucucacucugucgcccaggauggagugcaguggugccaucuuggcucaguguaaccuuugucucccggguucaagugauucuccugccucagccucccaaguagcugggauuacaggcaccugcuacaacaccuggcuaauuuuuguauuuuuaguagagaugggguuucgccauguuggcuaggcugaccucgaacucuugacuucagguguucugccugccuuggccucccaaagugcuggguuuacaggugugagccaccgcaccuggcuaugcucccuucuuaaaaaaaagauaguuuugguauccugaagugauaaugaauuaugggguacguuugguaaauuauuucaauuaguuuuauuccccuuguagaauccaaauuccuguuuguagccgguaaucugaggauugugaauuuuuaauguaacaagucaauuauauaaggguuuucauuguuguuuuuaaguuacagugugcaaugaaacggauagucacagguuuuacagcuuaugacuccaccucuaccaacccaaauaauggucagccaaaaauauccaaauuacauaguuugaaguauuagguguuacaguuacuuggauugucuuaaagccacauauuuuaaugguuauuaucccuuauuuucuuauuccucugucacugacuccuuuuaaaauacuuuaugaugcagauuugaauaguugucauugugauuuuuuuaaguucugggauucaugugcaggacaugcagguuuguuacauagguaaacgugugccauggugguuugcugcaccugucaacccaucaucuagguauuaagcccaacaugcauuagcuauuuauccugaugcucuuucuccccucaucccugacaggccacaguguguguuguuccacucccuguguccauguguucucauuguucagcucccacuuagaagugagaacaugugguauuugguuuucuguuccuguguuaguuugcugaggauaauggcuuccagcuccauccaugcuccugcaaaggacgugaucuuguuccuuuuuauggcuauauaguauuccaugguguauauguaccacauuuucuuuauucagucuaucauugaugggcauuuggguugauuccaugucuuugcuaucaggaauagugcugcaaugaacauaccugcauguaucuuuaucauagauugauuuauauuccuuuggauauauacccaguaaugggauugcugggucaaaugguauuucugguucuaggucuuugaggaauagccacacuaucuuccacaaugguugaacuaauuugcuuucccaccaaugguguaaaaguguuccucuuucuccacagccucacuagcaucuguuguuucuugacauuuuaauaauugccauucugacuggugugaggugguaucuccuugugauuuugauuugaauuucuugaaugaucagugauauugagcuuuuuuuuuucauguuuguuggcugcauguaugccuucuuuugaaaagugucuguuuauguucuuugcccacuuucgaaugaaguuuuuuuugucuugaaaauuuguuuaaggucuuuguagauucugaauauuagcccuuugucagauggauagauugcaaaaauuuucucccuguacauugucuguucacucugaugauaguuucuuuugcugugcagaagcucuuuaguuuaauuagaucccagucgucaauuuuugcuuuuguugcaauugguuuugauguuuucaucaugaaaaguuugcccaugccuguguccugaauggaauugccuagauuuucuucuagaguuuuuauaguuuuggguuuuauguuuaagucuuuaaaucuguauugaguuaauuuuuguauaugauguaaggaaggggcccaguuucaauuuucugcauauggcuagccaguucuccuagcaccauuuguuaaauagggaauccuuuccccauugcuuguuuuugucagguuugucaaagaucagaugguuauagaccuguggucuuauaucugagauuucuauuuuauuccguuggucuaugugucuguuuugguaccaguaccaugcuguuaugguuucuguagccauguaguauaguuugaagucagguagugugaugccuccagcuuuguucuuuuugcuuaggauuugucuuggcuauucaggcucuuuuuugguuccauaugaauuuuaaaguaguuuuuucuuauuaugugaggaaagucaaugguaguucaaugggaauaguauugaaucuauaaauuauuuuaggcaguaugaccauuuucacgauauugauucuucuuauccaugagcaugggauguuuuuccauuuguuuguguccucucugauuuccuugaguucuccuugaaaagguccuucacuucccuuguuagcucuauuccuauguauuuuguucucuuuguagcaauuaugaaugggaguucauucaugauuuggcucucugcuugucuguuguugguguauaggaaugcuugugauuuuuacacauugauuuuauauccugagacuuugcugaaguugcuuauuagcuuaagaagcuuuugggcugagaugaugggauuuuccagauauagggucaugucaucugcaaacaagacaguuugacuuccucucuuccuguuugaauacacuuaauuucucucgcaugauugccuuggccagaacuuccaauacuauguuaaauaggaauagugggagagggcauccuugucuugugccaguuuucaagggaaauguuuccagcuuuugcccauucaguaagauacuggcugugauuuuaucauaaauggcuuguauuugagcuauguuccauaaauaccuaauuuauugagaguuuuuaacauuaagggauguugaauuuuauuaaaggccuuuucugagucuuuugagauaaucaugugguuuuguuuuuaguucuguugauguaaugaauuauguuuauuaauuugcauauguugaaccagcauugcauccugggaaugaagcugacuugaucguggugaguaagcuuuuugaugugcugcuggauucacuuugccagcguuuuauugaggauuuuugcauuaauguucaucagggauauuggcugaaguuuucuuuuuuuguuucaucucuccuggguuuuggugucagguuguugcuggccucauaaaauaaguuagggagaagucccuccuuuucaauuguugggaauaguuucagaagaagugauacuagcuccucuuuguaccucugguagaauucagcuguaaauccaucugguccugggcuuuuuuugguuaguaugccauuuauuacugccucaauuucagaaccuguauuggucuauuccuggauucagcuucuuccuaguucagucuugggaggguguauguguccaggaauuuauccauuucuucuagauuuucuaguuuauuugcauagagggguuuauaguauucucugaugguaguuuguguuucuguggggucaguggugauguccccuuuaucauuuuuuauugaaucuauuugauucuucucucuuuucuucuuuauuaaucuagcuggcguucuagcuauuuuauuaauuuuuuaaaaaaaccagcuccuggauuaguuuuuuuuuuuuugaaggguuuuuagugucucucucuccuucagcucugcucugaucuugguuacuucuugucuucugcuagcuuugugguuuguuugcucuugguucucuaguucuuuuaguugugauguuagguugucaacuugagaucuuucuaguauuuugauguggucauuuagugcuauaaauuucccucuuaacacugcuuuagcuacaucccagagauucugguacauugucucuuuguuuucauugauuucaaggaacuucuugauuucugccuuaauuucauuauuuacccaggagucauucaggagcaaguuauucaauuuccauguaguugugugguuuugagugaguuucuuaaucuugaguucugauuugauugugcuguugucugagagacuguuaggauuucaguuuuccugcauuugcuuagaaguguuuuacuuccaauuacgugauugauuuuagaguaugugccauguggcaccaagaagaauguauauucuguugucuuuggguggagaguucuacagauaucuaucagguccaguugauccagagcugaguucagguccugaauauccuuguuaauuuucugucuugaugaucuaucuaauauugauggugggguguuaaagucucccacuguuauuauaugggagucuuugucucuuuguaggucucuaagaacuuguuuuaugaaucuugaugcuccuauauuggaugcauauauauuuaggaugguuagcucuuguugauuuaauccuuuuaccauuauguaaugcccuucuuugucuuuuuugaucuuuguugguuuaaagucuguuuugucagaaacuaggauugcaaccucugcuuuuuacugcuuuccauuugcuugguaaauuuuccuccacuccuuuguuuugagcuuaugugugucuuugcccaugagaugggucucuugaauacagcacacugaugggucuugauuguuuaugcagcuagccauucugugucuuuuaauugggacauuuggcccauuuacauuuaagguuaauauuguuauuugugaauuugauucugucaucaugauguuagcuggugguuuugcagacguguugauguagcugcuucauagugucauuggucuuuguauuucaguguauuuuugcaguggcugguaaugguuuuuccuuuucauauuuagucucccuuuaggagcucuugcaaagcaggccugauaguggugaauucucucagcauuugcuuuugugaaaaggauuuuauuuuuccaaacuaagccuaugaagcuuaguuuggcuggacaugaaauucuggguuggaaauuuuuuucuuaauguuguauauugguccccaaucucuuuuagcuuguaggguuucugcugagaagucugcuguuugucugaugggcuucccuuguaggugaccuggccuuucucucuggcugcuuuuaaccuuuuuucuuugaguuuugaccuuggagaaucugaugauuaugugucuugggguugaucuucucauggaguaucuuacugggguucucuggauuuccuggauuugaauguuggucugucuuacuagguuggggaaguucuccuggaugauauccugaaguauauauuccaacuugguuccauuuuccccaucucuuucagguacccuaaucagucauagauuuggucuucuuacauaaucccauaguucucagagguuuucuuuguuccuuuucauuccuuuuucucuaaucuugggaagauagucuucaagcucugaaauucuuuccuccacuuggucucuuuggcuauuuauacuugugguuccauugugaaguucucguguuguguuuuucaguucuauugggucauuauguuucucucuaaacugguuauucugguuaacagcuccugugauguuuuaucaugguucauagcuucuuugcauuggguuugaacaugcuccuucagcucugugaaguuuguuauuacccaccuucugaagccuacuucugucaguucaucuaagcguucgucuaguugagugcccuugcuggagagauguugugaucauuuggaggagaagaggcagucuggcuuuugggguucucaauguuuuuuucguugauucuuucuuaucuucauggguuuauccagcuucgaucuuugaggcugcugaccuuuagauggaauuuuuguggggacuuuuuuguugaugcugcuguuguugcuuucuguuaguuucucuuuuaacaguuagggcugggugugguggcuuacgccuguaaucccagcacuuugggaggccgaggcagguggaucaugagaucaggagaucgagaccauccuggcuaacacagugaaacccugucucuacuaaaaaauacaaaaaauuagcugggcgugguggcaugcgccuguagucccagcuacucaggaggcugaggcaggagaauugcucgaaccugggaggcggagguugcagugagccaagaucgugccacugcacuccagccugggugacagagcaagaccccaucucaaaacaaaacaaaaaaacaggccccucucccguagggcugcugcaguuugcugggggcccguuccagacccugugcguuuggaucccucccacaccuggagaugucaccagagggggcugcagaacagcaaagauggcugccuacuccuuccucugugauuucugucccagaggggcaccgaccugaugccagcaggaaugcuccuauauaaggugucuggcgaccccuguugggggggucucucucagucaggaggcacaagauccaggaccugcuuaaugaaaucguccagcugucccuuggcggaggggaugcacugugcuggggauugucacacuccucuggacuaccuggauuccucagagccagcagggagaaagacuuaagucugcugauccacagagacagcuacugccucuccccgcaggggcugagucccagggagagcagaguuccauuccuaaaccccugcuggaguugcuaaaauuccugcagggaggcccugcccagugaggagggaugggucaggaucuggccugaagaggcagucuggccacagucugccacagccgcuguccuugcuguggagaauuucuccuggguccaaaccguccagucucccuggcaccagcagggaaaaaacggccaacuggagcuacagugcuggcugcugccccuccggagcucagucaucuuaggcagcaggcagcugcagugauggcugcucucccuucccuggggagcuuagucgucuuggacagcaggcagccgcagugaugacgguggccccuuucccugggaauucgguagucuuaggcauucuccaguugagugaccgccaaacaucugcacagcucugcgcuuggcacgcaaggcccugguggcaucggcucaugagggugauauccugaccugacccacggguugcacagaucuguggaaaaaacaugguuuccugggcaggguagcacagucacucacugccucccuuggcugagggugggagcuccccuuucuccauuguggcucccaugugggccauugcaucacccuucuuuuccucacucuccauaggucgcgccaacugccuagucagucccauggagagaaccuggauaucucaaaguugcuggugcaggauucacuggccuuuuuuguucuuggugggagccucuggccacagcgauuucuauuuggccaucuuggcgccugucauugugauuuuuauggacuucugcauaacauauugcugaauaaaauuaucaaauuagacuuguuuaaaaaauuuaagucuuaauuguuuucaucaauuguuggguaaacuuuauguuaaguuuucuuaccaguuagagauacuauauuuauucaacaccaagccauuuuuucuuaguccaaaaaaguguuauugccuuauacuuuugaggaguaaaaaauuguucuuguaaaugagcauguuuguaucuaguuuuuggacaaacuaauuucuuuauuuacuucuagcgaaauaugugccagaaacugggaugugugagauacugagaugaagaaacacuugcccucauggagucuagagucuaguggggaaaaaagacuucaagaugagucaguuuccucauugauaaaauggggguaauaguaccuaucuaccucaugaagguuauugugaggauuaacugaguuaaauuauguaauaaugacuuagaauuuugccagguacauaguaaguguuccauaaauguuggcugcuguuauuauuucugcaaaaucgagauuuguauaaagugcuguggaagugcagacuaagcagggguugacuuucuagaaaguuaggggagugauccaguuuuaaucugcucucaauccuacuucguaguuuccuugugcauaguaaguccucaaaaacuguugaaugaaugaaugaagcaaagaaugagaauauacuuaccuaagugggauuguuaagacagcuucuuuaaacaucuuaaaauagaugucaauaaaauuugaagaugcaauauuacaauuuagcauuuaucuuccaugccugaguuaauucauggauagaauucagaauauuuuuucaaguaaguaaauaauggaagauaguuuaagaaauuaaaaagcuauuacuuucagccagguuuuugaaacaagcuggguuuucagacuguuuguuuguuugcuuauuuauuuauuugagacagagucucacucuaucacccaucuggagugcaguggcacgaucuuggcucacugcaaccucugccuucuagguuaagcaauucuccugucucagccuccucaguagcugggacuacaggcaugugccaccacgccuggcuaauuuuugcauguuuaguagagaugggguuucaccauguuggccaggcuggucacaaacuccugaccucaagugauucgcccaccucaguuucccaaagugcugggauuacaggcgugagccaccacgccuggccucaaacaguuuaaaauauuauuuucuagcagggucuugaaauacaaguaucuuauacuacagacuacagauauuauucauauauuuuggcagugucguguuguuguagaucauuauagcuacaucaguuaccaaugcuguguaauggacuaccccaauguuuauugccuuaaaacaacaauuuaucuuuuuuucaugauucugugguuugaguccaugguucucuuggagaugucaccuagagucauuccuaugggugcacuuagaaggguagcugcacugaacuaaaagaugguagaaugguuuauuccuguauuuggguccuuggugcuugaauguuggcucagagugccucaguucgccuccauguugccucucucuagcaggucauccuggauuacuuuagagcauguuacuaacuucuaagaauggaagccaccaguucuucuaaagacuaguugcagaaguggcagaucauuguuccaauacauuuuacucgugcaacaagucacaagauucaccagcucagauucaagaggaggggaaauggaguccauuuccucauaggaagaaugauaaggaauuuauggccuccuguaauccaccaugguagcauagcaccuuauuaucuuugauuagacauuuguagccuauccuccuuaucugcccuuucucccuuuauaaguuuuauguuuuaucuuuuuucccuuaauuuuccaugaauguuuguaguuugucuucuguuucacugauucagauuucuauucucuugauagaaacuauuucuuucuacgguggauuuuuguucugccuuuguguuguuuuacuuugccuguaugcuuuucuuaucuuuucuaguuuacuagucauguauccuacauuuuagaugccuuuucuugauaucauuuaauuuuaacuuuauguaaucuauuuaaaaauuuuucucagaauauaaauaauaguugcaguaguagaacuaaagguagugucagaaacaguaggguggugccuaccauguuauguuagugacccugugucuuugguuuagggaucuaguggaacaugaccagcuauccccuuuugccugagauacccucagcuuuugaucaucacuacugaguuuuuacauguuuuagugaaacuaugaauuacucaaauguugugauuuaaaauguggaagauaagcuguugauaugcuaguucaaaaagcaauucaaacugcuaugugaccuagaaaaacaccaucuugacucaucuaaagguggaauggccauuaagcugcuauucccaccagaaauggaauuauaagccaaaaacuaucaugaacuuuuccaucauaugagcaagccauaguagaaaccaaguagggucuucugaugacuacaucccuggcuaacauauugucugcaauuucaugacagacccuggugcagaaccaccuagcuaagucacuccuuucccacagaaacuguauaauaaaaccuuauuguauugaaaauacuaauuuuggggguaauuauagcaauagauaauagagauuuugagcagggcacgguggcacacagcuguaaucccagcacuuugggaggcugagguggguggaucacuugagcucaggaguucgagaucagccugggcaagauggugaaaccucaucucuacaacaacaacaacaacaacaacuagcugggugugguggugcacaccuguggucccagcuacuugggagacugaggugggaggaucgcuaucucuaaguucuugagccugggagguggggguugcagugagcuaagauugugcuaaaagugacagaaugagauccugccaaaaaaaaaaaaaagcaauauagauuuugguaucagagugguuuuguuuuguuguaacaaaaauguaguacugucuuuugaauuuggaacuggcuacaagcuugaaggauuuugaaacauuagugaaagcauguagagccuugaguugacuguuaguagaaguuugaguagaaguagaagccuuugagaaggcuuugcucgagggcuuaaaggaaagugagaaaaauauuaacggaaacacgaggaaaggggauccuuguucugugguggcagaaaguuuagcaacucugucaugugcaauaagauggaaaauagaaaaauguaaccuaugaaugaagugaucuagcuaaggagauuucuuaucagaauguugaagaagcuaccugguuucuucuugcuacuuauguauaaaauguaaaaggagagagauaagcaaaaugaaauacuauuaaagaaaaaagagcagggaacuguagggcuugaaaauucccagccucuucguaugaucauugauacuaaaauuaagaaauggguucuagaaaagauccaaucuaggacccucaugggaaaacuugaucuacagaucaagcugaagaugugacuuuaauguccuuuaagaccuuagaaauauccagguguuuugaaguugugacuuuaaaguccuuuaagaucuuagaaagauccaaaguguugccucaaaacaccugcuggauuucagaauugcuaugggucagugacucccacacaccuccuaauuguccuuuguuugaacaggagugcugaucguaguuuugcuaugccuuaugcaucacuggucuugaauuccugacccaacagaaacugugagaucauaaaggcuuauuguuauuuuaaagugcuaaguuuugugguaaucuguuaugcagugauagauagcuaauggagugacaguuaaguugaauuugggaggcugauaagauggcagccuggcaacagaggcagguagugggguugggggagaacauuugaugcagaguaaaaauaagauuugugauuccaaaggucaugaauuguuaggaucaugggaugacuguguaucauuggaagauguaagcucaagaauauucaugaauauguguucuauuaaacauugguaagaagaguuuucugaccaauaauuauuucuaggaacuacaaaauuuuauauguagaaugaggaagaauuuuuuccauuuguuuuauucuuagauuguaaaguuauguuuuuauagcuuauauucucagguuaguuuauuuauauuguaaaaguauuuaaaauaaauguuagauauaauaggguucuauacuuaaucuaaacuaaaucucuucaagauaagccccucuaucaauuuacuaauguuuacagugauuggaaagaagagaauauuacuuucccuuuuaacuuuuuauuuugaagauuuaaaaauauauagaaaagcugaauguauuguguucaugagcacaaaaauauccuuaacauuuugucacauuugcuuuacauauauuuaaaaauuuuauuuugugaccugaucucacucuguugcuuaggcuggaguggaucaaagcuuggugcagccucuaacuccugggcucaagcaauccuccugaaugagccucccagguagcugggacuacaggugugcaccaccaccuggcuaauguuuuaauuuuuaagaguuggggucucacuagauuguccaggcuaaucuugaccuccugggcucaagugauccuccugccuuggccuccaaaaaugcugggaauacaggugugagucacugugcccaguccauauacucuuuaaaauuuuuaauugaaucauuugaauggaagcuguagauaucacuuuaucucuaaguucuucuagcaugaauuuccaagguuaggcuauucauaaucacaguaucauuaacacaacuaagaaaaaucauauuucauaauuaugccuaauaugguaguccauaaaaguuuauaaauuuuuuaaaauccaggguccuuacacuauauuugguuaugucaccugagacuguuuuauucuagaaaauaaaaaucuaacguuauauugcuuucuaugacacugauucuaauuuuuuuuuuauuauguacuuuuuuucuuuuuuuuuuauuuccauaggcguuuggggaacaggugguauuugguuacacaaguaagcucuuuaguggugacuuacgagauuuugguacacccaucacccaagcaauauacacugaacccaauuuugauucuaauuuuuuugaggguuuuauaucacuuguuuugugaauaucccacauucugaauuuguccagcuuuuccucauuguuagauucagguugaaccuuuuuuggugagaauacugcauacaugauacauacuuaaucaagaaggugacugcuggaucucuucacuguaaagauauauuuuucucuuuuuuuuuauacuuuaaguucuaggguacaugugcacaacgugcagguuuguuacauauguauacaugugccauguuggugugcugcacccauuaacucgucauuuacauuagauauaucuccuaaugcuaucccuccccccuccccccaccccacaacaggccccggugugugaugucccccuuccuauguccaaguguucucacuguucaguucccaccuaugccaccuaugagugagaacaugcgauguuugguuuuuugugcuugcgauaguuugcugagaaugaugguuuccagcuucauccaugucccuacaaaggacaugaacucaucauuuuuauggcugcauaguauuccaugguauauauaugccacauuuucuuaauccaaucuaucauuguuggacauuuggguugguuccaggucuuugcuauugugaauagugucgcaauaaacauacgugugcaugugucuuuauagcagcaugauuuauaauccuuuggguauguacccacuaaugggauggcugggucaaaugguauuucuaguucuagaucccugaggaaucgccacacugucuuccacaaugguugaaccaguuuacagugccaccaacaguguaaaaguguuauuucuccacuuccucuccagcaccuguuguuuccugacuuuuuaaugaucgccauucuaacuggugugagaugguaucacauugugauuuugauuugcauuucucugauggccagugaugaugagcauuuuuucaugugucucuuggcugcauaaaugucuucuuuugagaagugucuguucauauccuucacccacuuguugaugggguuguuuguuuuuuucuuguaaauuuguuugaguucuuuguagauucuggauauuaacccuuugucagaugaguagauugcaaaaauuuucugccauucuguagguuggcuguucacucugaugguaguuucuuuugcugugcagaagcucuuuaguuuaauuagaucccauuuguuaauuuuggcuuuuguugccauugcuuuugguguuuuagacaugaaguccuugcccgugccuauguccugaaugguauugcccagguuuucuucuaggguuuuuaugguuuuaggucuaacauuuaagucuuuaauccaucuugaauuaauuuuuguauaagauguaaggaagggauccaguuucagcuuucuacauaugguuagccaguuuucccagcaccauuuauuaaauagggaauccuuuccccauugcuuguuuuugucagguuugucaaagaucagaugguuguagacgugugguauuauuucugagggcucuguucuguuccauuggucuguaucucuguuuugguaccaguaccaugcuguuuugguuacuguagccuuguaguauaauuugaagacagguaguaugaugccuccagcuuuuuucuuuuggcuuaggauugacuuggcaaugcaggcucuuuuuugguuccauauguacuuuaaaguaguuuuuuccaauucuguaaagaaagucauugguagcuugauggggauggcauugaaucuauaaauuaccuugggcaguauggccauuuucacaauauugauucuuccuauccaugagcauggaauguucuuccauuuguuuguauucucucuuauuucguugagcagugguuuguaguucuccuugaaggagguccuucacaucccuuguaaguuggauuccuagguauuuuauucucuuugaagcaaucgugaaugggaguucacucauaauuuggcuguuugucuauuauugguauauaagaaugcuugugauuuuggcacauggauuuuguauccugagacuuugcugaaguuacuuaucagcuuaaggagguuuugggcugagaccaugggguuuucuagauauacaaucaugucaucugcaaauagggacaauuugacuuccucuuuuccuaacugaauacccuuuauuucuuucuccugccugauugccccggcuagaacuuccaacacuauguugaauaggaguggugagagagggcaucccugucuugugccaguuuucaaagggaaugcuuccaguuuuugcccauucaguaugauauuggcuguggguuucucauaaauagcucuuauuauuuugagauacgucccaucaauaccuaauuuauugagaguuuuuagcaugaagggcuguugaauuuuaucaaaggccuuuucugcaucuauugagauaaucaugguuuuugucguuguucuguuuauaugcuggauuacuuuauugauuugcauauguugaaccagccuugcaucccagggaugaagcccacuugaucaugguggauaagcuuuuuaaugugcugcuggauuugguuugccaguauuuuauugaggauuuuugcaucgauguucaucagggauguuggucuaaaauucucuuuuuuuuguugugucucugccaggcuuugguaucaggaugaugcuggccucauaaaaugaguuagggaggauucccucuuuuucuauugauugggauaguuucagaagaaauggugccagcucuuccuuguaccucugguagaauucggcugugaauccgucugguccuggacuuuuuuugguugguaagcuauuaauuauugccucaauuucagagccuguuauugguccuuucagagauucaacuucuuccugguuuagucuugggggaguguaugugucgaggaauuuauccguuucuucuagauuuucuaguuuauuugcauagagguguuuauaguauucucugauaguaguuuguauuucugugagaucgguggugauaucuccuuuaucauguuuuauugugucuauuugauucuucucucuuuucuucuuuauuagucuugcuaguggucuaacaauuuuguugaucuuuucaaaaaaccaucuccuggauucacugauuuuuugaaggguuuuuuaugucucuaucuccuucaguucugcucucaucuuaguuauuuuguugccuucugcuagcuuuugaauguguuugcucuugcuucucuaguucuuuuaauugugaugucaguuuuggaucuuuccugcuuucucuugugggcauuuagugcuauaaauuucccucuacacgcugcuuugaaugugucccagagauucugguauguugugucuuuguucucuugguuucaaagaacaucuuuauuucugccuucauuucguuauguacccaguagucauucaggagcagguuguucaguuuccauguaguugugugauuuugagugaguuucuuaauccugaguucuaguuugguugcacuguggucugagaaacaguuuguuauaauuucuguucuuuuacauuugcugaggagugcuuuacuuccaaguauguggucaauuuuggaauaaguguaguguggugcugagaagaauguauaaucuguugauuugggguggagaguucucuagaugucuauuaggucugcuuggugcagcgcugaguuuaauuccuggauauccuuguuaacuuucugucuuguugaucugucuaauguugacagugggguguuaaacucucccauuauuauugugugggagucuaagucucuuuguaggucucuaaggucuugcuuuaugaaugugggugcuccuguauugggugcauauauauuuaggauaguuagcucuucuuguugaauugaucccuuuaccauuauguaauggccuuguuugucucuuuugaucuuuauugguuuaaagucuguuuuaucagagacuaggauugcagcccuugccuuuuuuuuguuuuccauuugcuugguagaucuuccuccaucccuuuauuuugagccuaugugugucuccgcacaugagauggguuuccugaauacagcacacugaugggucuugacuguuuauccaauuugccagucugugucuuuuaauuggagcauuuagcccauuuacauuuaagguuaauauuguugugugugaauuugauccugucauuaugauguuagcugguuauuuugcucguuaguugauacaguuucuuccuagcauugauggucuuuacaauuuggcauguuuuugcaguggcugguacugguuguuccuuuccauguuuagcgccuccuucaggagcucuuuuagggcagaccugguggugacaaaaucucucagcauuuacuugucuguaaaguauuuuauuucuccuucacuuacgaagcuuaguuuggcuggaugugaaauucuggauugaaaauucuuuucuuuaaguauguugaauauuggcccccacacucuucuggcuuacagaguuucugccgagagaucagcuguuagucugaugggcuucccuuuuguggguaacccgaccuuucucucuggcugcccuuaacauuuuucccuucauuucaacuuuggcgaaucugacaauuaugugucuuggaguugcucuucuugaggaguaucuuuguggcguuuucuguauuuccugaaucugaauguuggccugccuugcuggauuggggaaguucuccuggauaauauccuguagaguguuuuccaacuugguuccauucucccugucacuuucaggugcaccaaucagacguagauuuggucuuuucacauagucccauauuucuuggaagcuuuguucauuucuuuuuauucuuuuuucucuaaacuucucuucucgcuucauuucauucauuugaucuuccaucacugauacccuuucuuccaguugaucgaaucggcuacugaagcuugugcauucgucacguaguucucgugccaugguuuucagcuccaucagguccuuuaaggacuucucugcauugguuauucuaguuagccauucaucuaaucuuuuuucaagguuuuuaacuucuuuguguuggguuccaacuuccuccuuuagcucugagaaguuugauugucugaagccuucugcucucaacucgucaaagucauccuccuuccagcuuuguuccguuccuggugaggagcugcguuccuuuggaggaggagaggugcucugauuuuuagaauuuucaguuuuucugcucuuuuuuuccuaucuuugugguuuuaucugccuuuggucuuugaugauggugacguacagauggguuuuugguguggaugucuuucuauuuguuaguuuuccuucuaacagucaggacccucagcugcaggucuguuggaguuugcuggagguccacuucagacacuguuugccuggguaucauuagcagaggcugcagaacagcaaauauuggugaacagcaaauguugcugccugauuguuccucuggaaguuucgucucagaggggugcccggccgugugaggugucagucugccccuacuggggguugccucccaguuaggcuacucgggggucagggacccacuugaggaggcagucugucuguucucagaucucaagcucugugcugggagaaccacuacugucuuccaagcugucagacagggacauuuaagucugcagaggucucugcugccuuuuguuuggcuaugccuugcccccagagguggagucuacagaggcaggcaggucuccuuuaguuguggugggcuccacccaguucgagcuucccggcugcuuuguuuaccuacucaagccucagcaauggcgggcgccccucccucagccuugcugccgcguugcaguuugaucucagacugcugugcuagcaacgagcgaggcucugugggcauaggacccuccgagccaggcaugggauauaaucuccuggugugccguuugcuaaguccguuggaaaagcgcaguauuagggugggagugacccgauuuuccaggugcuguuugucaccccuucacuuggcuaggaaagggaauucccugacgccuugugcuucccgggugaggugaugccucacccugcuuuggcucacgcuuggugcacugcacccccuguccugcacccacuguccgacaauccccauugagaugaaccugguaccucauuuggaaaugcagaaaucacccgucuucugugucgcucacacugggaucuguagacuguagcuuuuccuauucggccaucuuggaacugcucccuauuuuucucauuuauaaaucugugggaugauuguucccaauagccuuuuaccuccauugaugauauugccugaaucaguuuuuacguuaugaauuauagggaaauugcuuuuuaauggccauauguaauccauauuugagauccauauuugcaaggaaagaugcauuacuaccacugaaagaacccacucuugccuuuucuuuuuaaaaguuaauauauuauuuggaucauggauuugaagguauuugaguuccauguaugcauauuuuccuuaaugaguaauuuugaaaaacugauuuaauuuaaaacaauaaguuaaugacagaucucucagauaguuuuagaacuccuaacaaugagacacaucaaauagcuaugugauauuuauugagacccuacuaagguacaaggaaucacacuagauaauacaauguacuuaacauuaaaaguuguagucugaaaguacuuacccauuuaagaagauaagacacauaugcauguaaagauggaaguauauuuguggcaggaaaccaaaaugcuaaaugacugguguagucaguuaaugcuuuugguauucacaaagcuagcacuuucaacuuugaugcuugcaaagcacugcagguauaugaagugucuugauuaugcuucugacauucugaacugggaccuuucaaguguuuuuuuuccccuaauaaauacuuaccaaguacaugccuaucauguuauagcaacuaaagaaacaaaaagaauaaaacgugcuccuugcaccuggacauaguuauugggugagaugaaaaacauagcaaccuaaaaucauuuaaaaagugcuauaguaaagguaucuacuuagugccaugguucuauagaagggagaacuaggaagucauguucauugggugauggguguguggcaggaaaggcuucacagaggaaggggcauuugagacugauaggaauuuuuuugggugagaagggaagaaggguguucuaggcaauagaaaauaggaagcaugcugaggagugugugugugcaugccaugguuuuagggaagacaagugaugccauuuucagaaaauuugggaguaguccuaauuugggaaggaaaaugguuauucacccuuuuguauguguguuguaauuuugccuuauauuggagaacaacacaguuuuaaugauagauauaauuuuucagagaaagcauauggaaaaugaacauugaagaauggacugaagaaugaauaugagaaacacacacuuuacuaacagggaaugagaggaaaaggagaccucuuuagagaaguccaacagcaagagagcuaaaauggauuauaaugucauugaaccaaugggcaagauuuuacaagaggauagugaaauaacgccacauacagcggugugcaugaggaaaugaaauuaaaggggccauuggauuugacaauaaaagaaauaucaugaauucaguuucagggauuugaggggagggaggaagcuagacuuuuggggaauaagggaagagugaugcuuaaauaccagauuuaaaccauucauuugaaaaaucugucagugaaaaguaggagagcaauaaagugagcagcuugguuaagugaaauauuuuuuuuaaguuagagaaaauuuuuguauaugugauggcagaggggaacgugcuagugugguaggaaauacuauagcuggcagagaaagaauaagauggagugaagguugggaggagaugagaacauaggugaugggguuaaucuuugaaaggaggagaggcaaacucccaguugguccagagggaaggugagcaugagggaugagcagagggaaggaagaauuacugaggaacagaagaggaaaaaagagggaauuucucugugaugguugugauguucucugugaauuuggagaaggcagaaucaucacgguuuuagaacuuccucuucuauuuauguaucccgggagugugaaugaagaaaucucugcccaccuaacauaaccuauaguuggugagugguauggcagaaguuugaaaagccaagggaguaaaguugugguauguucuaccauuagaaaaauguuaauacaaacaaaauaucaggcaauguaacacucuaauacuauuuaaaaaugcaguuauuguacagcaugaugacuacaguuaauguauauuauauucuuuuuuguuuguuuuuuuuuuuugagauggagucuugcucugucacccaggcuggagugcaguggugcgaucucagcucacuacaagcuccaccucccagguucacgccguucuccugccucagccuccugaguagcugggacuacaggugccugccaccacgcccggcuaauuuuuuguauuuuuuaguagagacaggguuucacuguguuagccaggauggucucgaucuucugaccucgugauccauccgccucggccucccaaagugcugggauuacaggcgugagccaccgcauccggccauguauauuguauucuugaaaaaugcagauauaguggauauuaaguguucucaccacaaaaaugauaacuaugugagguaaugcauuuguuagcuagauuuaacuauucuacaauguguauauacuucaaaauaucauguuguaugugguaaauaagugcaauuauugcuaauacauaaagauuuagaauaaccuuauuuaggaacacuaaauguauuacuaguuuaauuuuaaaaguuuuguuacaguaauuuaaaaguauauuuuagauagacaaaaugauuaauugaccuaauuuuaaaauguuucaaauuuugcaguguaguguuauuuuuuaacugagggcuucucucugagacuagucaguacuauuaaaaauuuaagcagcacaaauccaacucaagcagucaagcaaaaaauuaaaagacaguggauauguuagauuaaguaaaugggaguccaagauggacugaucucaggcaugcguggaucuagaacccugaugaugaugucaagggucuucuucugcugugugggcuggcucuguuuccaccugccauggcuucauucucaagcaggcuucuguugugugcuuauagccucagggcaacgucaucacggcucacugucugaaaggaagauagacuccuucucaccaguuauaugguaaauuucagaggugacucuguguuccuccuuaugucaguuuuucaucccuuaauguaucacgguagccaggagucagggggauggcaaacuugauugucuggauccuggguuaugugcucauuucuugaaggaggucacugugguuaugaguugucggggaguaguggcuuuuaacauuuuuggcacauuuccuuucagucuuauguguguguguguguguguguguguguguguguguguguguguguguacauguacgucuuuguucuguaacaaaccaaguugucaaaugaaagccuuguguugaaaucacauuccuuaggaaggaauuagucuuugauugcuuauauaagugagucuucacaacuuuuuuaguuuauguuuucauaaagaugcaguggaagccuuuucuuuuuuauaaguaaaaguguuuuucauguacauaaccuaauauuuuuaaguccuucacaaaaaugaaguaacucuauguggauaacuucaguaguaacaaaaagaaacaaaacaaccauccugucccccacuugccccaccaaccuggauuucuccuugggauuaugaaagcaguaugauggaagagaagguacagcuggcuuuggaggcagauagaucuggacuuuuaauguuguugggaggauuugagauaauuacauagaauccuuaauauaguagugcuaggcucauaauaggugcuugauaagugauaacuguuauuauaauuuuuuaaaaaaaauuauugagacagggucucacucugucacccagguuggagugcgaucauagcgcacugcaaccuugaacuccugggcucaggacauccuccugccacagccucccuaguagcuggaacuacagguguaugcaaccaugccugcuaauuuuuaauuuuuuuguagagauggggucuugcuguguugcccaggugggucuuaaacuccuggccucaagcgauccucccaucuuggcuucugaaagugccaggauuaugggcaugagccacugugccuggccuguuaaaauucuuacugauaagcauugacuuuuuuguuuugcugaaaagcacuggaugugaaugaaguccuggguuuuaguccuaacucuuuugguaaccaacuguaugcaaccaaaauauaaaacuacuugacacacugggccuuuguuuucuugccuguaaaaauaaauggauggauuagaaauuuugucuagcucuaaauuucuacuauuuaauagaguaauuuggguuacacaaaaauauaaaauagaaggaauccuaguauacuguaggaaaauuaaugaucuugguuuugauguaaaaccaagaguuccagcuucucuucccaaacuugcuaaacuuuaagaacaacaauaaugacuggaaaguuuacaguaaaaaugcaucuuauuuauguucaauaaaauuuuguuuugauuagugucccuaaagucucuucuagcuccaauauuugauauuuccuuuccaauaaauucuagccaggaauauuacuuuaaauuauaaauguauagcuauuuucgucacagcugccugucaugguuucguuugcuaccaugucauguagcguagaggggucauauggaacuuuuuguaacagaauuugacucuaccuuaccaguaguuaggcuuaauaguguauuguguuggaguauaccugaggaaagagaaauuaagccagcaaaaaaguauacaaacuuacaaaaaggaaaauucugaccaggcauuuggaaaugagcugcggccuuuggggucuguuaagauuccuacagucaagccggguauuauuuaagaugauugugaaaaccaaaggaaauaauguaugcaaacuuuuuaguguaguauuuuccauauauauuagcccccacuauuguuuuuauccuauaggaauauuuuuccucauaacagauuucaggaacuaacauaagaucagaaagaauaaaauuguaguuugggguuucgguuggccuucuucaguuuuuggauauaagauuccaguagcauccauauaaaaauugcauuagauuuuccauuggauauuugcuguugacuaaauguggcucgauaauuuuugcaggucacuacuauaagacuagugcuucagcuuuuuugaaauaguagauuaaauugguaaauaugcaaaacugcccuugguuuuuugaugcucccuucugcagguucugcuuuauggcuaucaugaucugaauuuguuucuuuauuucuaaguagcucuucuugaacucuguuucaaagaguuucccuaaccucagaauucucacaccuggcugauuggccucuagggaguauucagaaggcagucuuugugcuauuauacuuuuuuguuggcuggauaaacaucaguaguguuuaaaugaaauaauaacccugaaaagauuuuuauuaccgucuuuaaaacuuuauccauggcauggcaaguccuguuucauugaacauuuacauaugaaauacauggguugauggaauuauuaggucaaaaauggcuuuuaaugguuuuuaaguagugaacaagaaaauuugaauuaucuuuuuuucuuuuaaggauuucauucuuuguuacaaucuccauaucucucauaguucagagauaauagaaauuguuuuuaauauucauucauucauucaagaaauguuuauuuaauacucauuaugggauaggcccugaggaauaacauagauaacauaccuuauauuuuaaaaagcuaguagcucauuuuaauuucauuucagaauaacuuuguagcugcaaaauaagacuaguuuaagcuauaaagucaauuagcacaccagugaguuuuggguaggcuagaugguaaacuucaucuuuccaacauacuuagcuuuauuuaacuugauguuucugaaguguuuugaccuauucagccaucaccccuacugaacccacuuucagaaauaauaguuaaguauuugcuagguuuucauuaacuggaacugaacauuauuagguuaauuauaugauauuuauagggcagaaauggugcauaucauuguauuuuauggcuuauccuaacuaguugggugauacugucuuaauuugccuaagguaguucugguuuacucuugucgcuccagugugauuauuauacauaaucucucuuuuuuuuuuuuccucgagacugagucucacucugucgcugggcuggagugcaauggcgcgaucuuggcucacugcaaccucugccuuguggguucaagcaauucuccugccucagccucccgaguagcugggacuacaggugugcgccaccacacccagcuaauguuuguauuuuuaguagagacgggguuucaccauguuggccaggauggucuugaucucuugaccucgugauccgcccaccuuggccuaccaaagugcuggcauuacaggcgugagccacugcaccuggcccauaaucucuuccuuaaaucuuagaagugcccugggugaauuauauggcccucuuauagcuaacacucuuaguuagaaaacauauuaugugccaggcagcauuguaagcauuugauauauauuaacugaggccucacaacagcccuguaagguuggcacugcuuuauccuugauuugcagaugaguagacugagguacagaaaaguuaaguaacuugucuaagguuguacaccuagcaaguaguagggucaggauucaaacacaagcacauuugguccuggaagguauacuccuaaacagugugcuuuucugguacagaugagauugcucaaugaacauguuuaagagaaggaugagaggauagcacucuggagaauacugacauuuaaaagcaaguaaaggaaauagaaacuuggaaauaagacagagaauaagagcuaaaaaaaaaggaacuuuaaguuauagacagaauucaguuacuuggauccccccacuccccaagaauugucuucauccuuuuuuaacuagaaagaaauauuuuucuuuucacuauuuaauaagugccccaaagugcuagauaguuuuccuuugaaauauaguaaaagagcauuuauugaaagcagcuuguuuaugugugcuuuguuuaaaaauuagagacauuuuauuuuuucuuaaguaacagaaaucagacuuucaaaaaagcucuuuaaaccuagacuaacuuauuuaugacaauuuugucauauauuugaaaguuaauuuuaggaaaauuacagagccuuuuaaccacccuauggccagacuucaguguuguucuuuuuauuucuaccucauuucauguugagucuuaacuucgcugucucucuuuaucauccccuaccccuagucugaauguugaagaaugcuaaaguauauuuuauugcuucauugacuaaaacuauguuucuaaaacuaugaauuugcuuaaugagucagcaacuguaacuauaauuaacaguauaguuuuuacaaccauaguuuugugguaaaugugcaguucucagaauuuaaauguaaacguucaaugaaauuaaacaaaacccaaaucuucaugcaauagguaguauauauguauucaguaagggucaccaaacauuaauugagguucuauuaugguuaacuuuucuacuuuguacuuagggauaaaaagaugaguaaaauuguuuccugcauuuuuccccacccauucccuccccauuuucuuucuuuccuaccuuccacagccccauugagugucuacuuaaugugccaagcacacaguauauaaagauauaaagagcucaaggauguaaagauaaaugaggaucuagugccugcccuaguucaguuaucccuuaggaagacagaccaguccuaugucagucagcucagaaaagugcaauaacuguugaagccagggccacacccagucuugucuggguucacuaccccacuuuccacucauacuuuagcgaugaacagaauuuaagucaucuaaaaggaggagcaagauuaaaacagugaaggagguaugaugaguaacagaaaggagcucauuggugacuaaugaaagagcaacugcuguguuaagggguugaugaccauauucgccaguguggaguugaagguuaaggagugaaugggaaaugagaaaguagacuucaaaaaagcuggauguuguggagaggaauagagaaaauuagagguugaacauguaguaagagugagugaauauuuuuuagaauggggagauaaguguguuuguuugcugucuaggagugagcuauagaauuguccaggugagauggaaagauaacagagagaagauaugagaacaaaauccuguaggaaauuagauaauaucaagaacauaaauagaaggccuggcacaaagucucaugccuaugaucccagcacuuugggaggcugaggcaggcagauugcuugagcccaggaguuugagaccagccuguaacauagcgagaccacaucucuacaaaacaaaaaaaaaaaaaaaaaaaaaaaauuaaaaauuagccagguguaguggugcaugccuguagucccagcuaugugggagaucaggaggcugaggugggaggaucgcuugaguccaggaggucaggcugcagugagcaguggucaugccacugcagcacuccagucugggugacacagugagacccugucuuaaaaaaaaaaaaaaaaaaaagggccuggcacaguggcucacgccuguaaucccagcacuuugggaggccuguaaucccagcacuuugggaggccgaggcaggcggaucacgaggucaggagaucgagaccauccuggcuaacauggugaaaccccgucucuacuaaaaauacagaaaauuagacgggugugguggugggcgccuguagucccagcuacuugggaggcugaggcagaagaauggcaugagcccaggagguggagcuuuuagugagccgagaucacaccacugcacuccagccugggugacagagugagacuccaucucaaaaaaaaaaaaagaaaaacuguuuuuugguuuuuuuuuuuguuauccuaacuuuugaauuacuucauaaagaaguuuagugaucuauuugauuauguagaagcucuucugauaguuauacaugcuuaaucauuuaagaauaauuaaaggaacuauauugucauguuaucaggcauuccuuuaugaaaauguuagaaacuccucuuucaucuauaccuuccccacuguuuaacccuccaaucaaaagcacauauucugugguaagaacagagaauaucuauuuuaaaggucauuugugucaaauuguccuaacuagcuguugggauugggaggugcuauuugggucauaaauagcaaguuuucucucccaauaaagcaaugucugagaaucccaagauucucauuuaguagaucuggguugagaccuagaagacaguuaauucauuuagccaccaaauguguauugagugucuuccuauuauauauuuauuaccauauuguguagguaguguuagaagacaucccaggugccuacucuguaacuggcggagagauaauaaacaaacaggauaauuuuauauagugcuaaguucugugaagaaaguauaccaugauaugugccagauaauuaccuggcaggggaaaggagagagagagcuuugcauagagugaucuugggaggugucuuuugaagagauaacucuuauuuuuuaucuugcuuuuuuuuuuaaaaaaguauuuuuuagguuguaguaaaauauauauaacauaaaauuuaccauuuuaaccauuuguaagugcacguuucagcgacaucaaguacaugcacauuguuuugcaaccauucaccaccaucugccuccagaacuuuuuucauguugugaaacugaaacucugcagccauuaaacaguaauuuuuuauuuucucucuccucucagccccuaacaacaaccauucuuucugccuucuuaaauuugacugcuuuagugccucauguaaguggaucguacaguauuugugugacuggcuuauuucacuuagcguaguguuuuccagguucauccaugcuguggcacauguccgcaucuccuuccuucuuaaggcuaaauaacacuccauaauauggauguaccacauuuugucuguccaccuuugaacugagaucugaaaaaugagaaggggccaugcaagaacuagaagaagaacguuacaagcagaggaaagaacaugugcaaaggcccugagauagcaauaaacugguugguggucuaggccaguguugucagaauauauuaauaguagagaaaagugccuggaaagaaugguauuaaaugggaucagagauagacauacauuggccguauuauuuuaggcuuugaaagaccuuggcuuuuaaguggagugagaagcugcuuauuaggaaguuuuaagugggggagugacuuaaucugauuuccauguaacagcaaaagcaaaaaucacccagacugcuguguggacaagcauccuuguggauucuaaugcaagucugugaucggacuuugagaaauacuaauuuaguccuuaagucaguauccugagauagcugauuucaaaagagcucucucagggcuucugaccaaaagugacagauuggcuacaccuguacaucucuucuuauuuccuaaucccugccuaaauggaagaaagaaaucagagacugggagagguuacaacaggagacagaagcugcuauaccucuuucaaauaagcagauggacagguagugacugacuuugcagaggaaucacacaguaccuguaagugcacaaaaauaccuguaagaaaugcaguacuguguuuguccgaagcucccaagagucucagcauuuggaggcaccagauacuaaggaagauaggggucagaaauggagcugaaaacaggggagcuggucggaaaaucuguguacacugacagguggaccccuacgauuuucucccuaugugcccuuguggaugggugagucccuucacuaccaacucccuggccucaggagaacaagguuuauucuuugcaaaauuaaugaagagcugucuggacuuugaaaccaggggccguggauuguugcuugguuuaaaacaaggagaucggccgggcgcgguggcucacgccuguaaucccagcacuuugggaggccgaggcggguggaucacgaggucaggagaucgagaccaucccggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaccaaaaaaaaaaaacaaaaaaaaaaaacaaggagaucaagggaaaccuacgccugaacuauagaaguguuagcucucuuccucugcucuccuuccagaacugcacagucaagccuguccuauccuucuccuguggaagacugaagauaacagcaucuucagauacugauaggcuuucugcugagaguaccuuaagugaauucuaccagucguuaagcccuguuuucccacacagaucuuucaguuaguucuuuucaggggcuuauucuuaaauaugagcaaacaaucuaacaccauuggucaucugggggaagacuccaacauuaaaaaaaaaaaaaaguagacauagagagguggagagggagugauacuuggaacacugggagaaaacagauaccauaagggaucaaaagaaaacuuuaaaaaucuccaguauuaucagagaagacauguauuuccuuccccacuuaaaugauagugaacacauauaaaagcagaaauccaugaggguaaagagaacgagaugagagaugacagcaggcaaacaacgucaacuaaauauuggaagcugagaaccuggugcgugagugguaacagaauuuagcagagcugagaaagcagaaaguccuaugguguggguaguugugcaaaaacugguauucuuuuaauuaaugaugugcuuugcucuauuuggacugcuggguucuuauuuuugagcaguaugcucucucccaguugaagcuguuaaugggcuguccaccaauggagaaaucagaaugauuaaaauguaguucuuguauuuuuaugguucucuuaagcagucaugcauuauacucuucuucuugugucugagccaacauuucauaggaguagauaacacccauuucugguggcacugacagcaggguugaaaagaauguuauaaaagaaaauaugaauaacauuuaacuuaagaauauguuccaaauuuuguuuguaaaguaguuguuuaaaacuugguaguucuuuuugauauaauguuauaaauggcaguuauccuagaccaaacuuuaaaauauguuucauuagcaauuaaaugggcauuuguaaguucccagggaaaccuaaucacauuguauaguauuuuuuaaugaagaaacacuagcuggguacaguggcuuaugccuguaaucccagcacuuugggaggccaagguagaugaauagcuugaguccagaaguuugagaccagccugggcaacauggugaaaccucaucucuacaaaaaauacagaaaaauuaggugggcaugguggcuugcgccuguagucccagcuaauugggaggcugaagcgagaggaucaccuacgccugggagguugaggcugcagugagcugagccaugaucgugcuacugcacuguacccugggugacagaaugagacccugucucaaaaaaagaaaaaaugcuuuuuaaugguaaaauggcuacauggauuuagauuuagacuugaauucaaguccuacuucuaccauuuuucugcuauguaaccauaaguaaauuucuaauguuucugggucucaguagaaugagaauaauaucuaaucagaggguaguugugaugauuaauggauguuaaaguagaugagcuacucagucgagcuccuagacccuagggagucaauaaauagucgguuuucuucacccuuuuuuuuuuuuuuugagacaguuuugcucuguuguugaggcuggagugcagagugcaguggugcgauuauagcucacugcagccuugaucuccugggcucaaaggauccucccuucuaagccuccugaggagcuagggcuacaggugugcaccauugugucuggcuaauuuuauuuuuuuauagauacaggguuucacuguguugcccaggcuggucuugaaccccuggccucaagagauccucucacuucagccucccauagcaugugggauuauaggugugagcuacugugcccagcuguuguuuucaguuuuacucuucugugguaugugguaagagggagcauuuguuuucuagagccugcagcaugugugggucaguugaaaauguauaaaaauuuugaguuacgcacgguggcuugugccuguaaucccaauacuuugggaggcugaggagggaggacugcuugugccaggaguuuaagacuagccugggcaacauagugagacccugucccuaaaaauauguaaaaaaaauuuuaaaauaaaaauuuugaaaugcaauuugugucuuaaaauucugccuuauuuauuugcaacguguguuucuugucauguauuugcugcuguaugcugguagaaaaagcauagagaguggacucaggcaguccaugcucuagccuccuguucuacucugaacuagaugugugacauuguaagugcugcugcuucacuucggguguuacuccugauuugcacagugaaaaguguuuuauuacaagaugauuucuagaaguuuguuucuguucugacauuagaugaccugugauaugugaagcuuaagacaucuuuuuucauuacuggguuuauacgggguguugaggcuugugauacauuuacuguuauaaauucauuuuaauguguuuggaggacuugagaugauuggagauuauuagauugauagcugauguuuggcuuuauuauuggaaaauaguucuagcuacgaaaccuguuuuugagugaaaguaugcuaggaauggccauugcuuuucuuccuacagagauaagugaucucuugguguuguacacaugaagcucucaccuuuauuuuuaaagucauggauuuuaccuuggcuccuauaaacucuucuccccucccccauguagcuguaagcauuccuacuccuaggaugauuuggaauguguguguuucaaaucauguuuagugauuguaaggcuaaucucagcuuaauuaucacugccaaaggaauccucugacccccagggccagaucauguuguuugcuuucaugguauauuuuucccuuuucauaguccggguuauauauauagauguauaauuccauaauaucuugucagcaaaacuggaagcucugggagggcagugacuguaucucuuuugcugacuuuuaucuauaaugucgggcacaugauuggcagcauuggagacauauuuuugaguuaagugaauaaauuguuuccccacaaauaauaaauuaauagaaauuuaaugguaaaagcucaaaauguuuauuagaaucaugaugguagccuuuguuauuaccagugaauuuaaaaggaaagaauaaccaagguguuuguauaaaugacuuauuauuguuugugcaagaacagugaacguucccuaguacaggaagcagcuuuaaaaaacugcuggcagaacuaagaagucagacuguccuugaccccuagaucaaauguuuuugagccugaguuuccuuaaaucuucuucaguugagaauaaacauuuugacaaaauagaagauuuauucuguuaauuuuuggucuucauaaaccuaacuaaauuugcuaaaacaacaaaaacuuucuaauuuuuacuaguuuuguuuuuuaaaaaguuuguuuccuuuuaagugcauaacacuuuaaaaugagcucagcuguauuagcagauaaacauguugauucauuugguccagagcuacugaaugaagcuugcaggagcacaguuuguucuuuaugccgcccaggggcagaauguuucucuuccucuccuccuuauugagagaaggggacuggaauaagugacuccucuuauuuagguuugccugaauuguugacgagggaagggggcaagauuucuucaccauuuauccuucgucucauuuaaauucuguucauuaacauaaaguauaugcacucauacugugauauacauguugaauuauuagugucauauauuuacaguuuuuacaaaaccauuuuacuuaaugcucugguuugaguaaucuguuguuuaaagguauaaugaaucagaguuguuuuuaggcguauugcguuuuugaggauggacuuaauuuuggaagcaaagagaaguauguucuauccaguggaguggaguugagauaauagguaugcaguucgccucucauacccauuguggguucugcaucugugguucuaucaacugugugucaaaaauacuugagaaaaaaaaaaaagaaugguuacguucauacugaacaugcauagacuuuuuccccuuauuuuccccuaaacaauacagugugacuauuuauauaguaucuacauuguauuagguguuuuaaauaaucuagagaugauuuaaaguacaggccuagcuuguuuuauugcacuuugcuaauacugcauuucuuacaaauugaagauuuguggcaaccuugagucgagccagucuaucagugccauuuuuccaagagcaugugcuuauguugugccucugugucacauuuuggguaauucuugcaguauuucaacuuuuucguuauuauuauaccgguuauggugaccuaugaucagugaucuuugauguuacuguuguaauuguuuuggggcaccacgaaccauuacccaugugaggugaugaacuuaauaaauguguauguucuuaaugauccagcaacuggcuguaccccugucucucucacuccugagacacaacaauauugaaauuaguccagucaguaacccuaaaauggccucuacauguucaagugaaaggaacaaucacacgucucucuggaaaugaaaagcuagaaaugaugaagcauagugaggaagcuauguugaaagccaagacaggcaaaaagcuaguccucuugagccaagugaaugcaaagggaaauuucuugaaggaaaugaaaagugcuauuccagugaacccaugaaugauaagaaagcgaaacagccguauugcugauaaggagaaaguuugaguggucuggguagaucaaaccagccacaacauuucccuaaaccaaagccuaauccagaggcaggcccuaacucucuuuaauucuaugaagagagaugagaaagcugcagaagaaaaguuagaagcuaacagagguugauucaugagguuuaaggaaagaagccgucuccguaacauaaaaaugcaaagugaagcaaucaauguugauguagaagcugcaacaauuuauccagaagaucuagcgaagaucauugaugaaggugguuacacuaaacaauagauuuucaguguagacaaaacacucuucuauuuggugaagaagauguuauccaggacuucauagcuagagagagaagucaaugccugccuucaaagcuucaaaggacagugacuuucuuggucguagcuaaugcagcuggugacuuuaaguugaagucagugcuccuuuaccauuccaaaaauccuaggacccuuaagaauuaugguaaaucuguauucugccugugcucuaucaguggaaaaagagagccuggaagccagcacaucuguucauagcaugguuuacuauuuuaagcuuacuguggagaccuacugcucagaaagauuccuuucaaaauauuacugcucauugacaguggaccuggucacccaagagcucugauagagauggacaaggagaugaauguuguuuucaugccugcuaacacaacauuuauucugcagcccagguaucaaggacuaauuucaacuuucaagucuuauuauuuaagaaauacauuuucuaaggguauggcugcugccauagguagcaauuccucugauggcccugagcaaagucagugaaaaacuuuccggaaaggacucaccauucuagaugccauuaagaacauucaugaaucaugggaggaggucagaauaucagcauuaacaagaguuuggaaaaaguugaauuucaacccucauggaugacuuugagggauucaagacuucaaagaagaaaguaacugcagaugugguagaaauagcaagagaacuagaauuagcaguggagccugaagauggaacugaauuguugcaguauuaugauaaaacauuaauggaugaggaguugcuguuuuuuaucuguuuauuaaaaagauuuuuuuaaagacaaagucucauucuguuaggcuggagcagaauacaguggcacgauccuagcucacugcagccuugaacucccuggcuaaagcgauccucccuucucagccuucuaaguagcuaggaccacagucacacaccacugugccuggcuaauuuuuuaaaaaaauuaucuuuuguacagacagggucuugcuuucuugcccaggcuguuuucgaacuccucgcuucaggcgauccuccugcuuuggccucccagagugcugggaauacaggugugagcuaccaccccuggccaggcauugcuucuuauggaugagcaaaguaggugguuucuugagauggauucuacuccuugagaagaugcugugaacauuguugaaaugacaacaaaaggauuuagaauauuacauaaacuuaauugauacagcaauggcaugaugugagaggauuaacucaaauuuugaagaaaguuuuacuguggauaaauaguaugacacguuacagagauauauuucauaaggaagagucaauugauguggcaaacuuuauugucucauuuuaagaaauugccacagccacucuaaccuucagcaacugccaccccaaucagucagcagccaucaaggcaagaccuucuaccagcaaaaaguuuaugacuugcugaaggcucagaugauccuuaauuaagguaugugcauuuuaaaaucauaaugcuguuacacagaagacuauaguauaguguaaacauaacugucauaugaacugggaauccaaaaaauuuguguuacucacuuuauugugguggucuggaacagaacgugcaaugucucgagguaugccuguauacaggauaauguguguagguuauaugcaaauacuauaccauuugauauaagagacuugaauaucuguggauuuuaguauccuuagugggucccggaaucagucccccccacgaauacccagggauagcugcacucacacauaaugaauuuauaguggaaauucuaugaaauguauauagaguuguuauaauauaccuaggaugaucauugguauuucggaauagcuuuuagaauaugaccaagauacaugacaucuacuauuauauaaaccuguguuuguuucagcauguuuuuuuccuauguuuuguuccauguuagaugucaugaguuugcaaaguauaauaagcuauauucccugccuucaaguagcuuaccauccauguaccauuucccaaaguguacaucauuagcagguagguauuccucaaaaauagauuauugucucugauuaaguuucagagauaccuggauuaaucaaaauugaaaguuuuuuuuuagaauaggguucucaaaugcauacauuagggaauuccagaaagcgacuguauguugcaagguuuuccaagcuuugucgacacacuauuuuuuuucucaugaaacuucuguggugggaucugaggggaauggagguggggaagagaguggcagugguguuuuuaggaagaagauuaauguaggagaggagugggaggaacaccuaggacaguagcuguguaccuggccuagguuccucaguccagaugguagcaagucugaagacagggagagacuucuuccagaagaugaaauucauagaaaccugaggcaaauugguauacucaaaggagcuuugucagacuggagagucuggggugaauugggauaaauauauaguagauaaguauguagaaaacuaaagaaaugagaaacaaauuauuaauugcaagggaaacaaaauguuaugcaggaaaagaaaaguaauuauuguuuacugcuugguucagcucugaauacccuauguaguuauaaugacauaagccucaaauauugaucuaaccaaaguuaggauuguguugagacaucgggggugggaaguguggaggaugccaggaccaggaaacagcuauaucucaaauuuccucaacuggcagucacugaauaaagaaagcuuuugggaaaaggaaauauuggagagggagcugggacuaguuuuucauaacaagccuuguagaucuaguuaauuuaaaaaaaugugcauggguaacauuuauuuuuaccuuuaucagauauuuuucuagaucaaaauuuuuacaauuguuuuagcuucucauugaaauguugucuuacuagguuaaaguuucacguguguaauuggauuugaaaaauguaaauucacuuugucguugccuuuaugauuuagcuacaaagaucuuacuuauggaugagaugaugacuggcaguuauuccacaccaaccacucugggaccaagguuuucuagauuaaccuaauccuacaguccuuuuauucuguguuucccacuccuacauuuuaaacuuuguaucuguauuaugcucuucugugcuuguuagaauacacacuguguucucaggucaguucuuacaugggccucuucuuuuuuuugccuucuuuaauuuccuuuucuucacagcuuuuuuagcaugucaguagcagagcugacuuuauguagugagaagcuacugugugcuucucucuugacccuucuccccaaacauggauggaagggcagaacaagagaccugugggugaguaggaagggcugaggaaugccaucacccuccagcauuucugguucaacagcuucuaaucauuuuuaccaucuccaccgcgcacccccccaccccgugcuuuuaauaacuucaaguuucaugauugacugguuuacuuuuauuugcuuauuacauacuuauuuguuggauucagagcucuuaauuguuaguagaaaugaacuuacuaguuaacuuuugcuaauuuaaguauaaacagaauuaauugaagauauuugugguuucuugagcugauggaaaggccaggcuauuaagauuggggcugcacagcuaggaacaacaauaccaccauuccuaaaauagcuguagaacaacacuuaaauaacugacuauccugcuuuuaaagacugcuauucuuuuuuuacaaacuuguagguugagaaauuuuuacuucuauuuucaauuagaagucuuugggaaaauuaugggaugacuggauuuguguauaucuauaauccagagauaaggaaaaagaggaaacacagauuuucaggagauggaagcauaacuuuguucugcuuugugcuugaauaccucuuuuugaucaggguuagaggauaaccuuaggucagugcauuucccuuguguuuuuguuaacaaaacauaguucagaucccuugauuaaaacccuccacugguuucuugucucaugaagaagaaaaaauccuaacuguucuugaugaucuuuaaggcucagaaugaucuggacagagguauuuaccuugaagcucauaaagcauaggccuuucucacuugcagaguaucuuucugaagcuggacuaaauugguuaaggccacuguacuuuuccacuuugucuucuuuccugucacacacccuauccuuucaggcuguguugggauggacaaaagcaguucuggaguccuaaggagaagaugagugggauauguuucugugaccugcagucauuuuaaaguuuagcuguugcuagcugacuccauguaagaauaccuuccaggaauuugauggcugugcacucuggcagugcagcuggcaugguuauagggugcuuggccgaagguuugcauagcaauaugaacgcauccuacgacacaucuagccaacacuggaagacuguggguaauggacgagaaaccaagauugacuuuuugcaaguuuuuaaaaauaaucuucuuguaacucacaugugaaagaaacaugagagguuuucacaaauucaguaauuugagacauuuacauagcaucaccaauaguugugaagcugaaacuuuaguucuaaacuauaaguaguaaaaaaaaaacguugauucucuauuguaaacaaaagacaacuauuuucuguguucucuguguagaaaauuauauuauaaaauugagguggggcugggcacgguggcucacgccuguaaucccaacacuuugggaggccgaggcgggcagaucgcaaggucaggagaucgagaccauccugacuaacacggugaaaccccgugucuacuaaaaauacaaaaaaaaaaaaaaaauuagcugggcaugguggcuggcgccuguagucccagcuacucacaccugcggcugaggcaggagaauggugugaacccaggaggcggagcuugcagugagccgagauugcaccacugcacuccagccugggcgacaaagcaagacuccaucucaaaaaaaaaaaaaaaaaaauugaguuggacaguggcuuguaccuguaaucccagcuacgggggaggcugaggcaggaggaucacuuaagccgggaguugaaauccagccugggcaauaucgugagacugugucucuacagaaauaauaauaaaaaauagcuaggcgugguggugcacuccuguagucccagcuacucgggaggcugagguaggaggaucccuugagcccaggccuuuguggcugcagugagcuaugauugugccacugcacuccagccuaggggugggagggggagcacaggaggccgugaaggccagcccugcuggcuguggcuacugugcguggaccaagagcaugugcagcaugagggcuaugguggugcccagagagcaguguccagcgugagggagauuguggugccuggagaccuggcaguaucacccggcaugagggagaugcuggugcaccggcuguggaugugagcuugccuggugccagaacucggaggggccagacucuaauuuaguacuuuuuuaugugauuggcaguuucuaaaaauuuguaauuugaugucguuuccuuucuuauucugaauaaauauucaauuuaggaccuaaauuuguuuuuauaguuuuauguuccuuuuuuuuuuugaagagggcuguucccccaauuuuauaagcuuuaaaauuccguuaaaaccuggauugaccccuggguuuccuugucugccuuuuuaaucuugucucauacucacccccucauucccugcagucuaggcacuuucaucuuucuguuccucaaauggauuauguuuguucucaugucaggauuucugcacuugccuggucuccucuuuccuuagcuuuuugaaggauuuuucauuauguacuucucaggacgggugucuucucagagagucuuagaacacccaaucuaaaguaucuuuucucccucccucaucucugucacgucauccauuuuguuuucauagcauuuaucagcaucuuuuuuauuuguuuauauuuuuguuggcugucucugccuuuuagaauauaaguucaguguauuaauaugagagcuguauuguucacugcugucuucccagagucuagaauaauggcuggacuuauuagcauucaacagguauuuuuuggaugaaaaauuacuaaaaagcuggaauuuguacauuuucccauggguuuauuuauaauacuagcauaauuucuuauuguuaauuuuguguuuguguaugguacugcuuucuauuaucaauuguauaaacucguuugaucuuuucugcugaaaauguugacuaaguuauuauuuaccauucauuuugguuaaacauauuuuguuauagacuauucaagcagucagaagacuauagagaagaauaaagugagcacuaaaguacccauguccuagcuuugucguacuuuuucaccagauuuuuuuuaagaauuaaaaauuuuuuaaguuaacuuuucauuuacaaauuuuuaaauuuuuuuuuaaaaauucaccuuaauuaacugaaguuuaugcauucuucucucaucuuacuccucauuuuucccuacuuacccagaguuauaccuaguccagaugaagauauagggugagguacagaaggggccugagcacagaagcuucuguccuguggaguuaggguaugccacccugcuggcacauggaugccaucacuaacccagaaguucuucaagccccaugguuuuggcuuuuauguguagacauaauuaaucaaaucauuggccaucgaugaucaacuccauuucuagcuccucuuuccuucccagagguugagggugaggugaagcugaaaguucuaacccucuaaucaugcuuuauuuagucuuucuagucacuggccauuauccugaaccgaucuagggaccccacucaccaguucacuucauuaauauacaaaggacacucuugucacuccagaaauucuuagaagcucuuguuuuaggaacuggggauugagaccaaauuuauaauaaaagaugcuuuaucacuccuauuacucaggaagcgggaagagcuuuaggagcucugugcuagggacccaggagcuugggaggaagauaaaaauacauauuucuuguaauauuacaauaucacaggcuugaauaccagggugugaggaucauuagaagccaucuuggaggguagcuaccagagucucauauauuuccuuauaaaauaccuaaaguucuuucacauuuacugcuucuuuaauccacccagaaugggguguguaugugugcaugcgugagugcccauacguguauuguguaugguguuaaaggaaucuaaucuuuuauucuuucaaagauacgcuaaucgucccaguuccauuuguuaaauaauucaucagcauuguuccauuuauauauggguuugcuucuggguucucuguacuucucugcuaugaucugaauguuuguccuucccuaccuccccaaauuccuaugucgaaaccuaaucccggauaugauaguguuaagaaaaggggcuuugggugaggugauuaggucaugagggcucugccugcauaaaugggggcaagaagguaccccagugaaguaguuagcuucuucuucuguaugaggacacaacaagaagggugccaucuaugaagaaugggcccuucccaaacauugaauuugcuggugccuuguacuuggacuuccagccuccagaacuaugagaaauaaauaaguuguuuccuauguuuauaagcucccuacuuuaugguauuuuuguuacaguugcccaagcagacuuaagauguuuuccuguagccuauuuuucuauucuuaggccaauaccgcuuuacaaguuuugaucucucuuaggcaagucuccccuuuuuguucuucauguuuggcuugguucucuugucuccaaagggccauuaagagagacuaguuggcuggguguaguggcucacaccuguaaucccagcaccuugagaggcuaaggugggcagaucacuuagcccaggaauuugagaccaggcugaacaacauagcaagacuccacuucuacaaaaaauacaaaaguuagcugggcaugauggugugcacuuguagucccagcugcucagaaggcugagguaggaggauugcuugggcucagaaggucgaggcugcagugagcugugauugugccacugugcagcagccugggugacugagcaagacccugucucaaaaaggaaugauuaaauaaauccaucaauccaugugaauuuuagaauaguuuuccagguuucaucaaaaaucuuguuggaauuuugcuuauuuuaaggaauauaaaaauaugaccuuuuuaacuuaaaaaguaauagauacuuacuaaagguauuagauacauuuaaaaaacuguuaaaaaaauccauaggucugucacucaaacaucaacauuauuguggcauuaggaauccauaaagauuugauauuguaaaagugaaaucaucucugcaacaaaagguauauacuggguaaaaaauaggguuaauauucuuauacaauguguuucuauaaaucauuaagaaaaagauaaaugacccaauagaagaaaggacaaagaaugugaagaggcauucgacagaggagggaaguacaaauggcuaagaacaaauaaaaagaggaggaaaaugugaaguaaaacaaaaugaaccaacgcuuccccauuuuuacagcauuguauaugaaaugaaaaaaguuggagacagucuuaaguacucaccaaaagaugaauggacaaaugcauucauucguacuauggaauucuaaccaaccauuaaaaaaagauuaugugcuaacaugaaagaaugucuacgguuaacuuuaaaaauguaaaguaaaacaaggguuuauauaugugguaucauguuuauaaagaaaauuauauauacauaauuuuuuccauagaaaaaaauuuuagaaggcuguauagcucuauuaacaguaguuaccaagaguguaggaguaugccauagaagagacuuuaacuguauuauuuggauuuuuuaaaaagaauuaugcccuacuuugcaauuaaaacaaauuuaaaacauuuuugguguaauuccucuuaguguuuguuuuuuucccuaggcauaaguuuauuuacuuauuuuuuuaaacaguaguaaucuauagaaaggaacaauuguguucuuaaaauuuuucacucaguggaaggauucauucaaaggaauauuugaaugcaaauuggaguuagaaucaaucuagguuauaauuccagaucuacugaaaauuuuaucuugacauaauucagcccuguauaaaaguuagaacaauuacaaaguuuauaugcucauuacucaaauuuuaacauuuuuccauaguuguauuaucuuucuuuuuuccucuucuuccuuucuucccucuguucccucucuuucuccccuucuguauauauuuuaaauauauuuauauagauuuuaaacauauuuuuaaauacuuaaauauauuuauguucaaauauauagaauuuuuuccugaaccauuuuaggguaaauuugagacaugaugccuccuuuagucuuauauacuuaagugcauguuuccugaaacaaaagugguauccuacauaauuauaguuaccaaaaucaagaaauuaacauugauauaauaugguuaugcagauauugccaauaauugccuuuauagcucucauucuacaaaaaauaaucuugaaucauauguugaauucaauugccaugucuuucuaauaaucuuuaaucaggaggcacaucauauugauuuguccuaguccuaguaauguuaauuuugaucaccugguuacaguaguguuuaccaacuuucuucuucauuauaaaguuauuuuuccuucuuuauaauuaauaggaaucuugucguaugauucuuugagauuaugugaauaucugguugcuccucaaacuuuggcccaccaauuuuggcauccauuuaggguucuuacuugaauacauuauuaaugauuuaugguaguuuucuaauucugacauuccuuuuucauuuuaguuggcuuuuuacuauaaggaggaaauuucuuucucccucgugaauucugucuuacucaauggguuauaaucuuuuacuaucaucauuuauuuugaaaugcuuaaaugauucuagauugggcccaugaaagcacuuucaggccggcuuuuaaauucuuuugacaugucuccaucaauuuuugaggacuugcugggacaacaagauauuccagucucgucauauacuuuccuaccucuagaagcagcucucuagggagcucugguucuucuuaguggaaaauaguauuaacuuuccuuuauuuuuaauucuuuuauuuaccuuuguucuucaugcaguauuuuucuuuuccuuauccuguccugauccauucuauuuuugcaugaauaccguacuguuuuaaucauuuagguuuuguauuuugguuaauuauuuaucuuauuaaauauuucuguguauuugacacuagugagaaaccacucuugcuuguccccuggaaccuuaugaucuccuguuucuuuuugaucuguuugaauguucuucucauucuucuuuugaauucuuccuggaugagauuuuuaaaggguagaguucccuaggauucucuuuuugcucuggaaaaccaggcauugucacugcucagguauugcuggaggagaaucuacacuguaggagucccuacaaacuuuagagacgguuugacaauauauaucaaacuuacaaauguaucuucucguuucuggaaguggauccuauagguaaacuuaggaauguuuguuaugugauauauacaaggugauuccuacaacuauuguguguaacagcaaacgauuugaauaguaucaacaguaauccaaaaaguuuguuaacauuuuucucccuuuuucuauucauaucugcaugaggcuggauuuucuucauauaugccaagacaacauacagcaucagaguagggaaaagcccaaauguccauuaauaggaaauuggcuaaguaaaucaugguacagcaauacaauggaauauuacauagucgaaaaagaaugguaggaugagguccauucagugacaagaaaaaaaaaagaaucggaagaauaguauuuauauggaaaaucauggaaaaaccucaauuuauguaaaggagaggagauaagauguuauaguuguauuugcuuauauugucauaaacucuggaaugaaaaacaacuaauauuuuauccagaaagcaggguuaaacaggcagauggaugggugugaugagacuuuuuacuguauaccuuuuuaacguuugauuuuugacauacacauguacaaucuguuuaauucaguuuuaaaaaaugauuuccaguauaacuuaaaccuaguuuugacacagcacacacuuauacuuuguaccucuaaaccauuggccuacagcacaguauucuuaacacaguauggaaagccuuuugucugucucuauaggaugauacucugcaacuuccagcuucauccuuuacauucuagugacacugaauuucugguaguaguucuccacaugugguacuguuuuauauuuguguaugcuuuaccuguaucuucuucauaucuuuuaagaaucaguuugugucaucuucucugggaagcuggccucaaccuuugcaaggcuuaguugagugauucagucauaauacucuguauaauugucuauuauugcucuuauauugcauuguaaucauuagcuuuuuuauuguacuuagacacagauaaccaaagauuugcuuuaguguauuuuuuucacuguauucccaguagaaaagcauuaauguauguuauuugaugucuuuuucugcaggguaguugcccugccucaaacagcuuauagucuuuaauggagacaugcaggaaugcaacuaacauaagagagaguguacuaagugagguaauaggcaaggucauacuuuuaaaggaagccagucuuugaaaugaaucuuaaagauggucccagaguccagauggaaacauucuaacagggccuauuuaggagccccagauaauguagggguagcuucaguauaaaggauacaugccucaaggugagucagggagaaaaggaaaaacagggacagauugugagaggucuaacauuccagucuaaggaauuugaauuugaauauuaucuugugggugaaguaggauucuuuaaugcuuuugaacgaggaaucaguaucuguacuuucaggaugauuuuaugcuuuguguaaugucuuccaaaaaagaugagagauggggcaccuguuaauauauuuuauauuauaaaguacaguguugaauaugggaucaaaaaaggaacagccagccacauuuccaaaucccauguuuuugaccagauagucccuucaaccuagaauuaugucucauucaagcagugugauucuauucaucucaaguugucauaagaaagacaacuuauauguuacuuccacuagugaucccugauaaauuccuuccaaauguuauuaauaacuguauccuguuuugacugcauuguauuuauuucuguuacaauuuuucucauacccuaccuguuuuacagugcagggguccccaacacccaugcuguggaccaguaccaguccauggccuguuaggacugcccccugccaggccacacggcaggaggugugcauuaccaccugagcuccaccucuugucagauuagcugugguguuagauucucauagggaugcaaacccuauugugaacugugcacgugacagaucuagguugcacucuccuuaugagaauuuaaugauaaauguaaugcacuugcaucauccccaaaccaucuucacuccccaccgcccccgucuccccccaaucccauggaaaaauugucuuccaugaagccggucccuggugccaaaaagguugaggacugcuguuaaaguguuugccuuaaucacaaccacaauugcuuccuccuggaaacccuuguuuuacuuuauuuaacccacucggguaacacuuauuacauuguauuacugucugaugguuuucuguuuauuucaccaaacauuucuuaggugccagaccucaaggaagucauucuuugucaguucauguguuugacuauacuacuugauuauuauuagauauacgaauuccuuaagggcaccuuaucuuuuuuuauugcacuuagcacaacucaugauacauuuaggcacucagacauaucagagacaucagcggaacaguacugguuaaaaguugaguuuaaauucuggcccuaucacuaucucuuggauccacuguagggagguuauuuagucuguguaagcuauaauuuuuucuucuguaaaaugggggaaauaauaguuuccaucugaauuagucuguucaagcugccauaacaaaauuucauagucuagguguuuucucacaguucuggaggcuggauguuugagauaaggugccagcaugaugggguucuggugagggcucucuuucuggcuucuugcugugccucacauaauggagagugagcaagcucuuuugggucucuucugauaagggcacuacucuuaugagggugagggccccacccuccugaacuucaucuaacucuaaucuuuucccaaaggccucauuucaaauaucacacuaggggguuagcguuucaacauacggauuuuguuacagucuuuaguggagacaagcaggauuaauuaauuuauggaaagcaugcagcagugugccucuaacauaaaaaaugucuuauuuaaccugucaucaucaucaucauuuugacuuggccuaaaauuucgcauaugggcuaguggagaaaaauuagaacuaauuuggugauuuugcucuucauugauggaaaguaugugauaacauucauuaagaagggcaauguaggaagaaagagacaguuguaggcaugcuguggagagaugcuuccuucacuguaucaguagagaagaagaugguugucaaccucagguuuauggaugaauccucaguaugcuguaaauagaagaaaagagaugcuuuaguguucuuuauaucuauguggccuuuaaaaugcaguccuuuaauuuguuuuuauucaaaucuuuauuuuuuauuuucuuuucucugauuuaauugauagaucggguuuuucagugagccugggaaagcagaaguaccauuuuuaugucuauaaauaauacuaaauuuauuuugcuggauuuuguaaaguucuguauuaaacauuauggaucuuaaauauauuuugguauuuuaaaauuagaguauaaucaguuucuguucucuagccuuuggauuuagacuuuuucuucucuaaguuaaugaguccaggacugauuuuguuagccuuucuggagcuguuaagaauuccuauucuuucguuuuugguagucauugucuccacauuugcuuuauggaguccucuuugguggaucccacagguggggaggagacacaggauucauaagauggccggugggugagugacuuagaauuuggguuagaacuggccgggcgcaguggcucaugcccguaaucccagcccuuugggaggccgaggugggcagaucacaaggucaggagauugagaccauccuggcuaauaagguaaaaccccaucucuacuaaaaauacaaaaaauuagcugggcgugguggcaggugccuguagucccagcuacuuggguggcugaggcaggagcauggugugaacccaggaggcagagcuugcagugagccgagauugagccauugcauuccagcccaggagacagugugagacucugucucaaaacaaacaaacaaacaaacaaauaauaggaacaaggacgggugcgguagcucacgccuguaaugccaacacucugggaauuugaggcaggaggauugcuugaguucagaagugugagaccauacuggggaacaugacgaaaccucgucuuuacaaaaaauacaaaaauuagcuaggcgugguggcacacaccuguaguccuagcuacucagguggcugaggugggaggauccauugagccugggaggucgaggcugcagaaagccauauuugcaccaaugcauuccagccugggugacagagcaagacccugucucaauaauaauaauaauuggaauacaaugugaaauuuggacauuacauugucuuggugaaaucuguaaauacaauguaaugguuuugaguuuuuuccuuaugugaauuuuauuaauaauuuauauggcagagcuaucaugccaucuguauguacuaggauguuaccaaaauacaugcaguugacaguuugggaaagcauagagcaaauaguauauccuaaguagaucuuuucuuuggcuguagugguuaaaaagauauccuuaaauugugguuuggggcuuuucuuuuuuuuaaacaacaaaaauuucaacucuuaauaaauacuauuuuacuugugauaagaaggcagguaugcuucuggaaccacagaaaucaaacuugagagaaaaaauacaaacaauuauagagagacagucucugauuaacaugaacauaaaauaaccaucaggugacaaaccuuuucacaagaaaaaugaucugugcccaagaucaauuuuauagacauuaacucaaagcugugauuuuauacacaaagcaguauuguagcaaugguauaaacacaggaaaaauucuugugaaaggaguggagccugcaaauguggaacuauguggaaaagggaaaaguuuguaguauguagaacuauggcagguguuuauauuucacaguguaaaaaauaaacuuaaauugauauacugguuuacuaaugaauuuaugaauuuucaaugaauuuauguagagcuuauucuguuagaugggacuaauaguaagaaauacuacaaaguaggaaaaguuugucucuaggacccuuuugugaccuuuuuuuucuugcucuuucacacuccucauguaauggucaccauccauagauccuucucuguucacucuguucaaaagagaucuccaagaccuguaggcuuuguuaaguuaucuuaaaaaugaugaauaaacacacuagaguauugauggauuguuucacauuuaauugggacucuugaaaguccaaacagaauuuucuuaugguaaaauucaaacauugacgucuguuaggggagauauuuauagagaagagaacuuuuugagucugcuccuuaauuuacaaccuguugucaguugggaaggaaauuaacauuguuaaaugcuuauaugcuagugucugggugucugugcuaggucauacacaguauaauuugauucucacaaugagcuugugaguaugacauucuuauucucauuuuauaaaacuuuuuuuuguggggggcgauggggucucacuguguugcccaggcuggggcacagucacuauucacagguguggucauggcucacugcagccuggaacuccugggcucaagcuaucuucccaccucucccuccccaguagcugggacuacagcuuauucaaguuuuauaagagauaaacugaaagaggcauagaaagaugaagugaccuuccuaaagaggucacaguggagguaaaucauuaaaaucaggauuucagauuucaaagcgucuacuuuuaccaccaagccaguauuucauagucauuuuacucuucuguuuuacucauacucggugaacaugacaauaucuuuaauuacccuccagaauuccuuuacaugucucuaaagagaugauucuucaguuucuuuuuguuuuauauauauauauauauauuuuuuauauauauauguuuuuauuauacuuuaaguucuaggguacaugugcacaacgugcagguuuguuacauauguauacaugugccauguuggugugcugcacccauuaacucgccauuuacauuagauauaucuccuaaugcuaucccuccccccuccccccaccccacaacagccccuggugugugauguuccccuuccuguguccaaguguucucauuguucauuucccaccuaugagugagaacaugcgguguuugguuuucuguccuggugauaguuugcugagaaugaugguuuccagcuucauccaugucccuacaaaggacaugaacucauccuuuuuuauggcugcauaguauuccaugguguauaugugccacauuuucuuaauccagucugucauuguuggacauuuggauugguuccaagucuuugcuauugugaguagugccucaauaaacauaugugugcaugugucuuuauagcagcaugauuuauauuccuuuggggauauacccaguaaugggauggcugggucaaaugguauuucuaguucuagaucucugaggaaucgccacacugucuuccacaaugguugaaccaguuuacagugccaccaacaguguaaaaguguuccuguuucuccacauccucuccagcaccuguuguuuccugacuuuuuaaugaucgccauucuaacugaugugagaugauaucucauugugguuuugauuugcaguucucugauggccagugaugaagagcauuuuuucauaugucuuuuggcugcguaacugucuucuuuugagaagugucuguucauauccuuugccuguuuuuuugaugggguuguuuuuuucuuguaaauuuguuugaguucuuuguagauucuggauauuagcccuuugucagaugaguagauugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagacaugaagucuuugccuaugccuauguccugaaugguauugcccagguuuucuucuaggguuuuuaugguuuuaggucuaacauuuaagucuuuaauccaucuugaauuaauuuuuguaugaguuguaaggaauggauccaguuucagcuuucuacauauggcuagcuaguuuucccagcaccauuuguuaaauagggaauccuuuccccauuucuuguuuuugucagguuugucaaagaucagaugguuguagaugugugguauuauuucugagggcucuguucuguuccauuggucuguaucucuguuuugguaccaguaccaugcuguuuugguuacuauagccuuguaguauaguuugaagucagguagcauggcauccaguuucuuuuugaaucaccacaugagaccauucugcuugucauugauuagucuuacuugaaccuuuugugguauuuuuagcuaagaguauauagaaaugccuuguuagcagagaugacugacaacuacaauauucaguucuaaauauauuguuagguuuuuguuuuguuuuguuuuuugcagauagcuaacucugaaguuuguacuuagagcaaguaaguauuggcaaguuaugugugaauaauguuuggaauuauuacagcaagaauuaacaaauuucuuguuaucaacacuuuagaauagauguauucaguauuauaagcagucuuaaaauauccauucaacaaagaguuacaaaguacuuacaugugccagggcuauguuagguucugcacagaauagaacauggaaaacacauggucugugcccucaaugagaagguaguuuaggagggaggcaaacaugauguaauuaauagaauacacucuaauaaucauaguaauggagguguguaguaggaagagugggagcaauaggaaaggaauaguuaacugcauuugagggacucugggaaagauucagagaagagguuguaguuucaacugaggcuuaaauauuuugacuacaagaacauucguggucugcuuauacauuuuacauauacaacauuugcacaaacagcauuucccucacauguacauaugaaugcaguauuuagcuugaacaucuagccucuuccuuuuucccugaaaucaugcauuaucauguggauucuccuccccccauauaucuuuuuagaagacuucucucagagcuucucaguuguuucccuuuaguucucugcucuccagcuuuuaaauuucucuggcuuuuggaagcaggcagacucuguuucuacagucuuuaaaacaguaaugaaugaagaaugacaacgguggugggaaauguagaagagaacagaguaauggaacuaggucccugaauauuugaucauuuuugcugucccaaaaauguuuuuuuuuuuuuucuauuuagaauaaucuccaggcuuaaaagugugacuagguaucucucaaacacaaaaugaaguuaagaaacagcugucuggaaaggaacauuguauucugugguauacuauuuucuggcacauuuugguuguaaggcuuuuuggugauacaaaggauuccacucugauugagcuuacauauacaugccuaucucugucuucucauauacaugcagcuucucccagacaggcacauugguggauguuaaagcaauuaguuuuacuugaaaaaaaguaugauacuauggcaagagcucuggauuggaauuaggagacugaaauucagguccuaccuugaccuaugauuaauuuguucucuuugaguuagucaguuaaccucucuuagguuucaguuuuccuguuuauuaaauaaugggauaggauaaugcccucuaaggcuuuuccuaccccagaaauucuaucauuuuacuauugauggaguuggcuguucaacucacaaaucuuuauugagugcuucucaccuucaggcacugugcuaggugcagucaaaaagagacauagaggagagaaguagaucaauggaauauaauugagaauccggaauuuaaaccauacauauauggcuaauugguauucaacaaggauggcaaggcgauucaguguggaagaauagucuucaagaaaugaugaugggacaacccgauuuccacauauaaaagaaugaauuuggacuccuuaccucacaccauguguaaaaauuaaugcaauguguauuaaacaccuaaauuauaagaacuaaaacucuuagaagaaaacauaggggugaaucuuuguaauuuuggauugggcaaugguuuauuacauuugacaccaaaagcacaagcagucaaugaaaaagaaaguauacuucaucaaaauaaaaaacuuguaugucaaaggccgcugucaagaaagugagaaggucuucaggaaacaacaauuuuuaagaaagugaaaagaauagaguaugggagaaaauauuuguaaaucaugaaucugauaagggccuaguauccagaauauauuaaaaauucuuauaucucaacaaugaaaagacaacccaauuaagaaaucugaauagacaauaugaauauuuucuccaaagaagauaaucaaauggccaauaauacaugaaaagaugcucaacgucauuagccaucagagaagugcaaauuaaaaucaugugagauaucaacucaccuauuaggaugucuguaaacaaugauaaacaguguuggugaggauauggagaaauuggaauccccauacgcugcugguagguuuguaaaaugguacagcugcuuuggaaaacagcaguuccucaaaaacuuaaaacauagaguuguaggucucagcagucuacaccuggguguauuucuaaaggcaucaaagucauaugguuguacaaaacuuguaugugaauguuuguaguaguaguauucguaauugccucccaaaccacaaauguccaaucaacuguagaguggauaagcaaauuaugauuauucauaaaauggagcauuauucagacagaaaagaaaugaaauaaccuugaaaagcucggcuaagugaaaaaaacuacacacaaaaggcuacauauuguaugauucauuaauaugaaauauccaaaauaggaaaauccuuagggacagaaagugguuucauggucaggagaugaggggaugagggaauggagaaugacugcuaaugaguucuggauuuauauuuggggcgaugaaaaguucuggaauuaguagugguaguugcacugccuugugaauguaauaaaaacuauggcuuguauacuuuaaaauggcgauuuuuaugguaugugaacuaucgcucucuuuuuuuuuuuuuuuuuguggcggaucacugucuugcccggacuggaguacacaggcgugaucuuugcucacugcaaccucugccuccucgguucaagugauucuccugccucagccuccugaguaggugggauuacaggcgcaugccucuacacccagcucauuuuuguauuuuuaguagagauggaguuucaccauguuggucagguuaguaucgaacuccugaccugugaucugcccaccucugccucccaaagugcugggauuacaggcgugagccaccacgcccggccuauaucucaguuuuuuaaaaguuguggcaccuaacuaaaaugaacuguuuuugauagggauagagaaggguucuguaggaguauacagaaugacauuuugaccuacugugugaaguugacagcaaacuccugaaauaaguaauauuucaacagagaccugaaaaaugaauuggaguuacucaugugaaaaaacuguuagcaauggaaaugaggaaacauguaagaauauaucaguuaaaauuaacagcugaaagccaauuuuagcuguaacagguauaagcuccuacuugugucacuauguaagauuuugucaaagacuuuuugccuuaaguaauguaauuauccauggagaaccauagcaauauaauauuuguuauaaaauauauauauuauauauauguauguauaucuccuagcuucuggggaaaacagggcauuuauuuuuuauuuuuugauucuaaauauuuuuaaauuauaguuuauggcauuuuauaauuuuaaauauucuugaagccagaacuaaauucuagaguuuguuuaugcuuuauuuuuuucccccucucuauauauuuuauaaggcaauuuucuaagcuuugauccuauggaaauuuuaccguuuucauuacuuuugacaguuugagauuaguuucagaacccuguaagcaaauaguaaauauaauuagggaaaauuaaaauauuucuguuuccugguaggcaauaagacauuaagaaaaaaauucagacuuauaccaaaguagaggcaaguauaaucagcacccauguaaucaucaccagcuucaaaaauuuucaacucaugaccaaucuuauuuuaucuauauauccacuuacuccuuuacccacuggguuauuuugaagcaaaucucagauacuguaucauauguaaauuuuuuaucucuaaaugacaaaucuuucaaaaaauauauacuauuggguauuuuuuuaacuugaaaauacuucuuucuugugaaguauuaauuaaaaaguuaucuauuaguggaaauacucuauauaguuuuuuauuugcuuauauauccauucuaauaaauauuagguauguuuauaaaaauaauaaaauugagguuaugagaaugugguucauauauuagucuaugcucaucuuugugauuaauuaugaucaacgaaaccauaggcaugauaaaacucuucucuauagccacugauuaucuccuuuuaucauaaccaauggccuuaacucuguuaugccuucugggugugucuaucauuuaauuuauugauugcccccuccucauugaaacauucaucucccauggcuucccugauguuuggcuuuccuguuucauugcugcauuggacugugcucuuuuacugacauacuuucuuuugauaccuacauaaugugacuauaacccauccuuacucuguucuugagccuuuucugcccucugcaaauucuuagcucuucugcugucauggcuacaaaucuucuuuguguaucagugaauuccagguacuuauuaaaauaacaaaucaaagaacuucucuuuaguguuguaguugaaaaaaacuuccccauggguaugccauugucaucauaaguucagauuuuuaaaaacugagauuaucuucuuuuucauuaauaucaauuuccuuucagcuuuccucuacugacaaaucaccagacuagaaacauucauaucuucuaccuacuucaguccccugugcacgugcuauuaucuucuacuguuaauuauuccuucaaaauacaugcuauuuauguuuucauuuauugccuauucuaggcauuuucuucuucuaggaaacuuuucuucacuacucuaguugccuaaauguucaucucugugauuccauaaagucuauguguucuccacaaucaagauaauauuuuaugugucuuuuccucauuugaauucaagcucuugaguggcugagauuggagauuggggguuguuuauguuugugccauagaacaugagacauuguaauguuuguuaaauguuaauugaacuccuaaucucuuuaccuguauuacugcaauaucuaccuaaggucuugccuuucccuggcagaacauuguguauaaaguaaucuuaauucuuugugaagccaaugaagacaguagauucucuauuaaaguacccuguacauuuccaucauaggacuaauugcaauuuaaaauuauuauuaauuuucuuuuuuauuuucuuucucccccugggauacccucuguaaugguagucuuacacacaguagggccuuaguaaauguuuauugaauaugaauggaugccccuccucaccaguugagagcagugcacauauauguaauacaaauuauuuaacagugauuacaaaccuuaagccuuugcucuauuugcuaccagacugauuuucuaaaauaguguuuuuaaaaguucacucaaacuuacucugugccagacuuacaauaaguuuugagaauacaggcacaaauaaagacauaauuccugcauuuuauggaauuuggaaauaaagaggaagaaaugcuuaaaccucuuuggacaggccaagaaaagcuuuguagaggacaccugauaucuuuaagguucuuuucagccaaaaaauuguauaauucacaggugcccuuuucuguggcaguagguaaaaaccuugguagcugcaaagagaagacagcugccagcaggguauuuuuggcuguuccugaggcugcccucauucugauuaacuugaacguuuacuucggccugaggaguaacuuuguaacuuaaaucuaauuucuuacuaaauagagauuauuuuuagauuauccauuauuuuguuagcagagauaauugaaaggagaauuuaguaauguuuucugugacuuuacugaagccaguucaaacuuuauuguuuaauuuuuguuugguuaacaagggaaucaggagacauuagcacuuccuacuaauaauacaucauauaacuuauuuauccuguuaauuuucucuuucaaucccgcuagaauguaaacucuauaagaagggauuuuuguucuucgcucaauaaauauuugugaaaugaauacuuaggaagucauugguagccuuaccaggguaguuuaaauaaagugguggagauggaagcugguuuacaugguugaggguugccuggguuugcgguucaaaaucaaacaguaauaguaguauuuuuuuuucuuuuccuuuugaaaguuuggugguaaggaagauauuuaugaaaauucucuucuuagucacuucuauuucuuuuuacugcugguaacuuauaaaggcuuuuaaaauuaacaaguccucuuguuucuuuuuaaaauuuaaauaaguuuuauacacauuaaauguauuacuguaagccauauaaucucaaauacuuaggacuuuuuagauuuuuagaauaaguaaaacuuuuagguauuuuucucuuuacccuaaacacagccgugaaaugauguaucaauaagugguuuuggauuauuuuuuaacaucaauaaauaugcaccaaaaguaaauauauguauaaaugaauuuacauuauucagaauucuagaauuagacaucugucuaaugaaugcuguucuaaauguugcuaaaugauuaauaguaauuaaaagguuaaauacaagcuggagaaagcuuugaauuuugaaauguuugcaacagcuaguaaucugacugaugcagacguuuuugucaaaguugaaaaaguuagagcuaauuaauuucuugggagacauaugaugagauuguaggugugauaacauauuugaguaacauaugguaguuauggggcaccuuucuaaugacugagcagccaguuaaauauagacuuuuuugguuuuauuuauuuuauuaccauucuuuguuacuguguauuuuuaaaccaauuuuguuuucuguaauagaggucaguacucgggauuuuaacaauuuauauuuaaaauguuaauaggaauaugguacuucucuuugaaacugaaauaaauuuuagugaaaguuuucuuaaaaauacagcuauuuccuaccaacguauuuguguauuauacuuuuaagauuaaaucaaauguauagggaauuguacucucaguacacaguguuucacugagauuacuauugaaugaguacuuaaaaaauguuacuuuugauacacggcacaaauguauuuuuuucccauaaggauucauuauuugcauuuugacuaauuuucuuccagccccuuuuacuuuauagaguuuuauuucaguuucugaauauuaauaaugacaaaugacaacagauuaaaagggaauuaaaauuauuuuuauaucuguuauuaaaauaguaucuuaacaccuugguagagaaaauuuugacaugagaauuuugcaaauagaggcauaaaguagcgacuuagauguuuuuauuuuuaaaguuuggaauuuuaccaaaauuuauaugauuguaaucuguuguauaagccccaaauuuucugucauucagaaauaucggcagugaaauccgaguucaggguaaaaauguuucuguugugcugcagagccagccacuggaggguguucauguuaacuucguagucucaguauucugcugauuagauugaugaaaaagugaagacuguccauuuacaagucuuuugaaauuaaagcaaaaguacuauucgugucugaaauggaaauaaacagaaaaggaguuuuaaaccuuaaaggaaauaugauauuuaaauucuaaaauuaguaagcaaauaacuuucuuuugcuuuuuacucaaagacacuggucaguaauaacuguaauuuugaauauacuuacaaaauuauaugcaguuaugagguucugauaaguacacaaacaucccaaauuuauuuacuaaacuuuuuugacauuguucuaaucguuuucauuuaaauuugaguaugcuauagaauuuugauguguacaucugcucugugacuccuuccuuauuuuaaaucuguugcaaaauuuuccccaaucaguuggcaugcuuuuaagccaguagugauaaacagauauccaugaagggcugguagagucuuuuguccugaauggguuuugagcucaagccuaaaguaaauauuaaggugaacuuccaagugauucacaguaaagcacuagcuucucauucauugaauauaauugauaaaguuuguauuauuacauaguuaugauaggauuuuaaagacagcaggauucucugaaauauagcuuaccaauuggaaaauuacuuuagugugauguauucugaggcuguaaaguuuauaucauuuuuaauugauaaaauuguucuaaguucuuauuagaaucuugagaaacaaaaauucuacugaguaggcuguuuauucacuuuuuaaaaauguaugcgaauuucaguagaauaaaaugaugauuuagaaauugguuuuaguuuauuaguuaacaguaguaaaauaaacuuuauauuguuuuucuuuauuagaguaauaagccguacaauuuuguauagcuaguaggcaauacuuaauggagaaugaggggauaauuuuucauucaguagaaaaauuugauauuugauuucauaguugaguaauuauacuuagaaauaucaauuuuuugcuuucauaaguuguuaaaauauuuucuacucagauaagucugucuuuaugucauaaaguaaguaaaugacagauaucagauccauaagccaacauuaaaauucacuauaauauacuuggcccuaauccugaaagcucugguucguucuagaaauguuucuggaacagugaguacaugauuuugggagauuagaagauuuacauuuuaaauacagugucaaugaucuuuaccuugccaugcauaaauuguguugccagaugugcuuaggucaauguuuuaaccauucacauauccuguuuauuuuaugaaauuauuucaugagucuugaagugggacuuaugauugaaacgaaggguuugagagaaaguauguuaauagucuuauuaauaguacggaaaacaguccguuuggagcaugaugcgcucugucacauagaaacaguuuuuggaugcuuucauagccaucuguagaggguggaucauugauuauacaucagucagauaaaaaagauaauuuugacauuaucucuucuuccugaaauaccuugcuucugaaaaauguguguuagcuugaucaaauuauuacaaaggaguuucaaaggggguauuuaauaaacauauuacauagcaaauuuauugucuaugauuuuuaguauuuucuguugacauaaauuuaggaacagaugaucagcaaucuaaacagaauaaaugauuauuuuuccccucuaggaaugaaagauaacuuuaauaaacauaauuuaaguauccauuucacaugauuuagucacuaaauacaugccagaaauucuuagacacucagaauuccuaagaagauauuaaacguauucuucagaaauuuggggguaacuguagauguuuuuauucauuuacaguugccagguauccugaccaaaauguguuauuuugacguuuagaaauuguccuagcaucccaauuucuuaugagguacucaguuuggauuagugacagugcaacguugagacaagagagauuccaggauaaaggaaucaaaauucugugccuuuuugcuucaguaagaaaauacuuauuauauuucuuaaaauguguacauauuuuuuaaaguacauucaucuuuccuuaaaaaauuuaacaucauuaaguuaauaguaucucuucccagcuaacaguuacuucuuauuaaauauccaacguggugcuaugggcuuugcuuguaguugucauuuaauguguuuaaaugguuaaggguaaaguaacucaugugagugggaucauacaauauuuuucccuuugugacuggccuauuucauuuagcuuaaugucuuuaggguucacccauuuuguaccaugugucaaaauuucuuuuuuuaagacugaguaauguuccauuguauguauaugccacauauuguuuauccauuuauccauugauggucuuuuaguuuuuauuugugcgaaaaugcauucauuuuuuccauauuuuuaaaggauguuuuuacugaguaagacaguucuaggucaggguuuauuuucuuuuacucacugaagauaagcauuccucugucuaaauuaugauauuuagcuuguccauugagucuuuauuuuuggacaucguauuuuucaguucucaaaauuuguuucucuuccaaauuagacaugucucuuguauaguuuuauauuucacugaggaaaauuucaaguuuggcuucuguuuucuuguacauagaguaaauguaguuguuucauuuacacucugugucugauacuuucaguauuugaagucccugcucuggugucuuggcuuauuagaugcugguuauaaauacuggcugugcugguuauuauucauguuaguuauguuacauaaaggggccacagauacugacccauugcucuaggugaaauacagggcuggguucuugcaagucucuggucacgucuucaucagcugaucaauuacauaaccugguuuuauguguguuucuguuugaggacaucuuauuuaauauuauuuauuaauuaacauugaacucauggccaugaacacuauaacucaugccugaaugaagcuuauuuaaacaaacauuuauucuccauaaggcauaucauagccuucuuuugcugagaaacacuaggugagacuucaacacuauacaugagggccauuaaacugaaaucaccaacaggaagcacaaaaaugugaaaaacauggcacuaaauacugugaaaaggacauuguuuguaauaggagagcugaaggaagaaggcugagugacaccuuguucagccucaugugagaacaugggcaucaguuuauucaaauuuuuuugcugcucuaugccugcaaaugaccccuaaagcacccagauuuuuuaucacaaauaauuuuaggugaguaggugaauuugcaaauacagaauccaugaauaaugaagauuaaauauguuagcugggcauaguauuugaaaauuauuuguagaaauaugaagccuuggguugggcaugguggcucccaugguaaucccagcacuuugggaggcugaagcuggaggaucacuugagacuaggaguucaagacuagccugggcaacauagcaauauccugucuccaugacaaaaaaaaaaaaaaaaaaaaaagccagauauagagguacaugccuguagucccagcuauuugagaggcugagauaggaggaugcuugagcccaggagguugaggcugcagugggcaaaggccacaccaccguacuccugucugggcgacagagugagacccugucucuaaaaagacaaaaugaagccuugaguaaaguuaucuucauuuaauaucugcuggaugccuuggauagcaaucuaggaguagccuaacccaaguuuaaagccuaaaguuuccugguccacucaggugacaugaaucuagggugcagaucugugcaagauuuaguuuauuuuuugguuccccauugacauuaacgaucagccauuugugauuucagcuuaauguggcaauugacuuaucagaguccuaauuuugucuuacauuuuaaauuguucucaguggaguauucaucugaauuauucaaucugauauuuacagaagcagaaccuuccuuuuauccuucuuaauuuuaauuucuccugccuugugauuuucguauuaccaucuccucuuuuuccuucuucuuuccuagguuugugaagcauuuacuacaguuguuauaagauuaaauaacuguucucauuuaaguacauuucuuaaacuuacacuaagaugugaccuucagauugcuuuaauaauguaagaaauaaguucauuuuaaaaagaaaucuggauguuggaacaagaccuugaauuuuuauuuuuuuuuucuuuuuaauucauaauauuauucauuacccaucauguuauuuugggaagguauagcauaaaauaugauuuaguaauuuagcuuucaccuaaguuuuuauuguacuuuaugauauaggacuggcugucaugaaaaaguuaaauuugauggacauucucucaucaaauuuguccuuguauuauuuuauuuuauuuuuaauuuaauuuaauuuaauuuaauuuuauuuuuuggugagacaggguuuuacucuguugcucaggcuggagugcagugcagugguccgaucauagcucacugcagccucgaccuccugggcucaagcucuccucccaccucaguuuccugaguaucugggacuacuggugcacaccaccacgcccagcuaauuuuuguaguuuuuuauagagacgagguuuuggcauuuugcccaggcuggucuugaacuccuggacccaagugauccuccugccuuggccucccaaagugcugggauuacaggcaugagccaccucccuuuauucuguuuuucagggagcagccccacugauccuacuuaacuuaagucagaaugauuuggcucuucugcucagaaaccuccuguagcgucccauaucaguaaaagccgaaaguccuuucaggaaucuauaggacucuagaugagguguccccaacccccagccuguggacaaguacuggucccugaccuguuaggaccugggacacacagcaagaggugagcgagcauuaccaccuaagcuccgccuccugucagaucagaugcgagguuagauucucauaggagugcgaacccuauugugaacucugcaugcgagggaucuagguugcacgcuccuuacuaacucuaacuaaugaaucuaaugaaaucuaaugccugaugaucugaguggaacaguuucagcccgacaccuucucccccuaccucuuccaaggucuauggaaaaauugucuuccaugaaacuggucccuggugccagaaagguuggggacugcugcucuagaugaucuggcuccucauuaccucucugaucucaguuucugcuacuuccugcuucaugcucuuauugcagcuuuuuugucuuccuggaacaugucaggcauuuuccaucuuaaagccuugcuauucccuaugucaagaaaacucuuucccacagguaucuauaucgagcuuccucacaucguuuuaauuuuccuuaaaaguugccgucucaaugagacuucccuugguuacuuuagucuuccccaaaguauuauauucccuccuuugcuauauuuuucuccuagcauuuuucguacuauauaaccuuuuuucucccccauggaaauauaaacuccgugaaagcagugauuuuugucuaccauccucccagugccugucagagagucuggcacuuaauauuugucaagugaauaacaaaugcaugaaauuuauuaccauaaccuauuuaagagcuuuaaguguuaauuagauagcugggugugguggcucaugcccgugaucccagcacuuugggaggccgaggcggguggaucaccugaggucaggaguuagaaaacagucuggccaacauggcgaaacuccgucucuacugaaaauacaaaaaaauuagcuggaugugguggcguguaccuguagucccagcuacucgggaggcugaagcaccagaaucgcuugaaccugagaggcggagguugcagugagccgagauugcgccacuauacuucagccugggugaaagagcaagauuccauaugaaaaaaaaaaaaguauuaauuagauaaaucuguaucaaaaaguaaguagagacugcaaguguaagaacuuugacauugcauuuauuuuuauuuugaaauaauuucaaacuuaaagaaaaguuguaagaauaaugcuuuuucuucuuuaucuuuuuuucugagauggaguuucgcucuuugcugccugggcuggagugcaguggcacgaucuuggcucacugcagccuccgccucccggguucaagcgauucuccugucucagccuccugaguagcagggauuacaggcaccugauaccacgcccagcuaauuuuuguauuuuuaguagagaugggguuucaccauguuggccaggcuggucuugaaguccugaccucaggugauccacccgccucagccucccaaagugcuggguuuacaggcaugagccagugcacugagcacauaaugcuuuuucuaaugaaccauuugagagugagaugcuccuuuacuguugauuacuuuggugcauuuuuguagcauugacaugcucuuauguaaaaagaguauaacuauuaaagcaagauauuaauagugauauaucaaucacuaccaucugaucaucagaccccauucagauuuugccaauucuuucgauaaugucuuucauugcaaaauucuaacccaggaucugugcauuugauugucagggcucuuuacucucuucauguggaauggcuucauagucuuuccuuuuauggcuuuuaugcuuuuaaagauuacaugccaguuauuuuguagagcaucccauaauuagaguuugucuaauguuucuuccugauuagauguagguuauacauuuuuggcagcaaugucacaaaagugauguuuuguucuuauuguauucugaauugauacucaauuuugguuuauuccauuauuacugauguuaacuuugaucaccugaagguagugacuacuaguuuucuccacuguagagguacucuuuuguccuuuguuauuauuuucuaaggagguaauuugagaccauguaaauauuauguuucucuuugacucauuaguuuuagcauuuauugauguuucuugccuaacuuaguugugacuaagaugaaugucaaguggugacuuucuaauuuguuguuucuucaacauucauuaguugggauucucuuauaaggaaacucuccauucauagauucauuauuuauuuuuaucaauaugggcucauggauucuuguuuuauucaacaaaugagucauaguguuuucguauuauguauuuugauauccagauugucucagauguggccagcgggauucccuucaaacuucugugcccuuuaacauguccccaucauucucugagcaccuucuuacucucuggcacaguaagauggucccagcuccgcuugugauaucccugcuucagcccuggaaucagcaguuuuccagagacucuugauucuuuuuuguguggagaaugauauuuagaacccuaaaucuggguaucaauuguguucccuguauugagugucacuguugucaagcucuuucauuaaaaauaaaauuaggaaauaauuguaugacauacucacuuauucuuacgauuucugcaucuguauauuaaaaacugaauuuguauugacauuucaauuucuaucucacaccaaagaguccauucuagcuucauccuuuuuauauuuguaacuuccagugagaaacagggguucaguuaucuacaauauaugacuuauaugguucaucuucuguauauaaccaaucucucaaucaugcuggccacuacuucuuguggucacuuccuugauugggcuugacccuuuucuccuagcuucccccuacaguaccagcagauucuuacuuccuuuggccaugccuaaauacuuaagaaaagaaaggccuucacauuuuaaugcauacuuuggggauucccauaucccaccaaagcuuaugcuuugaucuuuagguggaauugcuuuaugauaaaaggguucuuuuacuguucauuuuggaugauguggaugagucuuagaguuuuauucuggucuuuacaaauaugauuugcuauuuucuaaacuuaucuaaugacuaacuuaaggcuuguuaugauaagauuauaagaaaacacuuuggggaaucuugagaguuuucuuuguaauuauaauuuauaauucuguaacauagagaacaugauuaacaugaagcucuaaauguauccaauaguuuugcuuucuuaucagugaaucuaucaguauacuaguaguaacuggagaauuucaaagauaugcuuacacuuuaaacccucaauuuccagugcuucagguggguuugcacauaugacaagacaggcaaggaguaagaaggagccaguauaagaauuaaaaaggagaccgggcacggcgacuuaugccuguaauccuagcacuuugguggccgaggcgggcagaucacuugggcucaggaguucgagaccacccugggcaacauggcuaaacccugucucuacuaaaaaaaaaaaaaaaaaaauuaaccaggcguggugucgcccgccuguaauccccacugcucuggaggcugaggcaugagaauugcuugaacccaggaggcggagguggcagugagccaagauugugccacugcacuccagccugggggacacagcgagacucugucuccaaaaaaaccaauaauaauuaaaaaggacuugagugauacauuuauuaauuuggcaaauauuuauugaugauuuccuacauaucaagcugcucugcuggaagacuguaagucaaaauaggguucuugacuucauggaaugguuuccucacuucagcauuuuugaacccgaucauucuuccucgucauagcaggcuguccugugcgcuauaagaugauuagcagcaucccuggcuucugcccgugaggucagcugucuccagccuucuuggcaccgggggcugcuuucauggaacacaguuuuucugugaaccuggguggugugugggaggggggacgguuuugggaugaaacuguugcacuucagaccaucagguauuaguuagauucucaaaggaccaugcaaccuagaucccucgcaugcacaguucacaauaggguucgcacuccugugagaaucuguugccacagcugaucugauaggagguggagcucaggugguaaugcucgcucaccugcugcucaccucuugcugcguggccugguuccuaacagccaccauccgcggcccagggguggggacccugcacuugguaacagcaccuccuaucucuccaucccucagcacauuggcaguaaccaagaaugucucuauguguugccaaauguccagugaggguggggagcacaucacuacuccugguuuugaguaccacugcucacaguaaaaucaaaugcagauacaggcauucuacagcuaaucauucaguguaauuaucaacugugguaaaugcuaauuauggaaaguacagagggccaugagacuguaaccaagaaaauaaugacuccauaauaaauuuggaguucagucaaacaaaucaaaguuucccuugaguguauaguagguauuugaugucagaaaagaaacuuaagacauggucuuuuacuuuaaggauaagcuggcuguguaucuuccaaaccaguacccuguugagagugaaagcgugcucuauaauaaggaaacugggaaaauaaauagagaugaggcaaauuguacauaaucuacuuccaggcuuucauuaucuacccagagaauaagaccaguauaugaaacacacagagaauaauucaagacaguauauacauuaagcgcuaaccuaugucacauuauuagaagagaggguucauuguuacuucuccaucuuugcuuuauagaaggcuucaugggaaaagaugggauucuagcccuucaauuuaguucuggagguuugccauaaaauaucucaauguuccuauucaguuauuuuacacucuacuaccuaagccccuaaccuguucaagaguuguguuugacauagcagacaauagagaacaacuggagagucuugaugaggaauauauuaugaugaaaugguuacaacuccuagaagaaacauucauuucucuaccaaccuugaucagcauugagguacaaaagaacaguauuauacaacuaucagauguacauacugaaaggacauuucuuucuuaaaccaaauucuagaaguuuuuuauugaaaacagauuuccuagggucauuuguguguauauauaucuaaggggacauuguuggcuuguuucucuuucaauuuuuaggucaauuuugaagauacuagauuuugagaaacuauguuuaggggaaaggggaagaaacuguaggaaagugaaaaaucguacgcuuuuagguuagugcuaaucugcuuacguaggaacuuucugcauccaaauaccuugcuuuauauucccuagcuuucuuuuuaaaauguugcuuuuacuuuaauuuuuuacacugcuuaagaccccauagauuauacauuuauuuaaguucauagucauggaacuuaauuacuuuuaaaaagguuuaggcauguucuuucacuuacuccuuagaagcaguucgcauucuuuguguugccugugaaaucggauggugauauagggcuuaaauuuugaaauaugggacauuuggagaacuuaaggcaaaucaaaauggcauaacaugauggaggaagcaugaagaccuugugacugguagaaacaacaagaggauguaggaaaagacuauguauugggaaaggggguagaaacuaugccaaaauuccauuugcccacuucagaugucugcuugggacgaagucugugccugggaaaagggaugaaaacuuuaacuuccuuuccccccacacuuucaucccaagagccuagaauuagagcugauuuaaugguacuaacuaguacuguuaaacuaacuaguacuguuaauagaccuuuaugacagcauccucagaguuaacuauuuauauaauuguucucuggagcaaagcauucagaguucccagaagcuacagugaauuucacaccacuuauaaaccaagggacuaccugcaaaguguuucuguuauuuuaaaaucuaaagucuauuugaauuugaaaaaauaaaaugaaaaguugaaaauaccaaaucuaagacuuguguguaauugaaaugagguuguuuuagaaaauuaaauuuggcaagugauuaaugcuuaauaaggaguaauuguuuuaucuauuuuagggaaaaauuaauuuaacaaaccuauuauuaugugaaauuuagguaaugaacaugggcaguacauaauuuccguaacauuuauagcaucgaccacaaaaaggcugaauuagugucaucaaauacaaagaauguucauuucagaaucaaagcuguucggaaagcagugcucaugguuacuauaauuaauucaacauuucaggacuauuuaaaauuguuaugucauaucacuuuaguagauauaccuuucagaugcauauaugccugauuuuggauaaguguauuuuuuguacuuuucaguuuaaaaauuuuuuucuuaguuaaaaauguucucucauuuaaugauuuuugguuuuguaucaaaagcaaagaaacuuucaguuaucucuuaaauaauaaaacagaggucgcccaaccugcacuguuuuggacccuguauacagcauuaacccagcucaacagcuggcugugauuggcuagccaaucagaguaccaauucuguaguguccuccaccuuucccugaagcuaguagaguuuugguugagugggguauaaaugugaauagcagauuagcuaauuaaaaugguccuagauaguuguaggcuccagugcugaaguuccuggaggauaauccaaccucccuaaacucucuugauaccgaagaacucaccuggaauagcuacagccuacuuuucugucccccuccccaccuucccugcaagcucucuuccccugugggcuggguccuguuucagcucuuccaugcaugucucaggaacuguuccuguagacaaagguccauucagcacuagaaugcuuuuuccaggcugcauuucuaaaucugagucccuguguaucuuccagaucaaagugccccucuccccacaacaauggacuagauuugccagggccucauagcagaauauccugucugacucucucuucacuagacuaaggagaaaaaauaacaaaacaaaaaugaagaauuuauuuuaaaagaugaauauagcauuccccccuccccuaaaaagaaaugagcaacuauuacuuacacaaaauguagauacaacuguauuccuuguaggauuacuuauuaaagcuuucuugauacguaaaucuaaauccaagcguuuggcaugaaugucugcuucauuuaucauugccuuggauaugcuuuaaagagucugucacagcuggucuacaaauggauuuuugcacacaccaaaacuugccuuguggcaaauguuuuauaaaaguuguauagaggcuucaaauauuguucuucaugauucuuugcugcuaauuuuccagaaguccuucucuuucagagucuuuuuuuuuuugagaagcauuuaagaaaauuauguugaguuugguguaaauuagaguugugacaaauuauagagcaguuuucacaaguaaaauugggccaguuagcucagaauuagaaaauuaaucuuuuuccaaagcauuaucucacuuucuguguguuuguaguguuuauagacugauaguaucaguaccaacagcuaaaacaaaagucaguuuuuuuucuuuuaaaaaacauuauuucuuuuuaaugaacaguuauugaaguauuggccuuaauuggcuaggugugguggcucauaccuguaaucccagcacuuugggaggccgaggcgggcagaucaccggaggucaggaguuugaggucagccuggccaacacagugaaacuccgucucuacuaaaaauaccaaaauuagccaggugugauggcaggcaccuguagucccagcuacucgagaagcugaagcaggagaaucacuugaacccaggaggcagaguuugcagugaacugagauugugccacugcacuccagccugggcgacaaagggagacucugucucaaaaaaaaaaaaaaaagauuagccuuaaucaacaagcauuuacuaauaacuuaccgguaaagaguaguauauucagauuuaaaacauuuugaagaaaugcccagaaguggaggacaaaggcauugagcuugcuguccuuguaaaauaccgugugugcgugcgugcguguguguguguguguguguguguguauacgugcaugcaugugagaggggagagaaggugggagaaggaggcauacaguaguugcaaguuaacauaauagagaauuuuuaaaaccuuaggacacaucuaaagaugauacaaaauguauguuaaugcaagauaaaauuugguuuauuagggacagugaauuaugauuugaaauaauuggggcaaauuuaaccaaguaggguuaaagcauuacuuugaaggaaaggaggguauuaagcaguacauaauuuugagcuaaauucauaggcaaaucaauuucuauuuagaaacugaagcacuuucuuuauaaaagcaugacuucgccucuuuauuugcucaaguauauaugaggccauauugcauuuagccuauaugagaaggagaagaaagcagagaaggaguuaugagggagauuggaagagaauaaaaagaucacuucacuuuagaugccaagcaagagcaauuauuacagcauuauuucaggauucaaggacaacaaggccuguaaagaggccacugauaaccucauuggugacuuuguggagaucaguaguagugaugguaaauagcaaauuggcaggaguugaagagugaauggauacugaagaaauggagacaguaaucauagauuuuucuucugaguuauuuuuugauaaaaggaaagaaaauagauuacagcaagccaaagaaagaugauuuuuggaugggauguuuugagcauauucauagguugaaggaauggagucaaaauacagagggaaauucagaaagauccaagagagagauucaucauuugacauaaucaaaucuuagaugacaguaaagaugggacacaagaaagagggguuaguucuugaaaacuagaauguauaugacuuccuuuguuauaaguaaaggggguauucugaauguuugaaguagagagcugggaaguugaaguuauucacguuuaaugguuucccugcuuucuaggaaguagggauauuauaaaaugagaaagaugggguugggggagagggguuugaagagggauaaagaagauguggcaugauuccuuuagaaaacaaucaugaucaagucaacuagagaugaaugaaauaauuucccagguuugcaugaauuaugauagauuuauuugguuuaguuucgugauuuaguauagcaguacucagaagaguuccacauaaaauggauuauaucauauaccuaggauggagacugauaagauguguauaaugaaagaaaaaguggauuagaaaaauauagaaugaucagggauuccauagaaugagacaaguagaagggaacuuuucaacugagaaaauagggagagaaugaaggacuagaagugguaaggaaaaggaaggaggaaguucaguagaacugaggaaauuauaauauuagcuuaaaauauuaaaguauucaugcaacagugugugagggccugccauaugcuagguacuguucauuuguauuuacaacagaugaaguaccaaguaguacuucaauggaguugccacuagaugucacucugauucguaugguaaggcuaaccuugacacguacucaagauuggggcuuugaaagucagaccuguauaaacaggcaauuuuuaauagccuaugcagaucaauuauuauccagaaaucuuauucauauaacuaaacuacuuuugagagaauauucucaugagaacaaaaccucucaaauuugaaaacuucaaguuauuaauacuguguuugcauuauugauuuauuuuuauuaucuuaaucacacuaaauaguauuucucagugaacuuuaacauuuucugaaauucuacauuaaaguuugugaauuuauuuucuuuauauuguuuuauuuacuuaucugcugaauugguucugguuuuauagggacuaaugaauuuuuauaagcacuaauaaagcugcuucuuucuaaguggugaagauugugcaugugaacaccaaaguugugaguauaguuuuacacuguguggccuuccuaucaacuagaaggaagaacacugucuauccaacucuuguuuuuuuuuuuaagucccauucuuguuuucuguucaaucaguauagcuuugccucuuuaucuucauguugaaauaaagggucauguuuagaaagcuugucagaauuccugccuauccacaauuuuuuacaacuugguucuuucaaaacucugaacaauuuuggauagcuaugcaauauaaauauuaaaacacaaaaaaccagacacaccagcaaaccauguugauuuccacugaaucauauaaacaauacccaggcaugcuauauguuuuaaaagauauauuuauguuuguguaucuuuuaauuuuuucuucauuugacaggggaaagaugugagauuauacagcauugcuagaaccguugggccuuaguauaaaacaauuuacaggucauuaugguugaaaaagcauagcaucacauuuuuugcaugugcuaugccuagguauauuucagugcuugcuucagacaucguuucauuacugacucuuaccgauccuuguuauucauuaugguguuaaguaauuuuuagccauguuugcaagaaaccuauacuaugucuuaagugaacugucuuacauuuaucccuuuugauuuuuuuuguguuuauggauaaagucaguuuacaauaaguuuaaugugguuuucuaugguaauucccaaugugauacuaagaguuucauuugcaaagguaccuauuuacuaagcauguuguuaggugacauuuuggucuguucauugaagauaucucccuuuaaucucuucauugugucuugggaaagaagucauuuugcuuuggacaagugaacgugaacaugcugcauuuacugggcuguacuggguagaauacaaguacaagagagaaggucaguuacaacuuagcagcaauggcaauguaauuuuacuuuccccaaauuuuguugaagcagucauuaagaauuacacucuauaauaaaaaaagcaugaaaauaugaugcagaaaucuccguuaaugaaauuccucuugaaauuauccucuaauucccuuuuaauucucaaauucacuuugccguauaacuuucaaaaugaaacuucugacauuuuuguuuguucuuggaaaaaguguucauuucuuugcaguuuuacggugaaaauaauauccuauauuucuuuuuaggaauauauuccuuuguugugcuaggaacaguaaguuuauuuagauaauagccaucuacacucucuaucucuaauccccaaaggccuuaaccuccauuaggaauaaauguagauuuuuguuugcuugaaauagcuuccugggcauguaaaaaccccuuugacaucauuauuuaggggcucccauccucccaauggaaucacagccuaauacaaaaacuuugcagcuggugagcucccaaagccccuuuugaugauuguuguuaaacucagcauggcagcuugcaguuguuccuuuccuguacugccccccaccccccauguucauguucuucaugacaauaagaauucuccagagguaaaacacagggcugaaaauuucugaugucuccuucauccucuguuucuucucauucauuuccauucuaagcauauuuauaaaguuuaguggagauuaucaagggaaagauucguucucucucugucucuaauaaacuaauuucuuuaaaaacaaacaauugaauaugaaagcauugaauaugcagagguuaugagaccccucaucuuuucuguagaguauguuaguuucagguacauuagaaaucagagguccuggcugugacuuaguucaaacuuggaaguuucuuaugucauacuguguucuuuauugauaaagugaggggacaaauaacccaagcaagugguaauuaaaugauucauuaacucagugacacacuaauugaccagaaauuuucucuaaaguuuuuguucuaacuuuaacuggcuguaucaaguauaggcuuauguugguauuauuuaggggaaaaaacauuuaucacucaagauaaagcauguuuagcucauugaaauguaaagacagaauacauuuuaauagaacaauuacauaugauaugauuuagauauuaugaaaauaacaaccauaauugagaaagaucuaaaaagaccugggacugauaggcaaguuagaaauggacguuaaauuauugaaaaaaacauacggagacaaacauguuagaaaauaaaguacucccuauguuugaguuuaguaaaauaagcauuaaaauagggcuaaauggaaacagaaacaaagcaaaguaaaaaaucaucgaaugaaccugaaagaucuuuuugauuccacauagggaauuuguuuuuuugaaguuuuugauaccugcauuaaagcugaauuuuagaguuaaugcagauuuugcuacauuaauuuuuuugaaguucugaaugcauugaguuuuggaaacuauuuucaggaugaauacuacggguacugcagaugcucacuuuauauaauuaugugucuugaauuaauuaaauccaacuucaaaggcauguaucggaaauuccuuugcauaauaaaaccuccauuccuagugccagugauaaaaugagcagcagaaugguuuagcagggguguccagucuuuugacuucccugggacacauuggaagaggaauugucuugggccacacgaugagcuaaaaaaaaaucaaaauaaauccuauaauguuuuaagcucgugaauuguguugaggcgcauucaaagcuguucugggcugcauguggccugagggucacagguuggacaagcuugguuuaaagggaauagggacaaauucucauuccagagagcugaguacugacuaauaucaucuauuaccacauacuuuugugacccugggcaaaucacuuuuccuguuuuuguaaaauaaggaggauugaccaaaaucaucucuaaauccauacauguuuuuaguaugcucugaucauuuuaaaauaaauaauuuugacaucauaucucguuuucuuaaaaauugauaugcccaauacucuuauuuuauuuuugagacaggaucucccucuguugcccaggcuggagugcaguggcaugaucauagcucacugcaaccucaaccuccugggcucaaguaauccuuccaccucagccucuugaguagcugggacuguacaggugcacaccaccacgccgggcuaauuuuuaaauuuuccguagaggacgggcuuaccauauugcccaggcuggucuugaacuccugggcucaagugauccucuugccucagccuccccaccccaaaaaaauccugcuaggauuacaggccugagccacugcccccagccuacuuuuauuuuagaacugagagcuucaguaagaucauaacaggaaaauuuaaaaucucccccauuacuuguaaaagaacaucuuuuugagaaauuaaaacaauuuuuuuuuuuuaaugagccaaggacucaugaauacagugaucacaaaugagauccccucauggugaugagaauagccauuucagaaauuaccacugaacauaguaaagaauacuggaacuaauaguuggugguguaaaaugugaucaaucaagagagucuauuucuguuauguauaauaauuuuuuuuuuuuuuuuuuuuuugagacggagucucgcucugucacccaggcuggagugcaggggcgcgaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccacccgccucggccucccaaagugcugggauuacaggcgugagccaccgcgcccggccaauaauuuuuuaagguaaacuuuuucuuaaaguaugagauacauaaaagugaaagaaucauaagaauacggcucuguaaauauucaugaaguaagcacaccauguaacaccuauauuuaaaaaacaauauuaccacuaccuuauaagccuucccuuccucuacccuuacagucacuaugucccaccaagcaaacaggaugacuucuacagcauauauuaguuuugccugcuuuugaguaugaaaucauauggcggcuuuuucaaaauuuuauuugugagauuuauugauguuguuguuuguacuaacaguucauucaggcccauugcuguauuauauuuccacugcaugacuagacccuaguuuaucuguucuauuuuuggauuuguuuuguuuuuacauuuuggcuguaugucuuugggugugcauacauacacauuucuguuggcuauguaccuagaaguggggcugcuggaucauagaacgugcauauguucaacuuuuguagaugcugcuagaugcuuuccuuaaguguuuauucuuuauauuccagcagcaguuuguaaguuucauuuguucuauaucuucaccaacacuuggugauauuguugguagagaugggccucuuccuaugguugcugaggcuggucuuaaacuccuggguguaagcaauccuuccaaagugcugggauuacaggcaugacagguguagcaucaaccuuggccaguaaugugguuuuaauuuguauuccccugauaacuaaugaaguagaacucuuuuucauauauuuacuauucauuuggaguacuaaaaaaauuuuaugacacuugcauuuuaaaauauuaaacuuuccuauguuaagaagggcuguuguaaauuaguuauuuucuaaaacauuuggcauaaucauucagucuaucucuguauuugauaaguugugaaauucuuugaaaauauuuuuuuccuuaauaaaacuauguauuucaaaccauggaauugauuucaaaugcuaccuucugaguguuauuaagacuauuuauucauaguauuuuugaaaacaagacuagaaaaaaugaaguguuuuaaacaaacagugguuuuuccuuccagggaagucuucuccaggaaauuucuuugccaggauggucaagucccuuauauacaaaguuuuucuuccaggguaaaauuauuaggcauuguagaggguauaauuaaaaguugaucugccuaauuuuagguuuaccggccaauuacaaccuuaucauugaacacagaguuuggaagauucuugagcaguauuuuagagcuguuuuugagauggagaccaacuuuucuaugugcuccuacauuuucgagccuuccgugcacuuccuuuggaucuaugugacuaauuucuggccagugaauugggagugaaaauaguaugugucacuuuggccugagucaguuaagagcuaccuccuucugaccucuucuguugcaguggugaacauguacauguucuaaaguuuauguaauaagcuaguguuuguuguugcagucaauguuaaguaaccuaacagaguuucauuuucguaaauggucuacacauuaaaaaaaaaaaaagauacccuggagccccugaaguauuuuuaugcccauaauuuuuugugaggagagugcugcuuuuaaaaaagacuaggguuuggagaauauucuuaugaggagaaaucgguuuaugaugggaaaaugaaaaaggacaaacguuuguuuuaucauucuaccaaaugagaagaaaacuuucacaaaaagaaauguuuaagguuucugauuaucagaguuuuauuuauuuauugagauggagucucgcucugucgcccaggcuggagugcaguggugccgucucgacucacugcaaccuccaccuccuggguucaagugauuauccugccucagccucccaaguagcuggaauuacagacacccagcaccaugcccggcuaauuuuuguauuuuuaguagcgacgggguuucgccauauuggccaggcuggucuugaacuccugaccuuaggugaucgccugccucagcuucccaaagugcugggauuacaggugugaaccaccaugccugaccucugaguauauuuauuauuuacauaaaauccgauucuuuuuauaacauuaaaaugauuuuaacuaguuuugcuuuuuuaaaaaaauuuucaauuuagaaaggugguaacuaucagagaggcauaugacacagacauaguggccccuugguauccacaggggauugguucuaggucccuuguggauaccaaauuccaaggaugcucaagucccuuauauacaaugguguaacauuugcauauauuguucuauuguuauuuuuuacuguuuuuuuuuuuuuuuuuuaauuuucuaucuguaguuguuugaaucuguggaugagaaacucauggguucagaauggccuaucacaaacugaggauuauggaaaaauacuguaguuuacagguauuuuuuugaauacuguuaauacacagauuacucauagucuaauuggaauaaaaauauugagaaaaauaaaguccuuuucauguuuaauuucuaauucuuugcacaaaaguaauuuuuuggaaaagcuguuucuugguuucauuuuagaauucccagcaaccaaaaguaagccugaguuuguaccaagguaggaaguauuuuauguuuuaucaugucugcuagucuuguucuauuaaauuacuuaagcaacuuuuuauuauaggaaauuuggaaaugugagauguuuagcgcaaggaaaugaucuuaaauggaacaaagcugguuaagaaauugaaaugaauaaaaagcauguuaugaaaauaugcaacacucucauugaccuaauuaaaauagcuuauauaagauuauuguuggacuaugucuuauaaacuuacaagggaaaucuugauucccucucuuuaacuccuuauaguuauugccaagauuaauauucuuacauguauauuuuuacaaauauguaugauagaauggucacuguaaaaaaguucuauuuuuaaaaacauuggcaugagaaaaaggugaaugcuucuuaauaaaguauuggaauaauuauuuauuaguguuacuggaaaugggugauucagugucacuuuuuggguaauguggauuuguuuugagagagaaacagagaaacaaggaaacaaaaaucaacaaagacuaacaaaauuucugcccagaauacagguacgugcuugcaugaaacaaagguccuaucaugaaaauacuaaaagucuuugaagaacuaggcuggaguuuauacuguuaguguucuuuauugacgauauauggaacauacaguuauauaugugaugaaguuaacauuaaugauauaaauuucccagauguagggcuaacacuucuucaaaaaucagauuuccagguauuucauagcuugaacaaauauuugaugagaccccuccccugaaauuuuauacccuagaacuuaauaaacaugccuggaaauuuuauguagaugaaggauugggguuucuagaggucauggcauaagucauucuuuccuaccuggccuuuguacaauaccagauacaaaaugaagaguaaagauagaggccagaacguaccuacuaaugauaaaaguccaaguggaggucugaguuugagagccaaaugaccugcugauugaauugcagaaccaggccaacuuuuucaagcacucuucagguaauauaaauaagacagugccauagagcagggaucuuuaugguuuuuguugcaauuguagcuacucugugauugugaugcaagaaaacagccauagacaacagguaagcuaaugaguguuccaauaaaacuuuauuuagaaaaauaggcaucagccuuuuguaguuugcugaucucuugcauagaggaaaaagacacauuugcauuuucugcagccuacuaguuucaacaggaagaaaaggggcccagcagaauccugcauaccaaggauuuuuccucaccaguuuuucaccagauuaaaauacuccaucuuaccagaauuagagggaguaaagggagagaaagaaaccugaaauaauacuaaugagcucuccuuguaagaaggggggcaaacgcuuuucucacaagucccuugacacuagaauuuacucuguuacucagguauacugccuuuccaguggacucaaaagaaccuauaaaacacaaaguauuacuuuguacugcauuuuccaaacuugagagucuaaguguuuuggugcuaauuuuggcguaguuucucucauuuuuugguuagugauaguaaaaccauguaaugagcucccaggaagacccuucucuuccggccacauguguugacaugaggacaugccuuuggccuauuuugggcagcuaagauuacucuguggauugauucauauuuuuugagugccuacaaaauaugaggcauuuugauaaaugcuggggauacaauaaugagcaauagugauccaguucuuacccucacaagagcuugugcuguguaacagaaagggcucuaaaaagaaaaagugauuucuaauuugaaaccugagggacuagcagcacaugccaaaggggacaaaguucagcauguuccgggauuuggggaaagcauuguuuaucuggggaacagaguguaaggggaaaauggagauagauagcugaggcuggaaaaggaggagggagccuagguugcaaaaccuguguaagcacuuggguuuugucagaucagcaggacgugguugaggggcuuuaaagccauaagaugaugugaaugaucucuguuuuugaauauguucagucuagguuagaagaggcaaaaauugaagaccuacauuuguacuguucaacaaaguagccaugggccaaaguggcuguugagcacuugaaagguaacuagugugaugaggagugaguuuuacauuuuuguuaauuuugauuuaaaaauuuaacuuaaaauuuuaaacaauauguuuuccuuuaacuuuaguauuuugauuggacuacauuucacauaaguuauugaaaauuuagagugcgaauugaccuauauuauagguguaaaauucacacuggauuuugaguucaagauauaaaaaacaagaauguaaaauaucucaauuuuuucuaugguuauauguugaaaugaucauauuuuggauauacuugguuaaauauauuauucaguuaaauuuuacucuuucuuuuugcucuuuuauguauggcuuuuagaaaauuuaaaauuacauguaugugucacauuaugugucuuauuggacuacuccggccagauuccaguucagaggcucucauaggaaucuagaugagagaucaccaugaucugugcuaggguuguggcaaaagcauaagguuugagagugaucuaggaaauaaaacauaggauuugccauuugauuaaaugagagauggugaauucguuauaaagaaggaaaagggagccuccaagcacaaaaauacaagaaaauguaugguagcggaauggcagauucagacauguaaacaagcaaaaacaaugcauguuauuuuuuauugacaaacuaaaauaauguaguuaaaacaauauucuucuaccauuggauuuuagcauuuuuaauguuugcuuuuuaguauauacuaccuaauugcuucuuuagaguuacauaguuuugcauuucuuagauuguaacugaacacuaaauuuuacaguguguaaugguuuaccaucuuuauuuccgugucauuaucuguucauccucaacgaguacuaagugggaagugggacuggagacauuuauguauacuuuugagcacauaaauucucuaaacauuuucaaauuugauaauauaaaauuuauuuacauuuucuuuaagaugaagcuuauuccuucuuaaaagaacaaguacuuuauuuacaugugaagguuuacuagacaccucccuaaaguugaagcccuaacaguaucugaugaauguuaaacguuuaauacuuucccccauuguccuccuaagaaauaagaugcauuucuagcuucauuuuccagucucuuaagcuuaugaaaguagucgagacaguuuguugaccccaaagagaccuuuuagucucuggcuuguuagacaacagggucuguagucuucauuggcauucagaucacaggcagccacugggcucagugcaaagccaagcacagcuuuaggauuuagacaaagccacccuggcaaaggaacccaguugucaggguagcuggcuguauuguaaagaacuguugcauaauggagagaccaaguagaacuauuaggaugcaaaugugaaaaaaaugguggagcuaaccugcaaaaacaaacauuucuuuuuuggugaagagucuagucauuguugcuuucuucuguuuuaacuucucugggccagggauguagucggugcaauuugaguauauuaguuaucuucagucauaaugccauccuauauuacuuuaaaaugaacaguuaauuuguaggaagagaccacaguacuucaauguuuuggaaucuuuucauaauuuacaagugcauccuacuuuagucuagaucaauuuuauaugugauuuuuauucuagauuagaugggaaauccuuuuugcuccugauuuuauuucaucugauuuauaacaaaauauuguucuaaucauugccauccaaugacuucucccuguggauucucauaguuguccuauuuauuguagaauuuuuggcucaagaggaaagcuacugaaauccuuaaaacaagaauugcuuuauuuuacuaauaucuuaaggaagucuacccugucccuuuucuccuuuucacuuucuuuuguuuguucaucccuguauugagugcucacuuuuucuuuugcuuucuacuucuucauuaguucuuuucuuucuacuuuucaucuuucuuagcaaaacauuguagaacccacacuuugauaaaugcugugguagggaaagggaauacuaguaagaagaagaagaaggaauaacagaaggggcuccuaaccuggauuuaggagucagggaauaacaauuacacccaugccuuacugagcuguuacuacacgccaagcacuauuuuagguguuuuaccugaauuaaucucauuuaauucucauagcaaccuuaugaggaaagcgcuaucacccccauuuugcagaugaguaugaggcacagagaaauaaagugacuuguccaaacucacauuuuguguaugauagagccaagaaaggcuuucuagaaguuuugagcuugaagcugagauccgaagguagaguaagaguugccugguacacugugaauggaagcagguuaugggaagagggaccagcaaaagugugacagaaaggacucuugcaccuuucuggaagugaaaguagauuaguaggguuugagggauucugugagaaagggacuagugagaaaugaugcuggaaagauugcucuauguucagauaauuuacauauguuauuugugugugacgguucauuuauucagcaaauacuugugucuaugaaaugccaguugcauggcuguuaucuguugggaagguggaaagaaaauagcaauauagggguggcauacaucuggaugaaguuacguggacuuugagguguuuuaaaguagaugaaucuuaagcaaagucuuaguacgucuguuuuguuucaaaucagcauaugccuugacuuucucauuuuguuaggcuuccauuucuuuaucuucgaacuuaguacuugcaaggcuccuaauuucuuuaagauugcuguauaauaccauucacuucauucuuguuuugguuugccuuugaaauagcuuuaagaacaaaauaccucuauagcuguuauuuuucugacuuuuaaaccuuuauugguagggccauucuuuuuucuaauucuugcuucucauuuucuuccaggacuaugauuccuucagccuucuuuaguuccuuucuuucuaguaaauuccauuaacagugggcaucaaguacagccauuuaaggccuuuuauguuuuucuugaccccagguuuuuggaaucugaauguugauuuaucacuaagacaaugauugguaauuguaauuucuaacauugauuacucacuaugguaugugccaggcacuaugcuaauugguuuauauaaaauaaccuaagcuuuagaacaacuuucugugguagguguuaccaaauuauuaucauccaguuuucuagugaaaugggaguuucagagggauuguuauccagguuacacugauaauaaguggcagagccaggauuugaauccauguauuugacuacaaagcauauacuuuuuacccccaucucaagcuuucugucuagcacuugcauuuucuuauuuuuacagauuaaaaaaaguauguggcagaugguuuaggcuaaauauaaccaaagcuaaaugcaucucccccuaaauuacuuaccacuguacuuaauauuuauuuaggauguauuuuguguuuagcacuagcacaaggaagaauaauuuuacuuuuuaauaauauuugaaauacauacuuugaacuucaaauucauucucccauucuauuuauucuuccauggcauugucucaaauaccugucauuggcuucucuccucuacaguuugacccaucaguuggguuuacauuuguuucccacaggugauuguggugagcaugcacccacuuuugcagcuaucuaauaaaaagauggaaauaguuggacaacucauaucaacuaugagaaugacuggugaugacugauaguaagagcuggcuacucaugcuaacguuuguugcuagguauguuacaguagucucuaauaaaaaugguggaaaauguuaugagaggaaacgcaacgaaauauuuuucuggguauaaaguaauguuacaaauugcuuuugguaugaguagccaguuaaaguuucaaauaucauacuuagaugauauuuuuagaaacauguugaaaaauagucauguggugcagaaugauguuucagucaaugauggacugcauauaugacagcgaucccauaagauuauaauggaacuaaaaaauucuuauugccuagugauguaacaucauagcacaaugcauuacguuuuuauggugauggugguguaaaccaaccuauugcauugccaguuuuguacaaaaguguagcacauacaauuauauacaguacauaguacuugauaaugauaauaaaugaccguguuacugguuuauguauuuauuauacuguugucauuucagaguguacucucucugcuuuauuuucuuuuuuaaagguuaacuguaaaacagucucaugcagguccuucaggagguguuacagaagaaggcguuguuauuggagauggcagccccaugcacauuauugcccccaaaagcccuccacugggacaagauguggaggaggacaaugauauugaugauccugaccccguguaggucuaggcuaauauguauguuuauaucuaaguuuuuaacaaaaaagguaaaaaaaauuuaaguagaaaaaagcuuauggaauaaggauauaaagaaaauacuuuuguacagcuguacaguguauuugugcuuuaagcuguguuacugcaagagucaaaaagcuacaaaauuaaacaguuuaugaaguaaaaaaguuauaguaagcugaauuuauuauugaagaaagaaaaauauuuuguuauuguagccuaaguguacgguguuuaugaaguccacaguagucuacaguaauauacuagaccuucauauucacucaccagugauucacccagagucacuucuaguccuacaagccccauucgugguaagugcccuauagaggugugccacuuuuuuuuuuacccuguguacuguauuuuuacuguaccuucucuauguuuagauuugucuagauacacagauaccauuguguuagaacugcguauucaguacaguaacauguucagauuuguagccuaaaaacuagguguuucuaugauguucacucagugaggaaauugccuaaugaugcauuucucagaauguauccccaucauuaagcaaugcaugacuguaauggaguaaugugaccugguauucuuuuuccuuuuuauaguucacacuguauauuuuuaaacaauacuucaguguuucaguuuauuugugaacuuugauuugugcacucauuuacacauucauacauacauugauucacuccuucauaaauacuuuauugaugaaauauuacuuacuggaagugccagugagguacaggagauacagcaguacacagugcugaaauagucacagcccucauggacuugacaguguguuuaucauuggauuggauuuaagagaauuagcuaauuuuuuucuguugagaguucaugccauauuugacuuuuggauuuucugagauuuauauuaauacauuugaaaauuuugguuuuagaauuaggcuaaugguuacaguuguaccucaguuuauugugcuuuguuuaauugcacuuugcacauauugcauuuuguacaaauugaagguuuguggcaacucuguugagcaagucuaucugugucauuuuuuccaacagcauaugcucacuugauuagcauuuuuagcaauaauguuuuuaauuaagauacguacuuuuuaaaagacauaaugcuauugcacauuuaauagacuauaguguaguguaaauauaacuuuuauaugagcugggaaaccagaauuucauauaacuuguuuuauugccauauuuauuguagaggucuguaacugaacccaaaaggucucugagauauaacuuguauauagauuuugauuuggucacuacauauguuuaugauuguuagcuuauacuuauuggcauucugaaauuuuccuuuuuucacuuaauauuguuuuugugcucuguccgugugcaauguaguuacagcuguagcuaaagcuauugguagguuaugccuuuuagcugcuguauaguauuccauuugaauauguagcacuacuuuuuauuuauucuuuaauugauagacuuuuagaauauuuccccuuuuccucuucuagucaguuaauacuacaauaauugaggucucuuaugagucaaaacuuuaaacagcuuugaaagagagcuaucuuuugucucauuaauguaauuuuaaaauagaaguauuugaauuuugccuuuaguauuuuugauauuuggagaaaguuccaguugacuuaguuuaaauggagucuaguuugugugcuuuucauaccuuaccaguaaaaguccugaacuggucauuuuacuuggaguguaugaauuggcauagcacaguacugaacagguaaaaggaaacaaaguauaggaaagcagcuaauuauaguaauugcagcugguuucaaaguacuucuaacaguuugugcauaaugcuuacuugaaagcaucaaaugggugcuaguugugaaauagaacaccuguuuguuguugagcauguguuuaugcagaugauuguuguugucaaagcaccuugauguagaguaguccuguuuacauuuacauucuccccaaaggauuaacaguguucucucaauaaauuugcagucuauucuccucucaaaggcugcuguuuggaggguggugugaaagaggcaacaagugcuugcuaaucacuugaauauacauaauuagcugcagucuggugcacuggauucuuuguagaaccauaacaauacugauuggcaaaugcacauaacaauagaugugucaccauauaguccuugagagugcugguuguuuguucauugguauuuauuacuuauuuuucucaacaugaguuaaauuuuuauuaucaguacacaaacucuuuuccuguucuuuuaaaugaaccaguguguuauauaacaacuccgucaucacuaagaagcaguguuguaaauuucuagacuaccuagagucugaggguauuauuuaaaaacacauuugcuguauuuaguaauuccaaagauugagaaacguccagucagccaccaucucuucccuuugguaggcucagcaagggaguggagaagcuuuuuaauggaagaaagaggcagcuuuagguaugcugugguuggaaggcuguuggcaugggaaagcuggaaguguggguaucuugugugacuggucuggggaacaucuuagcuuuuucuguuugguccuugguugucauugcccaaguccugaccguucugggcucuuggcugcagagcuugugguuugccauccugcguugguugcaaagguuguggcucagaguucugugguuauacaugaucucacuguuguccauuuuauauucagccucucaguggguaguguuguuaagaugaggcgaaauuuauuuagaaaaaauauguaaaucuauaugaggaacaauauuaaguaaauaauguagauggcaugugaauaugacacaaauugugaaggugguaaaugaaauuaggaagaaaggaaaaaccguuacaugguaauuacauaugaggcauuucacugaguguuuucccauuuuauuucauuuuauccucuucaaagcucuauaaguacaauaucauaauccugaaauuauaaaugaagauucugaggguuagugaaguacauugguccaugguugcacagcuaauaaacaggagcuggaauuccaacccagagcuuacugacuugagcuuacugacuuuugacucuaaaaagaggcacaaacuauuaguuuacaaaugugaucauuccaugaacugagaucuuucagugcgucacuucuagugccuucuauuucucuucacagaacacucuuuuuggauaaagaggguuuaaaaaauaaucucucuauugauuuuuaaauagcugcgguggcuagcuuccaagucugcaacuauguacuuccuuguuucaagcuggccucacuauguguguagaggacgccuuggcuuauccuaguuacuguugcuguacugagaccauccaguaagagugacucagagcuugcccauuaccucuucuugccccuuaguucuugcuguauaucaaagcaaguguuuucuaaauucuugcagacucuuuguucucuauugccuuauuauuggugauauugcaugccauuuaucuuaaacguauggaugguagaaaacaugagcugcuacaacaacauaauauauaucuacagcaggcuauuauauauauuuuuugcuuucauuuuggcaugugguagauacuuacauauaagaguuuaugcuaugagcagaaauaaucgaaaugucacgggauccuucaggugucacucugccagccgggaaccauuguggccuguggcgccccugcuugaguuucacucacucccacugugcucguuccacccacucagcccggcaggcugcacucaguucgcccaacccggaucccacgccugaugagggcaaaccaggcucagagcacugaagggugugugagagagcuaacacaggguccggccagcugugguggggcaggcagcucugggugcuggcagaggugccggcuccuugccaggcugcagcuggagcaggcguaccacacguaguuucuggugcaggugcuggugucuggaaaagggggaugcgguggcaccuaaaaacuuggggacgccagcaacugcagagccucaaggagugggucaggcgugcucucucauucucuccacccgcggcucggcgagcagggggagcagguuucagcuuguucagucccaccaccucaccccagccggcggcucccaggcuggcccagcuccacugccacuuccugucacauggggcagcugcccaaugcaggcagaaggcaggaaggcuauaguguuacagcccuggcuugggaaauccugaugucucggcccccagaagugucacugcuuuucacuccugcaguccagcaaaugggagcaugucaccaccacaguuuggugaguuggccaggaaaguguugcagcccuuuucaugcccacuguugggugggucccgaauucugguccuuuguccaggaagaaugagguuacguggacaacuggaaggugagcaagguggagaaguuuuacugaguagcagaacagcucagcagagaggagacccaaagcgggcagcuccuaaggguaguccuuacuuaccuugaguccagcugaagcugggguuuuuaugggcucaaaauggaggaagugugugcugauuggucccugggcaggaggaagugcgugcugagugguccauggguggaccuggaaaaaacaccauuucauuggcugaaaggcguaaaggaaauucucccuccagguuguggauuccagcuagaaggagcagccagguuuucaggcuucaugcugugugugcccugaagguuggguuucacuggggaccugucccaaucugccuaggaauuugucugccuccugccacuaucacaauuuuauuucugaaauacacaaauauuuaaagcuguuaggaaggugucaguagagagacuuggaaaauacaggcaagaugaaaguaaauuauucugguaauaaagugacccauucuuauuagggaaaaugaaaaauauacauaaagaagaacacuguaaucuaucauuuauuguccagagauauuacuaauauuuuaugucuccuuaaucuuuugucuaugcacauauuuuuauuuuuaaaauacaacauuuggaauuuuauaucuugcuuuuuuucucuuaauauuaugaacguuuucccauaucauuaaggacuuuuaauagcauuuuauaauuauuuaccuaacaguucucccugaucauuagacaguuaagauagauuucagaucuuuuuuuaagguagauuuuuaugagugaaauuacuggcucaaaggauaugguuacuuucaugucucuuuauaaucuaugagguacuugauuuuuuuccuggaaaggcuguacccauuuauguucucaccauauucucaugcuuuaaacucagugcauaugcucuuauuuucacuaguauuuugaauuccacccuuuuaaucuuuucaaaaucucaaaucauuaccucucuuguauuaccagucucucccucucugcuuuaucauucacaccggcauauaaaggugcaauaguaucuuccauccuaaaaagaaaagcccccucuugacauauugcuucccauucugcuacugccucuauuucugcuucucuuuuaauaaaauuuuauugcaugguuuguccacacuggcaucuuucauauucucaccuuguaguuaauuuucugcccuaaacucuaguuuauuuggauuucuuacuccucugaagagucuaguaaaaaucauugacauccgcgugaacauuuuucucuuucuuuuucuccaucucuuaauaucauucagcacaaguagcaacucaauucuugaaacccaaccuugguuucuccuaacucauuggcucuuccuuucugaucuuguaucaguucuugauacacuaccugaugccuacuuauuggagggccaugugacuccauggaggacuccuuucccuaaggaaaaacuaaguuucccugaaguccuuuuugucucuaauaacuuuuuaccucuucugggaugucuggcauaugacucuugccuuagaguccauagacugcaaaugaguuugugcuuuuaaugacacguacuuuaaaacucauugaucuuaguuuuauuaagucuuuagauuuuugaaaauuuucuuucaagugguuauucuuugaaaucgugaagaacugacagcauaugaccagacaguuuuucuacaaaagcauugggauugccuguccuguccuaucuguucccauaaaguuuuaggugaaauacaaagguuuaugaucuaaauucacaauugcuaguaugaugcauuagcacaccauaaguucacaguacucuuugcacuauauuccugaaugauuaaaacuuacagcuggcauaguaucaagugcuggcugcccaagugucucccucacaaccuauagauagaguuuauugccugucacagaaagggaguacaccaccugguuagaacuuuggcgguuucuuggagggaagaaagcaaggauaguauguacugagaaucaaaguuugguugagguugagugaauacuggguguguguguguguuugauuaaaauuggaugaugaccauuaugcaacagcaagggauucaaaaaaucuuacauacuguuggggcuuucuauugaaucguugaugcguguuucaggaguuugcugugaugaacaaucaaaccguuugccagggugaggcucucccugaauagucaagucauguuaacguacacugugaguuguuuagggaguugauaguuuuagucuucaaguuguaugugguuucuguuaaacuauuaaugucauaggacuacaacauacuacuucaagcucuuaaaauggcuuucccuuauuuuugagagauguagcugagugcugcuuauagucaggucaauucuuauaaaacaccaacaucccucuaugccuaaauaucaaaucaguguuauaauuauuuuuuuaaacuaagauuauaucaaauuuuuuaguuugauacuuacaaaauaguuaugaugcuuuuuuuucuugguucucuuuuuuucuuugcuagaaagacuuugaacuauaaggauggagguuccuuuucugcagacuuaagaaagaggaugugaaacuuggugucaugaguucuaaauaccucaaguuauuguugcaagaauaggguuuucaguuuugcaauuucagccuauaaauuacaaugaagaguaagaguccuuauaauaauaaacuuuuggggcugggagcaguggcugacaccuguaauccuggcaauuugggaggcugaggugggaggaucauuugaggccaagaguucuagaccuuccugggcaacauagcaagacccuaucuccacaaaaagugaacaaaauuagccacgcaugguagugcaugccugaagucccagcuacuugggaggauugcuugagucaggaggucaaggcuguguugagcugagauuguaccaucgcacuccagccugggcaacagagcaagacccugucucaaucaaucaaucaaucaaucaacuaacuuacuuuugguauuguaugcugauuuaugaagguugaaccuaggauuaaauguugucuuuugucugcccuuuauuuuucuucccuuaacagaugccauguugagcugccuuguccugauuuugacccacaauguguauucagccucagcacuuauuauguagguuaggcuccuuuuaaauguuaauguuucacauuuaugcuugugugaauugcucauuuucugucauaaccuggggguauggaaggaaucuguugaagaccaaggaggugggcuuuaccacaauacugacaucucuucucagcucaggcagggagccuuggcuaggccaccuauugccacugccuaaguagaaggugauuggcagaaucuuaucugcuuugcuuugacuuuucauugccagaguuuguugaaggaugccagauguuugggaaaacaaguuucuuuuugcuuucuaucccuauucuugccaaauucuuaccuguuuuuucaugaggaugcccuggcuugcaagaaaaagcaagaaaaauaaaaacauaaguuugauucuuaauuugagcauucugacccauuuucagcuuuauauauccuugguccauuuuucuuccuguuauuuugacaacucucauggcugugggacugagugcuuguucauagauaaauguuaacuuucuuuuggguugaaaaagagaauauugguugcuaaguugagcaaccacagacugagauuuucagaaaauugacaacuucuuuugagaauuuaccuguuguaaguuauagaaacugaacuuaaauauuaccaaacaaccauauuaaauauuugccauauuuuagauuguucccugcauuaauugaguucacuuuauagguguaaaauauuuuuauauuuaguaagcagaucaaauaauauuaaccccacaacuuuuucccacacguuaaaaaacaccugacucuucauccagauaauuuuuccagauuucaccacuggaauuuacuuauacauccuuuaauaccuaaauaaucagucuuguucugauauuaucugccuuucguaaauaauugaaauggauuuggcuuacauauuggggcguggguuaaccuccaguuggaauucuaaauuuaucaaacuuaagaucuguuaaaaugcccagcaacagaauaauuaaaacagauuugaaaagaugaguagcacccaccagcauacuagacauuaauguuggagguaugaaauuccagacauuaauguuggaggcaugaaauuccagagcugccugcacuaggccuuuaugagaacuaaccuuuuaaaaaggccaguagcuuuccuagucuucuacgaagugccagauagaugagugaauguguauaaacaccuuucuguguguacuuuuuagcuauuacuuugaaaauuguaacaacauauauauugcuuauccauuuugaaucaacugugacaucuuuuagccauguauauguggcauauguauuguuuucauuaaaucgucgaaauuauauaagccaguuaccacuuuucacuaauuuuuuuuggcaaugguauuuuggaagaauuaaauauauuugaacuguauauugaaguagucaaagugaccuucaaaaggaauguaaugaucuuaaauauaauauuuuaucuuauuuaguugucacaaggaccuuauuucugugguuaugcccccgacccuuaacccuugcaaaucuccguaugcagugagcaguguuacugcuggaguauauuauucuugucucugaaguagagacacaaaaaaggcugaguucuguucuguuauucugcuagauuggucacauauuccuggagagugguguuauaauuuuuuuuccugcaucuuugcagauagcacagugcccccauggaauacuucacucacucuagucacuggugaaguccuacucaucaacccuucaaguuauagcucaaguuucaccucuuguaucuugucuucccuugucaccauuugaaaguaaacucuuccuucugaaacugucaacacuuuccagaacuuuucuuacugcccuuauugcaguuucauuucuuuuucucuuuuuuuuuuucuuuaaagacaaggcucgcucugucucugaggcuggaaugcaguggccuuaucauagcucacugcauccucaaacuccugggcucaagcuaaccucccgaguagcuagaacuacgggcaugcaucaucaugccaggcuaauuuaauuuuuuuuuuuuuuuggucuagacaaggucuugcuauguugccgaggcugguccuggacuccuggccucaagugauccuccuaccucagccucccaaaguucugggauuauaggugugagccacugugcccaacccuacuuuuguuucuuguguaccugauuuuucuucuauauuguaggauauuuuauaacaauaguugccuuuucuucaucuuuuuucccucagaaacuggaaaguauuuuguuggccagagaucugaaugauuuaagaaugauuuuaguuuaaaauucaguuuuuucucccaggagauacugagcucuuaaauuaguauuucuuaaagggagggcaauaguccaccuguauuagaacccccuuaauccuugguaaaaguguaguuuuccagaaaaugaaauuagaacuugugggucuggaucccagaagauggaugcauuuguauuaagugccaugguaagucauauuuacacaaaaacugaagauucauucccuuaaauuauuauggaaauaaauaaacauuaagauaccauaagucuuauaauguaggaaaaaauuccuuacuuuugcauuugaaaaaaauaugcuuuugaaaacuaaauuccuuauugauucucuguuuuuggucuugauuacugauuugcucaccuaauaguucucuaauguauguagguuuaaggaacuaaaaauagagauauuacugacugaacuaguuaguauguaaaguagaaaaugguacaacugcauacucaguaacggguaguuuuaccuuuuucuggauucuuuuuuuuuuuuuuccccucaauuuuucuagauuuuggccuaccuuguauuaucuuguuuguuugguguuaacuuuuucuuuugaggacugcagggaugacagucuuguuuuccucuccuguaucacacagcauuguuacaguggcucagaaaagcauuucugaauacuuugaggauuauuuauguuuguuauaaaaugaaauuuguuguuucugacucggaaaauaaggauauaaauuucauaggaaugcauuuuaaaugaaguuucuugagagagacagcuuuaacuugaauuuugcagcagcaucuaaaacgaagccaaugaaaacaccuuuuuuuccccagacagauauuacucugucucucaggcuggagugcacuggugcauuauggcucacuguauccuccacuuccugugcucaagugaucuuccaccucagacucccaaguagcuggaacugcuggcagguuccacuaugcuuggcuaauuuuuuuuuguauuuuuuguagagacaggaucucuacccaagucucaaacucauaugauguccucaagcccucccaccuuggccucccaaagugcugagauuacaugcaugaaucacagugcuuggcgucaguggaaacacuuuacucuugauugugccauuuuccauagggguugguggcuggauuguacuuucuaguugugaaaguaauggugagguaauggcuuugagucuagggaucagauccuucaaucaguaguaauauaagugagaaguauuaauaugacauagugaauuaucuauaauuucuagagaacauuuaacuugcauucuuagaucuggagauggaggaccgguugauucagacuacauuggcuucaaagugauaaauucuauauucaccucuacuaggacauauagaaaaagaaaauagcuuugaaaguauggcucuuucuuucuucuuuuucugaauagugacaggcaucuaugaauagugaugaauucaggaaaacuccuaggcuagacguuaucuugacaguugguggacagaugcuccugauuugagugugagacugagguauucagaaagcacuucaaaacacucuccuaugccagcuaacauuauuuucguuauauugugauugaguuuuuaguugcuuuguaauaaucccucagauaaagggccuggugugagcugggaaaaauguuuaugauuuauuuugagcauaacagcauauagucauuuuuauaaauuguuuuucagaccuuauuauuacuuguaaacuaauguauuaaaacacauauuaacauauuaacaauuucacauugaacauuuuaaaugaaaauaauaaauguuaauguuuaaaugaaaaguggccuugauaauuuugaaaaugggugcccagacuuacugcauuucuugagaaagauuaauugcuuccuagacaggguucuuacggugauaguuguuuuuacauugcucaugucuaauauaauauuugagguauaauuugccaugguauuucuuuuucugaguuaguugauguuuuauugaagacaugaaucauuaugugauucucuccauuuaggaaaaaauuuuccaucuuuuucaguggggauugggcaggucauucucauccaggguucucuaguuuagaauuuguucuucuuagucugaaggaaguuguugacuuuuuauguguauuauaagggccuucuuuaacuucgugcuuuggucugggggugugaugauuacuagaaauggugaaguuaugugaugggggaaaugccuuuuauaaaacaaauuuuggcaauuauguuguuuuccccuuagcauuuuauucauaugcauguacucagaagcaugcacagaauauuuagacauguuaacauuuagauggagcugcuuugauggaacuuuauauuauagaguaaauuuagguuguugcuauuuuaauguauaucuuuuucucugaaguuuuauaguauaauguuucuuuuuuaugauaaccaguucaaauguaagcauaauauaauaaaaccuuaagcucgcagucuaguccuugcaacacgaauauauauagcagaugugucaaaauauaugaauuguucuuaauguuaaacuuuuguucgugagaauaacguaacaccugcugugaccugcuaagcuguguaaauuuuaaugacuguaaaacugaaauguauucauagccaaaauguguuuggaaauuauuuggaaugucuuaugcuuggcuccuuuagagauuuuguuauauaauauguagaaauuuaaaucugcuauaaaaguugaaaauuauuauaacgucuauguuacuuaaaaguuaucuagaaaauuauaauaccuagguuacuuauaucuuuucuuaaaaaaguuaucuguaggguaaucucaccucugaugugccuugccuggaagcaacaggaguguuaucuaauacuacacaaauuuguuuccuuuuagcaguggcauucuuuuaauucuacaaauauuuugauaccuucuaaaaguagguaggauuacauuggcauaguaaauuucccaggguuauuaacuccuuuuucucuccauuauguaaaaaauaguaagaaaauauaagaauuauaaggguacuacuaguuuauauuugguaguauaguaguggaaagggaaugaucccuuuccuccccaucauaaggguuauggccaacacuccuauaacaaaauacagaguaauaagagaaaagcauaacaaaucuguuuaauuauaguuuuacaugacacaggagccuucagagugaagaccccaaacauaugggacaacuauccauuuuucagugcuuagguucagugaaaaauggacagcuauguagaaauaggacuggacaaaaagguuaugaucuaauauuaauagacugcauauaaaaacucaccaagaccugucuguucagauucuucuuggccucucucuuguaauguuucuuccucccagguaugggacaggaccccucugaugagggucuuaugaccuauauuauugggacaaggguaggucagagaauuucuagacagaauuucugucuaggccaguuccuagacagaaaggugaggggaagguuagaguaguaauuguaguuuuuauggcuggcuuuggagaagagagaucuagucuuuauuaucugcuuuggugaggaggaauucuggugucuguacuugcuuugggggagaaugaggggcaagagacaggagggcaggagaagaugagagagauccagguucugaggcugcuucugauaccuuccagugcaaaguacuuugugugcugaagugccauauuuuggaguauuguuuucugagcuccagcauuagcccuauuugccaguagaauaugguguggcaaguacuuuaaaagaaugcuuuacaugcuuauuuucucaagaguauauaccgugagcuuuucggaauaguuggaccaucugggaauacguaaaaaauaaaaggaaaaggacaagagauuauugcauuuugauuggcuccaaauuguauuaacccuuaauauuuaucuacuuuauaauuuuaagauacuaauauuugaggagaucucuuuauucgaauuacugguuuaagauaauauuaugauauuaacaagucucuuuuuuucuccucacaucuuuuagaccagagcagacaggccaagucaggcugagauccuauuuaugauaaaaaucauagaacucuauguaguauugauaaaacacaugaagauuauauuauacuuagcuuuuaauuauauuuugacauuugcucauguuugauuuagaacuuuuuuuuuuuuuuuuuuuuuuacuaugucuuuuggucucaucaaaaagauuuuaagauccuuuuuauuuuggcaaaaauauauguaacaugaaauuuaccauuuuaaccauuuuuaaccauuuuuauuuuuauuuuauuuuuaauuuuuuuugaguuugaguuuuguucuuguugcccaggcuggagugcaauggcacggucuuggcucacugcacccucaccuccuggguucaagugauucuccugccucagccucccgaguugcugggauuacaggcaugugccaccauucuccgggcaauuuuguauuuuuaguagagauggggucaggcuggucuugaccuccugaucucaggugaucugcccaccacagccuuccagagugcugggauuacaggugugaggcaccgcgcccggccaccauuuuuagauauacaguugcuuucauuucuuaugucucucucuuaacaccaagguuauuaaguaaguauuuaagaacauacaagagauguucaguguagcagagauuggccaaauccguuugcgcguaauacaccuacucugcccuagcaccaaucuagacuguuuuuugcagcugucuuggaguuagguguggccauacgacugaguucuggccacucacaugugagcagaauuaacgcaugccuccucuaggcuugggucaugaacaucuguguucaguguucuuucucucuucccuucugauggcagucaugaaaccaaggagauggaagagccucuaaaagggaggauucuagguccuucagucacugccauugaaaggaaacauuguuuugaccuuacaugagccagaaacaaaacuuucauuguaguaaagcacuaaguugucaugauuuaccucucucagcagccagcauuaccuucacugauacacucaacagugauuugaguauguaauuuaguuuacucaaaauauacuucucauuucuuagcaauuggaauugguagucaggaaaacuaaaguugaacugaggagugagaaauuggggugugacuccaguuggaggaagacuugguguggaacucgaugagaugaauaaaagauagaacaauuuggaauguuuuguuagggaauugauacaaaaaacuuaaaguuagcagagaguuaugugaauaaauuagaguaauuuugggaguuguaggaguaggggggcauuaugaaauaagaaaagucucugagaguugggauaggauuuaaacacuaucgguuuuuuuaaaaaggaauuuugccacauuccacaugcagcuugcaaauguuuuugcaaugacugucuugacauaugugauacucagaaaaagguggaauguuuaaaugaauagaacugcauaccuuauauaucuuguuugcugggaguuagauucauuacuugaauaauuucccuaaugagucauucccuuaggggaauuaucccuaagggaauuauccccuuagggaaugacuuaucccaugaaaauaauuggauuauggcuuguuuugugcauauaugaaauccaguuuguuggacuucuacaacaccuaaauauaggugaaauuuaccuuguguuuuggacaugcaaaauauuggauagaauauuuaaaaagaaaaaauucaucaauucauuuugcuagcauuuacucuucauaauugaagcugaggcugggugcgguggcucaugccuguaaucccagcacuuugggaggccgaggcgggcagaucacgaggucaggagaucgagaccauccuggcuaacacggugaaaccccgucucuacugaaaaaaaaaauacaaaaaagaaaauuauccaggcgugguggugagggccuguaaucccagcuguaaggguagcagccucgggaggcugaggcaggagaaucacuugaauccaggaggcagagaucgcagugagccaagaucaugccacugcacuccagccuuggcgacagagagagacugucugaaaaaaaacaaaacaaaacaguagauagguaaaauguuuguggcuuuagauagcuuuuuuuuaaaaaaaacuuuaaagugaagauuuaauaauuauaaauuaaaaauacacuacaugacucacuugauguuuccaauuuucaucuccuauguaaguaacgauacagagaaugcauacaaucguuggcuuguggacauccauguccccaguuguguguauguuggaaaugguuauaagacauggggauuuucuuaccuccuguucauaauugcuucagcuacagaucagauucccuucuaaacaaaugguaagagaccaccucagcugagccuugggugguguuuuaggagcaauugcuacucuacuugaaaaggaaagguccucuguuuucuuaugcauagcauccaauguaaaaugaauguagcucucuucuuugaccuuacucuuauuugcauacuuuaauggguguaaucauagaaauguugcauauucagcauaacuggauucuaacuuauaauuuauuuuaaaaauaaaaguacuguuaaaaggaauuugagauuccaggauuucuuacaaguauaauguacaauguauguuuuaugaucgaaauuagcuggacuugaagucaaaagaacuaguucaauaacaugugucuuaacuugaaaucuugguuuccuaaucuguaaaaucaccaauauacuagaaucuugguguuaaaaguaaccuauggggcaguuugauaccaccuuuaacucagaacucaaauuucuuuuauaacaucuuugauauguggccguccaaugauagggugcucagugucucauucuuuaaucaggugcuuauagcuuugaaacucuugagcauagaauacugaugguaauauuaauaucugacuugucucucauaugaaguaaggagaaugaaagcaaauauuaaaguagcaaguaguaguuauacagugcuuuuuuaacuaaugacaugugggaacuaguuaccauuuguauuaauaauuuuuuaaaaugauaaacuaaauuuuaaaucucugacaaugaccauuggaacccagccuguuuaucagguggagucugccagugcuuccaguauuuuugauacuaccuaguccuugaaaauuaaaaaucuugacccacaauuuaaaagccacuggguaugacucuugggaagacauuucgauuaccuaguauacuaaaagacuuuaauacaaauugaaauuauauggaaguuacuuaaacauuucuaaaguaacacuaaaccacauucuuuaauguauuaugugucauggguagcauugccuggaagagguagcagcaagcugaguuuaugaaggaaaaaaacuucugagugagcuaaggagcugguggguagaguguggaagauggagcagacagacugagauccauccaggccugggaggggaaugggagagagaccagggacagaagccagacuugacacaaucccugaagaagauaaaagaaagugauuuaaucaccuuccagaucuuacuugcaaaagggcuaccuguauucuuuggaugaaguguuaguauuauuagaaugacccauuuuuacuuguguuagcuucaguggaucuuuguuccuuguaacugaaagaguucuaauagagcacuaagguuaaagacaaguaucagggguaaauauuuggcugaggccugcuucugaauacuauucuagacaugaccucuccucuuuucguucuuuuuuccacaacaucauuauaaaauaugaaguaauccuuuuuaauuucuugucuuucugaauuuaaaauucuauguuagguauucucauugcuugauuuguguuuauuauagaaaugaagaguuuguuuuaaacuaugcauuacucgaauuucugcugaggaaguccauauccauauguuagguuuuuugcaucccaaagucuuggauuagguuuugccaucauuguuaguguaucaauagaccacugcauuauuuucuuagugguaugucagucuuugacuuaauauuugcaaguauuuaauaauaccccauacauuauaaauuaaauuguauuugguaccugcuagaucuuaugagaaauuauucacauuuaauaagaaaacagcaacuuguuacuuuuguggcagauaugagcucuuaaaagaugcaacguagguaaauaaaaaugagaauguuuaccagacccacuaggaucauuugguucuguaauucuuauuuaugaacauuuucuuacagcuuuguucuaauuuaauuaucccuauuccccuuuagguaaaggauaucagaauugugauuauaugaagaagaauucuucuuaaaaaucauguauucuuggcaaauauuucuuauuagaagcuuuuaaaacagucuuaauuuuuccuuacagacaaauuuuucugcaguguugucauugauauaaucaaaaugguuucagguaguucagaaauuguugacagacuuaacuaagaaaaacuuuugaucaaaugguguaacaacaccuuuccuggacaaagccaucauuauucuguuaaauuuucagaucuuauauucacaucccauuuacccuaaguauuaucacuaaauggaguauucaguguacacacauauccucaacuugauuuuccuaaauggaaacaauuuuuuuuucuccacuaagaauggcuuuuuauucauaugugauaaaaagauaagucauuugguaacaccuuugaaccuguuuucaaaauaaugaaaaguuucucuucuaaaaauacuuuuuuucuuucccucguuuauuuaacaagaagaguuauuauguaauguuuuucugcagauuuuuagaaaaagaaugaucucucuccacuuuguagagaaugaucccauuuuuuguuuaacaccagauaguaucaugacauuguuaauacaguaggauucacccaguuugaaaguaugcagaaucagacuucuguuguuggucacauauuucucaaucaaaacaucugucuaugucgaaaccaaagucggcccaguauaaugaacuuuuaagacccauguuaauauuuaaaaauauuugguaaacuguaaagcaguauacaaaagugaauauuuuuauccaagguguaaauuggucauauggcccaauaccaguagcauaaagggaagccacuauacuaguagugggugaccaaguuuauuucuguuaagccaaaauggagauuuauuguagaaaauuauuagugguacuuucuggaugaagccauuccuucuuaauguaauuaugcccaauuuccuggguggagucacagucuuucuucuaaagacagauuacuucaagcuuuaguagggacucuuaguucugucuugaacuaacaauaccuuaaaauauucugcuucuucauguccccaaaauauugaucagaaggauacuuguggucaaauggaugcuguagaaauucaaaccagugauuuuacuccacuugaaauuuaaaggauucauaugaguucuaguugaguaugucaguuuuagaacauaguuuauauugaguaaacacagaauauuuuaccuaaaagggucacacagaugucauuacagugaauuuacuucugauuaaacuaaucuuguucccuauauauuuugauauauauugugccaugauaaccaguguacuauuaguguuauuaaagucuuucuucaaauaguagauuuuuauagaauuuugaaguagacaaaauaagucaauuuauguuuagauuuaaaaaaaaugugaaagcuuuucuauauucuccuccccgugccagauaggugcuuggcacagaguacuuaauaacuauuuaauaaaugacagaauuucuuuuccuaaaauuuuuaggacauaugcaaggaaauuucucuugcaucuagguuuacugauguauaugaggaagaguuacaucugcuucagugaaauacaaaauuaaaccaggugaucuuucugaaaaauuauucuuauggugacauaucagaaaucuuaucaacagcuauaguuuauucuguuggaauuuucaaaauacacugugccuuaacuuagaaacacuccaaugaacuuguauucauuaguguuuuguugaguuaaagaaaaaauaucuguacaaaguggacacauuguuuaauuuuguuuugcauuuuacuagauugcagugcaaggccaauaaauuaaaccuaggcaguucucuugcuaauuacacacaacuuaucuugaguaucagauauucaaauccauuuuaugaauaugguagagagaauaacaacuguaaaacaaagcagugugcauguaagugacuguuagcgugcauuucagaaaggauaaaugcucaccauaugguacaauuacuguguccaaguuuucaaauuagcuucucucauccuccuuauuacugucuuuaaaaagagaggaaaaaacccaacaugauuuaucuacucugcagcagaacucuugacgcaaaacagcagcccaguucuguccaguuuuuuuuucccuuagcauaauagaggcugucggacuuuuuuauacuaauuacugugugagccucagaugaacccccuucaauucacagggcuuuguuaagggaggagcugucaaugugucugcccguuugcagcugugcuguggcuuuagcuugcuuaacauuaugcugcuuuuuagacuugacagaagggauuuuuuuuuuuuuuuuuuuuuuuuuuuuauuaaggcaaagcagccuuguagcgaaaugguuuaagcagcugcauuguagggaagcacaaagaaguuauuauugugucuguuuagggggguaggauggagggggagauauucggcugcuguugaugccgauuguugacuugccaucugccagauagggagaagaaaaaaaugacagcuccagcaggguguucaagagguuguuuggagagacgcauaaacaugugcagaugucgaacugaauaauggcuagaacuugagacgguuuaugaugcugcugauguuugugcauauacagaaugaauguauguguggauuugguuaaccaaggguacauacuaauuaucauuguuuuccugcauccccccucccuuauuucguuaauuaguuuagggguuuaauacuuccucuucucucccuuauucaugucuaguuuuagaaagcaacuucuuuaaauggcaauacaaaguuucuuauuucuccguguugaugguagauaaccuguuuggcuaauguuagguguguacugcuaacugccaagaggagcuuuugaugaaggaaucagucaggugauuuggugugaucuuaaugcauacaugaacguuuuaacacuagucggcacauaaacuauuuuaaacugaaucgauuuguuucauagccuaccacuaggggugagguagagaguacccaguuuauuuuguaaguaauuccauaauacuuugaacuuaaaugucguuaguugugaaacaaaguuauauaguaaccuggccuuuuugaucaguacauacucuuuuucucaugguugucauggauucuauaaaugacaagcgugcauuuuuaucaagcauuaaugaguugguuguauauuuccuucugauacauucuugacauuagguguuagagauuugauauaucuggaauguuuucaaaugcugugauaacauuuauauuuagauggaagugagcauguuuacuuaaaugucugguuuauuacuuucaccuuaaauaauugagaagaaacagugaccuuagguaaaaauuuuccauauuacuuauuuucuagaacaccaaaaauuuuuguaacauuucagaaccaaucaauaugaauggaauaacuagaaaacaaaaaagagaagcucugacuuuucuccuuuuuucuuuuuuccgcccaauguggacuuaacauuucaaaaaaaaauauguguggagaauuaaaaagugcuuauguugacuuuuggaacucaugccuuccuaaaacauuuaagguuuuguugcauaauuaucaagcagaaauugcccaaagcaugguugaaaggccaacguacugacagagcuucguguccagaguaaugucuuucugaaagaauuaaaggaagguuaucuguuauuuucugcuuuucauaaagaaauagaggucaggucuaucuagaaaaaacuuucucucucaccgucaguuuuuacucaagugacucuaauccguguuugcugaaaaggcauagaaaaucaucagccaccuugacuuuuccuuugucucauguauuuauuucuuuuauauagguggccgugaauauauccauauuuguguguaggauuauguccauguauuuacaguuucauagucaauccuaauaucccuaccaaguuuggaggcgagcaguaugccauuuuuuaaguagaagguguuuguuauuaaagugagaggguaugguuugucaguggucaggauauuaaugagugacugggaaaagcaagcuuauaccaacuuuuauacacaagcaaacuugcaggucuaugcuuuauuaaugauauguuacuucugauucuuucagagccauuugcuaaaucuuaguaguacaggcaaguauacauauuaaggugauugaaauauuaaaggcagaaugucuuugaaguuacaaagaccagauuuaaauaucacuuaacuuagaugagugaauuuacucauagucacuuaaacuauuuaaaugugaauuucuucaucuuuugaaagaaggaaacaauacuugcuauucaaggaucuugugaaaacaaaaugagauaauauauuuagaaugucuugaaugaauucaguaguagcuguuaguauuuuuauuagguguuaugugcaagucuagagcucuguagcuauuacaauuggaguauuuauauaaugcucugacuaucauagaauaagaauaccaagcuguagaggcuguuugagagaauggucacagauagaagguuguuucuuggaaccuuauguuuauuuagggauauaugauuguuuuauaaauguggagggaaauaaauuauuuaaagaaaauauaaagaaaacaguuggauaaaaguauuucggauguaugguauuagugguuauuuagugaugaugauuucaaauuuuguucuuuuguuuguuuguuuuugagauggagucucacuccgucacccaggcuggagugcaauggcauggucugagcucccugcaaccuccaccuccuggguucaaggguuucaagcgauucuccugccucagccucccgaguagcugggacuacaggcacgugccaccacaccuggcuaauuuuuguauuuuuaguagagacgggguuucacuuuguuggccaggcuugucuguaacuccugaccuugugaaccacccgccuuggccucccaaagugcugggauuacaggcgugagccacugugccuggccagcugauuucacauuuuguucuacaaaauuauuuuucauacuuaaaaaaguaaccucaguuuauuuuggagcugaacuuuucucugcuacggccaguacuuaagcuguauuuggguuauuaucuuuaaaaugagacuuuggaacaccuagcuaaaaauaauauuucuucuccucauggagguuuaaagcauuauuugauugucacaacucuuuauuuugcagaugaagaaacuaauuaagcucacauagggaugaaagugcugagauaagcagaaguguuuucuuagagaaguaaagaggauauggcuuuggucgacaugaggaagucaguaaaccuaaaaguaugauuaauucccauacagauguagguggugguucuuuacauuuuucuuuucaaauuguuuucauccggcauuccacgcuaguaaauauuacugaauaauuuuggaugaugagucaaggguuguuguaccugggagagccaccuaauuuaguauuuaagagucuuucauaggacgggguauagugacuaagaacuucuauuuugguuuaaaagaauaaauugguuacacuagaaaaauaacgcucacuuuugaauggagugcuaguagcuucauauaaggauauuuuaauguuuaauggcacauggugauggaugccaguauuucuagacagauaguuaaguguuacagucuaaauuuauaaacaaauaauuuuuguuguuuuuuauaaaaaacaacuuacaguaccaaagaaguggaaauauccauagccuaugaaauauaucacaaaugaggaugaaacuguaaggacauuuucacaaauaaaugaaaccguacuugguauauuuucaggauaauucagaaaacuucagaaacuucuagcuuuaauguauauuugaauugugccucaucaaaauacugcaugaauagcaauuuuuaaaaauauuggccaguauguugaaaacagaguauuucacugucugacauauuguuuaaggcaucuugcuaaauguuuuggcuuaaauuuuuuaauguguuuuaguucaaaaaaaucugauuaaagauguggguaaacgugguagcacuuuuuagaacagaagaugauuaagauacaaaggcaggaaaagcauaaaucgugaaguuugucuauuuuuuuggccaagcaagucacuuauuugcuugagacuggaacacagcaucaaaguucauaauuuuauacuucuaaggaagaacgcauagaacagcaguuguuguuuccuggcaucuuuuugaagagauauuuaaacguaaguauauauauuuauuauagaaaagaauuuuauaaaaugaccuucauucccuucccugaauuuguaguauguucaacuguuaagcuaguuccuuuuaccuuuugauuuaguaaagaaggauuuuaaauagaauuuaaauuuuuaugaucuuaaaauauccaugauauuauauacuuuaaaaagaauaagacuguuuaguaguucaaauuuuaaaaaucuaauuuauucaaaguuaugcuaaauaauggcauaguuccugaguggagaacuacuauacuuugaauuauagaagcaaggacuuuuuugaaaaaguaaauacaaaaccuaaauaaaacacauuuuuacuaaauggcaaucagugucauccacgugagaucuugcugugucaaaguaaauuugcuguuuaccugcuuguaauaauuuuuaucuuccuucaauagaagcucuuuuuuuuuuucuuuuaaugcuagguuuuguuuuuuuuuuucuauaugggagaaguggugggaccuggaaaguuggauaguuacuaauuaacuuguauguaaaacucugacauaaagauuagcacuuuuuauauucuuaaaguaaaggucuaucauaccacuggauuauauaggguaaguuacucaguguuuuguauauaaaaaaaaaacuuugauaagugaaugcuagaaaacuuuuccuuucugugaaauagcaaaaggaauaaaacacccaguguacauugauugacuuagauucuagaauggauaauccuuaugcuauguaaagauucuuaguguaagaaucaguuaugaaaacucagugagugcuucaacuccacauugccaauuugucauuugcauuauauuucauuaauaaaugagugauuuguaacaaacgaguguauugguauuggcugcuuuuaagaagacacuuuggaacugaauuguuauccuccucaaauuacuuugucuuuacugaaagauuguauauuuagauguccugcaguuuuuaaaaacaaauuauucuacagagagcaaaacaggaacuuagauuauuuaugcaauguaaaauucuuauauacuuuuuuauuuuauuguauuuuggaugacuucagugauacugaugauuccaugcauuuuccuuccugaugccuugguuuuaagaaaaucuuuccuuucaaagucacuggaaacauuugaaaacagcauuauuaugcuuacugagguacagauaaugaugaggaaagaaauauguacguauaaugagcaaauaugcccauuucauuuuaagaaauuuguuuuuauuaguaugauagguaaagauuguuuucugaaauuucuauguguuagguaauacugcccucagagggccaagguaaguaaauucauuuuuaacauugagaagcagcuuuucuauuuauauuaucuauaagcuuucuuuggggaguacucaaaauuauuuauuugaguaauugaauaguguuugauuugugguugcauuucuuugauuuguuguguucuuuuaaaauguuugugcccuucaauucgacgauaucauuuaaacauguucaguucuagucuaagaaaauguuaacaugacuggccauaaauugucaaauuagauggguucauagagaguauaagaaaauuaccuggaaaaguuaagaugauuuuacuuggcgggugcguuuuaguuuuugugucuuugauagcagauauucuaguauucaaaauuauuugaagccacacuuuuuaauauagagcaguauucauuaaaauggaagcauagauucccuucaguuuuaaaaacuuaagcauaaucacaucuuucaaauauaauaugaaucaagaguaauuuacuuugcuguauaugcaguggcuauguauaaauauacuagaaguugaaauacacuuauuccugugcacuuauaaaagcauacguuuuuaaaguagagguaaagaccugauauugaugugugacuuaacacuucuuugaauucagaauauuggggauuagaugaugauuaauuuuuguaauaagaaaggaagaguggggaaggccugaugucaaaauaaugagguguucagcaucaugcuguauauccauguaacaaaccugcacauguaccuucugaaucuaaaauuaaaaaaacccagaauaaugaguuguguccuuuuuucuuuuuguauggaguaacuuucuuauaauuugaaagaaacauugcaauguuuaguaguaaauucaguggaaggcuuuugauuuuuuugcccuauaguuaguuguuauugaauuaagaaagaugauuucugugacaguugguauugucagucuuucacuagagauuucaaugaguuaaacauaagcgacacucaguucauuauucuuaguaaugagggaugaagacaggacauaagcaaagugaauaacaaaaauagaaauuuuauccacaaaaaaucaauaccuccuuugcucagcuaaugugcaauagugauagucuagacaaauuaaagaaauuccauuuuauuuuaaacacucuaguuacuuuuguguagucuaacauauuguacauauuagguacucacuaaaucuccuuugauugguuuccuuagccuuacucugagauguuuuauucaguuaacaaaugcuuacauaaugcuugcagugagcuagauguuguucuacaugcuuuacaaacuuuaauuuauuucuccauuauuauuguccccauuuuccagaagaggaagcugagacccagagagauuaaacagcauucacugucucucacacagcuagugagugacagaacuggcauuugaacccaggcaguccagcuugagagugugcgcucccaaccacucuuugaaucuuaacucuguccuuuacuagcuugucccagugucucagagccucagcauggcucucugugaaaagugagaauacugcagcaccagucucaguguugcugugaagagggcucuguaagugaagccugagcacagugccuggcugaggacauucauguuuccuuuucuuccuugcucuuaccucuucuuccuuucaccacuuaacaugcugugguacaagacucaaucaguacauugucuaaggagaacaaaggagggaagagaggaguuaugaagggcauggauucauccucagaauaguggagcucucgguuugaugcagugccauuuuaggguccauacuacuagacuuuucuuagaggaaaaacuccuugguaagagucuaagauaaaguccuauuaguuuuuauucuguagagcauugauguuaguauaggagugggauggguggguugaaccaccugagaguuuuuucagauggcacagaccaccuccugaugagcaagcacuacagccugccuucucugcaaacucccaguuagugcuguagugaggcaccauuauuguuauuugucauauccaucaggcauguucuaacagaaaaguggauugaaccauacgagguuguguuauagagagacuucucuguuugagagagcuuuucugacaggaguauagucuuuauuucaaauggugguagguuuauuuagucauugaauuaaugguuauugcccaccucugugguaguuucuugcguuauggacucacugcuuccauauuugguauucauuaagguuauuuacugcaguguauaugccauguaugauauuauauuuagauaauauaaggugguaaaaugggaaauauuuacaauaaggaaguuuuaaaguuucugaugaaauuauauuuuuaaauuggucuauauuuauaauaguuuaaaauucuaugacuacuuuuugaaaauggugcaagaaugacuuuguguuaaauccgguguguggaacuggaaacucugcucuaaugcaguaaacagauuuuuaaaaagaaagcucugcuuucacagccuacaagggugcagauguaagcaaaauaauaacuuagcucacacuuaacccagcaggaggcugcguacagauugaguaauucuccacaacauaccuacugcuauguaaacuaaagucaccguuuauucuucauuaaauugccaggaugcuuucuguuggcuaguccguguggaugcuuuguucucugugucuccacccaaugccccugugccuuccuuacucaccuugcuuuucucuuagaguaaaacuggguacuguaacucuauuaagauguuauuguguuuaagagaauaauuuaaaagcaucacuuugguuaaaaauguaauguuuccuaaaaacaaguggaacaaggauuugauuagucaauuuaccgaauaucaugaaacaaauaccagaauacuuaaggguagaugauaauuaugcaguuuucuggaaaacaaaagaaaauuguaaagcagauaaaaguacuaacaaaccaaccauacugagaucuuagagaaguugccauucuaacaucuugugguugguauucaaugcauagguauuuuucucaucaucucaucagcuucaaagcaaaacauggaccccagcuuucuuuaggaagccgauaugaaaacuauacuucauaauauugcuucucggacuuuuggcuaagaugaagugaaaacuguacuuaauguaaaaaugacaaguucaugcauuaugcauuagaaugagaguuucuugacuauaauauacuuuucaaaauaaucaugagggaacauauguggcaaagcagaggaauguggguacaucuggaaagccuuuaagacaucucggaagcacaacacaaaaucacgaaaauuguaaacaccuuccguguggccagcugcaguggcaacauugaccaguccaagagcagacaaacaucucagugacccagaguuuaccgggugaaauaaccauaaagagaaauucagguguuuaaaaaucugaccuuauuaaucaauauuaugcagaaaucagugagaaagacaagaaugggcaauaaucuuaaaaccugaaacguaaagauguguuauuuauuauucuagaugaaaggguaguaaagcuauugccuugcuuuugcuuguguuauugugaggcuucaaggaggaaugcaggaugaugcagugccucaucuuggaaucaacauagcagcaaaucgaagaauccuacgcugauauucuucccagucccuuccccacaguuagacgucaaaccaacaaauaucaucgacuaccuuuuucugaauccacaugagaugcuauuuagaaaugccaaagaauaggggcuauugccauccccaguaugacauucuggaucacuaagaaugguuaaagaaaugggagaaauuuucacuuaaaauuuuaauuagucaacucauccccuuuucuucuccaccucucacagcugccuacuagacuuaaagcuccacgagggcugggacuaugcuuguaucauuuauuaaagcuccaugagggcugggacuaugcuuguaucauuuauugcugccuucuuaguacuuguacauauuuugacacucaccgaguauuuuugauugaauaacuguuagcccguuuuucuuaaaucuaaguaaagauguuuaaaguggcuuuuuugaucuagguggucuugagcagcagcaccuuaaaaugagugagcugggcaggaguucauaaugcuuagacauugcucaauuuucacagacuaucaacacacauccaaagcugguugaugacaaguggucaaagacauugcauagacaucagaauagaauuuaacacuuuucaguugccugagggcaaggaaagaacauguuucaagacucaauaaaagauaaaugauaaccuaaaaauucagguuuuuaggaguuggaaaaucuaaucaauauauguauuuaauaaguaccuauaauaugcaaaaucacuuuaaaaaguuacauuucauauugucccugugcaguugaaaacuuacgcuaguuuauugcaauguagauaauaugaacaaaauucuucaggauauuuuucuuuuucuuuuuuuuuuuuuuuuuugagauggagucuugcuguguugcugagauuggagugcaguggugcaaucucggcucacugcaaccucccgcuuccuggguucaaacaauucuccugccucagccucccgaguagcugggauuauaagggccccgccaccacgcccggcuaauuuuuauauuuuuaguagagacggucuugccauguuggccaggcuggucucugacuccuggccucaagugauccgccugccucagccucccaaagugcugggauuacaggagugagcaaccacgccuggcccaggauuauuuuuaagacaucaauaaaacaugguuaugauaaguugagugagaagcacauuucuuugauucucuaagagacaugaauaggcuuccacucagaacuaauuguacuccucuguauaaaacuguaaucaguaauuuuaaauacugcaaaugucuuauuauauuuauugucaugcauuucuucagcaacuauaauugauuacugauauuuaagauguaucacauaauuauggacuauacaguauuuuuugugcuaauauuuauuuaugaaauccauuaguagaaaagauuuugccauauucuuuuagguaguucauaugugaaaauuuggugucugucaacaggcaacuaaauauuuacuacauugugaaugaugaaauuaaauagauuuuaugcugaaauuaacauuguaucuguuuuugucuuagguaaaaauuggcucaugaagacuuuuauuuaaggaguauugccaaagauaguuucuugaagcauguacauuuauuuuuacugaaaacugccuuuuucugguuuaaagcugcucuuugaaaauucauaaaauguuuauauuuuuaugguacuguacauuuguguguaucauuuauaaaaauucagaagaaucugacuucugcucuuuucuuuggaagacuaguuuaccccucugauauccugauauucaaaagaacuaaaaguauuagucaaauuaauacuguguuuagauguuggauaaccucuucauuuccuuacauaaaauacauguuuuauauaccugacacuagccaaagagacuuaaaaaauucaucguugccucauuuauguaaauacuucugaauaagugcaguacugauuaguagaacauuuaaugugugguuuguaguuggauuauaaauuauauuaucauaagugguauuaguauuaguaucacuugcuaacaaccaaaucaaauacuugaaauaugucagguaauguucuaagggcuuuuuacauuauguccuuacaaaaacccuuugguggauaaaaacuaugauuucuguuuuucagaugaggacccugagauguaaagagguuagguucaugcaucuaauaaaugaugugauuaggauucaaacccaagcugugugacuccagaguccuugcucuuaaccauuacauuguucugccuggagcauuuuaaugaugagguugagugggaaagaaacugaaggcuaauuugagaaguuuguugaccucguauugaucacaacaauuuguuguaccuuuuguuacacaacauagcauugguuuaaauuaaaauuucuuuuauucugaaaaugugaccacaugcuuuucacauugacaguauggccagcuuuuuuuuuuuuuuuuuugcauaaauucuauggcucucucccucuguaaauaauaaagauugcgaaagagguuauuuuuucauuaacgcaugcauuaaguauagauguaaucuauacauuuuuuucuucagagauguauaaggacaaauaaucauacaugguaaaaacuuugugacuuugcuugugauuaaacaugaaaauuaaauauuuaaaauacagcauucugaggaaagcugagcuuauacuuguuuuagcuuuaugauaaaacaguaacaucuauuccugacauacaugugaggaugcucccaccgucuuccuuaugcagugauuagcuuugaagacuauguuacaacaaguuugagugagcauugguaucuuaaaaagcuagcaccuguaucggaaaauuagaauuuuuguuuguuaugcaacucuugauaauuagggucuuuuuuuuuuuuuuuugcauuuuuucuuagguaagaagcauauuuuuaaaauggugauuguguuguuucuaauuaaauucuaaaugaacuaaaugaauuucaaaugaauuuuaugggauuugugaaaaauagugcuaugguuuuauagauuucuuuucaauuggauuguaucuauauuuguuuaguuacaucucagugaaucuacccgauuguguuuuuagcauaguccaugacaguugaagguagagaugaguauuucugcaguauucucaaccaguacccagcucacuucacaucuuucuaccuuucaugaaguuagaauuagaacuagguucuggaacacaauguagccuuaaaaagguaucagauauucaucaacaugaucuauuugugaggucacaaggcugaauuauuucugaagaucuuuuccauuugcaugucugaacaaaucuagauauuccuuaguuauucuagaugaaagacuauuugcacauuuuaaucaaucacuguuuaguccagagauguacacuucuagcuucugccuuggcgcuuacgacuucagcuuuuacacuuacgacuuaagcuuuuaaaaaaucaaaaugugauucucaguagaguguugaugaauaaugaaauaaaauguuuauauauggacuaauuuagguugaagauuauuaaguaaaaauacaguuuguuguuaucaggugaaugguaggaagugaacacugucaacuuuuuggugagcucugguuugagaguauauaauucaugauaaagaugauuuauuugaauauccuauccagaucuuuuagguggaaagugagcaugagucuaaacucauaccaggucccaucucagguuguuauuaaagacuaagccuggccgggcgcaguggcucacgccuguaaucccaccacuuugggaugccaaggcagguggaucaugaggucaagggaucgagaccauccuggccaacauggugaaacccugucucuacuaaaaauacaaaaaaugggugggugugguggugcgcaccuguaaucccagcuacucgggaggcugaggcaggagaaucgcuugaaccugggaggcagagguugcagugagccaagauugcaccacuacacuccagccuggugacagagcaagacugugucucaaaaaaaaaaaaaaaauagacuaagccugagguccaaaauaaugcaguauuuuuacucagcuguggaaauucaggauguuuucuauggucaaaauuuacucaaaaucauugagaucguuuguuuuaacuacagggaauaaguuauuaagugaaguaagaaagguggcaaagguccagaaucugaaguuauuaggacuaaguaaaaccaugaauucuagcaaacaguuucuuccacccucauaauuuacaaguaggauucucuaccauuuacaguaguaauguggauuuuccucuuugcauucagaaggugcuaacugaaucuguacauguccuaugccaagaacucaaugaguaaguaguaguuuuuagcucuguuagcaagccauuggucauaguguuuaggagcuguauuuccuaggacugcugucacaaauuaauaaaaaguggguggcauaaaacaacagaaauuuauucugccacaauucuggaggccagaaguuagaaaucaaggugucagcagguucacacucacugagaaggcuccaggggagaacccacuuguugucucuucuugcuucugguggcucuaggugcuccuuggcuuuuggcccauaguuccaaucuuugcuucuguggccacguucccccuuccuuuucucuguguguucaguuuacucuuaaaaggacauuuguaauuggauuuagggcuuaccuagauaauucuccaggggaaaaguccaucuucucagaauccuuaauuguuaaucacauguguugccauauaaaguaauagucauucuuuuuuaccauaagguaauauucacagguuccugggauuagggugcguacaucauucgaggguccaccacucaccucacuaccagaagccaguauaccagaauccuugcugggaaauguauuuguuuugguauugauaacagcauacuucaacauagguauagcuuccagcaaaagagugugagaaagaaguggaagcacccaugaagauuauauauauauauauauauauauauauauauauauauauauauauauaguggaagagguuggguuggaagucuuaaccaguugugacugcagugcuugcugaagguuuaucuugacgauacauuuacuauuuggauguauauugguggguguccauugaacaaucucuuugggauacuugguacaucauaaaugcuucuuuuuugacaagacuuuccauuuuaaccagguuguguuuuaaauugguuaaaaccuaugggccauaaacauaaaaguaugaugcaauuuggguuugaugcaucauguguaaacuuagaugcaaauucuguguuuaaaauaaaagauugacuuuuagcaguccgucuuaaaaggauugguggcagggaguguacuuuguucuggguacuuagccucauaaaagcuaggacuuucuguccauauuuuagaacaaccugacaacacgugccuuaucugaacucacacugccucaacuucugagcuagagaugaaaguguucaguuccuuuucgaacagcuaggcaccugaaaucugguauaauacuggaauuaagcucuauuaaguugucuuuuuuuuuuuuuuugguccagccucuguaacaaauuaauaaugaaugcauucuaagcaucuucucagaaaguuaauucauauuauaggugaaaaaugacaagaaaauagauuuaguagucuuuauuggaaguuugagaucuacuucuggcuuaguaucacaguauaauuguugauuaaccaaaucaauuuaaaauuauuuaaaaaguuugugagaaauaauacuuuuuuaaggaagaagggaaauucuuuaaaauuuuucuucuaugugagugaguacaucacuaucuugguauacuguauuacguuugaaggaugcauaauacauuuauuuuuaaauagcuuuuuggcaaccagaaguccugcuauagaucauagaaaauauuuuaaaaguuuaaaaaucugcuuaauaaaaaagauacaagauuuauauaaugauguuuuuguguuuuucaucugaggauguacauagagggaaauuaugcuuagaaaugaaaauuugauuucuuuuaauuuuacauuucuugaauaaguguauucaguacuauuuuaaaagaagaagaaaugguguuauuccguguuuucuuuuguauuuuucaaauggaucugauucauuuuauuuuugguauaauuauuaaacuauugugauuuaccuuuacagaguuacagcauauuguaccaguauaaaucucuuauugcuguacaacaacauuugaagucuaaauaugucauuaauuggagaauuaauaccuaaugauuuugaauuuuauauaggaauaaaugaaauggaaaaauaaaauaagagcaauuaaggaauuauuuuauuuuucaacgugggaauuguguauuaggcauucuaguuuuauaaauugccuuauuaagucaugugcuuauuaauauuagggccgucuuuuuucaguaaaauaaagugaagagcaucacuuuuuuuucuuuuuucuuuaaauuucuuuuuugcccuuacauacuuauguggaggauacugaucuacguauccucuauuuauucauuuguuuaauaaaucaugauugagcauuaaguggugggcaccagcuugggcauguagaguauuaucaccucaaggaaaacaacugacaguauaugcugucacugauggaaauugagcuuuuaagcaaagauuaaauuugggaaaacagaucucucguuaugagcuugucagcuuuccaauguuuacuuuuuucaugagacugguauugauaacaaaugugauuguauaaugaaaugugucaacauuaggaagaucagcauagcacgauaagccaggguuuucuaugugaccaaugcauaauguuauaaaauuauagacaguguuaaagauucauucaaaguccaguauagaucaauggauuuucacauaauaguacagaaaguucauuguuaaaaguuucaaguucuacauugcaacuaaccuuuuagaaacuaacccuuguugaauucugguguaguaucaaagaaugauauccauaacuaucugaauauuuuucccuuuuucagcuucauaucucuuugagccagauuuuuucccccuaaauuuaaaccaaaacaacauacugcagcaggauguugaaggcaggaacagcuaagaaaauuaagcugucuucuauuaagccagacauuaaauagauuuguaaaaauggaaagcagugcuggucuuugcauuuuucuuucuuuaaagaaaauaguuauuuuuuauaaaaauauguuauuuguuauauguaauaaauuuauuuucaagugaaguaaaacauuuauaaaaucuauuuucaauuucgaauaaaguaaacauagauaaaaaucuacauaauuuguuggugcucuaaguaauauuuaaggauauaaagagauucuaagaaguuuaagaauugcugauucagaggaaugauuccacaucugaaauacauguuggggugagauugcccuuuauaguaaaagauuuggauuacauuuuaugguaagagacuggacuuuacaguaagcaguaaggagucacaggauauuuugagcagaaaagugauaaagugguacacacaagauuaaucuggaggugauagauacauuaggauggaaguggggaauguguagaguggggaaaaacaguauuaacagaagaguagauauaacguauuaaggguucaguugauugggcucaaucagagagacuugugauggcaguauugaccuaacugugauaaggaggggaaccuucagauguuggguuugaguuugggucacaagaagaagcugauuuguagggaaaauugaacuguuugcaauuuuuuuguacuucuuugccuaagcauuugagauuuaaucagcagguagaaauaaccaguagagaacugaaucaauaccagauagccuucuagcucuuguagcaucauggagcaccucuguugcuuaaaauuagaaguuguccuuuaguagguaagcaaauuguaauguaguugcuaaaaauguguauuuugguggcuaggugguaccuuauguuaaguucuaauaaaguauacauuuauugacuauuauguucuugacacuguaccauauauuaauaguuacuauguuuguguaugugugaguuugcguaucguugaaagcccuguuaacccauguucuuucguuuucuuaaguacagcauugcaaaaagguuauuuuucuaugaagaacaauaaaauguugcuuaaacaaguuacagucaagauuuauuaaugaaaauagacuuuuuucuuucuuuuuugaaaaaaaaaagacacaauuaguggaagagaaacaucuauuucuugccucucuuaugauaaauguuuuuaauggaaauucauugauacuguguggaugauuuaccaaggcuuuuuaaaacagcugaaaauaugcucuaacaaccaucugauaaaaugaaaaacugaacaaaauguguacucagaugauucucugaaggaauaauggugcaaaugaauuaucaaagugugaaaucauuaaaaacaaaacauguuuggguuuuuauugaaucuuaauuguaggcuuauguauuuucuuuuguaagcuaaguuaaaagaaaauugaguaacuaaauuuuuggaggccaguguuguaggacauauauuguaccauaauuuauuuuuugcauaaaagcugcuguucauuuuuuucagcauuaacaugcgugcuuuccucauguaggagaauauauaaaaaacuggaggccaagauacuuccuuuugaagacagauggcucauucauaggauauaaagagaaaccucaagauguggauuuaccuuauccccucaacaacuuuucaguggcaaguaaguuaauuauaauuguugauucaucuuguauuuauuuauuuuuaugauuuuaugugucagauaucuuaggcuauaugagaaaccugugaaaaaguuuggguuuauauuuaauagagaaauuuucagcuuugauagaauuucagucccuuagcauagagguuaucgauaacauuuggucuuauacaaugcaauagaguuuaauauuuuuauguagaacuugaaugugauaaauauaauuccccaaauacauacuucaaguuuuuguuuauaacauaaaaacaaggaccuuugaacuugguuguuagauuuagcaugauuauaagauguugugguacuuaaugcacuuuaaucaguuuccugucauaaucuuagcucuuuugauugugugaugagaaacaggugauuuauauuagaaaucaucuucuggggagauuuuauguucguaguuaaauuuuucuuccuuacaaauaucuaacaaaaauguuuaaaacuuacuuagaaauuuuguauuugcaugaacauagcacaaaauaaacugaaagaugacaaugaugauaaugacaaugauuauuauuguuauguuauuaccaggcucuuccaacucuucaaauauauugauuaaucaauuagagaaucuuuguguuaauuuagaaguaaaguguuuuaaauuacgcuaaguuaaacuugccuaagaucuagcucgucuguauuauuaagcuaaaaucuuuaacgagacaauauccuuaauuuugauuuugguuauauguuaucuauuagccauauuugggaaaaaaagauacaagggaaauuugaagcuaaaaaaugcaauaauauaacaaaaaauucaagaaaauaagucuuugaauguuacaaauuucauuuuaccauuauaaaagccgugaucuuuuuuuacuccuauuguuuaauucagguuagcccuuauuaguggguuagaauggcuacuguauuuuuuuuaagaaaaagauaaaacaauaaaccaaaggguuaaaagauuugugaagucauuugaacgauauggauacuaacuuaaaaaaaaaagcuuucucuguuuauauuaguggauucuuaauauagauauuuuuuaaaugagaucacuaugaaguguguguguuaguuaaggaaaacaucuuuuuucccaccaaaaugcucauuagauaauaaugguuuucuuucaauagaaaauuauuuuuuaaacccuauugucaacugaaauaauauauuguauuuuguauugacuuaagaacagauuuucauuuuaaagacuuuuugagugaacauuugcuuuaaagugauagaaauuagcuuuuagaacauaagcagcauacauuaucuaaaugcccuaccuaaagccaguguagcuuuuuaguuuauccauuuuaccagcaaauguuauugguuuuucugaaauaauuuauaaaaguacagaauucuuguaucugcugaucaaaaugcagcauuuuuugaccuuaugaaauuucacaccccaacgaguuuuaaagacauacuguaugucacagucugccaacaucugcuccaacacuuccacuggcagaggcugaaauaaaugcugcacucuuggggaaggauccuauuuagugacugacagucagcuuauuuauccaugaaauaaauacuaucugacaucuguaaucuuguauaaucaaguagcuguagguaguugacucaaacuaacaaguaaguuguagguuggcuccuuaguuuuaaaaaguauuaguaacauggaucuuacucuaaauaaauuuuuagaaauugauuauuacuaaagcuugacuuaccgcaaucuucaauucuguaauaacaguuaugugaggaaagaaugagucuacugaaauggauacuagcugaagaaguaguucaaauuccaaccuggccgcaagcugcaaguaauaggaccuugggcagauuauucucugaaacucugaucuuuauguaguuucuucaucagcauguuagaaacauuuggauucaguggauuuguaaggcccuuuuugucccugacauucugugauucugugggguggacuuugagcagguccuugaagagugaguaggaguuaagcaaauuaaaacagagaagaagaauauuccaggcagagggcaaugaagaaugucuuuaugaggaauuaaggaaggaacaauuggugcaagagaggguuacuucaccauugcuuuuuccuuugcccuagcccccuuuaguacauuuuuaaaaagauaauuuuacaagguauuucuaagguauguugggaaauguuauauauauauauauauauauauauauauauauauauauauauauauauaucaaauuguagcuaccaaagggauauauauaucccucauuuuucugauaauuaaagauauuacuucauauuuaaucaauauggguuuuaaugaaauuuuaccaaaauaggcuuuuuauuuauaugaaaagaacagaguaugagaacuguaaagggguuugagaacuuccaaucuuaauuaaauuuugaauugcuucccuccugauuuaaauuuuucaaaaagauaguguuauacucauuguuuccacuucguaucccacugcagucuagcuuccucccuuacucacuugauugaaacuacuuauaauaaauuauugagugaccacuuaauugcuaauguaggggaaaagaaauaucuuuucuuaccauuucagguucauggcugaggcuccuauaacaaaaggaagauuaacaagagaaaaacacacaaauuuaaguaauaaaacuuuuaugugacaaugcagccuuuggaauugaagacccaaaaaaacacauaaauuuuuuuuuuuuuagacagucucacucugucccccgggcuggagugcaauggcaugaucuuggcucacugcaaccuccgccuuccggguucaagugauucuccugccucagccucccaaguagcugggaucauaggcgcacaccaccaugccuggcuaauuuuuguauuuuuuuuuuaguagagaugggguuucaccauguuggccaggcuggucucaaacucgugaccucaggugauccaccugccuuagccucccaaagugcuggaauuacaggcaugagccaccaugccuggccaaacuuguguauuuuuauguuuagggaugaugaagagguggauagucauaaggacuaagggcuuauaaugguaauaaacugaagggaacuuaguaaggcuuguuugucagauucuuuucucugucccugugucuucaggaauaaggauauuccuucccucuggguauaguaugggcaucucucauauggggaucuuaugaccuauuucaggggaaggucaaaaaauucuugcuaaguuuuaugaccugucucacgugagaaggaugagaggaagguaagaauggccuuccugcuuuugcuguuuucucaaaugcuaaggugcuaucuuuugggagaucaugucaugaacccugucaguaagucuaguagacaucuuucaguucuuauuuuuccuggauuuauaucugggcugcauuuuauacuguugaucaccaucuccuuuuugaccacucccacuguguucugggauauaccucuuuccuguuccccccuaccccuuaggcuaaugcacaguucugguauuuaacaggguucugguugaagacccuucacacuuuguacuuucucuugggcggacacguugacuuuugggguuucaguugcaaccuugugugcagcuuacucccacacuuaaaucucuaggcuaggccucucuccugagcauuagguuacucuguucaauuggcugcuggacaucucuaccuagauauuuuuugaccagguacguccuaagauaaacucaagauaauuuugucuauuucuuccuuuguacucaguaucugaguucugucucugccugaucaaaaacauggauccuuuccaugccuuuuuuuucuccuucacaucuuuaccccacucccaauccauuucuaguccugcugauucugcauauuucuugaaccuaugauccuuuucuauaaucaccccagaaugaggccucaucauaucugcuguagauucuuaacuagcuucucuguuucuaguuuguaccacucauacucuuucuucacgcggguaucaaaguggucuuucuaaaauuauaucauaacuaugccauuccccugugaaagcccugccuuggaucaucauugccuacuggauaaaguucagcuuucuuaauacaucauagaucucuucaaucuggccucuacuuucaacucuugcaggaucucucuucugcucuacaauuauguaucagcaauacugaacuguuuauaauucccuguacaaccuaugcugcuuuuccacucugaggcuuuguuuaugcuguucccuucgauuggaauguccuuugguccucuauuugccuggauacuuuucuaagacuuaauucagauuuuaauucccaucccuauuccuugcuaaauuaguccucucugcccuucuuaaaucuauuaucuucugcuguuaacacauuguuucuugguuaucuuguuccugugcaugucucauucacugaucaguaaguuauuuuaggggaaagagcuuagucuuauuuaucuuauaucuccuagugcuuguauuuuaugacuuaacuuuuuaagugaacaucugaaacaucuagucgagauuucucuuuuuuuaggugagaaaaaugaagccuuuagaaauucagugaucuuuuuaagguugccuuacuagguaguaguaguuaaguaucaagaauaaaacucaagugucucgacuaucacauaaauauuacuccccucccccaccccuauauuauaacauuuccccuagauuuauggugaugagaccugauuuggggccccauuuccagcacuuaaauuacuagguauccuuugacauggagaauggaaacuccacaaggccuguagaauguggauagcaauauuugacguucacccuucuuuggguggaucacauaagaacuauuaauauauaggugccaauguagugcuguagaaauguaaguaaaaauaagguuuuucaagcauaguacaucucuaaucacaauuaugguuugauggauuucuaaggauuguagauugagauauauacaagaaacaugcacuuuaaaaaauaauauaggauacauacauugucucagggcugcauuuuauuuuacuuugaguaaaacaguuugucuguccaggagucauggucuugcuaacauuuugacaauuuguaugaaccucucuugaguuuacuagcuugcucaguuccagagugggaguaguucccacauggaggacgugugcauuugccccuaugucuugggcuuauccuacuucugaucaauuccuucuuauucucuguggugggaugggagaagugccagccuguguccuaagaagccucuccuagaauucuaccuuauucuaugcugcaaauauugucccacccugacaauaugcuuuucuucucugaaaccuuucuucagucccuucuuaaaaaauagguuauuucugcauuuauaagcacaauuuuaaaagaugaaauauuuacucuuuuuuuucuuuuuucuuuaaguuuuuuguuuuuuaagacaagaucucacucugucacccaggcuggaguacaguggcacaauuacagcucucuguagccucaaucucccaagcuuaagugauccucccaccucagcauccugaguauuggggacuacagcugcaugccaccucaucuggccaguuuuuuguagagacaggguuucaccauuuuguucaggcuggucuugaacugggcucaucaagugauccacaccuuggccucccaaagugcuagaauuauaggcaugagcuacugugcaugaccaaaguauuuacucucuaaccgacuuuucucucucucuuugcaaguaagggaauuaugggacuuaaaccuacuaacaaacaucuuuaucucaucccagaugcuuggguggcuaagguggaaggaucguuugagaccggccugggcaacauagaaggacccugucucuuuaaaaaaaaaaaaaaaaaaaaaaucuuugaauaaauauuauauacagagauuuuaaauauguagaaaaaucaguugauuccuauuaauacuucuaguggacauacauggggauagagaaaaagcuuaugacuugauucuuagucuuguguaacagauaauacaaccuagaauaauaaccuuguaauucuagaaaaacuacagacuauguaaauauauacuauauaaauguacaugaauuaugagagaucauaauaauucaccuucgaaguguugauugaucauuauacccauaccugauagugaaaggaauauauaauaaaauuuuuauauguaagaauuugucauugacuauggaagacauucacauagaacauauagcagugggaggaaaaauaggauuaauugccaaaaugaauucuguagaaaguagcugcuguagaaguugagagaagcaauagguaaguguuggcgagguugacugagaauuuacucaggagaugggguuaacaugagcccugaagaagaggauuugauuauguuuuuguaagacagaggacagucucagguuaacaacauaagcaaacaaaugaaggcaaguauuaaggaguagcuuguuuugugaaugguauaggcaauauccuagauggauggagaauuuaugcuggaggaaaaaaaaaagcucagauuagagaguuaguaaucagauuauggaaagucuuaaauaucaaugugaugaaauuuuugaacauccgguuuccaaaucaguauucaauuuuuuuaaaaggauguaccugguuauagugugcaguggaggggauacauccuuaaacaaacaggcugcgagucagucagcaagauacaguuuaguccucauccuuuucagucuuacugcuaccauccuagcucagugcuucaucacuuccuuucuggauuauguuaagucuccugaucaaguucuuaccuucaaauauuaucuuuucuggaauauuuggaaacaaugcauaaaauagauucaucuccaaaaaaaguuccuuugcaaauaccguucuccuugcuuagaaaaauuucagauguucuccauuuuugacaaggaaaagcugaauuauuuuuuaauauauauccacaauuaaacacuugcccaaauaauaacuguguuuauagccuauaucuuuucauucuuuuuuuucuguuacucuuuaauguucuauacauuuucuuuuugacauacauugcuauauucuggucagguuuaauuacauacaaaauuccuaacccuguguuuguuuuuaaugauuuuuagaucauuuaaucauuuuaucacuugaagauuuggugcuuucuuuuuuuucuugauuuacuuuauuuaaaaaacauuuuuaauugauacauauuagauguacauauuuucggguacaugugauuauuugauacauucauauaaugaaaucaagguaauugauaaauccaucaccuuagauacuuguuuuuuucuuuaugcuaucaaauuuuuagacaaauggaaaguuauaucuguuaacagguguaucccacuguaaggaauagcugccuuaucuuaagaagugaauuaccguaaauuuaaucaaauuuugcuucucgcuucuauuuucauagguaguguuauguucagauauuugcagaauuuaaccuuaaaccaaguuuagaauugggaauggagaaaaccuuuguaaaaauuauuuuaaaaugagaucauuuuuaagaaaacuauaauguaacaaugucacauauuuccuucuucaggcuccaauucaaaucauacuccaauuugaaaagaacaaaaauuccacaaaacguucauucuuuccuacuuuuuccuuacguuguacaacaaauguggaaagaaaaaaaaaacagaaaaaguguaucccaucuuaaugaaaaugacugcggcagucaagaguuucaaauccagcugccaggggugaaagcaacccucugcaucucugaaagauuucaucaguguuaucuccuuuauaaucauaacuuuucauguguaucaucugaguuucuuauuaaauaaucucacuauuuuaauaguuccuucauuauaacacuacaggugaucugaucagauuucuguuuuagagccugcuuccucuucuuuaguagcuuccacgaucucccagccuuuuccugauuuguauucccaagccaaucauuuuaguuacagucuuuacuuucugagccucuuuuaucagaauauaaggaaugggggggcuuauuuagaaucaaagggaaugguaaacuuguagaagacagugaccaugcauacucauuuuaaaaaugucccacagcauuuauuacaauaucugguauacuggaacaucauuggacuuguagucagaagaccugacuuugggacuagguucuacugcuuuacuagcuaugugaucuugggcaaaucacauaacuucucugauuuucauuuugcucaucuuugaacaauggagcuaaugauaccuucuucacaggcuuacagugaggaucaagugagaucauauagccgagugguguggcucacgccuguaaucccagaacuuugggaggcugagguggguggaucacuugaggucaggaauuugagagcagccuggccaacaugaugaaacccccaucucuacuaaaaauacaaagauuagcugggcuugguggggcacaccuauagucccagcuacugggcugaagcaggagaauugcuugaacccgggagguggaaguugcagugagccaagaccaugccacuguacucaagccuuggcgacagagcaagacuuugucucaaaaaaaaaaaaaaaaaaaaaaaaaaaaaaaaaauauauauauauauauauauaugaaaacaauuuguauguuguaaaaugcuauccaaauaguauuaacguaagauagaagguacuuaguaauguuugcugaauuaacuggcaaucauuccuccuuuagcuaaauuacauuggagugaggaggaaaccacuuuacugagcuuucuuuaaagagucuuaaagguuuuagagaacuugcuuacaacagucuguugcaguugaggccaaauacuauuguuugguuggaggaaaauuucuaguuucauuucaugccuaggacuuugauuagucagggcuauucuuucuuaaugacuaaacagagugagguacauucccaaacccugcuuauggccuccuucuggccaaaaaagaagacaucacuauggcuaaagaaguaacaccuaauucugugaagaaagucaaugguagcuugauggggauagcauugaaccuauaaauuacuuugggcaguauggccauuuucacgauauugauccuuucuauccaugagcauggaauguuuuuccauuuguuuguguccucucuuauuuccuugagcagugguuuguagccuuccgugaagagguccuucacaucccuuguaaguuguauuccuagguauuuuguucucuuuguagcaauugugaauaggaguucacucaugauuuggcucucuguuugucuguuauuguuguauaggaaugcuugugauuuuugcacauugauuuuguauccugagacuuuacugaaguugcuuaucagcuuaaggagauuggggcugagaagaagggguuuucuaaauauacaaucauggcaucugcaaacagagauaauuugacuuccucucuuccuauuugaauccccuuuauuucuuuaucuugccugauuucccuagccagaacuuccaauacuauguugaauaggaguggugagagagggcauccuugucuugugcugguuuucaaagggaaugccaagaaagagcccauauagccaaaacaauccuaagccaaaagaacaaagcuggaggcaucacgcuaccugacuucauacuauacuacaaggcuacaguaacaaaaacagcgugcuacugguaccaaaacagacauguagaccaauggaacacaacagaggccucagaaauaacaccacacaucuacagucaucugaucuuugacaaaccugacaaaaacaagcaauggggaaaggauucucuuauuuaauaaaugguguugggaaaacuggcuagccauaugcagaaaacugaaacuggaccccuuccuuacacuuuaugcacaaauuaacucaagauggauuaaagacuuaaaugugagaccaaaaaccauaaaaacccuaaaacuguaaaaccauaaaaacccuggaagaaaaccuaggcaauaauauucaggacauagguaugggcaaagacuucaugucuaaaacaccaaaagcaauggcaacaaaagccaaaauugacaaacgggauuuaauuaaacuaaagagauucugcacagcaaaagaaacuaucauuagagugaacaggcagccuacagaaugggagaaaauuuucgcaaucuauccaccugucaaagggcuaauauccagaaucuacaaggaacuuaaacaaaucuacaggaaaaaaguaccccaucaaaaagugggcaaaggauaugaacaaacacuaugcaaaagaagacauuuauguggccaaccaacauaugaaaaaaagcucaucaucacuggucauuagagaaaugcaaaucaaaacacaaugagauaccaucccacgccaguuagaauggugaucauuaaaaagucaggaaacaacagaugcugaagaggauguggagaaauaggaaugcuuuuacacuauuggugggaguguaaauuaguucaaccguuguggaagacaguguggcgauuccucaaggaucuagaacuagaaauaccauuugacccagcaauuccauuacuggguauacacccaaaggauuauaaaucauuuugcuauaaagacacaugcacacguauguuuauugcagcccuauucacaauagcaaagacuuggaaccaacccaaaugaccaucagugauagacuggaugaagaaaauguggcacauacauaccauggaauacuaugcagccauaagaaaggaugaguucauguccuuugcagggacauggaugaaucuggaaaccaucauucugagcaaacucucacaggaacagauaaccaaacaccgcauguucucauucauaagugggaguugaacagugagaacacagggacacagggaggggaacaucacacaccggggcauguugagagauugggggcuaggggagggauagcauuaggagaaauaccuaauguagaugacagguugaugggugcagcaaaccaccauggcacguguauaccuauguaacaaaccugcacguucugcacauguaccccagaacuuaaaaguauaauaaaaaaaaguaaaaaacauuuauacaaaaaaaaguauucaauuaacauauauugauugcuaaaaaaaaaauaaauaagaucuaacaccauuggaucagagacaagaguuugggugagggcaaggggaacgggguauagaccaaauucuucaaacccugggcuuuggaagacaaagcugcugcaggcugagaaagaccugugugacuguuguuauucccuuuuuagucagaaguuguuuuuucuuaaaguaauaaaauccuucaguauuuuucugacugguugaagaggauccuauccauuggaggaaaaauuaaagguacuuugcuuccuagauuacugcuuuauugagagguggaggaugcaauggggauuguuuuuaaaggaaggcaggcaaguaguuaucagcuucaauaguuuauacugaggacauagaagagauuccagcaugaccaccuuccuuuauuccuuucuuuuucccucuuuccuuuccucuguaucugccuuccccccuuucugucucacucaacuuuuucgaaggucagcaaucaacuauuacuuguugauaggugcuuaaguaagggaauacccuacauauaauuaguaucacucaauuauuuuuaaauacuuaggacuccuuccuugauuuucuuuucuagccaucucaaauaacaaccauuugcaccuacuguguuuugaaguuuucuaccuuguguguauguguuugacuuaaaguaacacaauuuggaaacauaggagucaucaaaauuaauauuuaaauauauuuuuuaggaagucuaaauuguaaugaauauuuaggaaguuuuuauugaggguuauuauguucucaacauuguaccagguacugaggggaaaaaagaaggaaauaaggaaaccaaccuuucuuugagcguuacuauguaucaagcccuuucacauauguuuucucauuuuaucuucacaacaacacugugagguaaguauuaugcuccccauuuuaaaggaacucagagugguuauaugacuugcuuaggccacuguuuggcaaauggcagagcccacagcaugaacccaugucuaacagagugaaccuagaguuuuguguucauuuucuuauuccacagauacaagaucuagcccuuggcuuuaaagaauuuauagucuaguagcaaaaauaugccacagacccuugggauugguauuuugagauguuuuauggcuaaguuuugaagggaguuuugcaauuaauacaugcaguuacaauuuaggaaaaagagguaucauuaaagacagaaucaucaagaaaagcuucuuuggacauugagauuguuuggagaaauaguaagauuucaaaagauaaaguuacuuuccagguaacaagaauagcauuaauuugaaaaauuauuucugagaaacuuuggcugaauuucuuuucaucuugucaaaguaaguggguaugaaaucuucagaaaugaaugaaagcuccagaugguauguuauguccuuaucccuguauagagugaaaaauaucaaaugaggaaaaagaauaaaugauaggaauaaauauggcguuugaaauacuuagcagaaugcccuaaucaugucagacauuguuuucucagggccacaguuaggcacuagcuacccuguuuguuagcuuaccucguguuuuauuuguaguuucuguaguaacauugcuguucaucuuuucuccugguagaauauaaaauaauuuuacugacaaauaaauacuccauuuuaaaauccuaccuacagaguuuuuaaaauuuaagcuaaaaagguuauaaacuguagcuuggaaggugguacauuaucucuuuauauauuuauuuuuuaaaaauuugccuucuuguauguagggaaguuggaguauuguggaugggaaguggagggugggguaggaggaucaccaccugcagccugcgugugauaaggcaacuguaguguauuuacuguauaauuuuuuuaugaccuuauuaaacguauagauuauuuugguuaaguugaauguagauaacuauuugauuuacuuguugaauuuuuuuuuuagugugucauuuuaaacuuaaauuuauaguuucuagaaagaggauugugcguaacuaguuuuugaaauuguaauuagaaagaugauuguuugcccauuauauuugguguuuuaaucucauuuuauaauuaauacaucggaaauuaggagggcaauuaaggaaguaaaggaagaaaauuaacauuuuuaaagagccugcuuuuuacaagguguuuuauuuguguaauugcauuuugucaucacaugaaaaacaugaaauaaauauuauuacuuaaaggaaaaaaaacuagauaaugaaucugagaccuagagagacugaaaaacuugcccagaaccucaaagcaaguacguggcagaacugugauuugaacucuaacaccugguuugaaugcauuuaaucauauaugguguucagagaugacagcucucuucaaguaauacgucgucagcacccauagaacuuucgugcuaugccacguaucacccaguggguuaauaguggacucucauuguugucaggaguuguauuauauauaauagcgagacuucuuucugcuagagcaaaggaacaaauauagaugucguagauggguggcugauaaauuugauagaguuuuauuauguaauguugagccagucgcuuaaccauacugggacucagaauuuugucaucuguagagugagggaguuagagugaaggaucucuaaaguccuuucuucuaauucuaaauucagugguuugccuaucagcagcagauaauuauuucuugaaauauugaguauauuguggaguaguauaguaauaaauuaccacuuguugaguaccuucugccucguauuuuacauacauauauauauguacauacauacacauauauguguguguuaguaagauauauuuaauguuacuaacaucuuuggaggacaaacagucuauuuuauagcuggagaaacuagguucauggaauuucccaguggcaaggaauucuuucagagauggagcugggagauaaaccugcagcuuucaaguuuccagaccagugcuuuuuccauauuccuacuuaacuaauggaucucugacuaccuuacaguagggccuugaggugagagguuuuccagugugggcaauucagaagauauggguuuuccaugccucuagacuagucugucugucuguaucauggaucagaucuugucauucuugacuaauacaugaagauguauuugagaacuuuuggauaauuccauuuagggaaacagcagcuuaauguagaugauucacuaguaugugaagauuucagcauugcuuuuccaacuaagucauagaagccauaggggagacacugauuuuuuuuagaggcagaaucaucugaauauuugcaguaaguuauauaaucauugcauuuuuaacaaguugaacuugagggacauguuuuguugcuuccucugaguugauacaugcuaaauuauuggcuuucugauuuuuucaccccuauaucuuuauuuuaauuuaaaagcguuuauuauacuuugaguaaaguuaaaugaggccuaaggccacauugggaggaagaaccuuuaagccuuggaauuuaggaaagauacagaggcguucuuuuggguuggaaauaauacauaaucaagcagaugcuaaugaaaaaaugaaaugcaggggaagagaaaagagacuagggugccuguuuggaaguuuuauagaggagaguacauugccccuuuauuacaauaauguuucugaacuauaauaaggucuuucauugcaaguucagcuuuuuucauucauuuguuuugugcucugcuuccucuguuacuaauugucagcacaauagucuuccaacuaugaagucucaguguccuuuuggaccaauuugucauugucuuucucccucaccccccaacccaugcacucagaaucuauuacuaugguugcauuuuuagacauuuuuaauguuuuaaaauggcacugcuuuugaaaccugccagaauaguucaugauaacugaaucauccaaccagcaacaguuauugcuuccaaaagcacacugauaaaguuucugucucuauaggguguucuuauaagauaauuaaaaauaaacauguaauaaucuuuacagcacuauuucauaugcauuguuuccuuugaacuucacguuaguccuguguaacauuuuguuaaaauauuuuuguuaaacaguauuauuuacagauuuacuguuugccucauaaauuguuugauauuucuaugccucuaggaaguuccaucucucuucuuuaccuauugaugggucuuuauuuuuauagacagauuauuuuauuaugacuaaggaaucagcaaaguuggcuuagacugacaagccugaauaaauucugauauuagacuccaggcaacuuuaguuacauguuaauucauguuagguuuuuaacauuuuggccaaugaacacuuuaaauguguucucagccuuguuccaauaaucugauacugacagaaagacauuauuuaaauauaacuucuauaaagaaguccugaagcaguguaauauuacuugacaacuuaucugucacuuacagaacuuugucuuaugugaucagagcuuguuggugcuuuuacauauaaugucaaugaagauggcaguuauuuuuaaugcaugaauacuaaauaaaagauuggucaguuuucucugggagaaaacauauuucaguucucuaucaccuguuuguaucaauuuauucacauaaaacuagaaagugaaauacaguugacccuugagcaaugcaaaguuuaggggcuucaacccuuguguagucaaacauccuuguucuaacuuuugacucccccaaacuuagcuaccaauauccuacuguugcccagaagcuuuaccaauaaacaguuaauugauacauauuuuguguauuacaugcacuauauacuguauucuuauaauguaagcaagagaaaauguuauuaagaaaaucauaaggaagagaaaauauauuugcuauucauuaaguggaaguggaucauaaaggucuucauccucauugucuucuuguugaguaggcugaggaggaggagaaagagaaggcguuagucuuucugucucggguggcagagaugaagagauguggagcggguggaaggagaaggcaggagagauaggcacauuugguguacuauuauugaaaaaaauccauguauaaguggaauugugccguucagaccuguauuuuccaagaguugacuguguauaaacguuauuagaaagaaagaaaacuuuacuuccuuucauaaacaaccaacauccauccuaaaaacaguaugugauacaaaaagagacaugaauuuagagcuagaaaaccuggauuugagacucaguuuuaccacauuaauggcuugaugauuuugaauaagugauuuagacauuaaauagcuuccuuuuuaaaaaauuugugaacuggaaaugaccauacuuuagaacucagcugagaggauuaagugaggaauaauguaugugaaaucuuaauguagugaaucaacugauaauaugcuaagauaauuacuuaguaguuacuauuuaaaaaauaaauuuuggagaaagauauaauagaaagcaaaauuuuccuacugauuuaaauuggcagagauuuaagaugagauuuuccccccauucuucuagagaucagugaaggagcugauucuuuuacuuuacuucauauagcuugcuaucuaucaaaccagauuuuaaaaugaaguguuuuuauuguuuuuguuguuguuguuguugcuguaguaaauacccaagaggccuuuuuaugucugugguuggaaccaucuuucaaagccaggcuaacuuauuuggaguuagaauuccugaaggcaaagaaaacacaucuauaccuuccccuuaaaguuuaaagaaguuagagagugcuuuccaaagaggugguauucugauaaugacugauaggcuaucucuauauuugacuuuuuuuguuuguuugagacaagagucuugcucuguugcccaggcuggaguggaauggcgcgaucucggcucacugcaaccuccgccucccagauucaagcaauucuccugccucagccucccaagcagaugggauuacaggcacccgccaccacgcccagcuaauuuuuuguauuuuuaguagagaugggguuucuccauguuguccaggcuggucucgaacuccugaccucagguaauccacccgccucagucucccaaagugcugggauuacaggcaugagccaccgcaccuacccucuauaguugauuuuaauggaauuacuugauuuguuuauaauccuccacaauucauuguuuauuuggacagugcuuuacucuggauaaguagaccuaccuuuuuauuuuucuccaagggggaaaaauccuuuauucuuuacaucuacuccuuucaccuuuuccuguggaaaaaaaaauaucucaaguauuagagcuguugcuccaaaaucaaaaauaugauuaggauucaaaaauaucuauuuuuugaaaaguauguuuuuugaaaaauauauuuuuucauauauaugaaauauauaaauauacauuuuaugagaaaaaaauaaguugugagaaauuauauuguuucugaaauguuuccugaagcuuuuccuagaauucagucuguaugugcuuagauuuugaugaauagaaaagaacuaugagaaguauuccaaauucccugaaacuuaaggaguuccacucaaaacagucaaauaaaucacagcauaugaugaaguaccaccauaugggauacaaauaaguguaguagaucuucagggauagagaguaugaguuggaauaagagaagaucuugagugacuagaaucuaaguaaaaaggaagggaguaugugucaggugagagaaacagcaugaguuguuaaauccugaaguuaauaauaaucagauaauuuuuaggggacagugaagagacauguuuauuagcagaaaguacuuauaguuuggcagugaggaauacaguuugaaacuuuuuguuuuaauuaauggggcuuccuuaugaauagcuuugaaagucaggcuaagaaauguauuugaacauuguccugcagacaggaaaauauuuuugaagagaaugacauacaguuuaagaauuuggguaggacucaucuuacuaguaguauguaggacaacuuagggagaaggguagaaaagggagaccaccuaagaggucauuucagugaugaggauuuugauaguaaguucccggguugggugucagcaguggacaaaaaaaggaugauuccaagagucauaacgaacaaacuguuaacaugaauguugguggcuuagccaugagggcugaaagagaaggacgagccagagaugacugaggaaguguuucuugggugauuaggaagaugauauggaaauaaaauagaaaaacuguacugguauaguaauuuucaacuuggaagcugaaacaaacaaaaacaaaacccuuuuggauaucuugaggaugaggcaguauagggcaucaaaggagaugcuaguuuugccauauggggauggagcuugaugagaagggccgugacugaagaagcagguuugagagucaucagacaucaggugucagucgaugcagagcuacuggggagccuaucuauaauuaaauccaaaguccuuaccaacucauugaagaucuuucuaaccucaucuccuaccuuuuuuccuaacuuacuugacuccaauuacacugggcuucuugcuguuucacaaauccaucuguggaaucccuccagcugugagucugcacuuaauguucauucuguguaacuuacucuucccgaagguaaucugcauuggccucucauuucauuagagacacccuuuuaaauuaaucuuucgaaaauaguaucaccucccguucacuucaacucguugaccugccuuauuuuucuucauauuguuuauaagcaccuacuauguuauaaauuaauuguuuugcuuguuuauuguuugacuacucauccccucaguaaaauauaagcuuuauggaaaauaggcaccuuguuuuguucacugcuauucagugccuagguuacuggcugauauacuguggguaccuaacaaauauuguguaauuaaugucuagauuuacuaugggaaaaaaugucaaaaauaaaagcauaacagaaaggucugagccuuuggaagguaaaggucugagccucuacuuuggaaguagaggcccuaagaaaaacuaaugaaugguaugggaugguaguaaaaccaggcaagucagugucauggaggucaaggaaaagggacucaaaggauagggagccaagaacaucaaaugcugcaaagaaaugaaaaugagaacaaggaaaauauaucugauaaaaaggagacugcaguagagugguggaaaccagaauuuagcuaauugguuaaggcauggguaacaaaggccagccuuguagauuauuuugagugauuuaccagcaaaacgaaggagaggaauggggcaguuagcgggaagaggagcagcauuuaauacaagugcuuuaaagagugacuuugaggcuggauguaguggcucacgccuguaauccuagcacuuugggaaguggaggcgggcugaucaccugaggucaggaguuugagaccagccuggcuaacauggugaaaccccgucucuacuaaaaauacaaaaaauuagcugggcgugguaguaugcgccuguaaucccaguuacucaggaggcugaggcaggagaauggcgugagcccaggaggcagagguugcagugagccgagauugugccacugcacuccaucauggaugacaaagcaaggcuccaucucaaaaaaaaagugacuuugaaucugcaucuuggucuuuguauauguuuauuguuuauuucacugugguauguaugcacugauaagcuacuuugaagauacgugaguagaaauugucucauugguacagauggaaaucucgaggcauuuaaguuguaaguuacuucuaagugggaccuaugcaauugguacauauggacauaaagauggaaauaauagacacugcggacuccaaaaaggagaagggugggacaaggaccagaaaacuaccuauugaguacuauguucauuauuugggugaugaguucacuagaagcccauaucucagcuuuauacaauacacccauguaacaaaccugcacaucuacuucaugaauugaaaauuuuuuuaaaagcuguaucacaaucacaucuaauaaaacuaaucuuuaguauuaccaaguacaaauucauauucagauuucccacuuguugccuaaaacugguuuguuuagaccagaaugcauuaaggaggaccacgcauugcauuugguuuuuauaaaucuuuuaagucccuacuaguccagcagaguauuagacuaccuuccucaccccucuuuuggguacauucacuuauuaaagagacuacuucauuuguccugugaaaguucugucuuauggaauucucugaucguuucuacgaggugucauuuaacuuuuccucuaccucuguauuuacuguaaaaggaaguuagaucuaaggauuccaucagauucauauucagaauuuuuaucaagauuguuuccuucgugagucuguguacuucauauugcguuaugucaagagguaccuaguauuugguugaccagcucuuaguaaugcuaucauuguucacuggguuacgguggugacagugucaucucuucauuauaaacuaaguuucucucaugugguuaccagauaaucugugguuugacauguuggcacuaugcaauauuuagucuuaauuaguuauuuaccaaaugauuuuaccauuggugauuuuugccugaauuaauuauuuuauuagggguagauuaucuuuuagguauuuuuuaacaugauuucaauuagccaaggcacagauaaauuggggcaguauguuagucauucuguuuauuuauuugagaccagcccuguuuaggcauaguaccagaaaucaaauaguauggaccuuccccuaagggaauuuucaaucuaauguacauucuuguugaauuguuuaaaaauuuuguuaucaaaucccaguuucaucauguuucaaauauaaauagcuuuucuuaaaaauagaccgggcacaguggcucacgccuguaaucccagcacuuugguaggcugagguggguggaucacgaggucaagagaccgagaccauccugaccaacaugaugaaaccccaucccuacuaaaaauacaaaacuuagcugggccuaguggcgcacgccuguaguccucgcuacuccggaggcugaggcaggagaauugcuugaaacccgggaggcggagguugcagugagccgagaucgcgccacugcacuccagccuggugaaagagcaagacucugucuaaaaaaaaaaaaaaaaaaaaaaucucauaauuauuuuucagauuuuaccauguuauguaaugaaugguuaaauauccuguguacaucugaguaauuuacuucuguuucaugcauuaugacuauaaauaaacugcuuauucugguguaugaguacaauggaguuuuaugccacuauuaaauauaaugauguagaucuuuauuuacugaaauggaaaauauccaaaacauauaauaucaucaauaauggucucauuuuuguuucuaaaaagugcuuagaauaggucuaaaaauguauguauucaaacacuaauaaugguuauaacugaaugguaggauuaugaguauuuuuauuuugccuauacuuauguauguauuuuucuguauuaagcauggaugauuuauacagugaaaguaaaucaagaaauauguuugaaaaccaucuugcccacacaacaauuugaauucaguaaugucaccaaacuguauacuuaaaaugguuaaaaugguacauuucauguuauguauauuuuacuacauuuuuaaaaagcccauggcuauuauacugcaaaaaccaaaaucaaagccaaaaaaccaacaugccuaauuccuugaguccacuagauguuugcaugccucuuauaauucuuuuaguaaaugccuuaugucauuuuuauauuuuaacuauugucucaaaaugaccacaguacguuuauuuggaauuucaaguaggcagaaaguaugccaagaacaguuguuccagaagacucuugagguguauguuuguuuaauuagaggcaggauucggugggcaaacaagacagagaaauguugauggggaaaauauuggcucuguaagugugcuuuugguaaaugguaguaucuguagugaccauauucaaagaagaaaaauguguuaggagaaguucacauuaacauaucgugacuucaaauucaacucaaguucauaaauaguauuucauguuaauuccaaaguggugguuuaugauaauuaaaaugucacaauuuggaauguggaugaugaagugaaaaacaucuucuagagggaaauguaauguuaguaauccagucugacucccauuauuuauugaaccccuuguauuauggaaucaaauguaagaacuuugucuucucuccuauuugcuuauguggagagagauauguugaguuugggugauaaaacgcaaaugguucagacaaaaauaacuagcaaugcggagcuggauugaugugagucugcagaucacuuuuccauuauuaguaauugaacuuuuuuuaaucauuaacuucauugguauuggagaaugugagagccagcagugaaagaacccaaaggcucucuugccuuccuuucugcuauccuuaccacuuucuuucccuucagcuucucauucuaaaccgccucccguuacuccuaccuggagaaacgagaugucaaggaucagcauccugcuaggggauaacccucauuccuguccaucccuauacuguggagagaaccagaggcaaacacauuggagcccucucccgcucaaacacuguuaucaguugaaacuuauccuggauuugcuuauaugagaaaaagugucauagaugggagaagggccaagcacggggaagguguagagaagguauagaagagggaacagacauuccuauggcuuugacagaugauuacugauuuuuaaggcauuuuuccuagcaguguauucucuucagaagagcaugggauugggauugagauagacuuggaauaaauccuuauauaaugacucacaguuguguguuuuggggcaaguuauuuagcuugccugagucuuguaaauuugcucauuuagaaaauggaagauaauaacaccuuuuagguuuuuccuuuggauuaaaugaauaacauuuaugcaccacucuuugugcagugcuuggaacguagugaucacucaacaguuaucugcugcuggaaugcucucuaccaggacaccugccucaccuaagucaccuuccgcucauuggauuaaaugaaucucuuaaagguugauguauugagucuuaaauagguguuaugcuuuuuugccccuagugaaaacauuaaacaaaagauagaaaugcuuuuuguccccuucagagaaccuccaugguguaucauauuuuuaagaccugaaaaauaaauuugguuuauggucaucauaacucacagccagcauuauuucauuaugugauuuaauaaaaaauggaaucuggccggaugcaguggcucacgccuguaaucccagcgcuuugggaggccgaggugggcggaucaugaggucaggaaaucgagagaccauccuggcuaacacagugaaaccccgucucuacuaaaaauacaaaaaaauuagcuggauguggugguggccaccuguagucccagcuacucaggaggcugaggcaggagaauggcaugaacccgggagguggagcuugcaugagccgagauugcgccacugcacuccagccugggcaacagagcgagacuccgucucaaaaaaaaaaaaaaaaaaggaaucuauuauuaugccuucguuuuucacauuggauguuauuuuagaaagaauaaaauuaguguuuaaauggcuaaagagguugguugaaauuaaaccuuuaaacauuuuaaucuaaacagaugaucucuaaaaauuuuuuuuuugguguauguauuucuuggucugacauguugcagucucucuaauuggguuucagguuugcagaguaauuacagcuuuguacagacuuugucaucuguggcucagaaugguguaaaguaagcagaacauuuaaaauucagcuugugguucauguugcucaguagaguuuaacuaguguauaacuaucuaauauaaguaacaguguaacaaauaacacugagaaguagauguuauaauaagaguuagcuaccuggcauuuuguauaagcacauuuacuuuacugaugcauauuaaaugauucuaaaaaucguagauaaucauuugguuaauagcuuuuuagaaucucuauccaaaguuucuacuucugauuuuuaaaauuuaaauugcccuaccuugcguugggaaucuuuacguaaccaaaaggcaaauauucuucuaaagaaguauuggcuaauccauuuauuaaccaccauuuccuuuaagaaucauguguuucugauuccuuauugcgaacaugcaagaacucaaaaguuuuucuauuuacucgaucacugguuuuaacaugguaauuuagaguuuuaacuuuuuugaauuuggauucagcuuuuuaaauuacauuuguuuuguacagcaacaaaccauaagacauugugauauucucuugguagugauccaacuaccacuugaacaucuugguguagagaugaaauguguuuguagaguauuucauacugagaccuaaaaaauauagguuuauuucuauuauacuguuuauuuguaauuacacguaacauuauuuuuguuggacuagaggguucacaggaccugauuaaacccuuuauagcauaaaugaaauacuacuuuauaauuacauggguagaaugaucaguaguaugguguguaccaugagcucauagaguuuccuacucauuuuugugugcccagcauuuugcauagugcuuggcccauaacugacauuucauauaugucauuugguucaugaauacuuagcaaguuuaguaagaacagugaaguugugcauaacuacuuagucauuauguuacuauuuuaauauuuuuccaaaccacucuauacauaaauacagguauuuuauucuuuucuaagccauuccuuuucagugaucugcuugagaaugguaauuauaguaauaucuuuuauuguuuuuagcagccuuauaaauuauaguaauugauauuuggaaucuuauaacagcacuucgaguagcuucuaaaagucuaguguugagaaguucuuuaaauuauagcauuuaaacuucauuuagguauaguguugaaaauaugcuuuuaauucaugauagugcuuuuaaagaugauaaaccugagggcuuagauauaaaguacuuucaaaaggaucacacagcugauuguguuagagccuggauuugaauuucuuucugauugcagaguccauuaucuuaauuaccuuauaucaccauaaugggaaccugaaguaaaacugaaauagugaaccucagaccgggcauucuuucuuugcuucugugcuguauuucucuguaccccauaguauuucucuugggcacgccccucauuuaagugucuguccuccauucuuuacguuuaaagccagccaaucaguugcccaaucaggguauuuauuguauacuccuauguccugucacuguccuaggugcuauaagaagaacugugcacacaauuccuaacuuuuaaguaauauagcuagugaauuacuggcuggaaauuuaauagggcuuuugaaaagaaggauauggggaggaacaguuggcuucaaagagaaucagacugaugggcagagucagucauaggaauugguuggcucuuuauuaguauaaauuaguauaaugucuuugguauuuuaaaacuuaagucuuucaaaugaacaauauuuuugcuuauuuuuuguggaauauauauuuuguguuuuuuaacuuucauauuucaaaaaaugucaugcugcuauacaaaguugaauugugauauaauagauuuuaugaccuauugauucuaccaccuuuucauugucuugcacauccccagguucucacuuuccuccauacccauuuuaaguuucuuaguugaguaucauaaucacucccuugccuugcauucuuuauucuuuucugucuucuugcuuugacaaacuuacuugguuaaaguacagccuugcuuaaauucauuacucuauguuccucaccuguacacaugcagcugaauauaucuggguauaucugggagaaaauacacaaccaugaucucuguuauuaguuuaaauucuucauuauuaaauucagguugguccuucauccuucucggcagucaugguuggucuccuuagccuauuuguacuuugauuuucccagagugcuauuucauaucuuuuuuucuucaaagccugauggauccuuuugcaacguuauucccgaugacuuuauauccuaauucacugaaaaaaacagaagcagugagaaaauaauuucuaccagcuuuuacuugcuucuguacuccuaauugcauuugggcccuuauaucuucucuuuuauuuuauuacuaaacuauuuauacuccugauuagagcuaccccuuuacuuguccaguaaauuuaaucccuucuugcuuauauagguacauugcuuuagaaauuaucuuuugguagcaucaaaauuaccuucuuuguuggauuauuacuaucagaauucauuuggaaaauguuuauugaguaccuacuaugugucuggcauaguucuaagugcuaagaauauaugaauggagcuuacaaucuaguugaaaagacaauaagcaaaaaagauacuaaaaaacuucauaucaaauguuagaaaaugguaacaugcuauggaaaauaaaaaauagagcagguaagagaagauggagggagaguccuagguaaggggugcagauugcaguauuaaauaggaugucuaagagagcagcugugcgggugugugaggggggaaagaauguuaggcagagggcaaaaagcucuaaagcagaaagaguguagugcauuguugaggaaaugcagggaagccaggguggcuggcagagcagccugaaagagaguacuaaggaaguaggucagaaacuucaguggggucagugggagggucagaucacguaggacaccugcugaucacuuaaaggccuuacucaucuauucuuagugaacugaaacacugcagaacuuuuuugcagaucuucauuuuaagaagauuucuggcugcuguguugagaacagacugcagugaggggcagggaaaagcuauucuaaguuuuuuggaaucaucaggugagagacaaugauggcuuagucugagguaguggagguggugagaaguuaucagaagcugguuauguuuuuaaaguagaaacaccaagauuugcaggaggagugaaugugaugucagggaagagaggacuccaagggaauucuuggguuuucagcuugggcaauugaaaggauggaggugucaugugagauagaggaagccacaguagagguuggcagaagaaggagcaggguugagagaggucaagaguucacguucggacauguucagaugucucccagagcacaguuucugucuuuaacuuacauagucacucagcaucucuaaauaggaagaaucuugucuuagggcagccgggagguuuaggcauugggcacacagaaucugaaguagaauuauagcaguggaaaaccaguuacgaauggucucccacuuacaguaguucaugguaacgaugucuuacuuuaccgugcuccugacagcaguacacacucaauggagauuguauuucaaauuuuggauuuuugucuuuuccugggguagugauuugcugugugauacucccuagugaugcugggcagcagcagcaaaucacagcuugcagucagccacgugaucacaacaugcacaguagauacucuacaguguacuguguugccagcauuuuucuggaugcucuuaguuuuuguguuuucucaucucaucaugucgacaaaacacccaucuauguguaauauucaauacuuuacuacaaaacaggcuuuguguuggaugauuuuuguccaacucuaggcuaauggaaguguucugagcauguuucaaguagguuaggcuaaucuaugauguuggguagucuagguguauuaaaugcauuuuugccuuauaauauuucugacuuacgaugguuguauuggaauguaacacagucauaagucgaggagcaccuguaaugacaaauaguaccaguaucaaaaaggaagaucaguuuauguuucagccugggugauggaaaauuaugaaagccaggaggaggaaugaauuuuagggggaaaauacugaguuugguuuuaggggugguccaguaauucaaccagguagaaauauucacuauguguuuagacacgugugucuuaaaguagaacugcaaggugaaaaaaguuuggauuuugauauugguaaacugagagaugauugcugaaaacauguaaacuguuagaaaacuaagcagagacccuugggugaaugauuucucucaguguaaagggccaauaaagagcuaaucuggggcuggauacgguggaucaagcccguaaucccagcacuuugggaggccgaggcgggcggaucacuugaggucaggaguucgagaucagcuuggccaacauggugaaaccccaucucuacuaaaauuagaaaaauaagcugggcaugguggugcacgccuguaaucacagcaacuuggguggcugaggcaugacaaucacuugaacccagcaggcagagguuacggugagccgagaucgcgccacugcacuccagccugggugacagagcgagacugucucaaacaaacaaacaaacaaaaacacagcuaaucugaguaaagaauuggaacuauaaagagauagaaauggcaguugauaguugcuaaugauggagauaggacacagcagauaagcacugagaaaagacuugaaguuuucaacggagauaaauuaguuucuuccaaaagagcagagucagcagacaacccuacccuauuuuuucuugguguccaauaccauuuauccuuuaaagcccagcucagauguaugccaaauaauaguuaauguuuguugaaagcuuauaggucucauauuaugcuaauauuagaugaacuuauuauuaauuccuacaucaauucuaugauguagauacuguuucccacuuaacuguugaagacuagcgaguuuaauuaauuuguccaaguuuguguaguuaaugguacgaaaaaauaauugaaucuacgcacaccagugucagagaauccauacuuuaggcucauguuuguugacaucuuccuaguuauucaguaacagaauuuaaucauguuuagagugacuggcucuuggggcaguggauacuaagaguuacaggcaguuuauauugucaaaaagcuuauaaucuagguaaggauaagugauauuugucauuuucuuaaaaugauaaguaauacuguaagauagucuaugguaagugacacaugagggauaugguaauaaguaaagagaauagagaggaugaaauggucagucuagggcgagguguuauggaagguuucauggaaggaauaauauuugaucuggaccuucaaggaucaguacuauugugacugcaggugaugcauauggauagagguaaaauaagugaggaaaguauuucagauagcaagaacagcuggagcaaaggcauaaauaaaugaaagaguuaagauguguguuuggggaaaauuauauaguccaguugaggugguuaauguggccagaaugggugaaggauuggaaaggaagacuaaggucaggcuguaaauaaucuugaguggagaaccauagaaagcugugaguucgcacuggguuuuguuuaaaauagaacucuguaguucucaauuauuuacuucuuguuuuaaauauauccauauuuaaagaaacauuuuauuuuauucuuagaaugccaguuaaugaaaacagaacgaccaaagccaaacacauuuauaaucagaugucuccaguggacuacuguuauagagagaacauuucauguagauacuccagaggaaagguaagaaauucacuuguuuucauuuugugaaaaagcaacacucaaucuaaagauguauuuguaucugacuuuauuauuuguaaauauauauaaauauauuuuuuuaaaugcuauagucucuaaauucuugcuucuggcauaauacaugaauaacaguggcuuacaaaauaauauuuaauauaucagaaccucugggcaugcuagaagauauacuuucagagaaacagaacauuuaaagguuaaaauauaaauuuaaaaagacauuuuuggccuggcgcgguggcucacgccuguaaucccagcacucugggaggcugaggcagguggaucacaaggucaggagaucgagacuauccuggcugacaaggugaaacccugucgcuacuaaaaaaacacacacacaaaaaaucagccaggcgugguggcgggcgccuguagucccagcuacucaggaggcugaggcaggagaauggcaugaacccaggagguggagcuugcagugagccgagauugcgccacugcacuccagccugggcgacagagcgagacucugucucaaaaaaaaaaaaaaaaaaaaaaaaaaaaagacauuuuuauagccaaacuaccuuuuuuaaaaaauuguauaauugauuguauucauacuugaaauuccaaggcuagugauaguaaaagauuucaaguaacaugccauucuaaauuaguuguaaguggcugucuggagcacuaaguugcuaaggauucugagauugggucuaaggagcgggagagaggauuaauuagcauugacugucauuauuacuaaaguggguagugacaacacuguaguaaccaacucaucaacuucaucagguccacauuuuuauccuccugaucuaucaguuuuuacaaccacuucccaauucuauaucugcucacucugauacugaguuagguccagugaccacagucacaaaaccaccauccugcacauguuauuauauuugauccuaaucagcaacuuugugaaguuaaaucuuauuagccuuauuuuccaaaugaauacacaaaguuuuaacagucuugucuaaaauuuuaauaaaagcaaaaugguaaaguauuauuuuaauaacacuuuugaucaguagaguaaaugguaauguaugauugauuaagaaauauagaaaagaguuaagcacugauaauauuuucuuuugugcacuuccaaucuuacuaugugcagacguaauuaggccuuucauauagauacaguucuggguauggguccccgaacucuuacccugccugcacacccuccccucccugcacugccucccuccccgcacacccuccccuccccaccauugauccugggccuuuucucccuugauaauuaauacugagcuuucaauuuguugauauguccacccauaauccauaaucacuaaguugggcuaauuccuauguaucuuuucagaucugagcuuaaaauguuauuuuuccuacaaaaccucugacucuaauagacuaggcagguuccccugcuagguacuuagauauuuuucuuuguaccuuuucuaucaaucauauuauaacuguaauccuuguuugccauucucacuaaacuugaagauucuugacagcaaagaugauggcuuccuugcucauuuaaaacaucuuuugcacauaguccauggcccaacacaguauuuauugacuggcuggaugaaugguacuuuucccaugucaauauauauucuuugaaaauguuauucuuaguggauuuuuaacaucuguugaagcacaauucauuuugccauuuguguuuacaaagcuggauuucugucagaucuuaagacucuaaaauccucugcuguuccuguaauaauauacuacucuucugaacaaucaguuuucauuugcauuuauaacuauaagaaaaaacaguauuaauacaaaugaaaaacagcauacucauauuugccauugguaugugcauuucuauauaccucuagaaucugguguuuggacauucuauaugacuugauuuuuuuuucuaaauuuuuauuuuauuuuauuuauuauuauuauacuuuaaguuucaggguacaugugcacaaugugcagguuaguuacauauguauacaugugccaugcuggugcgcugcacccacuaacucgucaucuagcauuagauauaucucccaaugcuaucccuccccccuccccccaccccacaacaguccccagagugugauguuccccuuccuguguccauguguucucauuguucaguucccaccuaugagugagaauaugugguguuugguuuuuuguccuugcgauaguuuacugagaaugaugauuuccaauuucauccaugucccuacaaaggacaugaacucaucauuuuuuauggcugcauaguauuccaugguguauuuaugccacauuuucuucauccagucuaucauuguuggacauuuggguugguuccaagucuuugcuauugugaauagugccacaauaaacauacaugugcaugugucuuuauagcagcaugauuuauaguccuuuggguauauacccaguuaugggauggcugggucaaaugguauuucuaguucuaggucccugaggaauggccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugauggugagcauuuuuucauguguuuuuuggcugcauaaaugucuucuuuugagaagugucuguucauguccuucgcccacuuuuugaugggguuguuuguuuuuuucuuguaaauuuguuugaguucauuguagauucuggauauuagcucuuugucagaugaguagguugugaaaauuuucucccauuuuguagguugccuguucacucugaugguaguuucuuuugcugugcagaagcucuuuaguuuaauuagaucccauuugucaauuuuggcuuuuguugccauugcuuuuuguguuuuagacaugaaguccuugcccuugccuauguccugaaugguaaugccuagguuuucuucuaggguuuuuaugguuuuaggucuaacguuuaagucuuuaauccaucuugaauugauuuuuguauaagguguaaggaagggauccaguuucagcuuucuacauauggcuagccaguuuucccagcaccauuuauuaaauagggaauccuuuccccauugcuuguuuuucucagguuugucaaagaucagauaguuguagauaugcgucauuucugagggcccuguucuguuccauugaucuauaucucuguuuugguaccaguaccaugcuguuuugguuacuguagccuuguaguguaguuugaagucagguagcaugaugccuccagcuuuguucuuuuggcuuaggauugacuuggcaaugcaggcucuuuuuugguuccauauguacuuuaaaguaguuuuuuccaauucugugaagaaagucauugguagcuugauggggauggcauugaaucuguaaauuaccuugggcaguauggccguuuucacgauauugauucuuccuacccaugagcauggaauguucuuccauuuguuuguauccucuuuuauuucuuugagcaguguuuuguaguucuccuugaagagguccuucacaucccuuguaaguuggauuccuagguauuuuauucucuuugaagcaguugugaaugggaguucacucaugauuuggcucucugucuguuguugguguauaagaaugcuugugauuucuguacauugauuuuguauccugagacuuugcugaaguugcuuaucagcuuaaggagauuuugggcugagacagugggguuuucuagauauacaaucaugucaucugcaaacagggacaauuugacuuccucuuuuccugauugaauacccuuuauuuccuucuucugccuaauugcccuggccacaacuuccaacacuauguugaacaggaguggugagagagggcaucccugucuugugccaguuuucaaagagaaugcuuccaguuuuugcccauucaguaugauauuggcuguggguuuguuauagauagcucuuauuauuuugagauacaucccaucaauaccuaauuuauugagaguuguuagcaugaaggguuguugaauuuugucaaaggccuuuucugcaucuauugagauaaucaugugguuuuuuucuuugguucuguuuauaugcuggauuacguuuauugauuugcguauauugaaccagccuugcaucccagggaugaagcccacuugaucaugguggauaagcuuuuugaugugcugcuggauucgauaucaccacagaucccacagaaauacaaacuacccucagagaauacuacaaacaccucuacgcaaauaaacuagaaaaucuagaagaaauggauaaauuccucgacacauacacucucccaagacuaaaccaggaagaaguugaaucucugaauagaccaauaacaggagcugaaauuguggcaauaaucaauagcuuaccaacgaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauccugauaccaaagccuggcagagacacaaccaaaaaagagaauuuuagaccaauauccuugaugaacauugauacaaaaauccucaauaaaauaguggcaaacugaaucuauaugacuuuaguguaauaucauugaagacuuagagaggguuagugugaguuagaaaaacucucuauuuuuaauauucugcccagucuaaaauuuuuaccugucauaaacuaaaucuguauaucucucaccugucuuauauuuauuucaguacaugauauaaggguggacucuauuuuuuucucaauggcgagcccaucaucucaucuccauuuauuagauaauccauuuuuuucucacugauuguggauaacacauauacauauuugcgcuuuuaggauuuagucuuuuuuuccccuuugaccuuucuguacucuagcauuaacaccacauggccuuaauuagagaaacuauaaaauuuuuaacuguuaauauagcaacauaucccuuauuuuuuuuaacaaaaauguucuuagcuacauuagugcauucuuuuaaaaaauuaugguaaaaauuacauaaugugaaauccucuuucauuuuuaaggguauaauagaguauuguuaacuaugugcauauuauuguacagcagaucucuagaacguuuucaucuggcaugacugaaccucuguucccauugaacaguagcucuccauucccauacccccagccccuggaaaccaccguucuacuuucugcuucugugaauucgacuacuuuagacacaucacauaaguggaaucauacaguguuuguccuguuacugucuuacuucccuuaguauaaugucuucaaaguuaauccauguuacagcauauuagaggauuuucuucuuuuuuaaggcugaauaauauuccauuguauguauauaacacaauugccuucuuucuuuuuuuuuugagacaaggucuugcucugucagccaggcuguagugcaguggugugaucauggcuuacugcagccuggaacucaggcccaagggauccucccagcuuagccuccccaguagcugggacuacagccacacacgcaacuaaguuaauuuuuuuuuuuuuuuuuuuuuguagagacaagguuucucuguguugccagggcuugucuggaacuccuggccucaagcaauacuccucccucggcuggaauuacaggcaugagccacacugccggccaauacauuuucuuuauucauucaucugcugauggauauuuagauuguuuccaccucuuggcuauugcgaauagugcaacaaugagcaugagagggcagauauuuguuuaaguuccucauuucacuuuguuugaauaaauauccagaaaugugauugcugguucauuugguaguucuacuuuuaaguuuuugaagaaucuucauacuguuuucuguagcagcuacguuauuuuacauucccaacaauaguguacaagguuuuaauuucuccacauccuugcugacacuuacuuauuuauuuuuuauguuguuguuuuuuuaaaaacaacagccauacuagcagguguaaggugauauuucaucgugguuuugauuuguacuucccugauaauuuguaaugcuaagcauuuuucaaauaccuguguaucauuuguaugucuacuuugaagaaaugucuauucaagucuuuugccaaguuuuuacuuguguuucuguuuuuuguuuucgcuacugaguuauaggaguucccuauacauuuugaauauuaagcccuuaucagacauaugguuuggaaauauauucucucauucuguaguuuucuguuuuguucuguuguuugcugugcagaagcuuuuuauuuugauauacuucuacucaucuauuacugcuuuugucagcaucaagaaaucauuucuaaagaccaaauuaugaagcuuuucuccugugguuuuuuccuaggaguuuguaguuucaugucuuauauuuauucuuugauccauuuugaguugguuuugugugugguguaaaauaaggcuccacuuuuguucuuuugcauguugauacccaguuuucucagcagcauuauauuuccacauuguguuaguugugacgcccuugucaaagaucauuugacuguauauauauaugguuuuauuaccugggcucucuguucuguuccauuagucuauaugucuuuaugccaguaccaaucuguuuuaauuacugaagcuuuagaaugcauuuugaagucaggagguaugaagcccucagcuuuuugcuuucucaagauuguuucagcuguuugggauucuuuaugguuuccauacgaauuuuaggauuuuuuuuuucuguuuccgcaaaaaugcuguaggauuuugaaaaggauugcauugaaucuguagcuuacuuugugguguugacaucuuaacaauauuaaaccuuucagugcaugaacaugggaugucuuuccauuuauuugugucuccuuucauuucuuucagcaauguuuuguaguuuucaguguacaaaucuuucaccuucuugguuaaguuuauuccuaaaguacuuuauucuuuuuuaugcuuuuguaaaugggauuugccuuagucccuuugggcugcuacaacaaacuaucauaaacugaguagcuuauaaacaauagaaauuuauuucuuacaguucuggaggccagguguuuaaguucaaggugcuggcaaauucagugucuagagagggcccucuucacgguucauagaaggugucuuuccccuguauugucaccuaguaaaagugccaaaggaacucucugaggacuuuucuauaaaugcacuaauuuaaucuaugaguucuaucaugaccucaugaaggcccacuuccuaauaccaucaccuuugggguuaaguaacccaaaacauuuauucuuuguagaccuaguaucugcagacaauaacaauuuuaucucuucauuucugauaguuuuauguauuauuucuguguguuuuaaagcaauguuuaauaauuuugaucauagcacauauaccuuuuuucuuaauuuauuggauacaccacuaauuuacuguuaaauaugauuuguauauguacuuuauuaugcugcacaugaccauccacaauauagacaaaggucauuuuucuuucuuaacagcuaacuacuuucacugucacaaccauggccacgacacucacacucacauacagagacacaugugcaugcgcacacguaugccucgcccccaacauguuccagauacauugaacuccuuguuguuucccaaguacuaaugcuauacugugcucuuacauuaccuguagcucuuuccuucuugcccuuuugucccuacugcuaggaacaccucguauccuuugcuugucucuugcucauccugguaaguaccaauucauuuuucacaucuacauucaagaauuaccuuucuuuuuggguccccaucacaaacuuuuauuauuguuagaacaccacuguacuuagcguauacuuguaucauuuuacccauaacauuuuauuauacuuccccacaauaccaaggcucccccaucagacuguaaguucuuccuaagccauuccuuuuuuaaacuuuaguagcacacauguauuagacauuuaauuaaauauuuauuaguaaguaacuaaucaguuggugaaaauugauuuuuguaugaaguaguauauguacuuuuaaaagauuaauguacuuguuucauaggggucuccauucuguuuuucaaauuaauuacauuuuuaaacauuauuuaggaauaaaaagauuggaugcccucuuucaauuagucagguacuuuggccugauacuuuuuugcaggaauuacccccccacacccccccgccacacccucaccaaaugguguaggguuauaguuuaaguaucaugaauuauggugaauuauguaauuugggucaguaguccagcuaacuaccacuagugaagcuggaaaagacuuuuguuuguuuuuguuuuuuaaaaagacaccagagagcugauaaggcuaagauuuauugggccaaaacuguauugaagaaagaaacccagacagugaaccuacuuuuccuuuuggguuaccugcuaguucuugaagugguauuggagauggagagauuuugaguagcucccagagcugggagugauauuuuggaaucuaggaucugccaaagaggagacaugguaaaccacuacauuuugguauugguagcuuaaaggacuguacccuguaagaaagaguaaacuggaaauagauuugcuuugagaggauugacauauaacuauaaauuauuucaguccugaaauugagugaaggugauucaacuuugcuaguuuucuaggagcuugcuaaaagcaaauguaaacucacucuaacagaagauuauaucuuccuagaccucacauuaccucaguuuucauguguuguguccaggacuuguuaaaaaaugaguacacaaaaauucaacacuauguggccaaaauaauagaggaaaaaaaaacagacaauagaaucauauucauaggaacucuagauaaaagaacuauacauuaauuaguauguucaaguauguuaaaauuguuugauucuacagagggaaaguauaaaaaagaaacaaauggauaauagcuuucauuuguaaucaagguaaaauuaaaaagaaagagccccauagaaauucuaaaauugaaaacaaaacauuuggaauuaugaguucuagcagauggcuuuaauagcaaacuagaccucacauuagagaaaauuagcgaacucaaaaauacgucagaacagaacguuuauagugaaacaugcaaagauaagaggauagaaaauaaaaauaauuaagaauagaauguaagauaaaaacaaugcggugagcaugucuuacauauauauaacuggagccuuagaaggagaggagagaauagagcaaaaaguauuugaaaauauaaugauugaaauuuuuuaaaaaauaguuaaagauaccaaaccauaguuucaaaaguccuauaaaucucaaguaggaaaaauaugaagaaaaucccuaaucucauuagacuauuaaaaaacaaagauagugggaaaauccccaauguagacagagaaaaaaauguuugcuuucagagcagcagcauguagaccaaaagauaaugucaauaugugggauggaauaauaaugaaauauaauugaauaauguucccaaauaauggaauauuuccaaagaugaugaaaugauauccccaaaguucugaaagaaaaugagugcuaagaaacaacuauuuuccaugaauaaaaguaaaaugaaaauauuuucaguaaaaaauugaaagaggcugggcauugugucuuaugccuauaaucccagcaccuuggaaggcugaggcaggaggaucacuugagcccaggagcucaagaccagccugggcaacauagugagauccugucucuacucccuucacccuccaauaauuugauaagauuugucacuagcacaccuauaauaacuaaccuaguauucuuuggacacaauaagaauaaucucaggaggauaaguacagaauggaaugaaaaacaaaaugcuuaaauaaaccaauaaauaaaaguaagcauugauuuuuaaauaauuuauguuguguuuuaauuauauaagugaaaaauaucugaaguaauauaaauugagauccugacaaaaauggaguuaauuuuuugugagguugcuguauuuucugguaagaguuaaaaguauggacauuuuagacuuugcaaagucaaaguuaaauauuauaauuuaaguuacaauuacuaaaaagacagugagaguaugauggcuaccaggcuaauuggaggagaaauggaauuagaaauuauucuggcauauauuacauaaguggaccauguaaagcuaaggauauauauaaaaauaauugcaaaaaaagacgacugaaaagccaacaggaaaauuaaaauggaauucugaaaaagugcaaaauaauuuaaaaaacaggcaggaaaggagaaaaagauaaagauacagguugaaaauaaauagauugaaaaagauugaucauggaaacaguaagcauaagaagaauggauugccguauuauaucauuucaaauuaaauguauuaccauagauuacuaggauacuuuauaaugagaaaaguuucuguugaacaggaugauauagcagucaucaacacauguaacagaauuaaagggauaaaaaugggcaauuucacaaccauauuuggagauuuaaaaauucucagcacuugguagaggagcuacacaaaaaacuagcuaaggcauagaauaacauugucaaccaccuugauauaccuaguauuuauagaacacuacacucaaaaguggcagaagagacguuauuuucaaguaagcaugguacauugaucaggauggaacauauucuuaucaggauaaugcaguccucauaaaaugaguuagggaggauucccucuuuuucuauuguuuggaauaguuucagaaggaaugggaccagcuccucuuuguaccucugguagaauucagcugugaauccaucugguccuggacuuuuugugguugguaggcuguuaauugcugccugaauuucagaacuuguuguuggucuauucagggauucaacuucuccuugguuuagucuugggagguuguauguguccaggaauuuauccauuucuucuagauuuucuaguuuauuugcauagagauguuuauaguauucucugaugguaguuuguauuucugugggauugacggugauauccccuuuaucauuuuuuauugugucuauuugauuuuucucucuucuuuauuagucuggcuagaggucuaucuauuuuguugaucuuuucaaaaaaccagcuccuggauucauugauuuuuuuuuugaaggguuuuuucaugucucuuucucccacuauuauugugugggagucuaagucucuuuguaggucucuaagaacuugcuuuaugaaucugggugcuccuguguuggaugcgucuauauuuaggauaguuagcucuuuuuguugcaucgaucccuuuaccauuauguaaugccuuucuuugucucuuaugaucuuuguugguuuaaagucuguuuuaucagagauuaggauugcaacuccugcuuuuuuuuuuuuuuuuuuuuuugcuuucuauuugcuugguaaauauuccuucuucccuuuauuuugagccugugugugucuuugcaugagagauggaucuccugaauacagcacauugauggaucuugacucuuuauccaauuugccagucugugucuugucauuggggcauuuagcccauuuacauuuaagguuaguauugucacaugugaauuugaugcuuuaugaugcuagcugguuaguuugaccauuaguugaugcaguuucuucauaguguugauggucuuuucaauuuagcauguuuuugcaguggcugguaucaguuguuccuuugcguguuuagugcccuguaguggugacaaaaccucucagcauuugcuugucuguaaagcauucuauuucuccuucacuuacgaagcuuaguuuggcuggauaugaaauucuggguugaaaauucuuuucuugccuguaauuccagcacuaugggaggccaaggcggguggaucaccugaggucaggaguucgagaucagccuggccaacauggcaaaaccccaacucuaccagaaauacaaaaaaauuagccaagcaugggggcagacaccuguacuccuagcuacuugggauucugaggcagacaaucucuugaacccaggaggcagagguugcagugagccaagauugcacuacugcacugcagccugggugacagagugagacuccgucucagaaaaaaaaaaaaaaaaagaauucuuuucucuaaggauguugaguauuggcccccacucucuucuggcuuguaggguuucugcagagagauccgcuguuagucugaugagcuucccuuugugggaaacccuaccuuucucucuggcugcccucaacauuuuuuccuacauuuugacuuuggugaaaccuggcagagacgcaacaaaaaaggaaaaugucaggccaguaucccugaugaacaucuaugcaaaaauccucaguaaaauacuggcaaacugaauccagcagcacaucagaaagcuuauccaccacgaucaagucagcuucaucccugggaugcaaggcuggugcaacauacacaaaucaauaaacguaauccaucacauaaacagaaccaaugacaaaaaccacaugauuaucucaauagaugcagaaaaggcuuucaacaaaacucaacuccccuucaugcuaaaaacucucaauaaacuaaguaucgauggaauguaucucaaaauaauaacagcuauuuaagacaaacuuacagcaaauaucauacugaaugggcaaaaacuggaagcauucccuuugaaaacuggcacaauacaaggaugcccccucucaccacuccuauucaacauaguauugaaaguucuggccagggaaaucagguaagagaaagaaauaaaggauauucaaauaggaagagaggaagucaaauugucucuguuugcagaugacaugaucguauguuuagaaaaccccguugucucagccccaaaucuccuuaagcugauaugcaacuucggcaaagucucaggauacaaaaucaaggugcaaaaaucacaagcauuccuauacaccaauaauaaacagccaaaccaugagugaacucccauucacaauugcugcaaagagcuuaaaguaccuaggaauccaaauuacaagguaugugaaggaccucuucaaggagaacuacaaaccacugcucaaggaaauaagaggacacaaacaaauggaaaaacaacccgugcucauggauaggaagaaucaauaucaagaaaauggucauacugcccaaaguaauuuauagguucagugcuauccccaucaagcuaccauugacuuuuuucacagaacuggaaaaaacuacuuuaaacuucauauggaaccaaaaaauagcccgcauagccaagacaauccugagcaaaaagaacaaagcuggaggcaucaugcugccugacuucaaacuauacuacaaggcuacaguaacaaaaacagcaugcuacuaguaccaaaacagagauacagaccaauggaacagaacagaggccucagaaauaauaccacacaucuacaaccaucugaucuuugauaaaccugacaaaaagcaauggggaaaggauccccuauuuaauaaaugguguugggaaaacuggcuagccauaugcagaaaacugaaacugaccccuuacugacaccuuauacaaaaaucaacccaagauggauuaaagacuuaaauguaagaccuaaaaccauaaaaacccuagaagaaaaccuaggcaguaccauucaggacauaggcaugggcaaagacuucaugucuaaaacaccaaaagcaauggcaacaaaagcgaaaauugacaaaugggauuuaauuaaacuaaagagcuucugcacagcaaaagaaacuaucaucagagagaacaggcagccuacagaaugggagaaaauuuuugcaaucuauucgucugacaaagggcuaauauccagaaucuacaaagaacuuaaacaaauuuauaagaagaaaacaaccccaucaaaaagugggcaaaggauaugaacagacacuucucaaaagacauuuaugcagccaacaaauguaugaaaaaaugcucaucaucacuggucauuagagaaaugcaaaucaaaacacaaugagauaccaucucacaccaguuagaauggcaaucauuaaaaagucaggaaacaacagaugcuggagaggauauggagaaauaggaaugcuauuacacuauuggugggaguguaaauuaguucaaccauuguggaagacaguguggccauuccucaaggaucuagaacuagaaauaccauuugaccuagcaaucccauuaguggguauauacccaaaggauuauaaaucauucuaccauaaagacacaugcacacguauguuuauugcggcacuauucacaauagcaaagacuuggaaccaacccaaauguccaucagugauagacgggauaaaaaaagugugguacauauacaccauggaauacuaugcagccauaaaaaaggaugaguucauguccuuugcaggcacauggaugaagcuggaaaccaucauucucaaccaacuaucacaagaauagaaaaccaaacaucccauguucucauucauaagugggaguugaacaaugagaacacauggacacagggaggggaacaucacauacuggggccugucagggaguugggggcuaggggagggauagcauuagcagaaauaaccuaauauaggugacggauugaugggcacagcaaaccgccaugacacauguauacccauguaagaaaacugcacauucugcacauguaccccagaacuuaaaguguguauguauguguguauguguauauauauauacacauaacauauauauauacacacacacacacccaacauacacacacacacacacacacacacacacacacacacacacacacauauacacauaacauauucuuggucauaaaauaauucugaguacauuuuggaagaugaaaguuauaugguguauguucuguaauccacagaauuaauuagaaaucaauaacaguaagacaauagaugucaauuacuggaaauuaacauaauuuuuuauaaucauugggucaaaaaacucacaagagccauuagaaaauaauuuuaaaugaacaauaaugaaaauaauacauaucaaaauuugugggguguagcuaaaugaaugcuuagaaggaaauuuguagccuuaaauaccuguauuugaaaagaagaaauuucucacaucguuaacuuaagcuuguaucuuaagaaaccagaaaaauaaaccaaaagaaaacagaaacaacagcaaucagaaauuagugaaauagaaaacagaaaaauaguagagaauaauuaauaaaaccaaaaguacucuuugaaaaaaauuaauagaauugaaaaacguuuugggguauuguuaaaggaaaaagagggaagacacaaauuacugacauccaagaaaacauuagaaaacccaauaucaaugaauggaagugaauuaguaauuaagaaccuuuccucaaagguuccaagcccagacagccuuauuggugcguucugucaaacauuuaaguuagaaauuugaccaauccucuacaagcuguuugagaaaauaaugagaagggaguacuucucaacuuauuuuauaaggccacugucacccucauuucagaaaucagacagaacuauuuuaagaaaagacaacuauagcccaauacacuugugaacauaugcagaauuucuuaacaaaguaucaacaaauuaaacaauagguaaaaagcauaaaagcuuaaguuauguggccaaauggagcuucucccaagaauucaaaguuguguuaacaucuggaaacuauuaagcuaauuucaccauauuaauaugauaaaguuaaaaaucugugugaucauuuuauagagauacagaaaaagaauuugacaguuuuauuuucuuuuucuuuucuuuucuuuuuuuuuuuuuuagacggagucuugcucugucacccucacuggagugccauggugugauuucagcucacugcaaccuccauuuccuggguucaagugauucucaugucucagucucccgaguagcugggauuacaggcuccugccagcacauccagcuaauuuuuguauuuuuuguagagacgagguuucaccauguuggccaggcuggucuugaacuccugaccucagguaauccgcccaccucagucucccaaagugcugggaucacaggcaugagccacugcaccuggccuacauuugacaaaaauucaacaaacuuucauuaaaaauaugcagauggcuagaaauagaauagaacuuaguugauuaaguaaauguuauauagaagaucuacaacuuacauaauauucaagggggaugaaaacaauguuauuccuaacuugugaaacaaagcauguaugcugcuguuuacuuucauuuaacuuuguacugcaggucugaucuagggcaauaaagcaagaaaaagauguaaaaagcauacggauuggaaacaaguaaagcugcucuuguuugcauaccacaugguugcauguguagaaaaugcagaaaaauaagagugacuggaacuaauaaaugaauuuaauaaaguugcaguauacaaagucaauauacaaaaaucaauuguauuuuuaaauacuaauaaguacaauuagaaagugaaauaaaacccuccacaauagcauaaaagaacagucuugugucacuuaaugacagugauacguuuugagaaacaugucauuaggaacauuguguaaacauacuacuuggacaaaccuagaugguauagcccaccccauaccuaggcuauuugguguagccuguugcucacaguuuacaaaccuguacagcauguuaguguacugaauacuauagacaauuguaaugcaaugguaaguauuuauguaucuaaacauauaagcauaggaaggguacaguaaaaauacaguguaauaaucuuaggggacugccaucguauaugcaguccaucauugacugaaacauuguuauguggugcaugauuguauguaggaauaaauucaguuaaagaugugaaagaucuuuacacagaaaauuacaaacauugcauugggaaauuaaagaccuguauaaauguagagcuauaccauguucauggauuggaagauuuaaaugauuacgaugguaguuuucccaaaauucaucuauagauuuaauguaauuccagucaaaauccaaauagacuuuaagaaguagacaagcugauuuuaaaauucacauggaaaaauaaugauccuuggucugauaaccaaaugucaaaaaauaaaugcuugauauaaaugcuccugagacugauuguucaaacuacaagcuguauccuuuuuuuuaauuuuuucuaagaaauuuacuaugaucuggaaacaaugaaagguuuuggcuuugaaaaccuuuccuuggaaugucuguuggaccucauagaaaucuucaggaugucaaugauggacuuaaaauagcuaagcaaaacacuucuaaaaacugcagcaaacuuuuagggggucaacuuaauaguuaggauuggccaagugcggugguucauggcuguaaucccagcacuuugggaggccauggcggauggaucacuugaggucaggaguucgagaccagccuggccaacauggugaaaccccgucucuacuaaaaauacaaaaauuagucaggcauugugucacacgccuguaaucccggcuacucaggaggcugagacaggagaaucacuugaacccacgagguggagguugcagugagcugagaucaugcuauugaacuccagcuugggcaacagagugagaccguuuccaaaaaaaaaaaaguaggauauauauauguacagacaaauaaaauuuaacuuuucauguaaaugauuuuaacucgaguuuucaacaauuuuuuucuucucuuuuuuucuuuaacauacuuccaaaaaaugcuacuacagacuuuaggcauguggugaaugaaaugcucuuaggauuauuuucacuuuggggugauggugagaguguaugcuuaucuguguugaguguguuugaucucugaauagauuuuauuuguauugauuucauaguuuauaaaaggaaaauauuuaaaucauuuaccaucuucuauuaaugggaaauuuuacucauuuuuauagggaagaauggacagaagcuauccaggcuguagcagacagacugcagaggcaagaagaggagagaaugaauuguaguccaacuucacaaauugauaauauaggagaggaagagauggaugccucuacaacccaucauaaaagaaagguagaaaauaauaacuuauucccagcacagcauucauuugucuggaagaaacauauuaaaagcuaccauuugcagaaagaugucagccaguuuucuuacgauauguaaauauauuggugggucuuauucacaugaaucugaaauaccuguuguuguuuaaaaccaaauaggugaacauuguuucagugauccagcacuuuagcacugaaugcugauagggcucaugugugacugaugugccaucacacuacuuuauaauuugcauuuuuuccuuauuauuuuuaauacaauuuuagaaacuuuguaauaaaauguuuucccugaugauuuguucuuuuccauuucgcauuucguauucucccgaaaagcacgagcaguaauggcucggauguacuuccugauuggugcccucagucauaguaaagucagcaggaaagugaacaaucuuggaaacaauaacucuuauuuaauggcugcuucugagucaguagggaaauagacuuuuccuucucucaguguuccagcauaauaaguacgaauuuauauuuuuaugagcaauauaaauuuuuucauugcaauagaaaauugaaaagcaauuuccuuauuacaaaaaugauauuuucaugauuaaagauagagguguugagauaagcuugccauuuaucacuuuagaauauguuugauuuaauagguuguaaauuaaucuucagggaggaaaacacaaauuuucaagguauuauccaugaaauuugguauuagcacagugauuaagaacucuuuggagauagacugccugaguucauauccucccuuuuccacguuaaacuuguggacuuggugaaguuacacacucacaacauaaaguuaauuauccuuuccuuaugugaauaagaauaauauucuauacuugaucugggccaaaugucugagaucccuuucugucuucauuguagauuucuacucuguuuguuuguugaacugaaucccucuuuucuuuuacgucaauuuaaucugccuuguuccuccaucauugcaaaaagaaaaacaaagucuagcuacacccaccuaccuacucagagauaagaaagcuucuuuuguacauguguaaauuauuucauuuaaaaugaaaugaagaauaguguaaaucugauaugguuaaguauuugaaccccaaauucaaaauaccucuauggauuuuucuuuuuggagacucaguuggaguaaaaaauucuaagagaagauguuuuagagugauguuuauguuuaauuaucuuuauguggacaaagaauaguagcuaacuuuaauagcuaauauuuauugagcacguauuacauaaacacuuuaaacauuuuuuuuuucauuuugaacuucaacuauaaguuaaguaccauuauuauuccuguuuuauaguuaagggaaauaaaggauggaaggauuaagaaauuuuccccuuaauuacacacagggugggagccaguacuuaaccccaggcaguaagaucugaacuccucccuuucuagcacuagguugugauaguaaaguucuacugguuuuuucaagaauuuacaagcuuuauuaucaauugaaauuaacuaauauccaaaugucauauaaggacaacaguuuuucauaauauuuugagaaacagaguauagucauaagagaauaucugcauaauuuuguuucuaauauaacuucauuauaagcauaaaaauuauagagauuagagaggcucaagauauaugaaccaagaaaaagaaauaagcuguauauugacguguuacaguauacaauuaaaagaucuuauauguuugaaguucuguuaacuuuuuugaaauaauuuaaaauaguucuaaauuacugcagaaguuagugcagaaaaagaacauuuguaccacuacuaacuccauaacgguccuaaugacuuagccucaagugguaaaauauuacugucauuuucauaagauaaaugauucuagaacuauacccuuauguauaucaauuaucaugcaaagaauugcagaaguuuggauuauuuuuaagacuauaaccacacauugugaaauaagaauauuauucuaauaauuuauaggauacauuuccuucuuuaauuuuugccaaauggcaauaggauuaaaagaauagguacugauuaugauggcuauggugacaguugucagacugcuauuucuugcaugaaauaggguucguuaccucccuuagugguggauuaucgccacagugucugcucugccaguuaaaaacucaauuggaaaggaaggauguuggguguaaagaggcaagggccucacagacagauuuaagugcucuucuuuguuugaauuaaaagaaaaugugguucuauguuuuaauuaaaagauagcguuucagaggaauuugcuuagagaacccagaagugccuaaucuuggucagccaagcuaccauucuuguaugccuugucaaguaugugaaggggcauagcauaaaaggauaaaaagccaagugagagucaaaauucugcuuaauuuuuaacagacuagcauaagcuucucugggaucaacuggcuauaaucucaugauuuacguuuaaaguauaagcagugccuccugcuuucccacuaaguuugacuccaguucuugggauuguaucaccuaauuccuggcuguaguaacucauaccaguggccaguauccagagaaaaagagaaggaaaaaaagaacaauggccagaccugcugaaaucucaugaucucacacugcaugaaucugcuuauuuaaaagggagaagcgacguaaccaauguagaaguugacuaauaacauuagcuccaccucuucccgugagaaagagcaccaggagaagugggcagagauggaggcaaaggagugaacuucgucagagcucuuuuccucuuucuacuuacuugguuuugcuguuacauuguaaauguaucuggaauuuaucuuuuuuugaccaaauaugcuaauacugugguauucuuggaaguucuuuauguuccucauugauuauauguuuauuuuuaaucuaauuugugggcuagacagugucuuauauucuggugugccugauuugaacacauuuauuaagcauuuguuauauaugcccauguaucucuuuaccuaaaacagccacguaaacauguaaagggaagaguguaacuguaaaguauuuccccaauaaauucuuaagaucaggcuuuggaggaggauuauuuuucuggagaguauucauacuccuauauuuuuauuaaagacuuacuguggcugggcgugguggcucacgccuguaaucccagcacuuugggaggccaaggugggcggaucacaaggucaggagaucgagaccauccuggcuaacacggugaaaccccgucucuacuaaaaauacaaaaaauuaaccaggcgugguggcgggcgccuguagucccagcuacucgggaggcugaggcaggagaaugucgugaucucaggaggcagagcuugcagugagccgagaucgugccacugcacucuagccugggcgacagagcgagacuccgucucaaaacaaacaaacaaacaaaaaaaaggacuuacuguaucuuuuuccauaacaucauccagaagaccaaaacauuuuguaauaguguacauuucauuuguaaagacuacacaauuacuguguauaccauucugaccaugagcauuugauagcaaaaauaccuuuuuaauuuccugaaguucugucaaaauagaugggaaaucuguuucugauuuuaucacauacagugcuuuuuaacuaauaguaauuuccauguaaauucccuuuuuuuuaaagauugagagucaaacugacaagcugugaaguucagugaaggcugucauacuuuuuuuuuagccucauuguuccuaagaauugcaauuuuacuauuuacuuauuuauuuauuuucauuugagacaaggucucacuccuaucacuuaggcuggagugcaguggcacaaucgugacucacugcagccuuaacuucacaggcucagguaauucucccaacucagccucccagguagcugggacuacagacaccugccacugcacuuggcuaauuuuuguauuuuuuuguagagacaggguuuugccauguugcccaggcuggucucaaacucaugcacucaagugauccaccugccuuggucuuucaaauugugggauuacaggugugagccaccacgcccagccaagaauaaggauugcaauucuuaaggaauauaguaauauuuuauaauuaaauauuguuuucaacugaaaaugucauaaagcauuuuacagauuguuuucuaauuuuuaccccccaauaauucaauuucauuuucuaugauauuuaauaauaaggcacagcaaguauuauuuucuagugcuuuuaaauaaaaaaaugaggaacauacuguccaaaugaaacuuugagcaauaaauugacacucuggccugguuaugaaaauaauguuucugaguuacuugccauguguauuaggguucucuagagggacagaauuaauaauauauauauauauauguguguauauauguaugugugugugugugcguguguguguguguguauauauauauauauacacacacacauauauauggaguuuauuaaggaguauuaaacacacgaucacaagguuccacaauaggccaucugcaaacugaggagcaaggaagccaguuugagucccagugcugaagaacuuggaguugauguucgagggcaggaagccuccagcacagcagaaagacguaggcugggaggcuaagccagucuagccuuuucauguuuuucugccugcuuuauauucuagccacacuggcagcugauuagauggugcccacccggcuuaaggguggguaugccuuucccagcccacugacucaaauauuaaucuccuuuggcaacacccucacagauacacccaggaucaauauuuugcaucuuucaauacaaucaaauugacacucaguauuaacccucacgcuguggaacaaacuaccucaaauuuaaugucuuaaaacaauagccauguaaauaucucaugauuuuguaguuugggccacucuguuggucuugcaugcauggcucucaaucagcugccuacagcuuauacaugggugggcuggaaaauccaacaaaaccuuccuuaugugucuggggccuuggugcugacuguuggcuauggugucuugguucuccuccacuuggucucucucucggagugguaauuuaucuuccagggucucuccacauggccucucucuccagcaggauaauauggacuaacugacagcauuagagcuggcuuucuagagcuuuccaagagagagaacgcauaaacugccaggcuuaaaggcuuugucuguuacuggcauaguaucaguuugaucauauucuguguucaaagcaagauacaggguuagcccggggagagagaaaguugacuccaccccuucaugggaagaguggaaugugcauacagggagaaaugggaauuuguggcagccaucuuugcagacuaccuagcacaaauagcuuguuauguaguauucccugauuuuuucugcucuauuaaugcaauuaaaucuaauauuaccuguuauuuguucaaaugacacuagcugauuuacuauauuugauauuuagagcuacauguuugauuuuuaguugaauuaauauaucuuauuauuuucccugcuaucucuuugcuacuuuaucuuugaacuagagauauuauugaauguaagacacuuuaauuugacauuuggggaaaauuauaaaaaauaugagcagcaaaaaauguugaaagugaacguaggcauuucuaaaauuuuaagaauuuuuauguaauauacaugagagauauugggauguaguuuucuugcauuguuuuccucucauuuugguauugucaaaaaauugggguucagccugggagaccacauggguucuuggcuucacacaagaaggaauucaagagcaaacaacagaauaaagugaaagcaaguuuauuaagaaaguaaaagaaugaaaggguggcuacuccauaggcagagcagcccugauggcuacugguuggcuauuuuugugguuauuuuuuaaucauaugcuaaacaagggguggauuacuccugaguuuucuggugaaggggcagggaauucccagaacugacaguuucccccguuuucagaccauacaggguaacuucccgauaugucauggcauuuguaaacugucauggcacugaugggagguuccuuuggcaugauaauauauuauaaugaauguauaaugagcaguggggacaaccggaggucacuuucaucaccaucuugguuuugguggguuuugacuggcuucuuuacuguauccuguuuuaccagcagggucuuugugaccugcaucuugugaaaggagaccugccaaacuccuaucucaguaucaggaugaugcuugucucagaaugaaugagaaguauuccucauuuuaauuuucagaaagaauuuguauaaaauuggugucauuucuuguuuaaaugucuguagaauucaccagugaaaccaucugggccuggaguuuucuuugaugaaagguauuuaaccacagacucaauuuuucuuaauaaauaugggguuaucaaguuaucuguuucuuucaaagaaagagcuuucaaagcuugagacuuucaagcaauuuguucauuucaucaaaggugucaauuuuauugucaaaaugccauuuauaauagucucuuacguuucuuuuaauaucuguagaaucuguagugaugccaccucugucauuccugauauugguaauuugugucuucucuauuuuucugaccaaccuggccagaggcuuaucaauuuuuauugaucuuuuagaacuagcuuuugguuucacugauuuuuucucuacucuuuuucuuucuuuuaaaaauuuaauugauuucugcucugaucuguaucauuuucuucuaacucuuuuggguuaacuugcuuuuuuuuuaaguuuguuaagguggaaacugaaacaauugauuugaaauauuucucacguuuacuuuagauaaaugauaaacagaaaaaaaaaguuauaaaaggcacuaaaauuuucagugacuuguaauuucaagauaaaacccaaauacuuauuugauauuuauaaaccucuaaacugaguuuaaauuuauguaaacugaucauauacaauuaccuucucuucucuucaaaaaccuauuaauaugaaaguaaaggaauuucaaaaggaggcaaguccacaaaaaugaaaagcugggucggggaggggcauuagggcacaaaugccuucaaaaguuuggaaguuucuggaagaauguugauagagcagagcaggaaaagaguacauagaggggacuguagagaacaaguggcacgugugacuggcaaaauccucaggauuaccugacuuaagaaagagaagugaaacugaaaacaggcacauuaauuaaagauauucuucuuagagcucccuuccuugcuguucugaauugcauaaaguacucucucaggaauaacaacugcuuucuuugauuuauuuuaacugaaguauacgagguucucgacauuucuuauaaauauauccuauaucucucucuuucuuggauuuuaucuuuauuuugcuagaguaaauucucagauagcuccuuccaaagcacugcuuuuuuaggcauauuuggaaauguuuguguggaacauuuuugauuaucacauuuucuggggguagcagcacuacuaaauccuugaaaacuugaguccuuaaaaaugagugaaaauaauuuuuuuccuccuuugcccuuuuacacaacugauaauuucgcugaggaauucuagguucaaaaucauuuucuccaacaucugagaacugcuuaaauuauuuucagcauccaugguugcuaaugagacagccaaugccagucugauucuuuuucauuuaaaugugcuuauaaauugguaaaauuugguuuugaguggauauugcaaacacauauauauaugcuaacaaauaaauugcaucaaauacuucauauuauauuuuuuaauuuguauuuuucagacaaugaaugauuuugacuauuugaaacuacuagguaaaggcacuuuugggaaaguuauuuugguucgagagaaggcaaguggaaaauacuaugcuaugaagauucugaagaaagaagucauuauugcaaagguaacugauuuauuaaaguugauuacuaaauuuuuguuugcagugugcauguguuugugggcucaugaauuuacaugcuaauguaugcaaauuccauuaaacaaccaaaauaugguuguagacuacugcuacaguaauuuuuguguauuaauauuuguaauuuuuaaaguuuucagacauucauaauauuuguauauuauauacuaaagcuauucucuuaaggaaauagaaauguuuauguuugcauguuugggagaauguuuugugaucuauaucauaauuauacuaggauugcuuuuuaauaauuucuccuaucguucugaauuucuuauuaagauugacuaguguagaugauuuuuacucauaaauucuaaagcuuauauaacauugaauggaaaaacauccuaaauagauuugaaaauacuagaauggugaaauuaaaauaaauuauuuuaggaagacuuacuucccacccccauaccuuuauucagcuuagaccuuuuuaaauaaauaacauguuaaugaugucaguucucacucagaguucugaacaaaaucccaauucccucaggagauacacuuuacaaauugguccaugcuuuaagucuuacuuaauucaacaaaugacauaaauuacuguuauacuuuauggacuacuucaacuuccaguuauuugcuacuauaguuuccucaucuggaguguauugccccuuacacuuugugaaacuuuguuucccugucuuuguacauuuguuuugaccucaacuccuuuacaagucaaugccccuauuggaaagaacauuggcuuuggaaucauacacaccuagguucacuacucaccuaauagucuuuaacaaccaguacuuuuuaaagcaguacuuuggggaaguacuggucucuuaggggcauuuggaaauguuuauggggggcacauauuugcuuaucacaguaacugaggaggagggguacuucugacaguuaccagguagaagccgaaugugcucaauaucuugcaguguguugggcaaccaaucagagccuuaguuuuuuucauuuaaauugguauaauaaaaccucuggacaggaauauuuugaggauugggauauguaagguauuuagcauccuagcuggcacuuauuauuaauuaagcugauauuuucugggagguaguauaaugucagguagguuuugcugcuuaguaagugauccaacuuuuuaugccuuuauuuucuuaucuacagaguggggcuaauaguaguaccugccucauaugguuauuuucaggguuaaaugaauagauaaauauaauaguacaugccaucaguauuaaauaaacuuaacaaauuaaauuacaaaucaaaugaaauuaaaauaugcuauuguuauaaauauuugcuauaauuauuauuacuauuauuacuaccuacuguguauuauuacuaccuacuguguaucaagcaucaguaaauaucuauuccauucuguuuuuucuuuuauauauuagccucacuuguaucccauuauuuaauuucuguucaucagacuggggaauauccuauuagacacugucuuaucucacuacuuacacuuuucugaguaacuguacagaacuacguauauuucacaaaugauagacuauucugauugaaguagugccuugcugcuuucucccaacaaaucuauuuaucguuucuugaaagaaaauaugcucauuuauagcaagaugauuaacacuaugaagauuuggagugugacaagaccugggguuugguuccugcugugcccuucucagagcaacauaucagggaagaaaugauuuugauaucuuuuuacuggugauguuaauuuugauugcuugacuacaguggugucuacuguguuucuucacuuuaaaguugcuauuuuuuccauucauaaguaaucaguaucuuagaggaaauacucugggacuauauaaauaaccuauuuuuucuuaaacuuuuagguacuaauuuuaacacccauaucaguggauuuugcccauaauaauuauuacuguuguguucuaauggugauuuucuauuucccucauuccuuauacauuuauucuuaguuaagcuaaggguuuaucaauuuuguuaaucuuuucaaagaaccaacuuuuggcuuuguugacuuuucuuuguuuuaucugucuuugcuuuaaucuuuauuuuuuuuuccuacugcuugcuuuggguuaauuuauuuuuuuccuaguuccuuaaguuauaaaguuagauuguugauuugcaaucucucuuauuuaguauaagcauuuauggcuuuaaauuucucccuuagcacuguuuuuguggcaucccauaaauuuuagucugucguauuuuuguuuucauucaucucaaaguauuucuaauuuccuuugucauugauugugucuguuguuuaauuucuacaaauuugggaauuuucuuguuuucuuuauauucuaacuucauguuguaguuggagaagauacuuuguauuugucuuuuaaaguuuauugagacuuuauuuguaauccaacauaugaucuauccuggagaacguccccuaugcacuugaaaagacuguagauucuguuguuagguagaguauuuuguguauauuuaauagagcauuuuguguauaugucuuagauuuaguugcuuuauugaguugucgaagucuuccguugccuuacuucuuucuuucugguuguuguauucaucauugagaguguaggguauugaaaucuccaacuauuauuguaaaauggucauugcuuucugcaguucuuucaauuuuugccucauauauuuugauggucuuguuauuagguauguaaguguuuauuauuguuauaucuugcuguauuaacuuuuauuaauaauaucuuuuuuugguguuuucuggccuuuucauuuaaagucuauuuugucugauauuaauauagccaccccuuuucucuuuugguuacuauggcaguacccccuuuagcugcaguuuugcuuuucaugguuugaguuacccccaaucaaccacagccuaaauauagaugaguauaguaaaauaagauauuuugagagagagaccauaugcaucacaauaacuuguaucacaauauauuguuauaaguuuucuauuuuauuauuguuguuaauuuacuuuuaauaguagcuguuaaucuacuuuuaauauccauuuauaaaggaugugccuaauuuacaaauuaaacuuuaucuuagguaguauguguaggaaaaaaacacaguauaugcaguuggcucucuguauuccauauccauggauucaaccaauguggauuuaaaauacucaaaaauaauaauacaagaauaaaaauauuaaaaauuaaaaaaccaauguauuguaacagcuauuuacauaacauuuacauuauaucugauaugauaacuaaucuagagaugauuuaaaguauaugggaagaugugcauagauuauaugcaaauacuaugcuauuugauacuagggaagugagcauuuguggauuuuguuaucugcagggggauuuugaaaccaaucccccauggauaucaaggaaugacuuuauagaguuugguacuauccaugguuuuaggcaaauaccagggucucaaaacauauccuccacuaauaaggggaacugcuauauuuucauguaauaauuuuuucucuuucacuuuuacccaguuuguggcuuuuggagacagcauggaauuggaucauucuuauuguuuguuuaaucgacuuucccaaucucuuucuuuugauuggagaguuuaguccauuuauguuuaaagugagucgugauaaggacugacuucgguccuuuugcuauuuauuuucuauaugccucauugcuuuuugucccuccuuuucuacauaaaugccuucuuuuguguuuaauugauuuuuuagugaaacauuuuaauucucuugucauuuccuguuguguauauucuauagcuauuuucuuuguauagguuauauuuaauauccugaaguuauaguacuguaauuuaaauuuauaccaccuuaacuuuaauaacccucaaaaacuccacuucuuuacaauucuguccuuacuccuuucaauuguuggugucuuuaaauugcaucuuuaugcauuguguguccaaaaacaagacuacuaauuuuuuaauguaugagucucuuuaaucauguagaaagcaaaaagugguauuacaacacaaacuuacaguaauacuagcuuuuauauuuuuuuguguauuuagcuuuaccagaucuuuaauucuucaucugacuuuaagugacugucuaauguccuuauauuuaaaccugaaggguuuaauauaacucacuauagcuuuucuuguaugacagguccagugcuaaugaacucccucaguuucuguuuaccuagaaaugucuugauaccucccucauuuuuugaaagauaguuuugcuggauucuugcuuuaguuuuuuuccuucagcacuuugaauguaucaaccaauugccuucuggccuucaauguuucugaugagaaaucuucgauaaucuuauuagggugcccuuguauuugaugauaagcaagcaaaacagacucauugcuaauauggaaaaaguucgaguggucuugauagaaguucaaaccagcugcaacauucccuuaagccaaagccuaauccagagcaaggccuuaauucucccaauucugugaagggugagagaaguaaggaagcugcagaagaacaguuggaagcuaggaaagguuggcgugugagguuuaaggaaagacaccaucucuauagccuaaaagugcaaugugaaaccacaagugcugacacagaagcugcagcaaguuauccagauaucuagcuaaauaauuggugaagaugacuacacgaaaccacagauuuuccauguaguugaacuuaggacuuccuuagaaaggagaagucauugccuggcucuaaagcuuccaagggcagauugacucucucaguaguggcuaugcaguuggugacuuuaaguugaagccauugcuccuuuaccauuucaaaaauccuagggcccuuaagaauuaugguaacucuacacugccuguucucuuaucaguaaagcaacaaagcuuggaugacaagcacaucugcuuacaguauguuuuacugaauauuuuaggcccgcuguggagaccuccucagaaaaaaagauuacuuuuuaaauauuacugcucauugacaaugcaccagauauacaaaagcucugauggagauauacaaggagaugaauguuguuuucaugccugcuaacccagcgucaguucugcagcucauuaucaacguccauucugcagcccauuauuucaacuuucaagucuuauuauuuaagaaauacauuuuguaauagacaguaauuacugccauagauaguaauuccucugcugauagauccaaggaaacuuaauugaaaaccuuuugggaaagauucaccauucuagaugccuugaaaaacauucagucuucaugaauguucauggaaggaggucagaauaucaacauuaauaggaguguguaagaaguugauuccaaucuucauggaugaguuugagggguucaagacuccaguggaggaaauaacugcagaggugguagaaauagcaagagaacuagaauuagcaguggagccugaagauaggacuaaauuuuaucaggcccaugaugaaacaugaacaaaugaggauuugcuucuuauggaugagcaaagaaacugguuucuugagauaggaucuacucuuugagaagaugccaugaacauugcugaaauaacagcaaaggauuuagaaaauuacauaaacuuaguugauaaagcaguggcagguugugaaaggauugacuccgauugugaagaaaguugugcuguggauaagcagcauggcaugcgaaagagaaagccuuucuuggaagagaaagucaauaugggaaacuucauuguuuucucauuuuaagaaauugccacgcugggcaugguggcucaugucuguaaucccagcacuuugggaggccaaagcaggcagaucgcuugaggucagggguucaagaccagccuggccaauauggugaaaccuugucucuacuaaaaauacaaaaauuaguugggugugauggcaggugccuguaaucccagcuacuugggaggcugaggcaugagaauugcuugaauaccaagaucgugccacugcacuccagccugggugccagagcaagacuucgucucaaaaaaaagaaagaaauugccacacccacucucaccuuuggcaacugccacccugaucacucagcagccaucaacgucaagagaagaccuucugccagcaaaaagauaacaacuugcugagggcucagaugacccuuagccuuuuuuggcagucaaguauuuuuaaauuaagguauauacauuucuuuagacauagugcuguuacacacuuaauagacuacaguauagugcaguguaaacauaacuuauaugcacugggacaccacaaaguuagugugacucguuuuauugcaauacuuuuguugugguggucuggaacaaaaccugacguaugccuguauggaaaaaaaaaaaagaggcuauuugguugagacaugaaacauugguucuugagaagcccaggucuauugauguagaguaaccuuuccuucauuacaggucugaccauacuauuugauugucccaugaauaauauucauuuacuuacaccauuggaaacaccaaauuggcguucaguuuuuaggauuuaucaauagacaaagcaccgaagacuuaaguauaguuacagaacagacugaaaauguuauaaacccugucaguguaaaagaaaugguauaguugauggaugucagcugaaagcauguuauaauuuuuuuuuuaaaaaaaagcaagaaugaauuggaggccagagacagggugauggagccaccaggguugcaaaggcagagguugauggagccaccaugggccuagaggacagaaauacaaauuacugaggauuaguuacagaccuugaaaucgaauuucccuugcuggguuuagaacuugcuuggaaucagugauguuuuuauuucuuccaauuucucccuuucugagugggaauaucuguccuaggccuuuucuaccauuguauuuuggaagcagauaacuuguuuucuagugugagagguccacagauuuagaggaauuuugccccaggguggauuaugcauagagucucacccauuccugauuuggguuauaacacuugggacuuuugagcugaugauauuuaaaugagauuuuggacuuugacuugauacugcacugguugagacuucuggggauauuggcuguaaaguauggcguaugggcuauaaaguacauucuuuggucugaagacauguaacuuggugggggugcaguaccuucuguuccagucaucuuacgguauuuugagcuuuuguaucuaccauuggguaugcaaagcccaauccacuguaaacgucuauuuccaagaauuaccauuuauagcuuccuggggauaguggcaguagcucaguguaguguauuugccaacuauauaugggaguggggggacuuuuuucuggggaauauaugccauagucaucugcagucucuuucucccuuucuggcagacaggauggcucuuucuggaauuuugugcaucagaggguacaagaggaauauaucaauggccagcccaucucugucugcauugcugcauaucucccauaucuuuuuuauuuuuauuuuuggagacaaagucucacucagucgcccaggcuggagugcaguggcgcgaucucggcucacugcaagccccgccuccuggguucacgccauucuccugccucagccuccugaguagcugggacuacaggugcccaccaccacgccuggcuaauuuuuuguacuuuuaguagagacgggguuucaccauguuagccaggauggucucggucuccugaccucaugauccacccgccuuggccucccaaagugcugggauuacaggcaugagccacugugcccggccaauaucucccauaucuacuuauuuuggggacccagauagccaccucaaacaagcaugcugggacauccacuugcugguuccagucaucuccugauccugaaagaaguucuuuugaugaccaucaacauguccuacuuuaauucaccccuuaaauucccauaaugauucucauagagccaugccucauuaaucacccauccauuuauuauuuauuuuguuuacuuauuuauuuuugagauggaguuuugcucuuguugcccaggcuggaaugcaauggugcaaacucagcucacugcaaccucugccucccaggugcaagagauucuccugccucagccucccaaguagcugagauuacaggcauucaccaccacaccuggcuaacuuuuuguauuuaguagaggcgggguuucaccauguuggucaggcuggucucaaacuccugaccucaggugauccaccugccucggccucccaaagugcugggauuacaggcgugagccaccaugccuggcacauccauuuaauagucuaguuuuucacugccugucagccugaccauauggccaggcaaauggccacagcccauucauggguguacauccacacaugaagguuauguuuguuuaguucauccaucauugcaaggagaacaauguacaauugagcccuuugagcugauuuguuguucuuucaucaguuucacaucagucaguuauagugugacagccuuccaaacaggaugcuggcugauuaccuuugaacugcuaucaucuguaaaacaagccacuuuuugguggucagugagagcucuuuguaagacacuagcauuugaacaguaggauguggcaauaggaucugguagcuuuacagaugguuccaaaguugaucuggaagaaaagaggaggccaagcgugaugacucauggcugcagucucaacacuuugggaggccaaggcaggagaaucgcaugaguccaggaguucagacucagacucagccugggcaacauagugagacucccaucucuacaaaaaauaaaaauuagccaggugugguggcaugccucuggugauaccagcuacucauuuggcugagaugcgggauugcuugagccugggaggucaaggcugcagugaguugugauugcccccacuguauucagccugguugacacaaagugagacccugucucaaaaaaaaaaagguuuucuucuauugaauaugguaagugucuucuugcauuccucagcacauucccguuaagccauuuucauuuuguuauugguacucguuagaguguuucucugacauuacccaagacauggauauuuuagguuuuaggauuauguuauguccuucagucauaaagacaguugcaguuaaugcccgggagcaaaccaauaaucgucucucuaaugauguguucuauacuuucuugucuggcccauggucccagugguuacugcuggacagcauucaugggcuuuuugccauaagcuccagucugaguugcagauacuucuaaaaucauaucugaguguauaucguaaggacccaaaggcauuaauugagccacugcaacuuagauaauagccugcuguuguuuagguuuccauucauauguguccuuucagguaguuuuacggauuggauuuagcacuaguccccagauacagaauuuuucuucgcaaaacucaagcaaaccagcugcagugaaugcugcuuguuuacuuucaugguuauguaauaagagcaauuuaauuuuaguugccuguagaauguuaugggugguuccugcccagguuauucguaagaauuucacaguuugguuagacccugggguauuugcuggauuuauccuccagccugugguauuccugugagccaccacuauuuucaaguuagcccuagcuuguucuuagguuucugauaccgucauaaugucaucaguguaguauauuauuguauucuggaccuguaucaagucagaaucccuucgaaacaaauuauaaugguaagcugauaaaugcagauaaaccugcagcacugcaguaaguauaaauugggaucauucccacuagaaggcaaagugcaguuguuuuuuuccugagauugggaccaagaaaaaaguauuuucaagaucaaucaguaugucucucucucuuuuuuuuuuuuuaauugaaacagggucucacuauguuguccaggcuagucuuacacuccuggacucaagugauccuccugccuuggccucccaaagugcugggauuacaggugugagccacuaugucuggcugaguaugucucuuuuagauuguuuuauuuugagaacuucugaaaccaugucagagacugcugaugcuguagaugauacuauauuauucaagucuugauuaucugcugugaguuuucaugaauaauucaccuuuuucaugcacgacacagaacuuguugguaacagcacuccagugucgaacaugucauuaauucaugugcuaaaucucuuuugguccaccaugauacuguuucaaauuaacaaccuaugugagcuggggaaguugcacagauucucauuuagccuguucugacugaagggaaaacuaacaagcuuucugcaguauaguagcugaaguuuucccuggucaaacaucauauccuuccccaaaacauauucagguaauguggaugcaaguacuuccaagauucauucaaacauacuaauuuucauccaaauuuuaauuuaauccuaucagccauuucauccucauauccugucuuucuaguuauugccucugcuaggauuuuaccaauagguuuuggaaucagaggcacugaauucuaugucaggaaccccuggaagguuucuuuuuuaccuucuauuguaccuacaggugugcauauggccuucagucccuacuaggagauuaguuaaaagaaagcccugguucugugucaguccucauccugauuaauuugguagcccaucaccucugaugauuugaacugagguucuucauugucauuuuugcuucccagcuuggugcauucuuugaaauuagggugcauagaguguuuguuuagggcccuucaguguugggggacuaagaggcgcucccauugguaaaccuaacuucugauagugcagcauuaagaccuuuguguuaacaucaguguccauuuuauucaucccaucucuuaguaaccguuuaaaacuucauccugcuugggacuucguugacuaucuguuuuguguuacccauucacuugugauucagucuuauuuucuuagcaucuguaagacccauauuaagaagcugagacaacaaaucugacacauuucuuggaccauugauagauuuugcagcaguuauaucagaugccugccuagcggggccccuucagucacaguauuuaccaugauuuaaagggcauauuaaggaugaacaaacauccugaugaccaugaaguuaauccagcaugguuugcauaugcagcuuaccagcuaugucaucuauggaggagugccacuuggcauuuaaaggaggggaaggaccauuucccuuuucaggguaaacaaauuuuacaguggcuuuuacccaguccaccagacuagcugucccuuuaggaacaaucuauuguguguuuggaucauguacaacaauccaugauuguucaguaauaagguuccugcaucaaccccaagcagacuucuucauucugcaacauucagaaucaaagauacugcucccaaguuagucacucucacaaucuauuuucuuaaauguuuuucaggaacccgaugaauaccaguucacaaggcaagauaacuccuucacacauaaccccugcuuccaguacugucuugguuuugucacccaccauuuggacaauguuccugguggucaaaggccauagauauacugucuguuuuuuucagcauaauuuuccauuggguuuauccuggaggcuaacagccauagcucaagcuaaccaaaauccaagcuuuuugagcaucaggauuuccuuaacacucucucuuacuuucauuuuagcuguuuuaaaauacagcagacugggccaggcgcaguggcucacauugguaaucccaguacguugggaggccaagucgggcagaucacuugaggccaggaguuugagaccagccugaccaacauggugaaacccugucuccacuaaaaauacagaaaauuagcuuggcuugguggcaugcgucuguaaucccagcuacuugaggggcugaggcaggagaaucacuggaacccaggaggcagagguugcagugaucugagaucaugccacuguacuccagccugggagacacagcgagacucccucucaaaaaaaaaaaaaaaaaaaaaaaaacacaaacugcaguggcaauaagaccagcagcuccucacuucugucucuaaaguggggaaagggcaaggguggaggaggcuuucuguaauaccuggaagcugaccgacagaacuuugaugaguacaugaaggcucuagggaugggcuuugucacuaggcaggugggaaauguggacaaaccaagagugauuaucagucaagaagaagacaaaagguggugaucaggauucaaaguauguucaagaacacagagguuaguuuccaucugggagaagaguuugaugaaaccacuacagaugacagaaacugcaaguuuguuguuagucuggacagagacaaacucauucacauacagaaaugggaugacaaagaaacauauuuuauaagagaaauuaaguauggugaaaugguuaugacuuacuuuuggugaugaugugguugccguucaccacuauaagaaggcauaaaaauguucaugauuuggagcuggaagagcucuuuaguuuuccucuuuacucaagucucagugcuauccugcuguuacaguaugguugauuaaaugguuauucuugguguggagguggaaaauggugauuuaagaguuuguuauuccaagcaguuagccuaauuuuaaccuggaaguuuaucauguuuuauaauuaaauuuuugucuuaaaaaaaguggauacauuuuauaauuuccuuugaaaugcaaaucaaauuggaauaaaaaucuuacauguggggaaaaaaguacacguuaccaguggauuguguauuuagcuuguuucucaucauuuugcauuucuuuauguauccagugaucuaaguccuugagauuuuggucugucauuucuaaauuccauugacaacuucuauauguaguaacagcacaguacagcugccgucucaugccauuggugacuguauacccauuuaggcaucagaguuugucauugucugcccugucauucuuccuuuuuugaaacaauguuuuugccaugcuuuaaugaguccuacuuaugauggcaacugugucagcugucccuaagaccacucucaggcucagugagucaugacucacaagacucagaaaagacucaugguuauuguuuaugauagugaaaaguacagauuaaaaucagcaaagggaaaaccacauagagcaaaauccuggagaaaccaagugcaagcuuuaagguaucuucuuccaguggagucacauggaugauguggugaaaucaaggaucuccagagagacagacacaaucggauacauauacauauaugagagagaauucacugggaaauuggcucaugugauuauggagguugaaaauucccaagacaggccaucuggaagcuggagaccuugggaugcugguaacguaucuccguccaaguucccugggaagcugaugguguaauucuuagucugaggcuaagggccaggaaccuggguuuuggugggaaacuagggaguugcugguauaaagccuggaguccaaaugucagagagccuagaguucugauguccaaggacaggagaagaggaguguccccauuccaggagagugccuuuucuuugcuuuuuuggguccuauuugggcucuuaguugauuggauggugucugcucacauugugggugaauauuucucacucaguccaucaauucacauuccagucuccucuggaaacacagaaacagcuauuaguaaugcuuuaccaguucucuagguauuccuuaauccagucaaguugacacauaagugcaucugugaugguuaauuuuaauucucccaguagugaaguguugucaacuaaagaagcuuaccugagccuugguguccaggguuuuuauuggaagucagucacauaggcaagcaguaccuucaugacugcccugagaugcucagauuccaaccucucagagcaaaaucaggcacgaaguauuaaucaugcauccuguuguuugcauaaacuaucuagucaaacugguaccauguggcccaagaucuccagcauacaaaaauacucugaccaggcagaauauuucagaggcucagaauucauuucccaggaguuggccaacggcgccaguucugaagacugacuuuuuugggaauguguagaguuugggcaacccaggccugauguguuacccuuuuucugcacguaaguccauuaaaauaacccaaugcguuugcuugauuacuggcaucucuuuuuccuuggacucuuaaguucuuacugguggaucuuaacugaaaucucuuaacgugaucagccaguuacuuuguucucuucuuucauauucuuuugaaccucuguauuaaacauugcaucaacgauugugguuuauuguaggaagcagauaaugguuugaucugcuauaccuucaucaacugucauuguucuauugggaguaugauuucagugauuuauguucuagaguuauuucauguaguucguguagcuucuauucuucagcagcaugcaccaagguuauucguuauuuacuaguucauucacucauuauuucaauaaauauaugucgaacaccuaauuauuugcuagguacugcucuaggcacugggaccauuugaacgaauaaaacugacaaacuccucuccuuugggaaauuuuauucaagucagcaauuagagaauaaauaauacacauaauaaauaaaccauagaguauguaauaaacuaauccauacuuacagagaaaaguggaguagggaaauaaggaauaaugaugguagcgauuuuggggacuuaaugcaguuuuaaauagcaugacuauggaaggccucacugaaaggugaaauuucagcaagcauuugaaggagaucaggaagcaaguccuuuagauauuuugaaggaagaauguuccagcaaggggaaauagcaauugagaaggcccugaggagggagcuuacuuagcacauucuaacacauucuuugaauagcuaggagucuagcaugguguggaacaagaaugguguaggauguuuguaaggauauuggcuuuuacugugaaugaagugggaagccuuuggaaauuuuuaugccguguaguuacacagucuaguuuucaguaucacuuuggcugcaguguugacaauagacuguggauuggaagcagauaguuugcuaauugcagcaguaaucuagauaauugaugauaguggcuuguacuaggguaguagcaauggagguagugaugauaaugagaccuuggguguauuuugaugaagaaccaacaggauugcuugacagauugaauguagaguaugagugggaaaaaaaaggaguuggagaucauuguuaagauguuuggucuaagcaacugaaagcaugguauugccauucacuacauugaaguugacugcaggagaaacuuuucaaggggagauuuggaauuagguuuuagauaugucaaauuugcuauuuuuguuagauacuccaguuuaugucacugauuauacauccaugccaaauaggcauuuuuuaaguuuaggaaagaagucuagauuugagguauaaauuuggaagucugucagcauauauccuguauuagagccauagucugaaugaguuuaccaaaggaagaguguacccagugaagagaauucugaggacugaguccuggagaugcuuacagaauaaggguuucagagcaaaggaagcagcaaaugagacugcggaaagacaaccacugaagaggaggaagaugaagagauuaggauguccugggacccaaaagaagaacacguuuucaggaggaaggagugaucaaauguguuaaauguuacguuuauggcuucucuucugaguaggaaguaagaucgcauuuugaaagugugaacgagugaggcugagauaaagagagacaaauaaaugaaaagcuccugugcuuggaagucagcacagaccuggguucuagucuuagcuuaguagcuugacuagguaaggguuaguguguacauuuaaguauaccuaccaggcaaggaagaaggccugggaaagauuugaaacaaccauccugagaaauugaagagugaccuaaguagcgauggaugaaagaggccucagaagauucagcugaguuuuuagggagauuccaaugguguuagucaauauguuuguguaaauuuaucuuuagaugugaaauauagaguuaagaggguagagaugaacuugucccaauaccgcguaugagagaggcagaagaaagacuggaguccaaagugauuauaucaugauggaagucaaaggaguucauuuggccuucaucuaaggaauauuuggaacuggagcaucaagaacaaaguaucaaacacaauacucgagaaaggcgcaauaauguuuguaguuaacagagaacaacggugcuuucaucuccaucaaggugagaaaucuucaaaaaaaggaauagaaaucaaggaacagaagacagucugacagcuggagaauggaagaaguauuagaagucauuaucugggccagugcucaaguuuucaagaaacaaaaguuagaacccaaaauuuagagcuugauaagugugacaugucuccucuggcaggaaaaaaaaaaguauacauugcuaacauauggcuuguugagacaguggaaaaguaaauaauaaucacugguaaucauuguuuaauuuguaaaagugugucauaucacuacucaucagggaaaugcaaaucaaaaccacaaugugauaucaucuguauuaguucauucucacacugguauaaagaacugcccaagauuggguaauuuauaaagaaaagagguuuaauugacucacaguucugcauggcuggggaggcuucaggaaacuuacagucaugauggaagggggaagaggcaugucuugugugguaucaggcgaagaaagggcgagugugugaagaggaacugucagacacuuauaaaaccaucagagcuccuaagaauucacucacuaucacaagaacagcgugggggacacugcccccugaucccagucaccucccagcaggucucucccucgacauguagggauuauggggauuacaauucaagaugagacuuggguggauaccuaaccauaucaucaucucaccccaguuacaaugacuuuuaucaaaaaaacaaaaaaaucacagaugcuaaagggaacucuccuaugcuguuggugggaauguaaaucaguauaaccacuauagaaaaccauaugaaaguuccucaaaaacuaaaaauagaacuaccauauauauauccaaaacaaaggaaaucaucauaucggggagacaucuacacccuuagguuuauugcagcacuauucacaacagccaaaauauguaaucaaccuaagugcccaucaaugaaugaaaggauaaaugcgauauauguacagaguggaauauuacuuagccauaaaaagaaugaaaucacguuaucugcagcaacauugauggaaauggaacccauuauguuaagugaaauaagccaggcacagaaagacaaauauugcacauuuuuguucuuaugugggagcuaaaaaacgggauugcaucaagauagacaguagauugguuguuccuagaggcugggaaugguagggggauggggagauggaguugauuaauagguacagaaguacaguuguaauaagaccuaguguuagauaguucaguagggcgacuauaguuaacaaccaccuacuguguauuuuaaaauagcuggaagagaagaauuugaaugucuccagcauaaagaaaaguuaaagguuggaggugaugaauauccccauuacccuaauuuggucauuacacauauggaaugugucaaaacaacacauguaccccgaaaauguauacaacuauuauguaucgaaaaaacaugugccaaaguaacauuucucuacccucuucccguuucucccaccugauucgugucuuccucuaggucucauuuauagcucuggguggauggaggaaaugguuuagacggaaugugucuugauuucaacuagacuuguggucaauuuggagaaaauaaugugagcagaguaccuagugaaguagauaguagguuguuugaagaugggaggcaguuuugugaaguagaaaugaccuuuacuauugaacuuagaugugggaucaguuggugcagggauuaaaggagaugacacucaugguguucuugaucauuaaggguagaaauuuucuuuuucuccucuuguuugcccucuccuacaccucauucccucaaauaaccuaauuaccacaaaacaucgagagggucaaaugaaaggagaacuuuagaucguguguaauagagggugaaugauaaauuggagaggauugggaaaauaaaauauuaaaaagacuauucuucugccugaagaaauaaaaucccauucccccuaauucuucuaugaaagaaauuagauuuaaaaguucauuauuuacuauuuuaccauggauaaauauauguaaauuuguauuucaaaagcuuuuccaugaaaaaaauacauuguauccccaagcauuucuagaacucuucauaauuaugaucaacagauggauuuuuuaaaaggcaucacauuguuuuagucacuguuuuacuacuguuauuuuuaacuuuuuguuuugacauguugcuuuuaacuguaauuaaaaauuauuagcaucuguguuuacuuuuuagcuugcgcauaccuuaucuucauagcagaaacuaauuaguaugugaaauacaguaccauuaaauaugcauuaaugggaagaaauucuaaucugaucagcuguaaaauauguuagaaaauacauuuugguauguacaugguguucauuccaguuccauucucauaacaaauacuguuuuugcuuuugccuccauacgucuuuacuugguuccuuggauguggucagauuacaaauuuaggggguagaaaagucuucccucaugaaaguuacuaagugauuuagaaaaauaacuauuaugcgugauaagccuguuuuaacaaaauagaauguaauaccccacugaaaauauucaaagcacuagaauaucuuuucuauuucuaaauaaauuucauacauacuuuucucuagucuuuuccuaauuucuugacccagaucacuuaacaucuuaaaccacaacagguagauguuaucuucugugaauuucuuucugaacugccuauuaaaaugucugugauucacucucauguuggaggcauguaacuuuuauauuagcacuguuaacuuuauaucucagaacuauccccuuuuucuuuuuccgcugccaccauaguaguccaagccauccucacuucucucuugggguuauguaaugcuuuccuaauugauccuucuuagaagaacgugaguagacuuucacaaacaugucacccccaccccaucacuuucucuaugucccacaccaucacaauacccaacuuacacucuaccaauagcauugguucucccuuacagccccguugacaauaguggauaaccuccacuuuuuccuuaauaucacuuaucagaaagaguaauuauuuaaguuggauaauuuacuuguuuguguuuuccacuagccuaugaacucugugagcaaugggaucuuauuuuuuuuauuaaguuaccuuauaccagcacuguucuuaccaauuagugagugcacaucagcaguuuuuuuuuuaagugaauggacuugguucaguauaucacaaaauagccacuuguauaaugcuuaauuauguauuucauauucccucugugaugcucauuaacuguaguauccccuucucugguuuuucccauuaacacugaucaccauguaaguagaacuaaagcuccaugagagcagagaauuuugucuauuuguucaguguccugucucugaugugcagacgaauacccagaagauacuuguugcauauguguugaagaagucgguggguggguggguggguggauggaugaaugaacucuugcacacuugacaucuuggaauucuuuccuaugauacacaauucaguucaauagacauuuauuagguaucugcuguaugcuuaccauuauguuaggcacaguguauauggaaaucaguaaguucuggugucauuucugcuucugauuuauuuuguuuuacaauguuugcuauucuaauuaacuuaggaacuauaguacgauaugacauuggcuuucaaauugagcacuuaaaacugacuccuauaaaacaaauaagacugagaugauuucauguuuaugcuuuccuucacucguuguuaauuauacuuucuguucagacacaauugaucuuaccuucuuugaaugguugugggaucuuagcuucuuugauuaaucuaguuaucauuaucuuucgaguuuaaggucaaauauuuuuauaaagauaacaaauauaaugcaguguccugauguuuugcuuuucaugucuuucuuccaucuaauuuugauuuucugacaguguuaagaaauugauucagcaagggcuuuauuuaagaucuugccagaagugaagaacagagaugcuguguucguuucagcaguugucuuccuuucguuucuucuuuaagauaguguuacuuuugaaauaugaaacauuaucuccaguucuccauauguugaagaaaacacuaguuugcuuuugauaucaauaugagauuuaugcccaaaguuggggaaaacauucuuaguuuauuuuugguuugaaauauacuuacauuuuaaaaugaucaccuacaguaggaggguugugagcuuuuuuuuuuuuuuuuuuuuuuuuuaagaaaagcacauuaaaccuguagucucuggagcuaagcuaugaggacaaaaaagcaaaagaaggauacaguggacuuuggggaguugggggaaaggauggaagcagggugaggcauaaaagacuacacauuggguacagcauaugcuucucaggugaugggugcaccaaaaucucagaaaucaccacuaaagaacuuauucauguaacaccaccugcuccccaaaaaccuauugaaauaaaaaaaaauguguaacacccacgcccccaaccaaaggaaaaaaaacaaccuguagucucugcuacuugggagucugaagcgggaggauuccuugauccucaggaguuugagcucagccugggcaacauagcaagacccuaucucuaaaaaaauaaauaaggaagcauauaaggcugggcauggugccucacaucuguaaucccagcuacucaggaggcugaggcaggaguaaugcuugaguccaggaguucaagguuacagugagcugugauuguaccacuguacucuauccugggcaacagagcaagaacuuggcuuuaaaaauuaagacgcaaauuaaaaagccacaagcagaaagguauauauuuuuauacucuguuccuuucuauuucuaaaauguguaauuuagaacuaaauauugcauguguauucuguguucuaauaacuaauuuauuuaaaguaggagacuuuuaaauucuuugauauuuauugggaaauauauccuuucaucccccugaauaaaauguauuacaaacauggagauauuaaauuaccucaugcagaaauauuaguugauaaauuguucccuucaaggaggaaagcucaauauuuaauuuucugugucccugauaauuuucugacugauuuuuguaucauuauugauauacuuugauuaaguaugagugaauuuauaugaacuuauacaaucaucugaauuaaaucauuaauuugaguuuuuuuguauuuugguggagagaaugcugagugguaaaggaagcaugccacuguguuuuaaaauccuuuucaaucucugggcuuaaccucuuccaauuuuagagaaauagugaaauuauuauuaucagugcucaaaacauauauugaagguuugcuuuuuuucuuuuguaggaugaaguggcacacacucuaacugaaagcagaguauuaaagaacacuagacaucccuuuuuaacaguaagugacuagaggacagauguuauaaucguaacauuugaaauuuaaggaauuuuauguuagaaauuaaauugugaaaaauacuauucauuuagauaucucauuuucuuuguggaaagaacguaagucaaauuucuuauaacuuauuagaauguauggauuuuuacaguguguaugcauugauaauuccucccauuaugcauuuauuacuuuuuugagaauuuuuuuucucccaugaaucucuugccauuaaaaacaaaaacaaaccauagaguuaauacauuaccucuggcauuuuaaggagacuauugaggaaauggcugauuuuuaaaaauuucuuaaauguaaagauuuuauguuuguuuuauuggcuucugauaaauaucuuaaugaucagaagcauuucuucaaauauggaaggcagaaauguuuaucgaauauauuuuauagaaaugagacuucuuugagggauagaguacuuuaagaaauaugggaaugcuaaauacauuagaggugggauaagccaugcuacguuuuuuucacuagacaaaguauaaacugauuauaugguaugccuacaacuuaguugucuugaaagaaacuggauuuuuuaguucuguucuuagauuccuuguaauauagggauaauugguaaaguuucuguauuuucuugguuccaaugaacuauauugagaugaaaaauaauagcuagacuuuccaaaguggaacccuuuacacuguuuggaauaucugaaauagacauuuucagagcugucaguagauaccuagacuuacuuugcuaccuuuuuugguguguuuauugucuaguguaauaagauagcauuuggguauuuuuuaauaaccuauauauaaccuacaaaauuauauaaaccaacucuguuagguuggguucuguugugcacucaauaugcaaaaagugauguugucauuguauuagaaaccugaguguaacaaccguagcuacauuccuaaggaacuucaacuaguguaauuuguuggccacgcugugagguugcauggaugagaaccuugaguacuaaugcagcuucaaaucaauggcaaauuagauugagaagugcuuguugcaauuaaguuuacuuuuacuugaaauuuuaauuuuaguuuuucuuguaauaauaccuauugugaacuaaacauuuguuuuauguuucucauaaacucuuaagcacuuuuaaguaguaaauaaacucuuaaacaauaacaauucuuuucaucuuucaugcuuacuauuucuauguguucuauuuuuaguacuauuauaauuauaagaauacaggauuauaauguaacauuuuuucuuuuuuuuauuucaaguccuugaaauauuccuuccagacaaaagaccguuuguguuuugugauggaauauguuaaugggggcgaggugagucaagaaguaaauccaguauuugcaugguaguauuuucauuauuuuaaaaacauuacuuaaaauacaaguuacaauauagcaguucuccauuucuugauaggaauuuauguagcucuuaauacuauugaacaaaugggagcgaaauuauuucugaugagauguaaugauuguuuuuauauaacuacauuuauauguuggaaagcauaaucauauucuucuuuuuccuguguuuuuaaauguaaaaaguuuuaacagaaguaugauuuuugaaaucauguuauuaaauuuugaaaaccagaaauacaagauuuauuguuucacaaaguuucuuuucaaguaggcugugaacauggucaaaaguuauuuuacccauucuaaacucaguggaacaauaguccaugggcacauuauggcugaguuuucucuucuuuauaguagaguacuaugacuauauauauauauauguguguguguguauguauauaugaggguguauauauauguguauauguguauauauauguauguauauauguauauguauauauauggguggguauauauguguguguguguguguguguguguauauauauauauauauauaauuuuuuuuuuuuuuuuuuugagauggaguuucgcucugucgucaggcuggagugcagcagcacaaucuaagcuuacuaccaccucugccucccggguucaagcgauucuccugccucagccccccgaguaguugagacuacaggcgcgcaccgccacacccagcuaauuuuuguauuuuuaguagagaugggguuucaccauguuggccaggauggucucgaucuccugaccuugugauccaucugccucagccucccaaagugcugggauuacaggcgugagccaccacgccgggccuaccaugacuauauuuaagagacugacaauauuuuggagauaaauuuaauauuuuuauuagcacauuucacucauuccuuuauuccuucuccuuucucuuccuugguuuugaucacagucaaugugagggaaaaguaaauuuacuggaaaagcuaacuggaaauauuuuuauugugggcuuucugaaauaaauuuaauuauuaaauagggucuuguuugugucucaugaacuuaaaauauucuuauuuuccaaaauaaauaauuaaauauccuuuauggaauuuuuuuccuguagaauuaucugauuugcaggaauucguuuguugcaaaacuucauucauucagggcuugcaugguggcucagacuuguaaucccagcaguuggggaggcugaggcggguggaucacuugagcucaggaguuugagaccggccugggcaacauaguggaagcuugucucuacaaaaaauaaaaaaauuaccuggacaugguggcacacacccagcuccuguacucccagcuacugaggagcugaggcgggaggaucacuugagccugggaggucaaggcugcagugagccauggucaugccacugcacuucagccugggugacagagcauuaccuggucucaaauaaaaaaaaaaaaaucaaaacccaaaacuuaauucauuaauuugguaaacacauuuugagugccuaggcaguauggguuuaugaaaauguguuaagauauuauccuugcugugaaggaguauauaacuucccuuaguguauuacaaauuagaaugcauagugaaagaccuaacuucuaauaaagucauaaaagaaaaugcuuuauggaugaucuagcacuuagaguaggcuuaaugagauuucacccagggaauugauguaagaaguuguuucaggcagagaggaugggaugggcagaaucacugguggaugauaggacaagauaauuaaauaauaauaacccaggaauacagaacugggcccuugcaguaagaugucugagaaaauacgaagaaaauggauguuguggaacuguaggauugguacaucuuuuuuuuuuugagauggggucuggcucugucauucaggcuggauuguaguggugccaucucugcucacugcaacuuccaccuccuaagcuuaagcuauccucccaucacagccuccuguguaacugggacuacaggcaugcaucaccaugccuggcuaauuucuguauuuuuuuguagagauaggguuuugccauguugccuaggcuggucuugaacuguuggccucaagugaugcacccacgucagccuuucacagggcugggauuacagacgugagccaucacaccuggccauauuguuacaucuuaaugaccaauuaauuagaucuugguagaaacaaaaagguacaaugaaaagugauuuuugguuggaauuugggagccuuagcagauacagugcaauuaugaagaacauguuaaccuuauaaauuugguuuugaaacaguuuuucguaagcuuuuaaaguaauguauguguggaacuaugauggagaguggauaaagagucaaaacuguggaugcaguuuuggcagccauucccauaaagauuauaauuuaaguuauggggguggaaaugaaauugaugaaaccucuuacaucaguaucuaucaaaauuuaaaaugcgcuuauacuuggacucagcaauuucauuucuaagaauuuauccuacagacguacagaugcaccacagaaugauauauagauaaguauacucauugcagcauuguagcauuuuaaaugagcauucguaaggagucugcuuaaauaaaguuacauucaugcaguggaaucucuauauccaucugaaagaaugagacagcccaauaugggcauuaauagaaguuaaaaaaacuaggugcagacgaguauaaagcauacuucuguuguguuaaaauaaaauuagaccguaaacauguguauauauguuugucuauugaucgaguaucucugaaauuaugcacuggguauuagugcuugucuuugggaaaauaaacugaguggccagggauaagauaggaggaagacuuuucauuuauguauuuuucaguaucuuuuguguuuugugccacauacauguauuaucuaauaguugaaaguagacagacaaauaaaugguuggaugaauggaugaccaagggaaacaguaagacagauaaaacaguccgcagacaaaaacuuggaaaaacacuauuaaaugucucucuuuuuuaaacgguauuguguguucaugucuauaguaacaauuuucacauuguuuuacaauuaccuauuuacuugucugucuuucccaucaaaguguuagcuuucuaagaggcuuguucacgguauaacccuagcaucuuauucacugcuuguacauaguuggugcuucacaaauauucauuggauuauuugaaugaauaagugaacaaauggaugaacauucccucagggauuagggauaagagaaguuagcuaaaagggguaaaauaggaacuacugaggaguaggaagaaaaauagaaauugauguaguauacaguuuauuuuguuaaaaaagcugaaaguguaaauuuaggagaggauaucuuuuuauuucaaaaauacauauguauuaagucuuuguggaaggcacucugguagauaucuagggcauagaaaucugaauuaaacauagaucuugcccucaaagaguuuauagucuacuggagaaaggguacaaaaauaauacuaagugugaaauaauuaucacuucuaucauaacagauagauagauggugggacuuuggugggaugagggaaagcuuccuagagggcgcuaccuggcaucugcacuucuuuucuaaacccggaguacuuaaagauuaauuaauugaugauuauugaaaaaaauuuuacacuaaaagcagauuuucagauuagccagaugauuuucuuuagcauuaauacuccuacauuauuuuucuuguucagcauaucuuuguuuuucuucagaauuucuguuuuggauugggcuauagauaaguauuauuuaauauuuugaagcaagugaacugauucucuagggucucacuccaucacccugucuggaguacagugguacaaucucggcucacugcaacuucugccuccugggcucaagcaguccucaugccucagucucccgaguagcuaggauuauaggugugcaccaccacacuuggcuaauuuuuguauuuuuaguagaaacgggguuuggccauguuggccaggcuagucuugaacuccugaccucaagugaucugcccaccucggccucccuguaugugguguauaauuuuaacaugcguagguaauuacaguguugguacacacacacacacacacacacacacacacacagaaaaugaaaaguuauuuauauuuaauaacuuuaguaggaaauagaauuuuauauauuuaaccucacaauuuuuuuuuuuuuagauuaucagauguauuuuaaaauaguuauuuaguucuuggaguauaguaggauuauuucaauucuugauuuaucaugacuggggaggaaaucuaugcuugauguguuuauccuuguggcaacuuguuuaauuuugguuuugcuuuggguucaccuugccauuuaugcugcccagggaugccuuauaaaaaugcagaaaacgaccaggcgucguggcucacaccuguaaucccagcacuuugggaggcugaggcgggcagaucacgaggucaggaguucgagaccagccuggccaacgugaugaaaccccaucucuacuaaaaauacaaaaaauuagccgggcauggugguggaugcuuguaaucccagcuccuugggaggcuaaggcaggagaauugcuugaacccaggaggcggagggugcagugagccaagaucacgccacugaacuccagccugggugacagagcaagacuccgucucaaaaaaaaaaaaaaaaaaaaaaaaaaagcaaaaaacuuaauuacuguagaaaaaguauuaaacauaguaguuauauuuuugaaauagguuuaaaguaagggaaacaauaaacacacguaaacaauucacacuagcacaauccacacauauaccaagacucagccagugggguaggaucuguauggcaucuaaggacuugagcgugagaauacuggccuuuuguaagcaagcucugguaaguucauaauaccaaaauggcagcacacucaaaucuuuuuauaucaaguuuuugcccuaagaugagcuccuuuaguggccucgcugaaauaacuagcccaauuuuuacucaauuuaugcuuauuguucacugauuuuuaauuaacaauagcaucuucuucuuagucuaugcucuagaaaguuuaccuugaauuauaauuugaguuagggguuuagcaugcucuugauuaugcuugugauuuuuauguguuugucaauauaagucacaugccauguagcaauguugaagucaaugauggauagcacaaugguaguccgauaagacaaacaugcacagguuuguagccuaggagcaauaagcuauaccauauagcccagguguguaguaggcuauguugucuagguuuguguaagucacucugugauguucacacaaugaugaaauugccuguauuaguucucacacugcugaaaagaacugccccagacgggguaauuuauaaaggaaagagguuuaauugacucacaguuccgcagggcuggggaguccucaggaaacuuacaaucaugguggaaggggaagcaaacauguccuucuucacauggugacaggaagaagugcugagcaaagggggaaaagcuucuuauaaaaccgucuugugagaacucgcugacaaucacaagaaucacauagugguaaccacccccauaauuaaauuacgcaccagggcccucccaugacauggggauuuugggagcuacaauucaagaugagauuuggguggggacacaaacuauaucauucugcuccuggccccucccaaaucucauauccucacauuucaaaacacaaucaugccuuuccaacagucccuuaaagucuuaauucauuucagcaauaucccaaaaguccaaguucaaagucucaucugagacaaggcaagucucuucugacuaugagccuguaaagucaaaagcaaguuaguuacuuccuagauacaauggggguacaggcauuggguaaauacacccauuccaaaugggagaaauuggccaaaacaaaggagcuguaggccccaugcaagucuaaaguccaauagugcagucauuaaaccuuaaaguuccaaaaugaucuccuuuaacuccgugucugacauccagaucaugcugaugcaagaggugggcuccuauggccuugagcagcaccaccccuguggcuuuguaggguacaucccuccucccagcuacuuucaugggcugguguugagugucuguggcuuuuccaggugcacugugcaagcugucaguagauuaccguucuggggucuggaggacagugacccucuucucacagcuccacuaggcagugccccaguggggacucugugugggggcuacaacaccacauuucccuucugcagugcccuagcagagguucuccaugaggacucugccccugcagcagacuggucauccaaguguuuccacacauccucugaaaucuagguggagguucccaaaccuuaauucuugucuucugcacaccagcaggaccaacaccacauggaagcugccaaugcuuggggcuugcacccucugaagcaauggccugagcuguacauuggucccuuuuagccacagcugggacugaagcaguugggaugcagggcaccaugucccaaggcugcacagagccggguuggggggcccugcuuuugggcccuggcccuggcccacaaaacuguuuuucccuccuaggccucugggccuaugaugggaggggcugcugcaaaggucucugaaaugcccugaagacauuuucuccuuugucuuggugauuaacaucuggcuccuuguuacuuaugccaacuuuugcagugggcuugaauuucuccccacaaaauggguuuuucuuuucuauuguauugucaggcugcaaauuuugcaaacuuuucuucuccgcguucucuucaaugcuuugccacuuagaaauuuccuccaccagauacccccaaaucaucuccuucaaguucaaaguuccuuagaucucuagggcaggggcaaaaugccaccauucucuuugguaaagcauagcaagagucaccuuuacuccacuuaccaguaaguuccucgucuucaucugaggccaccucagccuggacuuuauuguccauaucacugucagcauuuuggucaaagcuauucaacaagucucuaggaaguuccaaacuuucucacguuuuucugucuucuuuugagcccuccauacuguuccagccuugccuguuaccugguuggaaagcuguuuuuacauuuuuggguaucuuuacagcagcaccacacucucugugguaccaauguacuguauuaguccauucucuguucucaugcugcugugaacugcccgagacuggguaauuuauaaaggaaagagguuuaauugacucaguucugcagggcuggggagaccuuaggaaaccuacaaucguggugaaaggggaagcaaacauguccuucuucacauaggagcaggagagagaagugcuaagcaaaggaggaaaagccccuuauaaaaccaucagauuucaucagaacucacucacuaucagcagaacagcauggagauaaccagcccugugauucaauuaccuuccaguggaucccucccacaacacauugggauuaugggaacuacaguucaagaugagauuugggugggaacacagccaaaccauaucugccuaccagcaaguuucucaggccauaucccaguuguuaaguaaugcaugacuguauuuggagcacuaaaaauuuuugaugaaagugaauugugaaagaaauguuggcugugaaaaaucagcccuaacuucuuacggucguauugguacaauggaauuucaucauaguugcauguaauuuauaugaauucaaagaagugggcucaauaagauauagcugagauagacaaguugauuuaaaugaugugauuauucugcucuuuuucucaauuucucaaugaguguauuuacagagugaccuuaggaugagagauauaaauuugcuauucuuuacuccuuguuacuuccuacuuuccaugcauagagcuucauggaauauaaacucugguguuuuaaaauacaaaacuuacauaaaaugucauugagugcauuguaacugcagguguucauuuaaagaaacuauuuucuggccaggccugguggcucaugccuguaauucuggugcuuugggcagcugagauaggaggauugcuugaggccaggaguuugagaccagccuggcgaacauggugagaucccgugucaaaaaaaaaaaaaaguuagccauguauggugauguguaccuguaguccuaguaaauuaaucaggaaagcugaggugggaaguucacuugagccgaggaacucaggguuauagugagccaugguugugcuacugcacuccagcgugggcaacagagugagacccugucucuaaagaaaauaaaagaaaaaagacuauauuauuguaccaaagauagaaaacuguccuggguuuaacuaugucgagagaugacaguauguuggucuccaguguaauaccguucuaaggaauguuugggagugauuugauuauuuuugauaccuuauggauuaacuuuauaaucuaguacauuaucauucaucuauuaaauaaugagcaacuucugugggcuagaccucagaagauucauaaauaaggaaaacauacuauuuuuccuuugaugagugacuuacuggggagauagaugagaaaauacuuguauacacugcagugacaugguugcucugauaauacugguuacugugcauggagagaaugagcacuuuaaugaaccugaggagcagaggaaaggaaagcaaagggugccagaguaggaaacucuucuuaaaaagugguugcuaggcuaagacguaagaauaacuauacauuauaucacuaagguugggaaggagagcauuccuacacagguaaaauggcauguguagaguacacaggagcagacagguucccccacccaccgaauauagcacaguguggauaaugcauagaguucugcagaggaaagccagagagucugcacagguagucagaaucacauuaagacagaucuucacucucaagucauuuagaugaaggcaguggagcaucauggaagaauuucuuugggggaaauguuuagaaagaauacuuggcaguauagagguugaaguagagaggacaaaaguggaagcaaggaaaauacuugggagguugcugcaguuagaagguuuucaguaauucacuuauaaaaaugauaagguugucggaugugguggcucaugcuuggaaucucagcacuaugggaggcugagguggguggaucaccugaggccaggaguuugagaccagccugaccaacauggagaaaccccgucuguacuaaaaauacaaaauuagccaggccugguggcgcaugccuguaaucccagcuacuugggaggcugaggcaggagaauugcuugaaccugggagguggagauugcagugagccuagauugcaccauugugcuccagccugggcaacaagagcaaaacuccaucucaaaaaaaaaaaaaaaaaagauuauuaauugaagcaguguuagaaggaagcaaauucuaguaauauuuaguuauuagaaucaccaggauuuaaugaauaaauaugcagagaaguaucauaugauuuccuguuugcugcuuggggaauuguggauacuggaguauuuauaaaaauagaaaacacagggagaagaaugaguucuuaagcagaucaugcuauauuugaggcaccuaguguggcagccaaggaguggggagaguuaaaucagagauacaaauaggcaucaugagcaguguuaaaacccaggaagugaggaaauauccaaugugaggaaaguauguacaguuagaacaucaguggccaaggauggugccuggaaaugccagaguaaggcaugcuguagacacagcuguagaugcagugagacuagugcacagguguagaggcagagagaagccuaaggaggauccugggcaggaggagccagacaagagaagccuuagaaguuaaggagagauuagguacaacagaguauauuaaauacuguacaaugauaacugagaauuguccauuggauuugccaucuaauaguuccuauggagacuaccagggauucuuccuuuucugguuugguacaagguaugcaccuuggcuguaguacagaauguaaaaggguugguuuggagcccaguagaacaagguuguaagagugaguucagugcaauuucaguggggcauuuguagaacugauuguaaaaucucucuaauaauaugaccaaucacacugcuaauauauccaggcagcucucuuuuuauuccuuaaauguuacuaaauuuacaugagaagcagaaaaauauccugggagaauaaaguagacaaaauugacuaaggagguguuuuuguuuucuuugguuuaggaagucucuacuuaggacuuguuuccaaaaucuuacucauagcuucauuuauuucaggcuuauuuguuggaccucugcaaaucucucucaagucugaaguuuccugaaguuaaagauucauuaggggaguaaaggaaaaucauuguguagaaaugcuauucaucugauaaauucuucacauuccucuauuuucuuuauguagguuguaaugaagcuaacaguuucaguuauguacuacuauuuuuguccauacuuaguucauuguaaacucuauauuaauuucuuugauaacauguauuugauuuuuuugcaauacggcuuucagguucuugccauucuugagauucucaugcuuauucagauuucucauuuggcuggcauuuuguuaucagugaaccaaaauuaucucauuuuaaauucacauaagacaaaagcaccaguagucaguauucuaguucuccuuacuaauuuacggaggugugaucugggugauuuuuaaauuaauuuaauuaucauuucauauucauagugaugauuuuuaaaauuuuacaaaguuuucagguauauaaacaucuuuauugucaggugucugacaagcuaauuucuuugcuaacuauuuuaguuauuaauauauuauguagguuguaucagaauuuuguuuuucacccaaugcuuuuucaaaauucccaagucaagaaggaugcauuacaauguuuacauuagcaucuaaaggcaauguaaagucgggaagcauuuuuaguauauaauuucauaauucaaagacauuuuuaaaaaaugaaugguuaaaccaguaucucacugcauuaaauguaauugaaugcauugaauuuaguuauuaggagauguuauuacaagccucaacauguaacaugcuugcuuacaaaucuaaaaucucagaucaaguggcuggaacugcaggggccugccaggcaucuggguauuuacaugauuccuuuccaugugguuauggcagagcauggccauuucaagguagucaaacuucuuacacaaaggcuggcuuaccacagaguggguauuucaagggagggaaaacagaagaagcaacauauguauaauuggaaacccugaggaggaaaaagagggcagugacacaaaacaguauuuaaauaucaaaaacuauaaucugaaaacauacuuacaggcuuuuguguucuccauuuuucacuuagcauaauacuuuuaaaauuuauagauacuguuccauauaucaguaguuuguuucuuuuuauggcuuugcuccguugugugauguacagucauauguuuauauaguugccccuggauagacguuuggguucuuuacauuuugggccuauuagaauaaaagcucgugaauauuccaguacaaaucugugugugaauauauauuuuuaaucuucuuggguaaauacauagaaaugcaauuucugugucauuuguuaugaucaacuucauuaaaaacugcagacucuuuucaaaaucagccauaccauuuugcauucccaggauguuacuugacaacaucaccacacuuggcaugguagucuuuuuaaauuuuacucauucugguggauguauagugguauuuuuuagcuucaauuugaauuucucaaauaacuaaugauauugaacuucuuuucuuauucugauuugccauuuauacaucaucuuuuuugaaguaucuuaaaaucuuuugucuguuuuaaaaauuagguuguugucuuaauauugaguugucagauuuauuuauuucauguaagggcuuuaucauauauauauuuuauaaauauuuucucccauuuuauaguuugucuuuucauuucauaaugggaaauuguuccaaaauacacuuuuguuguaaucuauuguaaucagcauuuuaaugcauaguuagcauucaguaaaauuaaucaauuuugacuguacaauuuagugaguuuugacagcuguauaaagcaguuucccaucaccacaaucaugaucuagaauguuucuuucacaacagagccucgcaugucucuuuaaagucaauucucuccccucacucucacccugaaaaccacugauaggcuuuccaaccaguaugaagggcagacuucuaaauuagaggaaacacaauucauugauuauuuucucuuaugauuuguacauuuuguuuuuaaaacaucuuuuucuaacugaaguuuguuaagauuuuuuucuaaagucaaagcuagaccuguugggugguggcaggucggggagauuuucuuuuaugcuuucuucuagaaguguuaauaguuuuagcucuugcauuuaggucuaugagccauuucaaguuaauuuuaauguauacugcuacauaagggucauguuucauuuguuucuugcaaagugauaucuaacuguuccagcauauuuguugaaaagacugucuuucucccauugaaugauuugguacccuugucaaaaaucagucauauaugugugggucgauuucuggacucugcauucuguuguauuggucuauaucuauccugaaaccuauaccacacugucuucacuaugccacacacuuacuuuagaauaaguguuaaaaucaggcagcuugaaucuuucaauuuugauauucuuuuuaaauuugguuuugcuauccaauuuccuuugcauuuccacauaaauuauagaguaagcuuguugaauucuacauaaaagccuccuggauuuuaauugugauuguguuaaaucuguugaucaauuuggggagaauugacaguuucacaguguugucuucugauucauaaauaugguauauguuuucccauuauuuaagucuuuaauuucuuucaacaauauuauguaguuuuuaguguacaggucuugaaaguuuuaaaaauuuauccuuagggauacuuuauaauuauuuuauguuuuuaaguuauaaaugguuuaucagucauuauuaaaaauuucaauuuguaguugauucuugcuaauauauagacauacaguugauguuuacuuauuagccauacuaauauuaguuuuaguagucuuuuauuguaaauauauuggauuucucuauguagaugaucaugucaggugagaacaaagacaguuuuacugcuauuuucuaauauguguacauuuccuugccuuauuaaacuauccaggauguuuagaacaguguuaaagagcaggauaagagcaaauauccuugcuuuauaccuaauuuuagggcagaagcauucauacugucaccauuaaccauguuguuagcuguagauuuuucguagaugcucuuuauuaaaaguugaagaauuucuauuaguaauuugaugaguuuaaauaaucuuaguuugauuagcucugcuucuuuguucuuauggugguagcuuuaggguuuagaauauguaucuuuucucaucacgguagacuuucaaacaauaugcugugucacuuuaccuguacuguaagaaccuuauaacagcauacgucuauuuucuuaccuucuaucugaaccuuaaaaggcauacaucuguuucccugccuucugucuuuugugcaguuguucucagacauuuuacuuccauguauuuuuuaaccuuuacaauacacuguuuuugccuuaagcaauuaucuuuaaaauaauuuuuaauagaaaaaauguuuuauauucauaaaguagucauuuuaaguguucucuuuuccuuuguguugguauacauuuucaucuauuacauuuuccuuuugcauaaaaacuuccuuuagcauuuguuuuuguagugcaggucugauagccguaacuuuuguuagcuuuuauuugugugagaaaaucugcauuuugucuuaagauguuucccuuucuuuaaaacaguuuugcugaguuaauaacaaauuauaaauaauuuguacauauuuaaaguguacaaucugauaacuuuugacccaugaaaucaucaccacgauaaaaauaacauccccacaaauguucuccuauacaggagauuuuaggaggaaaggugcauuugaacuaaaucuucaagaacagguauguuccccaaauaagauuagcucauucaaucaaaaguauguauuaaaugcuuacugcguucgcuaggaugaauaaaacagucaugauuucuagaaggagaugcauauuauaaaauaauaaaacaaaauaaacccaauaaauauaauggcaacagagugcuguaguaugagagagaaugauggagaaccuacuauaaauuuaguuaucucuuugaggaaguaguguuagguugacauuugaaggguaugugggaaggaacuuccugugcucugaugagagaagccuguugagcaugagacuuuagggcacggcuguagaugcagucaucuuuuugcaaggaugggcugaauaccuguucacuuacuaaaccgugggaguacagcuacacucuagugcaguuccuguuaggcuauuaugagagagaguuauggagaaaauuucuuccuaauagaaugaugaaauaugcuuguauauuuaguaguuugaguuaaugcauuuuacauuacuguauuccuauagcauggcuaagcuuaacaauaaaaaaaaacuauguagucuuugccuuuauaaaggaacuuaacuugauaaagauaagcucccuauuuuagcagcaaauaauucacuuuccuuuuugaacaaagauaagauuauucaacuauuauauaugauuuuuaauacuuccaaugaaaauauuuuaccucaaaaaccuuaaggaugauuuuucuuauaauuuuuugagagguauuucugaauuuaauuuuauuuuuugcaauacauauuuaugaagaauauaauaugugucauauacuaggcauggugcugaagaugcaaagauaugguguacugucauaauuuucucauuuuccuaugccuuugccaagaaaaaaauagagcauuaaauuuauaauaagcauaaaucaguacauuaauuauuaguacauuuauuugaaaccuuugaauaauuuuuuucuauugcaaaagugauaauguacauucauuacagagaacuucaaaaagccaaaaaaauuauuuuaauucugucaaaaaaguucuuauugaaugcugcuuucuucaaggcaggcacuguacuaugugcuuaguauacuacaugagcaagacagauggucucugcauuuaagaagggcauaggccaggcccaguggcucaugcccagcacuuugggaggccaaggcaggaggaucacuugaacccaagaguucaagaccagccugagcaacauagggagacccuguaucuaccaaaauaguuaaaaauuagccaggugugguagccagugccugugcucccagcuacucgagagacugaagugggaagauugagugagcccaagagguugaggcugcagugagccaucaugcgacugcacuucagccuuggcaacagagugagacccugucaccaaaacaaaacaaaacaaaacaaaaaugcauaguauucuggggaauggauauuaaauaauuacaaguauuuuuugagguaugaaacagaagauaaaaaccacucuaaaucuuaccaucuagaaauaauugcuaauaccguguuaauauauuuuccacuguuuauacuguacacauauuuucaauuuuaucauuuuaaaauauguuacuuguugccuacuaauuauguagauacacuuuaacuuauuaaaaccuucccaaaucauugaacguuuagguuguuuucauuuuuuagucaacuuaaguauaauuuacauauaaugaaaugaacucauuuuaaguauaugauuagaugacuucugacaaacauauauaugcauguagcccccaucacaauaaaaauauaaaacauucucauugccucaaaaaguucugccaugccucuuugcagucagucuucccuguacccauaguacauccacacguggcccuagguagccauuggucugcuuucagacacuaaagauuugauucaucuuuuuaaaaaugucacagaaaugaacucauacaauauauacugucuuguaucuacuucuuucauucugcguaauguuuuuugagauuguuaacuuuguugcauuucucagucauuuauuucuuuuauugugaagucauuauccuuugcacagcuauaccaccauuuguuaaucucucccacuggugacguacaugcggauuaauaccagucauugccuaauaugaauaaagcugauaggccuguuucuuuucucuuuaauuaauacugaagaguaugauuguuggauuuaugguaagcauaugcuuacauuuuacaaaaauuuaaaacuguugugucauuuuacagucucagcauuaauguaaugagaauuuuagguguucugcacccucaccagugcuugcuguggucagugguuuucauuuuagucauucuaacgagugugugggaguauguuacugugguuuuaaguugcguuucucuuaugacuaaugauaggaaaugucuucacucagacuuuuugccauugcauauacuuuugugaccugucuauucaaauauuucaccuauuauucgguuguucaucuucuuacugaauuauaggaguucuuuggauguucugguuacaaauaguuugccaaauauuuguauuacaaaugguuucuuccagacuguagcuugccuuuucauuuucucagugaugucuuuugaggaacagacguuuuuaauuuugaugucuuauuuaucaauucuugccuuuuaugguuuucacuuuuuuuguguacuguccaagaaauguuuguguaccccaggucacacaucuuucuccuauuuguuaugugucacgugcuauauaauaaguuucugucaacagugggccauguauaugacaauaccauaagauuauaauguagcugaaaaauucauauugccuagugauguaaauguuguaagucauacugcagugcauuacucacauguuuuggugaugcugguguaagcaaaccugugcugccgguuguguagaaacauagcacaugcaguuagauacauaauacuugauugugauaguacaugacuguguuacuucuuuauuuuauauauuguacuuuucauuguuucuuaaaguguauuacuuucacuuauuuaaaaaaaaauagguaacuguaaaacagcaucagguggguccuucaggugauauuccaaaagaaggcauuguuagcguaggagaugacuacucgaugccugcuccgaaagaccuuacagugggacaggauguggagguggaagacagugauacugaugauccugacuguguagguuuaggcuaacguauaugcuguguuuucauuuuuaaccaaaaguuaaagacguuaaaaaaaauagaaaaauauuuauaaagauguaaagaaacaauauuuuuguauagcuguacaauguguucauauuuuaaacuguuauaaaagagucaaggcguuuuuaaaaauuuuaaaguguauaaagugaaaaaguuauagaaagcaaagguuaacucauuacugaagaaaaaaauaauuuuaauuauuuuauacauuauacaguguucauagucuacaguaaucaccuaggccuucauauucacucgccacucacucacucaaagcagcuuccaguccuacaaguuucauucaugguauuauaaaugcaauagacagguauaucguuuuuaaaucuucuauaucauauuuuuacuguacuuuucuagauguguuuagaugugcaaauaucauuguguuacaccugccuagaguauucaguaggguaacaugcuguacaggucuguaccuagaaguaguaggcuaugccauuuagguuuauguaaguaaacccuaggauguugucacaaugaugaaauugucuaauugcacauuucucagaauguauccccaucauuaagcagugcaugacuguauuuucuucuaaaacuuuuuaaguuguaccuauuacauguauaggucugugauccauuuuaauuuuuauguaugcugugagcuaagaguugagguucauuuuuuucccccuacagacaucuuguucuuucacuaucuuucauugaaagggcuguccuuuagucagacaugggggcuuauaccuguaaucccagcacuuugggaggcugaggcaggaagaccacuuauguccaggaguucgagaccagccugggcaacacagcaggacccugucucuacaaaauaaaaaauuuaaaaaauuagccuggacugguggugcaaggcagaauugggagcauugcuugagcccaagagguugaugcugcagugauccauguucauaccacugcauugcagacuggacaacacagcaagacccugucucugauugugugacuuggguaccucuguugaaaaucaguuugucacacauaugggucuguuucugcacugucuuauucuguuuaauugaucuuugaguuucucuuuacaucaguaccacgcuaacuugauaauuguugcuuugggaguauauuuugaaauagagaaaaacuuuguucuuuuuucagaauuguuuugacucuucuguguccucugcauuuucauauaaauuuauuaucaugucaauuuuuacaaaaaagucugcuguaacuuugauuaugauugcauuuaauccauaaaucuauuuaagaauauugagucuucuaauccauggacacacacucuguuugcuuauggauuucucuaaugucuauugaaacacuguaguuuuaguguauagguuuguauaauuuuucaauuuuucuuuaccuauuccaauuuuuucccauuuacaauuguuugcuguuagcauauaagaauauaguugguuuuuauauauuaaccuuguauuccauggccuuccuaagcucacuuauuaguucuagaaacccuuuuucuaaauuucuuugaaaugucuauguagauagucuugcucuuuguaaauaauagcaguuuuacuuccauucuuguuuguauggcauguauauauuugucuguuuaauugucuaucugucuaugcaucuuucacugccugugacugcuagugcaguguugaacaaaaguagcgaacauuguguuuuuguucccugucucggaaaagauuaagucuuuuauuauuaagugugauguuagucauaaguuuuucauauauaccuuuuauuagguuaaguucucuccuauuccuagaauauuuuaccaucaguggacauugacuuuucuuuaaagguuuuugugccuccauugaggugaucauaugguuguuuauuuagacacggagucucacucugucgccuaggcagaagugcaguggcgugaucucagcucacugcagcuuccagguuuauucccagguuuaagugauucuccugccucagccucccaagcagcugggacuacaggugcccaccacugcacccagcuaauuuuuguauuuuuauuagaguugggguuucacuauguuagcuagauugcucucgaacucuuacccucaagugauccacgcaccuaggccucccaaagugcugggauuacagacacugugcccggcuuucuuuuuaguuuguacauuugauaaauuacauugacauucaaauguuaagccagucuucauucuugagauuaaccaucuuuuagucauaauguauuaucauccuuauauguuguuggaauugaauuagagaaguuuuguuaaguuuuuacaucuaugauuuugagggauauugaucuguacucaucuuuucauguaauaguucugucugguuuuguauuguggcaaugcuggccucaugcaacguguuaacaacuguucucguauuuucugggaguguuucuauaaaauuguaauuauuucuucuuuaaaggggugguggaauucaucaguaacuuuugggagcuccaguuuuuauugugggaugacgguuaacuauaaacucguauuuaacuuuuuuucccauuuuguguuccgcuuagauuauaccauuucacauacauccuaagauccuuucacugguauacuuuuauuuccuccuucaagccuuuguacuguuguuacaauacauuuuacauuuguauguguuauaaaugccacuaugcauuauuauuuuuguuuuaaaccagugauuaucuuuuaaggaaauuuaaaacagaagaaaaauuaauuucuguucccugacacaguuacuauuuccaauauuuucuguccuguggguagauccuguuuuccauguggugucauuuuccuucauucugaaacauuuucuugaacaauuucuaguucagugucucugguggugaguucucuaaccuacaugucugauaauggcuuuauuuuccucucauuuuuggaaagauauuuagcuauguaugaaauucuaauuugccauuuuuacauuucauuacuauaaaaaugucacuguacuuucuucuggcuuauacaguuucugucaagaagucugcuuuguuccucugugcuucaugugucuuuuuuucuguggucgcuguuaagcuuuucuguuuauuacuuccuuucagcuauugauuaugaugugccuugguaugguuuccuucacaguucuuuggcuuaggguuuuuuguuuguuuguuuguuuuuugucuuuuuuuuuuuugagacggagucucgcucugucgcccaggcuggagugcagugacgugaucugggcucacugcaagcuccgccuccuggguucacgccauucuccugccucagccuccagaguagcugggacuacaggcuccugccaccaagcccagcuaauuuuuuguauuuuuaguagcgacgggguuucaccauguuagccaggauggucucgaucuccugaccucgugauccgcccagcuuggccucccaaagugcugggauuacacgugugagcuaccgugccuggccaggcuuaggguguuuuaagccuuguggaucuauaagcauauaguuuucauucaauuuggaaaauuuuugaauauuguucuguaaguauuuuguuacucauuucucuuguuccauccugagaaucuacuuauuuacauguuagacaucuugauguuaucccacuguuuacuaauguucucuucuuuuuuucagucuuuucucugucuuuaauuuuggguuuuucccccugugucuuuaaguuuacuaauacuuucuucuccagugucuaguaacaucuaguauauuuuuuauuucagacauuuucaucucuugaaguuugauuugggacuuuuuuuuucaucuucaucuuaugugcuucccucuaccuuuugaacuuuuauauuuucaacagcuauuuuuuauauuuucaacggcuaauuuauuaugguauucguguaauuauaucuuaugugucauuuucucagucuguuucuauucauugauuagucuccugauuauagguuauuauuuuccuguuucuuuuuauguccguuaauuuuuuauuggaugccagacauugaauuuuacauugucagaugcuggaaguuuggggauuaaaaaauauauuuaggcauuauucuuauguauaaacaguaugauccuaucagugcuugcuuuuaagcuuaguaagacuggucuggaauauccuuugcucuagcacuaacacggcugcacuauugaggcaguauuuuuuuaaaacucuguuagaugccauaguuuuuaggagaucuuucuauuuugccaugugagaacaugaaauauuuuugccuuucuguuagccuggugauuguuucaucugguccuuuucaguggcucuuuccguagcuuuuccccacauacaggugcugcucaaugagacuccgaggcaauccauuguagaucucucgagcucugucuuugguacugucuucugucuaguuaccugucucaugaauucuagauaccuuggucuccccagucucugaacucaguaucauuaaaucaaggauccucguaggcucuuuuuguuuuguuuuguuuuccucucccuguguuacagccuggacauuguuucuagguauccagcuggaguaaucauaacuaucaccuuauucauuucccuuuucuccugggcaacuguagaucugugcauuuaguuauuuauccaauuuuagaaaauuucagccauucuuuuucaaaugucuuucuccuuucaguaauuuauauuacacauguguuagauucauugauacuguccaacaggucacugaggcuuuuuuuucccaguuguaauuuauaucgauucuuuagcuaugauuucacauucagaaguccuuucucuuucagugucgaaucuguuaauuccaucuagugaauuuuuuauuuuagauguuguuuguuuuaucucuacagucucauuuguuucuauuucccuuuaucucuucuuuauguucauguacuauuuugaagucaguaucuauuaauuccaucaucucugauuuuuagguauguuucuaaugacugauuuuucucuugguuauaggucauauuuucuugcaucuugucauguuuaguaaacguugauuggaugcuaaaucauuuguucuuggggguuucuuuuuuuaauuuauuucuucuuggcuuuauugagguauaaugaacaaauaaaauuguauaaauuuuagguauacaguguagugauuugauacguguauguauugugaaaggauugccacaauugaauuagugaauacgucugucaccuaucaguuaccuuugucugugugugaugagaauaccuaagaccuacucucuuagcaaauuuuaaauauacaguacaguaucauuaacuauagucaugaugcuguacauuaaauccccagaacuuacccguaacuggaaguuuguaccauuugacaaguaucuccccauuuuacuuaccucccuaccccagcuccuggcaaccaucauucuacuuucuguuucugugaguuugauucuuuuagauuccccauauaaguggaucauacaguauuugucaucccugacuuauuuuacuuaacauaaugcccuugagguucauccauguugucacaaaugguaggacuuccuucuuuuuauggcugaauaauauuccauuguauaaauauaccacauuuucauuauccauuuaucugcugauagauguugcuucuucauauccaagaaaucuauauauauagaguguuuccauucuuggaauagagauaccugcaguccugccuuaauuacagugaauaaugcuacaguguaugugggaguacagauaucuauuugaaauauugaugucauuuccuucagauagauauauauaccuagaagugagauugcaggauuaugugauaguucuauuuuucguuucuuauggagccuccauacuguuuuccauaauggcuauaccaauuuacauucccaccaacagugcacaaggguucccuuuucuccacauccucaccagcacuugcuaucucaucuuuuuuauaauagccauccuaacaggugugugguaauaucucauugugguuuugauuugcauuucucuguugacuagugaucuaucuugagcaccuuuucauguaucugcuggccacguguauauuuucuuugaaaaguauauucagguccuuucccuauuuuuugaucagauuuuuuuucuuuuuucuuuuuuuuucuuuuuuuuuuuuuuuuuugagauggaguuuugcucguguugccuagguuggagugcaguggcacaaucucggcucacugcaaccucugccucccggguucaagcgauucuccugccucagcuuuccgaguagcugggauuacaggugccugccaccacgccuggcugauuuuuguauuuuuaguagagacgggguuucaccauguuggucaggcuggucucaaauuccugaccucaugauccauccuccucagccucucaaagugcugggauugcaggcgugagccacugugcccagccgaguuuuguauauauuugggauauugaccucuuaucagauauauuauuugcaaguauuuucucccauuccauagguuuuugacucuguugauuguuuucuuugcuucacauaagcaaagagauaaauaguagucccaccuauuuaucucugccuuuguugcuugugcuuuuggugucauauccaagaaauacuugccaagaccaauaucaaggagguuuuuuugguauguuuucuucuaggaguuuuauaguuucaggucuuacguuuaaguuuuuaauccauuuugaguugguuuuuugauaugaugaaagauaagacuccauuacauucuuuugcauguguauauccaguuuuccuagcacuauuuauugaagagauuguucuuucucccuuauguauuuucaguacccuugucaaauguuuguugaccauauaggcauggauuuauuuuuggcuuuugauucucuuccauugauuagauaauuugaguuuuacgugaguuacuggauuuuguuuucuucugucagaguguuaguuuuuauucuggaaggcaguauuuacaaauaugauugauauuucaguauugauguuagcuuuguucguguaaguucagguuucacucugacucuugagauaucuacugaaugccugagaguucaguaaugacucuucucugacugccuaaaaauugaaugucucucagcucugcgugagcucuaagagcuacuacauauuuacagcuuuccuuuccuucucugcuuguccucauaaaguuaaacccuacacaugcauugcuuaguauucaacugcagacucaacugugcagauucuguauagcuuccuccucauuaguguucuguccugcaaaugccaucuaccucaucauccucaaaaucugauguuuaucuuuucagcagugaaacccuugaauuagguuugugauuuuucuuccucaauaaugugucagaaagugcccccagacaaaagguggauaaucauauggcucaccucauuuguuucuguuguaacagguaccaucgucaugcacuuccucuuguccaguaucuaaugagaguucuuuuauauauuugcucaguuuucaucuucuguuuuagauaugcccaucaaauguuuagggcaguuggguaaguucaguccuguugacuuuucacucauauauucugguucuuaacuaguaguuaacuaaaaaauauaaaaaauuugaaauuuaaaauacuaaaaaaucugaaauuuaucguauuauauugugagguaaaaaucuaauuuuucuucaaccugguuggaaggccguuuucacauuuuucucaauguauauacuucugaaaauauccuuguguagaagauggcuucuauauuuuuauguauguauguauguauuuauguauguauuuuugagacggagucuugcccugucaccugggcuggagugcaguggugcagucucggcuuacugcaagcuccaccucccggguucaaccaauucuugugccucagccuccugaguagcugggauuacagcgcccgccaccaugcccagcuauuuuugugugcuuuugguagggacgggguuucgcuguguugccagggcugguuucgaauucuugagcucaggcaaucugccagucucggccucccaaagugcuaggauuacaggcgugagccacuguacccagcguauauuuuuauuuuuuaaggaaauuucuaggagagcaacuaccgaacuuuaaaaauuaucuugcuaucuauugccagauuguuuugcaaagacugucuguuuacauacuagccaccaguguauaaagaugcuuaucucaccucacuuucacugacaauacuaauuuuucauaaauuuaaaauugcccuuuuuuaaguuuugucucuguuacauugauuauuacaagguggccuauguucauauacauuaauaauuuguagcccucucagguuaauuguaccuuuacccaauuuuuuguguuuuagucuuuuaauuuuuuuuuauauuaagaauaugagcuuugucacauguuauaaauacuccauuuuauuucuaucuuugcuacuuuauauggcuaaaucuacuggauuuucccuucauuauuccauuucuuuuuuauuuuuuucaacuuuuauuuuaaauucaagaagguacuugugcagguuuguuaccuggguauauggccaugaugcugagguuuggcauacaaaugaucccaugaucagguacugagcaugguacccaacaguuaauuuuuccacccuuuuuaaccccuccccuccucuaguaguuuccaguuucuauaguuaccauauuuauguccaugaguaccaauugauuagcuccuacuuauaagcaagagcaagcaguauuugguuuucuguuccuguguuaauucacuccggauaauggccuccagcugcauccauguugcugcaaaggaccggauuuuguucuuuuuacgacugcauaguauuccauggcauauauauauauacaccacauuuucuuaauccggucuauccaugucuuugcuguugugaauaguucugcaaugaacaugcaagugccugugucuacuuuauagaacaauuuguuuucuuuuggguacacacucaguaaugugauugcugggucaaaugguagcuuuauuuuaaguucuuugaaaaaucucagaauugguuuccauaguggcugaauuaauguacauucccaccaacaguguuacaagcauccccuuuucucugcagccuugucaacauguuauuguacuauuagaccgauuauuguuugacauuuuaauggcagccauucugacugguaugagaugauaucucauugugguuuugauuuacauuucccugaagauuagugaugugcagcauuuuucauauuugguggcugcuuguaugucuucuuuugagaaaugucuguucaugucauuugcucauuuuuuauuggguuacuuguguuuagcuuguucaauuguuuaacuuucuuauacacuuuggauauuagaccuuugucagauaguuuaugaauauuuuaucccauucuguagguuuacccuguugauaguuucuuuugcuguacagauucucuuuaguguaauuaggucucacuugucgauuuuugguuuuguucaauugcuaucgaggacuuagucauauaauuuuuuccagugccaaugucaagaaugguguuucuuagauuuucuucuaggauucuuauaguuugagguuuuacguuuaaaucuuuaaccaauauugaguuaauuuuuguauaugguaaaagauagggguccaguuucauuccucugcguauggcucaccagcugucgaagcaccauauauugaauaaggaguccuuuccccauugcuuauuuuugucagccuugccaaagauuagauuauuguagguggcuggcuuuauuucugggcucucuauuauguuccauuggccuuugugucuguuuuuuuacaguaccaugcuguuuugguugcuguagcuuuauaguaugguucgaaggcagguaauuugauaccucuagcuuucuucuuuuugauuaggauugcuuuggcuauucuggcucuuuuuugguuucuuguuaauuuuguaguuuuuuuuuuccaguucugugaaaaaugauguugguaguuugguagguauagccuugaaucuguagauugcuuugggcagggaaauauggcuauuuuacugauauugauucuuccagucccugagcauggaacguuuuuucauuuguuugugucauguaugauuucuuuuaacggugucuuguaguucuccuuguaaugaucuuuuaccuucuugguuagauguauuccuggauuuuuuuguguguguggcuauuguaaaugauuuggcucucagcuuggauguuaucaguauauagaaaugcuacugauuuuuguacauugauuuucucuccugaaaccuugcaaaaaucauuuaucaguucuaauagccuuuugguggagcccuuaggguuuccugaguaucgaaucauuaucaguaaagagagauaguuauacuuuuucuuugccuauuaggaugccuuuuuauuucuuucuuuuaccugauuuucucuggcuagcacucuccacuaauauauugacuaggaguggugagagggggcauccauaucuuguuccaguucucaaggggaaugcuuccaguuuuugccuguucaguaugauguuggcuguggguuugucauagauggugcuuauuauuuucagguauguuccuuugaugccuaguuuguugaggguuuuuaucauaaagugauguuggauuucauugaaagcuaauuugguuuauguggugaaucacauuuauugauuuguauauguugaaccacccuugcaucccaggaaugaugccuacuugaucauggugaauuaacuuuuugauguguuuuucaauucaguuugcuaguauuuuguugaggauuuuugcaccuguguucaucagggauauaguccugugauuuucuuucuucauugugucuuugccagguuuugguaucaggauguuacuggcuuuguaaaaucauuuuuuuggaauaguuucaguagaauuuauaccaccucuuccuuguaccuuacauagaauucaacugugaauccgucuuguuugggacuuuuuugguugguagguuuuuuuuauuacugacucaguuuuggaacucgauauuagucuguacagugugucaauuuguuccucauucagucuugguaaauuguguguuuccaggaauuuauccauuuccucuagauuuucuuguuuguauguauagacacauagccucugaggaccuuucguauuccugugggauaaguuguaauguaaucuuugucauuucuaauugugguuauuuauaucuucucucuuuuccuuuguuaaucucacuagcagucuagcaaucuucuuuauccuuucaaagaaccaacuuuuggcuucaucauuucauuauguggauuuuuaggucuuaauuucguuccauucugcucugauuuuaguuauuuuuuuuucuucugcuagcuuauggguuaguuuguucuuguuuuccugguuccucuagaugugauguuagaguauuaauuugagaucuuucuaauguuuugagguaggcauuuagugcuuucaacuuuccucuuaacacugcuuuugcugcgucccuggaauuuugguguguuguguaccuauuuucauuuauuucaaauacuauuuuuauuucugccuugauuuuguuguuuacccagaagacauucaggagcaaguuguuuaauuuucauguaacuguaugguuuugagauaccuucuugguauugauuucuguuuuuauuccacugugguccaagauuaugguuaguaugauuucaggguuuuuuuguuuguuuuucuuuuucuuuuucuuuuuuuuuucuuuuuuuuuuuuuuuugagacuuacuuuaaggacgagcauguggucagucuuggaguauuguuccaugugcaccugagaagaauguauguucuguggcugauggguagaguauucuguagauguuuuucagguucaguuggucaaguguugaguuuaaguccagaaugugugacuuuucugccugaaugaucucacucaugcuaguaggguguugaagucccccacuauuauuguguugcugucuaugucuuuuuguagaucuaguaguacuuguuuuaugacucuggguucuccaauauugggugcauacauauaugugagauauauauauggaagauauauguguguguguguguguguauauauauauauauauauauauauacacacacauauacauggaagagagagauauauauauggaauauauauacauacuggaagagagagagagauauauauauauauggaagauauauaugugauaguuaagucuucuuguugaauugagcccuuuaucauuauguaauacucuucuuugucuuuuuuuuuuuuaacugcuguuaguuugaagucuguuuuaucagaugaaagaauagugauuccugcucuuuuuuguuuuccauuagugugguagcucuuucuccaaaccuuuacuuugagccuauaggugucauuauauauaagaugggucucuugaagacaagccagauggaugagucuuguuuuuuuauccaacaugccacucugugccuuuuaagugagguguuuagaccauuuacauucaaagcuaauacuguuaugugauguuuugauccuaucaugaaguuauuagcugguugccuuacacuuucuaguguguguuuuugcuuuauagggucugugggcuauguacuuacaugcauuuuugugguagcauuuauuuuucuuucauuuccauauuuagaauucccuuaaggaucucucauaaggcuggucuaguuguaacaaauuccuuugugcuuguuugucuggaaaagauuuuacuucuuauucacuuaugaagcuugguuuggcagguuaugaaauucuugguuggaauuucuuuuuuuuuuuuuuuuuuuuuuuugagaaagcuaaaaauagguccccagucucuccuggcugguaagguuucugcugagaaguugacgguuggccugaugacauucccucugaucugcccuuuuucucuagcugccuuuaagauuuuuuuuucuuuaguguugaccuuggacagucuggugauaauauccuuagugauguuuauuuugcauaguaucucacaguuguacucuggauuucuuguaucuggauaucugucucccuaacaagauuaccaaaguuuucuugaguuauuuccucaaauauauuuuccacauuguuaacuuuuucuucuucucucucaggaauaccaguaauuuguagguuuuaucacuuucuguaauuccauauuucuugaagacuuuauucauuuuuuaaaauuauuuuuucuuuauuuuugucugacuggauuaguuuaaaauacuggucuucaggcucugcaagucuuucuucugcuugggccggucuauuguuaaagcuuucaguuguauuuugaaauuccuuaugugaauuuuuucaauuccagaaagucugauugauuucucuuaaagaugcuuauuucuuccuucauuuccuggauuacuuuagaaguuuuuuuuuguugauuuucaacuuugucuuggaucucauugggcuuacugcaaucccuacuuugaauucuuuaucugucauuucugaguuuccauuuugguuagggaccauuucuguagagcuagugugauccuuuggugguaucacuacauucagauuuuucauagugcuggaauucuuacgcugcuuuuuucuuaucuggagacccuaacacuuguaacuucuguaauuauuuucaugcagguaggauuuuuucuuucuuuuucuuucccuauaauguuauuauauauuuuuuucuccuuucccuuuucuuccccucccuucagaaugugacuauagagaauucuggguagggucuuugacuuuguuucuuuaguccucugugcugcuuuuggccaauuuuauuuugggcuguggcauuugaccugcaagccuguagauggcacuuagagguaagagcuaacugcagccaacauggcuuaguguauaccuugauacuuguuuacuggcagaagcucuuuguugccacaggcuauggccaauucauggaauguaccauggucugagcucacugcccagccccagggucaggggguuggcagagggcaggaauggcagggccagaccugacagguccaccuacagguccccugaugacagacacaggcacuagugccgagggagaaugcaguggguggccaccaagggcccagagaugugccuaguaguguagcugggaaaccuccucagccccaaguucucugcacagggauaggggauggucuaaacuucuaguccaggagaguaggugcucaagaugccuagagcauggagcagagacccccugcacuaagaucucugcauaggagggguggggugacucaaacuccagaagcaggcaaggaggugcucugaaugccuagggaucuuccuggguauggagcagagagagcucugcuucaccauaacguuauguccaggaggagugcgguggcucaggcuacucaacuaggcaaaugguuacucuggaugccagagaugugcuuggagauggagcagcaagggcccuacugcaccacaaucucaggagaacagaguggguuacccggcaauggcacaugcgaaucuguuccagguugccaagcugaacgugacugcaaguuuugcagcccaggagaaacugcagcuguagcggcucuccugcugccccaggcuugaaaguggggaaagcacaauucuagcccuguuguugggguacuuuccacaguuuugacugugaagccccuaucccauuccagagcagguguuuugaucucugguccaagacugacaugccugugcagccacacugcugggucaccaaggaauggcugaguuuuuaugugcccaaauuuaaaacauuguccugcucuuuuucccgggucuggaaaaaugccuucagcuuuuuccgucacagugacuccaggccacuccccaaguuagcuccaggacugggagaaacaaagugcucucccuuggccuagguugcuuggauccccaguggaagggugagucacagagggaggcuccuugccucucucaugcacuggggcuucacuuaacuuuuaucagcuggaugccgucaguggggcuguuugcuggccuucuccucucugggaucuggaguguacgucaugauuccaguagauuccuguuuuccuucuugaauuaaagcucacagaguuuaucuuuaucugcuaucuugcuauguccaaguggcugaggcgugcagaaagccucuaacccacccucuuggggaaaagcaaaaagucuauuucuuccauuucuuuuaugcuuagaaaauucuucuucaucuugagacuagauaaccacuuacacauauuuucuaguuuuuuaauuuuauauuggacuaauacauauaaauuuuauuuuguuaugaggugaaaauuaaauuuuauguuucuucagaguuaauuauuguugcacuauuugucauuuuccuguauacuuuaucauauauugucauguucaaguauucuguauuaaauuuuuauaaccuaaaauaaccuguuccuugcuucauuauuucuuugguguuucauuuguguaccuauuccauaugaauuguaguuauauaagucaauuucuuuagacaaaccuuuuucuugaaggcacuauuuaauauguugcacagaaaccuucugguucaauaauaccuuggcucaccucauccauuuuuuuaaaggaaugguguauuauuucuaccuucacauucucuuuucagcccaccuaaauaugacaacuuaccuuugaaaaguaacagaugaccuaauuccuaaguacagcaaauguuccugucuuucugaaacuuuauuuucccuucacuucuuguagucuugcuuccuuuuuuuauaucucuuaguauuccaucugaauguccuguucugcuuuuuucuguccuauguauaguaguacccuaagauucugccuucacuuaucuuuucaguuuuuacugaauuccuagacuauucuuugcuuucucagucuuaacaauauccuuucuaugaaugauucccauaucuaccuucaugaacuugcaaagcuguguuaucaaaugccuauuuagauaucagcaugucaaaauaaaacccauugcuccucuguccccauucccauucuuuuccuuuauaucagcaucuacucagucagccauagagaaaccucaacaucguugauuucucccuugacccaagugguaaaagcuaguucccucuggaauauugauucucuuuauaugucuguuacuacuaccuuagcugaugucccucagaagcucucugcaagcucaaauauaacuucugauauuuccaaacaugcuuauucuuugaaugucuuuucugcuuuauaauaauuaccguaacuuuaguagaaaaguuuauguaucuggcucuuguaaccagauagugauguccuugcagauugguacgguuuucucucauugugucugcagcuuuucauaacaguggugaucaguaacuuuuuuguuguacuuuaaaaauuguuuagcagucuguagucucaggcauuuuuaguugauucucucauugcuacccgaauugccuuuuuaacauuaugcuaauuauuuuauuuuauuuuuaaguuccaggguacaugugcaggaugugcagguuuguuacauagguaaaugugugccauggugguuugcugcaccuaucaacccaucacuuaaguauuaagcucagcaugcauuagccauuuuuccugaugaucucccucccuuggcucugccccacaagcccuaauguguggugguguucucccugugcccauguauucucauuguucagcucccacuuaugagugagaacaagcgguguuugguuuucuguuccugcguuaguuugcuuaggauaauggcuuccagcuccauucaugucccugcagaggacaugagcucauuccuuuuuauggccgcauaguauuucuuggguuauauguaccacauuuucuuuauccaucuaucauugaugggcacuuggguugauuccaugacuuugcuauugugauagugcugcagugaacauaugcaugcacguaucuuuguaguagaaugauuuguauuccuuuggguauauacccaguaaugaaauugcugggucaaaggguauuucugguucugugucuuacagcaauugccacacuugucuuccacaguggcugaacucauuuacauucccaccagcauuguaaaaguguucccaucucucuguagccccacuagcaucuauuguuucaugauuuuuuaauaaucacuauucugacuagugugagaugcuauuucauugugguuuugauuugcauccucuaaugaucagugguguugagcuuuuuuucauguguuuguuggucacauaaaugucuucuuuugagaagugucugcucauguccuuugcccacuuuugaauggggauuuuuuuuucuuguaaauuuguuuaaguuccuuguagacucuggauauuagaccuuugucagauggcuagguugcaaaaauuuucucccauucuguagguugucuguucacucugaugguaguuucuuuugcugugcagaagcucuuuaauuagaucccacuugucaauuauugcuuuuguuguaauugcuuuugauguugucaucaugaaacauugcccguaccuauguccugaaugguauugccuagauuuuauucuagguuuuuuauaguuugggguuuuacauuugucuuuaaucaaucuugaguuaauuuuuguauaagguauaaggaagggguccaguuucaguuuucuuuauauggcuagcuaguucucccaacaccauuuauuaaauagggagugcuggccagaugcaguggcucaugccuguaaucccagcgcuuugagaggcugaagugggcagaucacuugaggucaggaguuugagaccagccuggccaacauggugaaaccccaucucuacuaaaaauauaaaaauuagcccagugugguagcacaugccuguaaucucagcuacucaggaggcugaggcaggagaauugcuugaacuugugagguagagguuucugugagccaagaucaugccacugcacuccagccugggugacagagugagacucugucucaaucauucaaucaagcaaucaaucaauaggauguccuucccuauugcuuguuuuugucagguuuguuaaaaaucaaauaguuguagauauuuggucuuauuucugaguucucuauucuguuccauugguuuaugugucuguuuuuguuaccaguaccaugcuguuuugguuacuauagccuuguaauauaguuugaagucagguagugugauggcuccagcuuuguucuuuuugcuuaggauugucuuggcucuguggguucuuuuuuggucccaugugaauuuuaaaauaguuuuuuucuaauucugugaagaauuuccaugguaguuuauugugaauagcauugaaucuauaaauuacuuuggccaguauggccauuuucccaauauugauucuucauauucauuagccuggaauguuuucccauuugucuguguucucucuuauuuccuugagccguaguuuguaguuuuccuugaagagguccuucacuucccuuguuagcuguauuucuagguauuuuauucucuuuguggcaguugugaaugagaguucauaaaugauuugguucucuguuguuguuguauaggaaugcuuaugacuuuugcacauugauuuucuauccugagccuuugcugaauuugcuuaucaacuuaagcuuuuggacugagaggaugggauuuucuagauacaggaucaugucaucugcaaacaaagacaauuuuacuuccucucuuccuauuugaaugcucuuuauuuuuuucucuugccugauugcccuggccagcauuuccaauacuauguugaguaggaguggugagagagggcauccuugucuugugcugguuuucaaggagaaugcuucuggauuuugcccauucagugugauauuugcuguggguuugucauaaauagcucuuauuauuuugauguauguuccuucaauaucuaguuuacugagaauuuuuaacaugaagcgauguugaauuuuuuugaaggccuuuucugugucuauugagauaaucacgugguuuuuguguuuaguucuguuuauauuaugaauuacauucauugauuugcauauguggauccaaauuaugcuaauuuuuaagcuaaaauucuuucauacuuauuaucuacagaaaaaaaauucaugcucuugucauguuaguaaagauccuaaccaaucugaucucaucuuuuuuuuccagaaguccuauuauuucucugauuauauauuauuuuuuggcuacauguguucccuacauguguuuucuugccauugcuauuuuuccucuuuaguauuaaugcuuucuaaauuuuuauuaaucaccuacuaugugcagguacuguccuaggcuguguuggaaauacaaauggauaaaacuugaguagcacuuuuuuggagauuuuucccuuaaauuuuccauuaugaaaaaccuauucuucaaaacuuagguaaagcuuuuucuuaucuaucaagucuccuuacaugaugccagcacagauuaaucccucuuugccuucaaaguacuuuuaauaucugaguuauaaaauguuaucacaacccucuuuuuuuaaaaaucaauaccuguguccucuucauucauauugcuuaauggcaggaauugucuuuuguuuaaaccacuuuauugaguuaugauugauauacaaaaugcuguauauauuuaaucggaacaacuugauggguuuggaguuaaguguauacucaugagaauguuaccgcacucaaugcuuggaaucauaagagauucugucuuaucacuguauucccucuuucucuucuccagugcccagcagugacuuuaaaauaauugauacucacuaaaugaaugcugaauugaaaaguugguucagagccaaaguagaaacugagaaggauuagccagagaguuaggaggcaaaucaggagagagucauauuaccaaagcccagaaauguguuucaagaaagagggcaguaggugauguccuaagcuucagauuuggaagaagcagugcagacuguaaauagauuauuggauuuggcgauuaagagguuguugguuaucuuaacaaguuccauaaaguaguaaggguacacaucagauagcagacugagaaguaaauucuuacccuuaaauauaauuuuuagcugauauauuuauagaaauuggcuggcagacacauugaagauacauagucuaaauaaagaucuagaaucuugcauauauuauaucgauuuagggaggauccauauuuuuuguaaaguuaaaugaguggguaaguaggcuugacauucuuuuaagaaaauuuagaaaccuaaucacuauuuucaucucauuagaagacuacugcaacuccacauagagaucacacgaucuuuucaucaaaguuagugauauuuugcauggcagaaauuauuuuaaccuggaaaacauggcuccuucuacuuucuauccuuguuaggcugguaauacauugauaauauauaucuaacuauaugaaaugaaugaauuuuuuaaaauaucccugaguaauuguauaaaugacuugauuuuucacauacuguauuugauuauuuggaagacauacuuaacauuucuguaaucagaaugccuuuuagaauagaucauguguuauaguuuuaacugacaaccuuuuuuaccuugguguuuuauaaaaugaugaugcagucccaauucguagcauaugagauuugauaaaauacaguaauauaguaggaagcauuaaaguuuagagacugcaaaauauuuuaguuuuaauauaauuauuguugugcuacacuuuuuggggcuauaggugauauuuucucucucucucuguuuacuaugccaaugggucaugcauaaagcuuaucuuauaauaugcuguuaagugaaggugggggugggaauggggaagaaugaauuuauagggaaccuguuuuauguuacuugaaauaaugacuuugguguaugcagaacaaaucuuaguuaaccauaauuuucaccaauuuuguagaaacauuaugagucaaugauccauguaagggaaaaauuucugaucuugcagucaaggguacauuggcugauugguucauuuuuuucacagacauguauuguguaucuauuaauaaccaugauaccuggcaauauacucagcacuguaaacaaucuuucauuguucugagcauguuucaacaacaaagauuaauagucaauucacagugccugaaaccugcucuuucuucauguauguuguccaauugagauaauauuuguaguuucuuuaaugaagaaguggccuauuggagagccguguacuuggucacaguaagcacccagugaauguuuguugacuaucgaaugguauauguuuuaagagguugacuaggaaauggaugggcuuauaguuuuagugauaauaugagaaaggacuggcauuguagcuaauuauuauugaaaauagaauauacauugagaacugcaauaggaauaauggauguuucucaguucauuuugggcauuacuaaaauaaauuaaaaacauaaaaccuuaaaguuucucaccauagaaaaugucaaauuauuuucuauuuucaauaauaauuugacuuugaaaauauuuuuagagauaucaugauuaaucaaaaauuguagaauauaacaaguucgcguaaaucaguuucagcaaauugacagucuugucuuugaaaucaaauaauuaagugaaaauauaucugugcuuguguucauuuauuuuaguaauaucucaauaccuaauccuugaagagugaagcaacaguauagugagggggaaacugcaaucugaugaugcauaccuuuuuccucugguaacugaagguuaaauggguagcaagcagaaugccuuaaacaagauugguauauugauuaaaacgcugauuuaacagcucgcaguuuccccuuggaaaccuggaaaagauaagccagcugcugucuaagagugcucaguguccacugagaguacacuaucuaucaucacaauauggugaugagagguguuuuauguuuguguuaauuucccccacuaaaucaguaauuauuacaauccugucccugcuguuuacccugcagcuguuuuuccauuugucgagagagcggguguucucugaggaccgcacacguuucuauggugcagaaauugucucugccuuggacuaucuacauuccggaaagauuguguaccgugaucucaagguaaaaaaaaaaaaaaaguaaucaaaauuuguuuuugcagagacuauagggacaaacauaaaguaauuacaaaguuauacaguuuugagaaaagcagauuuaguugggaaaaaagcacuauguuuaaaaauuuaguucacuacauuugaaggaaauuuuauucacuaacauguauguaguugauuuaugugugaguuuuugauuugcaaagcaauuucugcccgacugcuuggaucaaauaaaaauguuaaacgugauuaagucaaauaaauucacaaguuacacuuaaaacaaguuuuauuauguuuacagaaauguuuuaugaagaaacauaguaagacuauuggaaggaacauauucauuuugauuuuagcauuaacuuugggugguuuuaaauaccugaagcauuuuaauauaauaaccauuuauuaaugugccucguguuuuauuuaugaaagcacucuauuuuuucuguugguaauaguguuuugacugcuguaaguuccauuaugaugagacccuuaggguagcucaggauuggcaaacuuucuauaaagggcagauaaaauaauuuaggcuuugcuguucguguauagucucuuuuguaaacuacucaacuccaucauuguaggguaaaagcagccucagauaguauguaaaugaauauguuuggcuauguuccaguaaacaaaauaggcgaugggcucaauuuaguccacagguugucauuuguugaucccuggaguaacucauacaagguaauaguaauucucaugacaguguuaugaauuagguuggcgacauuaaaggaauuuguaccacgacacauuuugaauaaauucuagauguuagucuuucuuuuguaagaagcaaauuguguauaaaauuugacacagaauugccuuauugaucaaauacuauuucauguaacguaaugauugguagaaacagaaguuacaugaggcuuuuaugaaauucuguuuuguuugaaaugagguauauagaagcuauaagauguuguauguaggaagaacugaacuauguaccuauaaaacaucuagaucagagaugaccaacugucuaagugccaaaaugggcuaaagauuaauacaaauuaauaguuugauuguauuuagccugaaucuuuuuauaacuaggaauguggcagaauucagcauucauguaucugcauggccagauaauccuauacugucuaaaugucuuaaauaucaauuucuuuaaaggaauuaguuauguggcaugacaaaauguguuaacuuuccaaauauacuuagaaguaguuagcucugcucuuccugaguccacuucucguauucccacuacauguuuuaugaauccuauuuguaggggugaaaaggggaaggauagaagcauggaggcuuagauuuaaggaaauuauaacaauuuugaaguaauagguaacauccagaaagcuuaaauucaaaagauugaauuauuagccuaaagacugcuaaagaaaagaauguucauuugauugcaguauugauuauggucuuggucaguauuucuucuuuaaucauuucucaucaaaugaaucaacauauugaggguauguguguguguguuuucagauggagucucgcucugucgccaggcuggagugcaguggugccaucuuggcucacugcaaccuccaacucccugguucuggcgauucuccugccucagccuccugaguagcugggauuacaggcaugugccaccacgcccagcuaauuuuuguauuuuuaguagagacaggguuucacggaguuggccaggauagucucgaucuccugaccucgugaccgccugccucgaccuuccaaaaugcugggauuacaggcaugagccaccaugcccagccaacauauugguauauugaagcucauuaaaugaguuccacugccccauucuuucugaugauggaauuagacuaaauuugucaaacugcaauauaaaguaccuacuuuauauaugaauaucagucaauuaguuaccacgugcacaguucaccaaguuuacuagacaauuaaguggucucugcucccugaguuuauuucuuaaaaaauauagccuuaacuuaaagaccuaaguauauaguuagcauaggacagaaacuguaaagguacaccuagaaaaauccauguaacauaagaaaucaaacauccaaaacuuacacacauguuauuuguauccacaguaacaggauuauuuauaauacaaugacauauuuuagguaagaucacagaaauuuugagcuggucuuuaauuuauaggugaucuccuucaaaccuagaagccuaguaaaugacuuacuaaaaguaaugaccuaaguugauagcagucaggguuuuuggaacucaugaauccuagcuccuuauugaauguucuugucacuauaucauucugacuucuagaguugaaaugaaauuauagaggggggaugcauuggauuaacuuugggaaaucuuuguaagccuaaacuucaaauuaaacugcagaagguaagagaaugaguguuucaaauauauuuauaccagauguauuaaagaacauuaucaugaacugauuuagguacccacuuugaucagucucagauuugucucuguucucauuacuaauaaccuugacuuuguucaaaugcaaauccaauugcuaugccuacaguagcagcacuucucaaguaaauccauacccguuugccgcugucucauucacauuggaggcagagccuucuuuuaugugcagguuaacuuaagauauuuuuaucaguuccuguuuccuaauaaauuaguguuuauagcaacagaaaaauuguugaagccuuuguuguacuuuagaaaguaaguucauuuaauuugucaauacacaucauguaaugaaguuuuauuuuuauuaaggacccaaauuccuugugauuacuuaaggaaaacugcuguugcuucaugauugcccaaaauuucgaagaaaucucuucaaagacuucuucaguaguccaaauuauauguuaaaaucuucuuuucugcuuagcucuuauuuuacaaauacaaccaaugaccauggccaucuaagcacagcguaggcugaacagggacauuugcaaaggugaauauaacuauauuggaaaucauuaagaauuaauuucuugcuaguuuaugggagaaaauaauacauaaguuguugcuauuuccuauuuguagaacaccuaaucuuguuuuccaccuaaugugagaauaguuaaccauuuacaguauuaauaugagaaagcaccaaauaaauuuagguacuuucuaacacucaguaauggcacgaagggguggcuucagagaguuuuaucauagcccuccucguccucaucagcucccuaauguucacuucaaauaaaugcaguuuggguggggaaagcaugcuugcuuugcuugcugagcuucaagacacuuuccccagcucccacuucuaacuagauggucacuggauuucccccuauauagaaaucuuaagccacugcucuucauuccuuccacuucuaaaauaaaauuguacugguauuggacuauguaccuuauucguaauaaauuuguaaauagccuggcaaccuauuuggggucuguuuacaugaugaguccuuuucuggauucagagguugaagugaagaaacguuuuucuuuuggaauuucagcauuccauggucauucaguuucugcagguuagcuugugacauuuuggcacuggaugcccguaaacuuaaacuugcaaugugcagaguaggaauuccuuacuaccuucuugggccugagugagucuuggugccuaaaacugaguuugauguaugugggcuaaaaugugguguaagagugaguaacaggaauuguuuauuucuauugcugcaguagucaucggagcccuuaggaacugcuauuuucauuccuuuguuuaaucacaaugucagucguuuaauuaaaaugauaccauauauaugguguuuuuaaacuuucaaauauuuagucuggccuacauucaagccuagcuucucagacugggugcuacaaacagguuacaaccaugccucggccugcaaaguguucagagaagcuuccaggccagugaguucuggcuucaagcaucuuguccaguuaaccugguaugccccacaacuuuaaauuguuauuuuacugugaaauguaaaagguugggaagcauuguauuaaagacagcuaggauuuuuaaaguuuaauuuuaugcuagccaucagcaagaacaggaggaaacauaguaauuuuuguuacaauuuugugcccacuaagcacaggaaaaaagauuuaaaaaucuaccauuucuucauauacacacugaaucaagacccucugucaaguaaugccuguccacuucaacugggcaaaaaauguuacccuuuuuuuugguggaaauucuaugauguauuaugucuaguguuuuuuuuuuucucucuccucaaaagcaugaccuuuuagauaacaacccucugauagaaauaguaagcauuacuuagauuuuuaauauacaaucuuguuucuuaugacuucauauuugacuucaucacuacuuuuguuaguggaugcauccauuaagcauaagcaugcugcccuacucuccaucuuggaaacugagauuggcugugaauauuaaacagaugcauguaaaguuucauaaauuuagaguaccuaagcagucagugacaauaugcauuacauauugucuggcuaacaaagggaagaaggaaagugaucuagaagagaagacuaaagaaagaucauuuguaaauauuuuucuuccuccuuuacgcaguagaaagauuccuaaaaauguaugacuacuguaaauaauguaaauacuacuuacauuauguuaguguuaaaugaaccaagacagugauuuccagauguuacugauauaucuaggccauugauaugcuuuggaaagacuuacagguguuucugugcauucugcagguuuacgaaucacccuacuaaugguccuuguauuuuacagaaacucuguuaaugcauccugaguaaaauuaucauguauuguauaacagaacuguacauuuuauuaucuccugauuuaucuuuauacaagauuagauuuggggauauuauuuuuuaagcuaauauuuugguggacaaguuuuagucauucaugcucagcaaaacaacguuuuaggauggugagagaagacaaaguaauugauagaagaauguggacacuacuucaaaauaacugggaaauuaugaggcugggcacaguagcucaaacuuguaaucccagcacuuugggaggcagaggugggaggacuguuugaacucaggaguucgggaccagccugggcaacauggcaaaauaccaucucuuaaaaaaaaaaaaaaaaaaaaaaaggaagaaacaaacaaaaacuagcagggcgugguaguggugugcgccuguguacuuaggaggcugaggugggaggaucaguugagccugggagguugaggcugcagugagcugugauugugccacuguacuccagccuaggcaacagagcgagacccugucucaaaaauaagaaaauuauaaaauauuuguguuuuguuuuuuugagacaggauuucacucugucacccaggcuggagugcaguggcaccaucucugcauauuacaaccuccccacacaccucgggcucaaguaacucucccgcuucagccuccagaguagcuggcaccacaagcgcauaccaccacgcacagcuaaucuuuuguauuauugguagagacaggguuucaccauguugcccaggcuggucuugaacuccugagcucaagcgaucugccugccucagccucucaaauuguugggauuacaggcaugagccacugugccuagccuguguuuuguuacuuaaaauaaauuauugcauauugaaaaguauuuuuaaugcagucauugagccaacagaaauguuuuaugggguuccacucuugaacuuuguucuuuucuuuaaaauacaguguuuuuuagaagagcccacaucaugacaauuuacaaauaagccauuaaacucuucauguuuuaagaaaagaugaguucauuuauucaauucuuaugguauguuaaguuugcauuuagcaucucauuucucaaaacugucacauuggauuguuacuguuauuuacuuuuguuuuauagaugaaauugaagcacguagaaauuaauaauaugcccaaggucacacagugaauaagggauaaagcucaaauuuuaauaugaacccucugacuugaacccauagucuuauccauuuugcucucuacugccucccaggcaguaugcuaccaguccccauggccaugacccuuaccccaucucucucagucaucccuuaggcuuaucuuauuucuuacuauaucauuguaauuuuuuuaaaagcuaauuuauaaaacaaguaggguaaccagcugucuugguuugcccaggacugcccaguuguagcacuacacguccugcauucuuugaaaccccucaguucugggcaaacugggaguuggucacccucagccuauuccuuacccaaaccuauccuugcaucucauuucauucuucuucucacaaccaugaucugaggcucagagaugagauacgagguuacagaauuagaugcaagucagaauuuuacacacacguacacacacacggagcuagguauuaaaaagcaguguuuauacauuuugguuuuucuguauccagccacuucaaaaauagcuuugucaaaacguggagaaauagugcauccugucugucauguuuccaugaagacuuucccaugcauacaaagcaugugaggaguauuggcacauuacacaccaaacuagaugggaauggaaugguguaaaaaguacauucacauuuuguucaauauuuuguauuauuuggaacuuuuauaagaauuguuaauguauuauauuaguaaaagaguauucacuaaagaucuucagcauuuuauauauuuauaaagcauauuuuuaaaaauuaauaaaagggcauauacauuuuuauucaguaaaacaacagaagcuuuaguauauacuuaacguuucucauuauggcaaagugggagggaggaagaagagagguuguuugaaagagguggaaaaaagagagaaaccagaggcugagaagagacagaccaaggcagaaagagaaaauaggacaguugaagacucuugauguuucugauugguuucaauauacaagacuuauugucauuugugcagauuggguuugguuucuagguucuggcugguagagaaacaggaauauacaagauaacugaguuuggauaaaauaaaaaauuuuaauuugguggggcaugguggcucaugccuguaaucccagaacuuugagaggcugagguggguggauugcuugaacccagcaggucaagaccaacuugggcagcaaagugagaccuugucacuauaaaaaaauuaagaaauuagccaggcaugguggcacgugcccguguucccagccauucaggaggcugagguggcuugagcugcugaggcagagguuguggugagcugugauugcaccacugcacuccaguuuggguggcagagugagacucugucucaaaacagaaauuuuuuuuuaaagguucagcaguauauuuuauguguucauucagcuuucuguagaaaaaaauugaagccagacuuaccucugugagacaugcuauacaugaaauguauaucaagcauuugguuuaguuagauggcacauugaaguacuauaaaaaaggacuuuugucuguucugaacuuugcuucagugaacacaacuugccuaacuguauuuagugucugguuuauaagacauuugacaauauggcagagaguauaauaacauauuuuauaugacugauauguuuauguucuaaaguggagaucuguuuuaaauuugauauuaacuucagaguccagguacauucuuucaaaugucaucacauuaaggaguagaauaagaaucuacuccucaaauaaaaguuaacuaucauuuauccuguuaauauacuuuucacauuuuguauauuuuuucaguaugacagaagaaauaccuuuagguugugucuacaugacuaggcaaaguuuuaugggcccugaauacauaaggcuguaugaucauaacucagaacucaucuguaucuuuguuugaugauaaucauaaucuuagguucaaauuagcucgaggggaacuggcugguuacauuguuauuucuaauuguguuggcuuugcacaaauuccuccucucuuacauuucauaauuuuccgcuugaggcacaugauccuguuacuugguuaaaucuuuaagauuuucuuugguguuuugaauuaauggguucaaagaggguccaacuuuauaacauuuaugcuauauauuuuuauuaacuguugaauguuugacuuugauauucuuuuucuuuuuauauuuaaaaggguugguauuucuuuauuacaaagaacugcaaaagaggauaucgccuuaccuuacaaaauaagauuuagguuugauuuacaagcaccaccaaaaaacauuucuguaagugaauauuuuauaauagcaauagauucccaggagaaauuguugaaaccaucuguauauaucuagaagaagaugcucaucucuuugggauuguuuagaucacauuuucuuuuuuaaaaaaagaggauugauguuugcuuugaaaaguugauuaggcuuuaauuucagaacuuacaaaauaauggcucuuaaagcuauaucacuuauucccaucgguuuaaaaauagauaauuuuaucaucgugaaguauuugauaaaacauguuucuuuuuacacgugaagcaacagaguuuguaaguacugagcguucuauuagcuacaacuauguccuguuuccaaaauaccuuacucagcauucaguaguuuuuuaaaaugguauuuucauguuguugaagacuauagaacaaauuaugucauuuuucuuaauacacaguuggagaaucuaaugcuggacaaagauggccacauaaaaauuacagauuuuggacuuugcaaagaagggaucacagaugcagccaccaugaagacauucuguggcacuccagaauaucuggcaccagagguaggcuucgguuccauuaauaggaaaguaacauugacauaaugauuugcaaaguaaaccauuuaagcauuaaaaguuaacuguaguaucuacuacuuuuaucuauauuucaaccugaaucaaaauuuuuuggcucuuaauuuguuauaaugggguauuguaggaucaagaauauacugaaauuaaauuuuauaaacuauaagcacaaagguacuagcuauagucaguuaaaucaauuuuuauuucuuggccauauccauuuuaucuuggcuauacccauuuugauucauuuauuaaaauagaauaauugauuucagcaagaguauuuauauuuauaaaccaucuuggacuuuccuuagaaacaacagugguuuuuaauuuauaguauuguggguuuauuuaaaauuauuuuauugggaaaauuauugaaaugacaguagcuacauuuuggaauuuaugucagaggaagcuccaaacugguaacuucccugugcuaaggguuccacaauaauuuauuaauuuguuuauucaacaaauauuuauuguguaucugcuguauaucagguacuuuucuggaugaugugguuacaggcacaacacagaaaaggauccuagucucagggaacuuaacuuucaguggagggagacagaauaaaaauaaauaaauaacauaaugucuuaaguuucauaaacaaacaaacaaaaaagcaagauuaaauguaagggugugguguggcuguuguagaugguguuccaguuacuaaugcuguguaacaaaccacccuaauacuuagcaguggaaaacaaccauuuuauauaaaauaauggauuuucugaaucaggaaugcaaaugggcacagcaaggauagcuaguuuauucuccacuauguaugaggucucagcuugaaagacuuuacagugagagcaugauucuauggcuggagacuagagucaucaggaagcaucuucacucacauguccgacaguucugcugccuguccacugguaccuuauuugggcuguuggcaggaacacuuacauguagcccuucucuccaugagucuggacuuccucauaaugacaguuucaaugcagucagacuucuuuggcucugagcccuaaaagcaaauguccuagggaacacauuagaagcugcauggugccuuuguuuccaccuaguaaaccaucaagacuauuaacuuuuuaaaaacuugauuucacagauauuuuuauaauuggaguacaauucauaugccauaaaacuuacucuuuuaaaauacacacuuuggugauuuuuaauauguucacagaguuguacaacuaucaucgcuguccaauuccagaauauuuucaucacuccagcaagaaaccccauacccguuagcuccucauucuuccuuccgccacaggcaaccacugaucugcuuuuugucuuuauagauuuaccuauuguagacaguucauacaaauggaaucauacaguauggagucuucugugacuggcuucuuucacuuagcauaaaauucaguguuccucccuguuuuagcauguuauacuuauuucauuccuuuuuauggcuggauaauauuccauuauauggauauaccacauuuuguuuauuuguucagcagcugauguacauuggguugcauccauuuuuuggcuacuaugaauaaugcugcugcuaugaacauuuguuuaugcaucuccuuuuauggccuauuuucagaagucacacaacaucauuucugucauacccuuacucccugaagcaguuguaagccugcacagguuaaagugguagagacagagaccacaccuuuacauuacagaagagcaugugagaugggagauacugccacagccaucuuugaaaaauaacaucuuucacagauacuauguucagcgaaagugaugguugauggaaagugaugguaccuguugcaaagguaaaagggaagagcuuuccaaagagagcagcuggugcuccauuuccccucaaacuccaauacaguuauuguggcuauaggcaaauagggagguguuaauauuugaugugugaggguaacuauuuaaugagcaucuacuaugugccaccugcuguguaagugcauuacagcuauuauuucauuuaacauuuggaauaaucuuugaugauagauagcaaaugcaauuuuuuaaaggugagggaucauaagaucagaauauuuaaauguuaucuguacacagcuaagaggugguagaaguguaaugaagauucuaauuagugugucugacuauaaagcccacuuuuacuuuuuaaacuacauacguccuggccucaaaaaauccuaauuugaagaccacuuacaaauauaaauaaucguaauuuuuaaaugaaugcuuuguaaaugcccaacaggaaaagguaaucaaaagaaauuaggaaguaaaauaaauccccaaugauacuagcauuccuuaaacauaaaguaacucaugcuggucuauuauucuaauacuucuuuucaacuagggauuacauuuacauuucaacaauguuaaguuauuguaaauaagugcuacuauuuaaaauacaauaaauuucauacuauuauuuucuugccaaaaauauaauuuucucucuuuaaaaauuuguaguuuagaauucucuauuuuugugguuuaauuagguaaaacuuuaguaacacuguuucuuguuuauucaaauaaaauauuuucuagaauagaauuguuuuuauaaaugucacaaaaaauuauuuguuucucuggaguucaguuaccccugcuauaaauuugcuauggaagaagauaugccauauuuagaauaacaaaauuaauugugucacaauuaggguaaauuauuucugaagaagaugaauacaucucauuuaagaagcagaugaucugagaaacaaauauauuauuucauaugcagugucaucaacugaagaacaaauuaagaaucuaaugcaagaagaguccacuuguuucugaauggaaaguuuauaguugccacaaaauuaucaguuucucuuuaaagacaagaaaacauuucuguauaccuuuuuuaauacuucaaaagucuggucuuuaaaaacaguuuguauacccauccuugguggauacacauugauucauaauucaaaucuggacaccauguuuuuauagggaagagugauuauuguuguuauuauuugaguaugagaaaucuugaaacaacuuacgaaauuguaacuuuuauauuuuaaauguugugucacauauugcauuuuuaaacuuugacuguguuuacccuuaaaaaaauaagaauuuaauuccuuuauucuggucuucagcguggaccauuuuacugagggacacucauucauucaucaaagaauuauuuauugaauauuaaguaucaggcauuacauuagguacugggaauacaacgaugguagaagauguuuuugcccucaaguggcuugcuguucacugaggugauaagacauggaaaacaguuauuacugugcaagaaaauaacugcuuuacuaguuccauacaguggaguggaaggaaaaggaaaagugcuuaagccugcagggaggguccggcaguggaaaaggggaagcaggaagagaggaggcuggacacauagauagggauugaaauguaacaguuuuagauuugauccugugggcuagggaaaauuacuugugaauugagagcaaggcgauacugugaucagauuuacauggucaguguuagggagcgauuggcaggagcugaagccagccucuuccuuuuaccucagauggugucucgcacuuuuuuuggaccuugaaauuucuaguacauuaccauuauuaaugcugggcuuuucgugacaguacuagaaguaguaguuguguaucagaucuguaauacauucuugacuacugcuucucuugugaaugacucacugucaacauuuuccccucugucuuuacagaagauuuguuuacacauuauguaggaaucuugcugcaaccuauacuucaucuagcaauaguguuccuucgccuuuuacguuguuuuaaucugguauaaagacaggugaaggguauuuugaagauacuucacaaagaguguuagaaaucaguuuaaagccaguuuauuaaauguccaaugucagauacauggcagguuuuaaaauaaacuugaguuuuaagugaacuuaauuuguuucuuauggcaaauuagaaaaacauaaaacuuacaguauaaauaugccauuuguugaaaaaagaauauuuuuaagguauuuguucucuuaucucuuuugaugaagaaugcagcuuacaaugcaguuuuccaacuugggaagcauuuaacaauacugcuaauguagaaaaggcuagcuuuguuuuguuuuguguuuuuaacagguuacagcgguucaguucuagcuggcauaugcacugugcauuuagugugcuacaucuugaaaacugcauuuguauguauaguuuuaaaugaauguacuuuugcucuuuuguacauucgaaggaaauaaacuuauaguaaauuauggaccauaugauaucuugaggggauuuuguuuuuauaaucugugcuguauuuucacaccuagaaauuauaaaagaaauuagaaaucacauauaaacucuuacugcuaaauuuuauuauuugauuuggcuccuauugaauccaaaccauuuuaugcagugcuaauuauuuagagucucagcuuugcucuugaguuagcaguaccugauccacuuuccaacuguaaaacaguuugaaaaucaaauguagcuuacaugcaagacccaacaaaauuaaaaguguuaagugcguuuuggcaguucacuuuuauuaugcccaguccucaaauguaccagcagauaaucaucugaauguuaguuauuuuucacaugcuuaugugaucacacaaaaaguacaugcuaaaaagaggcagauggugacagauggggaagguugaauaaggugguuuuggaaaccuagagaaaugcacuucuguaauaguguaaaaauaaaaauuauuugauaaucaaguuagaacuaacaaagauugcaaaaaaugacuugauuguugggaaauauaucuagcugugguugcuauugagaaaaaaaugcaucuaauuuuauuucaucuaaauguaaaaugauuuguuuuuccaguggcugaagugcaguauuugaugcauucuuuuuaguuuuuuagaaccccauucuuagaaaauguuuugcuugccaaaauuuuccugauuuuuucuuugaaaccuacuaucuuuaauaucuugcauauaauguaacauuuuuaaaauagcugaaauagaugagaauauuuugacaacuauuuugauacaaagauuugcucaaagucauuguguuagcucauaguacacauggagauuaauuucuauauaaauuaaaaaccaaagauauauauuaacuuccacaaaagguaguaaaggcagugccagggcauggacuaguguuguaggugugggaaauaguuagaagcuaacuugcuugaaauguauuaaacagaauuuucuuuauuuuaaauccaacaaagaauaaauguaaaauaugucauuuugugggugcugccaauguuguuuuuaggagaucugaagagaaaugaaugaggcuaaaguuacauauguuugcacauuuaaucuguagguaaaaauaguagcacauguaguuacauucugauuagucuuugcacaaaguccuacuauauuccagcagauuguaaaacuagucuuagaaucucuaugcuuuuugugaaaagaaagaguuguuuuaguagccuuucuaaaauuguggacaacccuaacauuuuauuuacuuauugauaauucauaugauaucucuccaccugggguaauuuugaaaaccuucaucuuccugggaauucagaaaaggucucaucaccaugauuaaagggaacauuaaaggaguagagggaugaguucagauagaagcugucugcucuauaguuagaauucauguuuaagaacuucuaacucucauaugaguuggcuuacuauuuaguugaauauauuuaauuucuuucuauaguauguugcuauuuuauaugauuuucuggguaauauuaaaagccauuccauuuuaucucauaauuggacauuguuuaaauaugaacuaaaauggaauuaacgccucucaauguuuauaaguggcaucuuuuacuuacuuagaggucugucaguucuuaaaguagcuauuuuucgcccuaacuucuuuucaauguuauauggucuuuuggcuuuaacagaauauuugcauucaguacuucggugugauucuaguuuaagcaugaaguuuaauuuuaaauucucuguaccaugagaacauauacaaaacuaacccuaacuggaaacacuggugauuaccuauaguauuuuacaauggcuauuguuacuuggguuaugaaggcucaguuucuuggaaucccauaaugucuauugcuucagaauaaaaaagaaguauagaaauuucuuggaagauauguguaaguaugaucuaaucaucauuauuguauccauuuagccuuucucuugucaaaggauuuuuccugugcuagccagaguuugcuuuugaaaguacgauguuaacuguauacaaguauuugugugugcuaggagagguggccauaaagcguacagcauucuaauucauagcaaauggcauugacaguugcugucacuuaagaacuauuaaagcaguugagaaauaguuauaaaauauauauuuaugaagaaaauaccaagcaacuguagaauuuauaaucuuauguauugaaauggauacuuuuccugaagcugcaguuuacuuuaaaaucugaaugagaagauuuauaggucuuuuuuucuuagcccauaccugugauguuaagaauaucugaagggcucccauaaaugauaaaugauacagauguauguuuagguauaaaacacacaucuaucaguuaccugaaauguaaggcuaccagaaaaaacuuuuuuuuugaauuagugguaaauugguucauccaaguucgcaguuuacuuucacagcauaggugugcagacaguuuguuuagauguuuaauuuuuucccccaucuguucugucaggauuauugauugagcaguaagccacuccagggcauacauagccuccuuauaauugcuugccuugggugcauuguguggccuggugggcaagcugagagaggggucccuuuaaccuccuaguaaauccuccugguaaacaaauauuguaaugaauaguuuuuuuuuuguuuugaaaaagcccauuagccaaauaaauauuuacauuaguaacuugaauugguaguaucauuuaaaaauauauaguuucucauucaauaucauucuuugaaauuaauaacaauucaaaaacuaauguguuuuaacucaccuggcuguuuuauaaauguaagugucuucaucaaauauugaucaaauauuuccaggauauuuaauguuaauuuguaucugcuguaaccuccuugagucuuagguuuuaucguaucauaaaguaaagcaguuucuggcuccuauuagaaauacagccuuguuuucuagacuuugugcucuguuuaaguuuucauuugaugugaccucucaucauuuuuuaacaauuacauuuuuuugauguuccaaaucuccucuuucaucucuguuugggcauuuguguuaaagguagguauaauguacaacuacaucugugguuacaaaggacuguagggguagaggaaauaccaaaugucugcuuuccuauuuaaaguuuggguuucauuuacaagucaguaauguugguuuuauggaaaggagacagaaguuauuucuucaagauaaaucuuucacuggauuuuuucaggagcauauuuugaucugcauuuauauccaaauuauaugagaaauuaaccuuuuaaugaaguugaaauaugcucuaccauuguuguaccuguccauuauaccacuguuuaucauaccuuucagccagcccucacaauaaccaugaaauaaauuagccuuuuagcuagaaaaaaaugaucagagguagccagaaagaauuugcaauccuuaaguuaaaaaaauguaaauuuuauauguuauguauuuauagaauaauaagugcuuugaguagagggagaaaaauugucuucuuaaaauaaugugaaagagguuauuggauucgaauugguuaauuuggcugugggauuuccagaguauuugaaaguauuguguuuugaaauaauuuagauucaggaaagagaaaggauauuguuuuaauagugggaacauauguauccacauguaggauacuguaaucauuauuuauguauguuucaucuuauagcuguuuggagauaggauuuggacaaaaaucuuucuaauugauagugaagucucuuagguaaagagggauuuuaguuguuaggguguuuucuucucagcauugcuuaaguuuacaugucaggaagacaauacguuacaucaguuuuguucaauacaaaguaauacggcaaacaguucuaauuauagcauuauguaucuguagaucaauuaaggcacguauguucagaggcaaaaucacuuauuuuaagaaucgauauucauuuuacaaagcuaaauaaaauguauuuuauuuuaucaaacagauuuuuuuacaaugcaguuuuauuuuucaguugcuuacuucucuucaaaaauaaaaccccccuuuuuuauguacucacuuucccuucuggcugcaaaccagguauuuaaaaaaaauaaaggauugccaguuuugccagcuggggaugagaacccggcuggugaaauguggguucgggaggcaguuaauccagcuuuuaugcuuuuuaugguuuuaugaaaaaaaaaagagguuaaaaaccacauuuggcuccuuuucguauaugccacuguuguguugguguuguaggaauguaguuaaagguuacuuagauauaaauuuuugguuguuauuaguuaaaaucuugugucaauuagauaaaggcccaccaacagugcauuguacuaauuggccaugagcgagauccuugaaucaucaaaagucagugguauuuuaaaauaauacaugcagcauuuccuuuaacguaaauaugaaguagaauuucuucugcuuuuuuagguuauuuuuuguuuucuauuuguucucaaauuacucauuucaaacaaguaaaaauaugacauucuuugcgcugaugaugaaaacuagaauuuguuguucuuccagaaaauguuuuuuuguuaguuugugauuuacaaaacauuucuagaaaagcauaggaucuaaacauguguucauaucuuaccagugaaguuuucaguuuuuuagccguaaaacaaacauugauauaauugaauuaaaaaucuuuucauaauagaaaugcuuauugaauagaucuuuuaaguaacauauuuuuucuuauaaauuauauccuuugucuuuaaauacccuaccaaagugccuuucauaguauuuuuagguaaucauaauguaacugucaaaaauaucaccuguaauucugugagauuauugguaaauuuuaaauaaaagucauguaggaguaaucuuccagaaaauauuuaauucgaagcaagaaaguuuggaacacaaguacugcuuuguccuuaucaaauguucuccuuuguaaucgguuguaaguguuuuuaaauugauaaauucauauauuugguuuuccccaucugguuuuccaaagcugagaggaucaaauaaaauaagcuuuaagauuaucaaauauaguuuuaaaauaaaauauucaaaguugcauauagaugaggaauauuccauuggaugaagaacaaaucugauaaaaagauaaaaccaaauuuuuccuggggcaaaugguagguuaccauguuaccauuugaacagguugcuccagcauaggcaaacggauacuuuuguaucauuucuaacuaaauuuauuuuacguguaauauauuuugggaaaaauuuaaggacauauaccacacagauauuaaguccauuuuuuuugcuguaacaggaauuuuuguugugagguauaaagcuguggcuaucaaaguuuauuacagcucguaccauaagcuuuuauauucacuuugucucuuaaauaguuccagaaagaguugaaacauacaggggcauccaaagguuuuucaaaguuauuuuaaugguugucuugcccuguagacuucuccauuacauugccuuuguuuacuacugucuuucacuguuuaauuuguauuacuuaguucuucuuaaggcaagaauguacagugcacuuuaugugcucuauaaucagcacacccuagcucugaguuguuacuugaaguccacauggguggaaccagaaugaaaaagucaguaggccuaagaaaaaauauguaaauaugcuagcuaacguuuuucauuugauccuuauguauauucauguacuugggauuuuuuuuuuuuuguacgaccugccccuuuuuuuguacacuggccauuuguggauauauauugaauauuucacauauuugaugugauuuguauuuuuuguaggaugcuucacaguuuaaaugucaagaucucagacuaccuaggcuuugaaaguuaagauucauuuuuauguaaaaaucuuauguuuuaugaauaaugcuuuaaaaguuaacauguaauaauuaaucuuuuuacugauuucacuuuuagguguuagaagauaaugacuauggccgagcaguagacugguggggccuagggguugucauguaugaaaugaugugugggagguuaccuuucuacaaccaggaccaugagaaacuuuuugaauuaauauuaauggaagacauuaaauuuccucgaacacucucuucagaugcaaaaucauugcuuucagggcucuugauaaaggauccaaauaaacgguaagccucaaauaacgcuuagugaauuacugaugaaugugguuaaaaauugagauauggaaauuaauucaaauauaacuaacuccaagaagcaauguauuugguguagacaucuucccacugagauccugacuuauuuuuaacugcauaauauagaacauuuaaaaauuuuucucaacucuuuccuaacuuggaaauuuuaugcagauuuaccaaauaaggauuuugagaguuucauuauccauauuaugagugaaaauuucuuaauugcucuguuacuugaucuuguggggauagaagaaucacuuuucuuucuuucagucucugggccuuuguauuucuuauaaaaggaauagaccuauuuuucaauacucuccucccacccgcaaccuguguuaacauaucuaauugcauuuuuuuuuuuuuuuuuuuuuuuuuuugagacagagucucacucugccacccaggcuggagugcaguggcgcgaucuugacucacugcaaccucugcuucccagguucaggugauuuuccugccucagccucccgaguggcugggacuacaggcaccuccaccacgccugucuaauuuuuguguuuuuaguagagacgggguuuugccaaguuggccaggcuagucuugaacucccgaccucaagugauccgccugcuucggccucccaaagugcugggauuacagucgugagccaccgcacccggccucuaacugcuuuuuugucauuugaaaauaaucuuuucuaugcauagcugaaagaguugauggcaaaaaauaauuguacacacuuuuaauuucuguuuuuguagcuacagcuaugaauugaagaacucuauggcucuugcugcuuuguucaaugagcuacaguauuuuuauucauguuuauacauucauucauauuuauaaauucauaaaucauaugugaaaugacuauuaauauuaaaauguuucuuaauauguguguuuguauauggauauaucugccuucccaucuagguaucugugcauaucaguauuucucugagucuacucauuugaagcauagaugauuucacauauuguugaauauuuuauaauaccucacauagaguuuuaugaaaauguuuuacguaugguugaugcucauauauauauauauuauauauauaugaguggguuaaugagugaaucccaaaaaguuggauuuuuaagucuaucugagaaaugguuuucauuguauucuucuagcuuuuaaccuuguaaggaacauggcuuuaucuucagcagaaauaagcaaacauaauaaaagagauauugucuuucugcuuugugaagacucauucaagaaacauuuuguaauccuagcugcagauauuauuuauauguguaaagugauuuuguuuucuucuucagagcacuuucacagcuauuaauucccuugcuuuuucaggagccuuguuggguggauaggggagauacuauucuuauuuccauuucauugaguugaaaacaaaggcccagagaggguuaggugauuucuucaaggucucucagaacauucaugcagaccaagaguagaagucaaguuucuuggugccuauuugguauuucuuauguaucuuauuuacaaugcagcaguuucucaguuuaaguuuugaaauguguuccguuugauagcguucuuuuacaauuaaguaaggagcagcacccgaugauagguaacuuuaaacagaguggugacuuuuaucuuuuuuuuuuuuuuuuuuuuuuuuuuuugagagggagucucgcucuguugucugggcuggagugcaguggcgcaaucucggcccacugcaaccuccgccuccuggguucaagcaauuccccugccucagccuccugaguagcugggacuacaggcgccugccaccacaccuggcuuuuuuuuuuuuuuuuuuuuuuugguauuuuaguagagaugggguuucaccauguuggccaggauggucuccaucuccugaccucgugauccaccccccucggcuuuccaaagugcugggauuacaggcaugagccaccguguccagccgacuuuuaucuauuucauuuuuuggucuaauauuuggcuugguauucgaggcagugaauauuuaucucaucguuuucuuauuccugcaggcaacuuugaccacccuuuacuuuguggcccucuuuauauaaguggcuaguagaacaaaauguacuugugguuuucauguguaugucucauucauuuuuuuuuauuugucagcccacuccaugaauagcacauagucgguacuuaggaacuauugaaugaaugugaggcaaauucuuagaauguuaaccgccuaguauguauuaauagaacaauuccuaacuguuuguucaccaggagguugauauugaucuaaugagaagaugcaguauuuucaaugaucuaauaauuucuuuuauaauagaugugucaagccccuccacugcugcaucaaaauacagagaauacaaggaugagugagaugaaccagucucugcucuagauguucauagaauaauuuggggcacaaaacauauacucacagaugcucaggucaaacuacauacaaaguacuguugaaauuauuggcuuugucuaggggauugggggacuugagcuggaucagaaaggaguuugaauuugcauuggcacucaagcacagaaauuuacauguagaguauagcuaggauugcaaaagaacauggcauuugagaaguucagugacuagaguguagaauaugaguuggguaacacugggaaaugaagcugauauauuagauuauaaggaucuuagguuucuuagaaaauauuuaaucuucauucagaagagggugagauacugcuuaaguguuuaaagcaagggauaguauaaucagauuugugucaugaaaagguaacucuggcagcuuugucauggacagauuagaugagugaggauccaggggcaggcagagcaguuaaaaguguuuauggggccaggcacaguggcucacaccuguaauccccgcacuuugggaggccgaggcaagaaggucacuugaggucgggaguucaagaccaaccugggcacauagcaagauucaucucuacuaaaaaaaaauaaaaugcuggguaugguggcacaugcuguagucccagcuacuugggaggcugaggugggagaaucgcuggagcccaggaggucgagacugcagugacccaaggugacaccauugcacuccagccugggcaauagagugagucccugucuuuuuuuuaaaaagaauauuuauggaauuguucagauaauagauggauuccuuccugaagcaguaguacacaagugauagagguuaugauuaacuagaaacuaugaggaaguaggaggaguuaggaaucccucugagguuuccagcuagggugauuaacagacaggguaugcaaaccaaggaggcuugauggggcuagauguugauaauaacuuuggguacacugagucugaaguuucuauauaaaaccaagauggaaaugucaagugagcagcuggaaauaauagaaugaaugcuuaaaagaaacacaguaacugacuacauggauugggaaccauaacuauaucuaggagguagcuagagccaaggcaguaguggcaaggguaguggauaaggagaagagggccuaggacagaaucuuagggaaccucaguuucagggggagaaagaaaagaaagcuaacaaggaccuugaaaagccuuuggaaacauaaguaaugauagcauuauaauacaccucuucauuuuuucuacgcagcuauuuuaaauacuacuggaauuuuucugguauuucuuauugaauugcuguuaguucuauccaagggucaacuaucauuuugcuuuuauuucuuagucuccauccuuucuguucauucuguuagccccuccuuuaucuuccuaugcggaguugauaggaaaagcaugaccucauguauucaguaacauuaggaaaaugugaauucugugauguuccuaauaguaaaggaauuuguaguagcugaggauuuagucuggcauucugauacuggaguuuaguauucuagacauaaauaucuuacuucaaagcauauuuuguuauuauuuuugaagucuuaaauuguauauuagagagucauugacacugaaauuuuugacaguuucacacauugaagaaguguguuaaagaauuucuccuagcuucuaaaauggaagucugauuguauucucagacuuugcauaguauucauagcugauauuuuaguuuuauauguauuugauaaauauagaauaaaugcuggcuauguucaaaaccaaaguauugcuagaaaacuugaggaguuacaaaaauggauaacuaaagcuggauuaaaacauuuuauuuacaaaaugauuaugauucuccacuccaacucccaucucaaguacaauucaaaugaaaacaguauugaaauaaacuacaacauaaguguaagaaaaugccauggagcuuugauguuucucaugcagacuauguugacgcaugcuugaaaauauuaaaugcuuuucagaaacguguuuuggugcuuuugcuucucugguuccccaagcacaagcuuagaaugccuuuuggauaauccagcacugaucuugccuucaaaggaguuugcagucuccugggaaagaaaccuacacaacugaaauagaaugaaaaagagggcagggucugaaaugcugagcucucacugaacacagaacuaccagucugaaaauuccaaaugcaaacaucgaacagcacuauuaugaucaaaccuaaaagugccaucucugggguauaguucauuuagagaauucuauaaggaucugggaguuggagacccagcuggugggaauuauuuaucaucacuaaagauauucagguaucaguugacuguuuuccauuuuaauugugugucaaaggauacuagguccuucccagucauguguuucuuagaucuaauaaccagaauucauuagaauuauauaauuauaaaugauuucugaccuacgauggcuugacaauuuuuugacuuuaugauggugcgaaacugaugcguauuuaguaugcuccucaacuaaugauggaauugcauccagauaaaaccaucuuaaguugaaaugugggcuuaucuagacauaacccaucauuaaguuuaggagcaucuguauuuguuuucuaugacguauuugguuuucuuccaacccagugguguuuuggaguuagcauauaccagcucucaagaaccaacuguuaaauuuucaccaauuuuaugagcugguuguauauuauagucauuacuaaaaauuauauaaauuuacuaauaauaggaaaaucaaaggucauaaauacuaaaaagucauuacuccuuaauuuguuauguuucacuguuaucuguauuuuugagauuaguuaugucugcuguaucuguuuggacauaauauauaaugguuugcuacuaugcaucucuuccugccuacauguucagugacaucuuauugguagcucgaaacuggccacaguggaagaauuuauaccgccagaauuggcaaauacuaugaguuggggcugcacuuacuguuuuguugacuguuuagacuuaagagaaaauauuaauaaugcagauucauuacauuguaaauagcaccaaaaaaugaaucuucuuccaccaucccaaaguuacuaaacauuuagcaaagaaaucacucacauaacugacaagugaaguucugaagucuccauuguaucacuuucagcuuugacuuuaacauaaacaaaaaugucaaccaauauucauguuggaacuaaucguaaguuucauccauuaguggcuuuggcguacagcagaaauuaacaaguuuucugugagaaucaggugacuaauuuacaauacacaacauuguauguuuuaugaucuuuguaaauuuuguguuuugcauucuuuauaucaguaaaauuuaaauuuauaugucugggguguggugguggcuaggucaggcaagguuuggucccagcagcuccauggcugcucugcucugagcaucugguaucuacugugccuuugaaaaaaaaaagaaaaaaaauuauauuuguauaaaugcaugauugcucacagagagcugguuguuaagcacuuaccagcacauaucauuucuaauaaugaacaaguccaaauaaagccuacuauauaaaauucagauuuaaauagguuuauuuuaucuuccuuuccuuguucuuuuccccucuuuuccuccuguucuuccuauuucucacuuuuaguucuuuuaugcuuaguaauauauacuauauuaaacugaauaagccagaaaacacugaaauuucuuuaccuauuauuaguccauuuucauucugcuaugaagaaauaccugagaccgcauaauuuauaaagaaaaagggguuuauuggacuuacaguuccacauggcuggggaggccucacaaucauggcagaaggugaaggaggagcagaggcacaucuuacagggcagcaggcaagggcaugugcaggggaaucgcccuuuauaaaaccaucagaucucaugagacuuauugacuaucaugagaacagcaugggaaaaaccugcccccaugauucaguuaccucccaccugguaccucccaugacacauggggauuaugggagcuacaguucaagaugagauuuggguggagacacagccaaaccauauuccuauguuguuucuaacccuugcagugacccaccagcaaacguuaucauuccccacucugcagaugagaaaacugagguuaagccucuuuucuguugucacacaucucauaagugccagacaugauugccucuuccagaucuaucucuaaagccucugcucuuuuccaaauaccauacuguucugaagcuaguucuuacaagcauauuaggaaaaauagaucuuauagcaaaagcuuuuuacuuuuagagcuauuuaucccaagaacuguuuauuacacagaaaauuacacuuucacaaaauauuuuuuguuaugcuuugagcuuauguaaauguuuuauacuuacuuaauuuuauuucuguucucauagccuugguggaggaccagaugaugcaaaagaaauuaugagacacaguuucuucucuggaguaaacuggcaagauguauaugauaaaaagguaagauuucuuuauggcauaguguguauauauuuuggcugcacugcuaaaaugaauuuauagcaaaaauauuuuaagugaauaaaaguuaaugauguaaugauacuuuccauuuuaccgacauuuaagugauuauugaacuucugugcacaaaauuuuacucaugauuuugacuccccaaaugccucuugagauuuugcucaacaugaucacagaauuuuucuauuuuuuucccauaauaauuuguuugccucucauuauuucuuuaauuuuaauaaagauaccaaguguuaauuuuucuuuaagaaaacuaguuaaaauuuuuuaauuugcccuuaugucuuuaauuuuaaagugaacacuucagauucauuuauacaaauccuuguuuuaaaagaaauuuaaagaaauuuguuuuuaauauuuaaugaagguaguaaacacagugucuuacuuuggacuucucugucauuugaaacagaacuuuauugcccacaaaauuaauacuacuaggccaggcaugguggcucaugccuguaaucccagcacuuugggaggcugaggugggaggaucacuugaggccaggaguuuugagaccagcaugggcaacacagugagaccccaucucuacaagaaaaaaaaaaaaucaacugggcgugguggcgcacuccuaagaaggcugcuaaggcaggcaggagaauugcuugagcacaggagguugaggcugcagugagcugugauuacaccacuguacuccagccuggaugacagagugagacccaaucucuuaaaaaaaaaaaaaacaaaaaacaaaaaaccacuacuaauuacauauguuuaguuuuauugugaucugcuuauuacuuuuuauucauuuauuuauuuauuuuuugaggcaaggucucuguuggccaggcuggagugcaguggcacggcacgaucacagcucagcagccucuaccuccccaggcucaaguauccucucaccucagccuaccaaguagcucggacugcaggcaugagccaccauaccugccuacguuuuugguacuuuuuguagguuuugccauguuucccaguaugguacugaauuccugggcucaaacaauccucucuccuuggccucccaaagugcuggauuacagacgugaaccacugcacccacccuucuuguucuuaguacugcaauuuuugcuuaaguucaggagcaggaaauuauuaugucugucccccccucccccugcuuuuuuuuuuuuuuuuuuucccccacuaccucagauauuguuaguacagacagggauuuugauacuuugauuuucagaugcuuguauaaaauguuuacuaugaaauguuuuucauucaauaaucuacuccgaauuuuucuguaauuauuuuuaguucauccauuucaguuuauuccaacauuucauauuuuucucugaaacauuuauuagucaacaacauuuauuuggggucuguuaugugccaaguguucuucucuguuaagccuuaagguaaacauagaauuaugucauaugaauuagaugaguuaggaggaaguaacacaagcacuucaugucuguauuauguuauugguuacugggaguauggugauuuucuguuucuuguaacuaggaauuuaaaauaggugcaucauauuagacaccucuacucgauucaacucacauaucuugaguuucuacuauguauaaaguaccauguuaaguacugaauccuucacaaccuuuaugagaagcacuugagcauuccuaaauguuuauucacuucuuacagacaauuuuauauccacuuaguaucacugaggauguuccuuaugaguugcaugcauauauaggaaugccucuaaugagcuguguacuguuuucaucgugucaguacacuacaaaagaaccuggaaggaagaagggcuugcugucucucccagaaaucaugcaugguuuuauuuuuaauaaauagcuaauaauaagcuacaacuaaauaucauccuuucuagacacccucuucuaggaggacuuacuccaaaaaaaaagaagaggaaaagaaccauuucuuuaagagacaaugguugagguaccaauguggcccuguaaauucaaggaagggccaaaauauggaccuucuuaguccugugaggaaauaagauuugcuacaacguuuccuuaucucaguguucagcuauucauguugaauaagaguuuggccccaccuggagaaagcucugagagcccaaccaguauaccaguaaggaagcaaggccuguccuaucucagcuccacuggguuagacaugcccaguguaaaggugauaguaagacagccaggagcuaccaugugggaauggaauuaggggagccagcagcucuggcagggaggaggagcugccuaaacaccuucugaugacauguagauaaauucguucaaguuguuauaauuauuuuuuuuuaaugggugccacuuaauuugagcaaagguguuaaauaucuugcauaaagaagcacaacccaaaaugacuguuucuguaaacaauagauuggucguggauuggugccaucuacaggcuuacucacgguguccugugugacccgcgaggcucugguguucucugccgccccauauauacuugaaggagcaacuuuauuauagcagcacuuuuaaauuugaguuucuuucuaaaaggaaaaugugauugagucuauuuggguuuguaucauaucacagaugaacaugaaauuaauuuugagaaccagccuggggguuaguagcuguuuuaaugaauucaguuaaaauuucaguguuuuaguguaaauuacuaaauaauuuauaaaauaaaacauuuuaauggaguccuuauaucuuuaaaauguguaauuuauuguaaaagucaauucauuccuaagaucagggauuauuguuacauuuuuauuguuuugauaaauuuauucuuaauuuauuaucacauaauuauugguuauuuuucuacuuauugcugcacaucgagaggugauggcacaucuagagauucuggcaucuguugaggagaucugaaucucuuucuaggcaaaguaaaaagugaaaguaaucuuaauuacaaguagcaugauguaccacucuaaagagcacaguaucaaaacaugaaagaacaaaguuggauccugguccuggauuugcuucuugcuuucuuuguggaaauggacaggucauuuacucaugcaaaagauaugauccuuuaacuaccuucaagcuuuuaagauucucuagcaggguguuuuauagcaugaauuuaucuagauuaaugucuauauagauuucuacguaaauuuuacacucugucagucugcuaagauuuugugugagauuguguugaaucuguagauaaauuuaggaagagcugacaucuuaacaaugagucuucagauccaugaaugcaauuuauuucuccauuuauuuagguggucuuuaauuucucacaguaauguuuuguaauuuucaauguuuaagucuuacacaaauuuuguuagguuuauccuuacguguguuucaugucuuccaagggaaaugauauuuaaaauuucauuuucacuuuguuuuacugccaguauauagaaauacaguugguuuuuucauauugaccuuuucuccugcaggcuugcaagaauuaguuguaguaaccuuuuuuguagauuacuuacaauucucugcacagacaaucauaucuucuguaaauaaaguuuuacuucauuucuaaucuguaugcauuuccuuucuucuuuugccuugcuguauuggcuaagaccuucauuauaauguugaauagugguaagagugagcauccugacuuuguuucuagucuuagggagaaaagcaccuuuuaccauuaaauaugauguuaaugagcacaucuagcagccagaucuggguuucuaacuauuauucuccaauaaaaggaaccaaggcuccuugaggacgcgacugauuucagcacuaguauagggggagaaaaaaagaugagcguggagaauuuuguggugucagaaaguaaggagggagccuuaaaaaaaaaaggcaagaccuagaaaacagcccaagcugaaggguccuguagcagaagcugaaacaauuucaguaauaaaguaaauauaguguuaguuuaugauccaaaggaugaaauauguaaucaugagucuauauugcauaaauaagugauugauugucuaaauaaaguguugagagggacaugucuuccuuacagaugaauuccaauuaauguaaaagaggugaguagaguagaaaaucaaaucaccauuagaacuccagagugaaaauugcucauucagaauucaccuaugaauauuaaaauuaguaagcaaaaguuuaggaaagaggauauuuccauacucucaagauaucucccugugaacauuuaucauuuacaaagguaaaaugacuaacuuuacaguggagagaucuggaaaacacaguuuuaaccaagugaucacgguuaacaucaccaguaaguaagauguugacuucauggaacccaugauaagaugcucugagaagggcacaguacuuuugaagugcucuccuccaagaugcauaaccucaguauaaucaugaggaaaccugaagaacucacagggagggacauuccucgaaauaccuggccugauaacuuuaaaaguguuagccucaugauaggcaaagaaugaugauggaacacucauagauuggagagacuaaaguggcaugaugacuuaacugcgaugugggauccuggguuggguccuggacuaggcaggggcauugguggaaaaacuggugaaauugaaauaaaguugguaguuuaguuaauaguauugcacugauguuaauuucuuuguuuugauauucauacuauggcuauacaagauacagaggaagguggguaaagggcauaugguaacuauguguacuauauuuuuguaagucuucucuaaguccagaauuauuugaauauguuauaaaaacaugauguuauaauauagauguuuuaugccuccuuuaucagauugaggaaguucuaguccuagguuacugagaguuuuuaaaaucaugaauggguauugaauuuuauuaaagcuuuuucugcacuuacugcaaugaucauauggcuuuucucuuuuauguucuguuaaaauggugaauuaacauugauuuuccaaaguugagugaaccuugcauuccuguugaaaaaaaccacuuguucaugauguguuauuauauauugcuagcguugguacauuguauuucuaaggauauuugcauccugaaauccugagugauauuacuaugucaucuucuuuuccuaaaaugucuuuguauaauuuucacuucaggaucauguuugcuuuuuaaaaacaaaaggggaaguacuccuccuuucucuuuaauuuuauugaauuguuuguaugggauuuguauuauuuauuaaugaaauauuuggugggauuuacuagugaagcucucccuagaccuggaguuuugucuuuguugguaaguuuuucacugugaauucaauuuauuuaauaguuacagggcuguugugguuaucuguuguuacucagaugaauuuugcucuuugugucuuucaaggaauuuaucaucuaaguuaaguuucucucuaaggacuguuagucaugcuuugcacauuuugaugugcuguguuuucauuucaaaagaguuuuaauuccccuugugauuccuucuuaaggguuauuuguaaguguguugauuaauuuccaaauauauggauuuuucagauaucuuucuguuacugauuccuagcuuaauucucuuuugguuggagaacauauuuuauaugauuuuaauuguuuuacacuuuaaaagauuuguuuuauggcccagaaaauggcuuauguugcuguauguucuauauacacuugaaagaaucuauacauugacccuugaacaaugugggaguuacgggcaccaugcucaaaaacccaguaacuuuugacuuccuagaaacuuaacuacuaguagcccacuguugacgaagccuuaaugaacaguugauuaacacauauuuuguauguuauuuguauuauauacuguauuuuuauaauauaguaagcuacaggaagggaaauauuauuaauaaaaucauaaggaagaggaaauauauuuacuauucaugaaguggaaguggauuaucguaaaggucuuccuccucguugucuucauguuaaguaggcugaggaggaggaggaagaggagggauuggacuuggcugucucaagagguggcagaugcagaagaaaauccggguguacgugggcccaugcaauucaaucucauguuguucaagggucaacuguauucugcuuuuauugcauaaauuguucuaccaguguucauuaggucaagacagcugguaguauuguuuaugucuucuauauucuuacugauuuucugccuacuuguucuauugguuucugaaaaagauaguugaugucgucaacuaugaucguggacuuuaucuuuuagguuuugccucauguguuuugaagccucauuguuaguugcauacauauuuagauuaaggauuguuuucuuggugaauuuaccucaucuuuuuuucuuuuucuuuuuuuuuuuaagagauggggucuugcuauuuugugcaggcuggauuugaacuccugggcucaagcaauccucuugccucaggcuuuugaguagcugggauugcaagcauacaucacugcgcucaucuuuaccuccuuaucauuaggaaauguucuucuguauagauggcagcaauauuuguuuugacaucuacuucaucugauauuaauauaaguacuccaccuuucuuuugcuuuuguguaauauaucuuuucccaucauuauaccuuuaaccuaugccaauuauauuuaaguggauauucuuuuagacagcauauagucaauucuuguuuuucuguuauucauuagaaaauacgacuuaauguaauggguagcccguuuucauuuaauguacuuaaugacauacuuggguuuaaauauacaaucuugcuguuuguuuuuuuuuucuuuguuccuuuuuuucucuuugucugccuucuuuuggauuuguugaauauuuuaugguuccauuuuaucacugcuauugucuucuuguaugucuguuuuauuguuuggagguuguuucuagaguuugcaguacacauguuuaacuuagucuaccuugagucauaaccaauucucauacaacagcauauuucuguuuccuccaucuauucuuuaggcuauuauuuucuuacaguuuacuuucacauauguuaauaaacaccacaauacaugguaaugguaauuagauuuugcuuuagauaauuauauuuuaaagugguugaaaaugcuacacauuaaccauuauuagcacucuccauuccuuuacauagacuaugcuucuaccugccgucauuguuuucuugauuauaaggcuccuuuaacuccacuuccaccucccuggguuuggaaaaauucauggaaaaauguguuugaaggaauacaggauugggaaaugaaggaaaugggacauuucagaaugggaaaacaaugugagaaaaaaaaguaguaacaagagaagugaaugaagauaugcugacuggaggaacugggaaucugugguggauagaaucuggauguaaacagcggacagguggccugugaauacacugcggcuucuugaaagucgaccucguauguuugcuugauccacuuaacagaacuguagaugcugaaguaaggaaaugacacgcagcaacuggauuuuuucaaguuuuguuggaauagacucuuauggagaagagccuggaaaagggaaucucauuaagagacuacugcaguaauacaguguuaagugacagagcucuuacuaaagcagaacauaggcaacaaagggaaaggaagugugaauuccauagaaauuaucaagaaauugaggacuccuauuuuagucugauaauacuggggaaaauacugggagaaaguuuaaggaagaggauuauagcugguuuuugguaauuaauuucagauagaauugucuaauggcuagaaauauagcacuucugggaguuaaaauggaaauaaauaugucuggaaauucagaguuuaauuagagcuguggaaaugauuaaggaggagagggcuaaggaaauggauaggagagagggaagagaaaauuugaaagggaagucaggagggagggaagcagugagaauguggaagguugggauugagugcuggaaaauauucauggucaauaauggaaguugguuugaggacacauuuuugcaagguguaucaagaucauuugugaagcaucgugccagaguugaaguggaacuuuccugaguugugacuuucuacuuucugguugagauauucagccugaagaguucggugauugauggcaguuacgcagagguuaaugauuguaagcuacugcuuuacaagugaagcaaggccagaggaguagaacagaugcaccagcggaagagagaugaaaggcugaaaauagguuucuauuugauacuucccuuaucacacucaaauaauggcccacuuuuaaacuuggggucaaagaaagauguguuccaaauaccugcuagacauucugauggcuaagccuuacaauuagugucuucuuuuggucaugaggcauuguacuuaggauauaaaaacacaaacagcugucaaaaccaguguuauuucuggcauaaaauguauacaguuaaagcuuuaaaagccuucaaauuggguuaggaaauauaacuagauguuccuuacaaaaaaucucaccuagaauaaaauuacacagcaaacuggaaaaaauaagaaugaggaaaagcuuaaucaucaaaugacacaaaaaguaaacagaggcaacaauaauaauuugaggcuaaguagauuucagauauuaaacgugauaaguagaucauguguagcauaaaugagaaacauauuuauuugcaccaaauaacagcaucuauaugcacaaaacaaacacuauuaaaaaugcaagaauuaacucaagauggauuggagacauaaauguaagaccugaaaccauaaaaaauucuagaagaaaaccuaugaaaaauucuuccggagauugaccuaggcaaagaaugugugacuuaaguccccaaaagcaaauacaguaaaaacaaaaauaaauaaauggggcuuaauuaaacucacaagcuucugcacagcaaaagaaaucaucaacaaaguaaauagacaacuuacaguuugggaggaaauauuugcaaacuuuacuucugaaaaagggcuaauacccagaaucuuauaaagaacucaaaucagcaagaaaaaauucaaauaauuccauuaaaaagugggcaagcaacaugaauacacauuucucgaaagaaaauaugugcaaauggccaacaaacaugggaaaaaauguucaacaucacaaaucaucaggaaacuaccaaauaaaaccacagugagauaccauuuuaccccaaucagaauggucauuuuaaaaaagucaaaaaacaauagauguuaauguagaugcgguaaaaagggaaugcuuacaugcuguuggugggaauguaaauuaguacaaccucuguggaaaacaguauggagauuucucaaagaacuacuaguagauguaccauucgauccaggaauuccacuaguagguaucuacacaaaggaagucauucuauacaaaaggauacauauacucauauguuuauugcagcacaauucacaauugcaaagauagggaaucaaccuaaguccucaucagccaaugaguggauaaaguaaaugggaugugcacacagacacaccuuggaauaucacuagccauaaaaaagaacaaaauaauguauucugcagcauauagauggaacugaaggccauuauccuaagugggguaacucaggaacagaaaaucaaauacugcauguucucacuuagaaguuggagcuaagcuauggguaugcagaggucuacagaguaguagaguggacacuggagacucagagugaggggaggauggaagagggaggugagggaugaaaagucaccuguuggguacaacguacacuauuugggugauggguacacuaaagcccagaguuuaccauuauacaauucauccauguaaccaaaaaccacuguaccccuaaagcuauugaaauuuuuaaaauauauuuuaaaauaauuuuaaaauauauuuuaaaauuauuuuaaaauuuuaaauauauuuuaaaauauauuuuaaaauuuuuaauuuuauauuuuaaaauuuaugcaagggagcugauagaaauacacuuacuuaacaugucuagagguuuaucaguucauugauauuuacaaagaucuggcuuuugcuuuuguuaguuuuucuccauugauuuucuguucucuguuucauugauuuccgcucuaauuuuaauuauaucuuuucuucuccuuacuuuggauuuaauuuucucuuuuucuaguuuuguaaccugaaagcuuagauuauuuguuuucgaucuuuucuaauuugugcacucaaugcuauaaauuuuccucuaagcauuauuuuaacuguaucucacaaauuuugauguuuuauuuucauuuaguuacaaauaguuuuaaguuuuauugaauuauuuaauauguguguuguuuagaaauguguuguuuagucuacagguauuuuggagcuuuccagcuaucuuucuguuacugauuuccaguuuaauuucauuguggucugagagcauacuuuuauaugauuuuuaaaaauuuguuaaaggugcauuuuauggcccagaacauggucugucaugaugaauguucugugugagaagagaagaguuacauauucugcuuuucuuggauaaaauauuccauaauguugauauuaaauccaguugauugauggugcuguuuaguucaguuauguccuuaacugacuggggggacauguugauguguccaacuauaauaguagagucaucuguuucuccuuccaguucuaucaguuuuugccucacguauuuugauucuguugcuagacacauacacauuaaggacuguuauguuuucuuggagaauuggcccagguaucauuauguaaugccccucuuuaucucugauaguuuuccuugcccuacuuugucuuaaauuaauauagcuccucccacuuucuuuaaauuacuaugagcaugccuaucuuuuuuccaucccuuuacuuuuaaucuaucagugucuuuauauuuaaaguggguuucuuguagaccauauaguuagaucuuguuuuuuuuaucuacucugacugucucugucuuuuagcugaugucuuuagaccacugacauuaaaaaugauaauugauacaguuggauuucuuacagguuuuuuuguuuuucuuuuuguuuuuggaaacggagucucgcucuguugcccaggcuggagugcaguggcacaaucugggcucacugcaagcuccgccucccggcuucacacuauucuccugccucagccucccgaguagcugggacuacaggcgcccaccaccacgcccggcuaauuuuuuguauuuuuaguagagaugggguuucaccauauuagccaggauggucucgaucuccugaccucgugauccgcccaccucagccucccaaagugcugggauuacaggcgugagccaccgcgcccggccuucuuacaguuuuuuauccauugcccuugcuguuucuuuguguguguguguaucccauuuuuauucugccuucucugguuuaauugagcauuguauaaggcaacauuuuucccucucauaacauauuaauugaauaaauuaugcuuuuuuaacuuuuuuuaacugccagcccuugaguuugaaguauacacuuauaacuaauucaaguccucuuuuaaauagcaccauucauuucacagauaguacaauugccauagguacuuugcucuuguguagaauauucuauaaaugucagugauagaauuggcuaauaguguuaagucuucugcaucuuuacugauagcuuaauggcuugcuuuuaucaguuacuaagagagaagugaaaccuucaacuauaauuauggcguugacuauuucuguuuauaguucuaucaguuuugacauuuuuuuaguuccauguguagaugcacccaaauuguaguauuguuauaucuuuuugguaguuuuaccucuucauuauuuugguuaaccaauuuauugguguaaagauuacaacggaaauaaaugaaaucgauaauugaaaagcaauagagaauaaugaccgaaaccgaaaguugguuauuugaaaaaucagcaaaacugacaaaacuuuaaauggauugacuaaggaggaaaaagagaaaaaugaaauacugaaucagaaaugaaaaaagauauuacuccugacuugagagaaauagaaaggguuauaagaugauacucugaagaaguguaugccaccaaguugaguaaccuagaugaaauggacacauuccuggaaauacacaaaucaccaaaaugacuuaagaauaaauugaaaauccaaauagaccccguaacucuuaaagaaauaaaaucacuaaucgcaaaccucccaccaaagaaaagcccagggccaguuggcuuuacuggggaagucuacccaacacuuaaagaaaaauuaaugccaguccuucucaaacucuuccaaaaauuugaagaggagugaacacucucucacuugcucuaugaagggagcauuauccugaugucaaaacuagaggcauuauaagaaaagaaaacuacagaccaaugucccuaaugaauacagaugcaaaauuucuuaacaauacuagcaaaccauucagcaguauaauuaaaggauuguacaccuuaaccaaguagauuuauuccaggaaugcaaggauguucaacguauagaaauuaaucaguguaaugucccacauuaauagaaugaaggagaaaacuugcaugaucauuucaacugaugggcagcauuugacaaaauucacuccuuuaugauaaaaacaguaaaaagaaaaaaaagcuaggaauagaaggaaacugccacaacauuauaaaggucauauaugaaaaauucuuggaaagacuguccuuuaagggaucauuucuauaguuuggaaaacccucagcucacauuauauucaauggugaaagacugaaaguuuuuccccugagauaaggaagaaaacaaagauaccacuuucaacauuucuguuaacgugacacuggaagcuguagccagaggaguuaaauaagagaaauaaaaagcaaucaaauuugcaaggaagaaauaaaacuaccccuacuaauaggugacaugaucuuauauguagaaaacccuaaaacauacacacacacgugccacacuugugcuuagaacuaauacauucaguaaaguugcaggaugcaaaagcaagcuagaaaauacauuguauuuccauauacuagcuaucaacaauguaaaauugaucuuaagaagaucaauuucauuuaaaauagcaucaaaaaaugucuuaggaauaaauuuaaccaaggaagcacaagacuuauacacuaccgacuacaaaacauugcugaaagaaauaaaagaagacauaaaugaauggaaagacaucucauguuuauauauuggauauuuaauuuaagaugagaguacucaaaaugauaauacagauucagugcaguuuuuucuuaaucuuaugguagaauacuauucaagaauaaaaaacaacucaaauuuauaaguaucaauauugauaaaucucaaaaaacaaacacagaaaaacaaaauacugaggauauuuacagaauaccguacuacaaaaacugaaaaugcaccauaaaaagcauuguauuuaugacaaaauauauauaugggagaaaacuauaaaaacuugcaugcaaaugauaugaaguaacuucaggacaauauuugcuugaaucauaggugauugccauucucacagguuaaaaugguugaacauuuccaggugcagugacucauuccugugaucccagcauuuugggaggccaagguaggaggauuccuugagcccaggaguucaagaccaauggcaaaaccccaccuuuaccaaaaauaacaaaaaauuagccgggcaugguggugcacgacuguagucucagcuacucaggaggcugaggugggaggaucauuugagcccaggagaucaaggcugcaaugagcugugaucacacuacugcucuccaagcuugggugacagaacgaggccucaucucaaaagauagagagagggauggauagauagauagauagaaugguugaacaucaaugaguaggaagaagguagguauuuagcaguaacuauuuuacaucugaaaaaaacagauguuugaaaauacauauaguacaauguuaacauccauuagauuugguuaucuuauuuucuacucuuaaugcuuaaacuaguucuuuuuuuauuuucaauucaaguguaaguuaaaagaaauagaacaccaagcuuaggcuacucaagaaaauugaagaguaguaaugaccccuuugucauuucugauuguguuuauuuggaucaucucucuuuuucaguuauucuagcuagcagucuauuuuguuaauucuuucaaaaaaccaacuccuggauuuguucaucuuuuguacuuuuucugcauuucaauuuccuucaauuccgcucugauuuugguuauuucuugccuucugcuagcuuugggguugcuuugcucuuguuucucuagcucuucuaguugugauguuacauuguuaauuugagaucuuucuaacuuuuuaugugggcguuuagugcuauaaacuuccuucuuaacacugccuuagcugugucccagagauucugguauguuguaucuuuguucucauuuguuucaaagaauuucuugguuucuaccuuaauuucauuauuuaccuaaaaguaauucaggaacacguuguuuaauguccauguaauuauaugguuuugagagaguuucuuaguauugauuucuguuuuuauugugcuguggucugagagugugguugguaugauuucagguuuuuaaaaauuugcugaaguuaaaccauccauguuugcagacaguaugguucuauauaccuaaacaacccgauuuucucugcccaaaagcucuacaauccaauaaacaaccuaacaaaaauugacaaauuaacauaagcaauaucucaggauacaaaaucaauguacaaaaaucaggauuccuaugcaacaacaacaucuaagcugagagcaaaaucaagaaugcaauccuauucacaauagccacaaaaagaauaaaauaccuaggaauacagcuaaccagggaagugaaagaucuuuacaaugagaacuacauaacacuggucagagaaaucagagaugacacaaacaaauggaaaaacauuccaugcucaugguugggaagaaucaauauuguugaaauggccauacugcccacagcaguuuacagauucagugcuauucuuauucaaacuaccaaggacagucuucacaaaauuagaaaaaaaaaccaaacuauuuuuaaauccauguggacccgaaaaagaacccgaauagccaaggcaauacuaagcaaaaagaacaaagccagagacauuacauuacgcaacuuugaacuauacugcaggcuauaguaaccaaaacagcaugguaaugguacaaaaacagacacauagaccaaugggacagaauaaauagcccagaaaugucacacaguuacagacaucugaucucugacaaagucaacaguaagaagcaauagggaaaggacucccucuucaauaaaugauauugcgauaacuggcuagccauaugcagagaagguggaaacuggaccccuuucuuacaccauauacaaaaaucaacucgagauagauuaaagacuuaaauguaaaaccuaaaauuauaaaaaaugccauauaagauaaccuaggaaauaccauucuggacauagaccuuggcaaagacuucaugacaaagacuccaaaagccauugcaacaaaaacaaaacuugaccuaauuaaagagcuucugcacagcaaaagagacuaucagcagaguaaacagaccucugcagaaugggagaaaauauuugcaaacuaugcaucugacaaaggucuaauauucagaaucuauaaggaauuuaaacaaauuuacaaaaaaaaaaaaaaaagcuccauuacaaagugggcaagggacauggacagacacuucccaaaagaagacauacauguggccaacaggcauaugaaaaaaugccuaacaucacuaaucauuagagaaauguaaauuaaaaccacugugagauaccaucucacaccagucagaauggcccucauuacaaagucaaaaaauaacagaugcuagcaagauugugagaaaugggaacacuuauacacugcuggugcaaaugcaaauuagcucauccacuguggaaagcaguuuggcaauaucucaacucaaagcagaauuaccauuugacucagcagucccauuauuggaauguaaauucuucugccauaaagacacaugcacacauauguucauuacaacacuguucauaauagcaaagacaugggaucaaccuaaaugcccaucaauuacagauuggauaaagaauguaguacagauacaccauggaauacuaugcagucaucaaaaagaacaagaucauguccuuugcagcaaaauggauggagcuggaggccauaagccuaagcaaacuaacacaggaacagaaaacaaaaucccgcauauucucacuuacaagugggagcuaaacauugaguacguaucaacacaaagagaggaagagcagacaccaaggccuacuugaggguggagggcaggaggaaggugaagaucaaaaaacgaccuaccagguacugugcuuauuaucugggugauggaaugacauguacaccaaacccccccaugauaugcaguuuuccuauauaacaaaccuacgugugugccacucaaccuaaaauuuaaaaaauagagaaaauugaagaguuaagaaaggagcaguagcuaaagggagcauguagaaugggugauauuuauuucauacacucaggaaugauccaaaagggagugugaaauuggagcuacauagaaacaaguaauauuuaagauaaaaacauacagauaguaagauguaaagugaguaaauacagaaaaaaauguaagaucucugaagcauagcuaaccuauagaaaggaggugggauacccuuguagugacaucaauuggaaagaaguaagacgcccaccagagcagauguguuuauaagcauuuaggcagaaaguuaugguauuuaggcagaaaguuaugguaguuucugacugaaggccucaaauucucucucucucucucucucucuguguguguguguguguguguguguguguguguguguguguguguguguguguguguguguguguguuuuaagagauggagucuugcuguaaugcccagguuggagugcaguggcacgaucacagcucgcugcagccucgaauuccuggccuuaagggauccucccgaauagcugggccuacagguauaagucccaccaucuuuauggcagaaguucugccuucuuauuaagagugagaagaauguuuuaugguugauauuagaaguuuuaagacagugacugucacauguagggauaggcucagagggagcuagagagaaacccaaguagggaccuauaaagagguaccgauugcuggagggcccagcugagguugaaaaucccaaagcccaauuuuaugcugacugcuaaagccuuguuccucgaaagaaaaaauuauaaugauuauaaaacauaauuauauaaguauuauauaaagcacaacuuagaaaagauuuaagagguauucuaggaagauugauuuagaauguuuggauuauuuugaaauggaucuuaauacuuauugcauuccuacuuaucuuucagagauuuccuucagaaaagaagaaaaaaucuugccucuagagaguaauuuagguacuuuauaguuuauuuuggucacuugguugauacucauuucaauaggauggcaacugauuacauaaguaauauuuuuaucuaucaugugcaaggcacagagaggccucaaugaaauaaugucuccucugaaagggccuaagugaaucuuccagaccuuacuauauuaauuuuaaguguuucgguuuauucauuaaacaucuguguuucuguuugaagauuaaucuucauaucugucccagauucuaaguuaggacucuuaguauuuauuauuuucuuacguauuugcuguuuccaguguuauucuuuuguuaauuuuuuauugagauaauucacccuuuaaaguauacacuuccaugguuuuuagggucuugacagacuuaugcaaccaucaccgcugucuaauuugagaacacuuucauuucuucauuuuuuuuucuuaaagauccauguuuucgucuggaauaauuccuguucagucuaaauuuuuuuuuuuuuuuuuuuuuuuuuuuuuuuuuuuuaaccauuuuuuguagugcagcuggcaaaaaauuuguuuucuuuuaugggaugaugucuuuauuuugccuucauucuuaaaggauauuuuuacugaauauaaaauuguggguugauaguuuagugaguacauauuuaaauauuucuuccuugcaagucaugugguauauuucacuggcuguuuucaagauauuuuuguuugugugauggcuuuguaauaugucaguugacuagacugagccaccuuucccaggauuccuuuugcuauuuaagauucucgugggagauuuggaggauagacgugacggaacagccauuuuguagcucauucauguugucugcuagaccaucuuauugguacguggcaguggucaggccugcaucagcuccaccuccuccugcauccuguuagcccuugagccuacuucugggcuggaguguguguuuagcuccaugaugaaagucccagcuuuugcaggauauccacaccagcaaggucaggcgguacgaauuaacacggguuucagucuauccuccugggcuccagcuugugcuucuagauuccauuucaucuuuccucuccuggcuuugcuugcaucuucgcuucucaacuuacuguccuauggacaugaagccucagcagugaacuuggagacaacagccuuacagagacaacauaacuagcucccacaaucagggaaauucaguuaccuguaaucucuuuacacacacacagaguaguucugcuucucucauggaaccgugacagacucugguuuuaagccuuuugacuauaauguguuuaggugagguuuucuauuuauucugcuuggaguugccugagcuuuuugaaucucuugcauauccuucuuuaacuuuggaaaacuuuuagccauuauuucuugaaauauauuuucugucuuauuaucuaucucuccuccucccccucccucccucccucccucccucucccucucucuuucuuucuuucuuucuuucuuucuuucuuucuuacuuuuggaaguuguccaacagguaugaaguucugcuuguuuuuucacauuguuuuccugugcuauucaaauuggauaauaaucucugcugguauaucaaguuuacugacucuuacauaaucuccaaugugcuccaagcccauagagagaauuucuuauuucagauauuuuauuuuuuuuuauuuuagguuuuuccauuugguccuuuuccuaauaguuucugugucucugcugagauuuucaacuuuuuuacucaugaacauauuuuacuuuacgucauugaagauaauuauaaaguugcuuuaaagucuuugucuacuaauuucaacaugagaucaucagagcaucaguuuccuuugaugucuuuuucuaguguauggguucuguuuccuuuguuuuuuuaaugcugagucauuuuggaauauauccugggcauugugacugguauuuugugccucugaauucgguuagguugcagcaaagaauacugaauuuuuuauuuucuuaggccagucaucauggaugaacucaaacugcaaacgcuuucuuuuuuccaguggguuaagauuccaggcugguuuauuuagacuucacuaggaggcuuggagccugcccugugcaugugugguucaagagucagagaucugggcagacuuuauacugagauuuuagggcuucuucucuuuggcugccucuuuucuggaauuucaccuccuucacuuaaaagcugcuguacuuguucaagcucuguccucugauuguucauggcaguagaacuguggguuucuaauuuaagauuuuuacccuaaauggcauaagcuggggcccaccuucaggcaaaaagccguaaaaaugagaaauucauuuggugccauuccuuauuccuagugcccaccuccucuuuaguaccugccuguuuuuaguugcuucccagaaccuuuagauuguuuucaugucuuucuccugagguuacaguuauauggaggaggguuaauccaaucggagcugcuugaccaugauuguaagugaaacugaguauuuguucuuaauuaugcauuauugcaugccagauguacaccuuuucuucauguggcacagcaguguuuuguauucaugcaaggaaguaucucacagauucacguuugugcaaccuucuaaagagcuugugugagagagcuuauuuaaacagugugaauuaccagugaauguuaugguuaguucagugcagccaaaacauaauucauggcuguuccccuucucuuuugucccaauucucaguaacaaauucagaccucuuuuuagagaacguguaauuucauuaccuuuugacaaugccuuuuagacuucacuagggagcuuggaggcuucccugugcaugcaugguucaggagucagcagaggcuggugccugguauguaugguucaggagucagcagaggcuggugcuugguguuuggcaccaguggccaaaacaccaaagaaccuccugugaauauuuucuugucuuuacucaccaaauauuuagugcuuuucuguaagucaugcacaacauaaugaugcuucagucaacacaccgcauauaccacagugguuccauaagauuauaauagcguauuucuacuguacuuuuucuacauuuagauacacaaauacuuaccauuguguugcaguugccuaccguauucagcacuguaacguguacagggcuguagccuagggcaguaggccaucccauauggccuagguguguuguagguuacaccaucuaggcuuguauguaaguacucuccaugauguuugacaaugacacaaucaacuaacaugcauuucucagaagagaccccugucauuaagugacacaugacuguaguuuaugguaaguauugugccaacagcuagccuugcagagauagcuaagauaaagucccugucuucaaacgguugcuuacaguuuaguagaagagacagauaaauaagcaggcgauuuacauuuucaugugaugcggguuguguuucagaggugguagaaguauuucagagguugccugacccagauuuuaagaguaaaggaccuguuauagaagcugcaguuaggauuggauuaaaauuaauuggguggugguugauauugugaugcuuuaguaugacuuuaguaugaauauuuaggggcucaguguuuucuucaucuuaaaaugaggggauuggacuagaucuauaagauuauuuucaaugugaauauuuugucaguuuaaagacacauugaagagaugcucaaaaaacauacuucuuuuuucuuuuuagggaauagaguauuucagaucauuuaaaguccuguuugagaguuuaccaggcuaacaggaaguacuacuugugauuucuuugccuguuccuguucugauguuuagcugcccaguacaaaccugcaaggggagccuuggauauccaauugguuucugaaagguguguguguguguguguguguguguguguguguguguguguguguguucguccuuuuuggagccagagcuucaaaacauagcuugcaucuucuguguccuucauaaaauuccaguugguuuccugcauucacuuaauuaguacagcaccugggcauaguagcucuggauaaauacagguucuuuucuccaauagcuuccuugcagaacauagaaauugcugccugccccuaugccucaaauugaccuucuaccucuuccuccucagcuuuuaaagccccuaucuuuccuucucaccacaaguucaucccccaacccaaauguucccuaucacugggucucuccagcauucaucuggugugguauuaagagaguggcuguggcugucagugcuagaaccuggacagagagagagagagggucuuggucacgucaucuuuacagaaauauaauaggaauuucucuauaaaaauaauagauacuuguuagaagcuuuaauguuauauuuuuuauuuauuucugguuuaauagaccuuaauguuacugccuaguaaccuaccuacauuauauagccuuucuguguauguguguguaucuauugaaacaggucccaaguuuuuuccaguuuauauguaggcugcauuuuucuuuucuuuucuuuuuuaaauuuuugagccagggucucucucugucacccaggggagugcaguggcgcaaucacagcucacuucacccucaaccuuccaccucagccucucaaguagcugggaucacaggcacaugcuaccauaccuggguaauuuuuaaauuuuuuuguagagauggagucucucuauguuacucaggcuagucuugaacuccuggccucaagugaucugcccaacuuggccuccuacauuguuggaauuauaggcgugagccacugugcccagccuuacauauauaggcuuuuauaacaaaauuagcuuguaaguuggaaauugccuuuaugucauuucuccccagucugcauacuuauucaacuuuugcucauguucuugaauauuucuaagagaaauagugauuaauggcugccacacugcugauguuggacagagccuauaaaaucagcugaagaagggagaaaguagauuguuucacuaggcucuuagugaaguucugauaguuauaauaaaugcaacuuguccuuuaacacuacuaggugcaaaaucuuuuuguuacccucucaugccuuuuaaaaaggcucccaguguuucacuaaugagagcccuuuuguuguaauuuauaggugaauccucuccagguauaacugagaucuucaaauaauguaucguaucuauggauguuugugaauaacaucaccugggcauaaaccuacagucaauaggaugagugcuuaugaaguuauuuuugaaugagaaaauuuaucacagaaaagaaaauacaaguuccaguuucuggggauuacuuuuuaaaguaaugcaaaucauccauaucauguguuaacaaaccccucagaauuccaacaaggaaagcagauguauuaauuaaacauuuaaugucuuuuauaguuaaaguacucauuuuggcaggucuaauauuacgauacaauagugguauauuaauuuguuauauaccuugggccccuugguacauuuuauguaggcacaagauuaacagcaugaacuucaauuauuacuguguaguuuuguaaaaaugaaauauaauuauuuuaguuucuaguuuuaugucaagaagaauucauugguauggcacagcuuagcauacaaaguaacuaaauaauguaugccacauacccauuaguuuuguuagaaauaaauccucuuuuauacuccugcuuuuccaguacaugcacaccuacauauacacaaagcgugaagccaguauuuaguagagauuaaauaaaccagaaucuccaccuaugauugacuacuuucucauguuguuucagagaagugaaaauuauagcaccagauuacugucucugggaaaucuaaacaugcaauaguguuggcaauucuuuacugcaaacaucuauguucacuggauuuuggacccuauaugccaacacaaagugguggaaauaaccacaguuguuaaggcaauuaagauaccacaaucacuguccacaucagcugucccagaaaguuucaaguucuccagucuauuucuuaagccccuggaaggaacaauagaagaaagaauauagauaucugauaguagcacgugacuuguuacuaaaaaaggucuguggaaucucuuaccuucagagaccuugguguucaugcauacacucauggaaucauuccagccauaccagaaauaccaaaugugacuuacucuaacaaccuucagaaaauuaucucuuuguucuuucauugacacuuuuaggaagauaguaaaugguagagugauuucauagcauuuaaaauuugauaaaagaucaguguggaaagaauuuagggagcuucaacguugcugucaccauacggacuugaaguugcauauuuucagugagaugaaauugaugucuugaacccagaaacuuuauccucuuguuuaagaucacugaauacuacauuuucugaaagcaaauugguuuucaaauaaagauuuguuucaaguuuagugcauuugucagaaaaauauguuguuugcaguuaaugacacuauagcuguucauugaguugauccauaaaaguagcugagauuuacagaaauauauaugacuaucuuuucuaaaugggaauuuacauucagucaguugacagaaauguuuugagagaugugguuagaggaaaagaagagaugaagauacugguuuaaagcugaaauaggaaauuaauguauuuaugugcuagggcugcuguaacaaaauaccacagacugggugguuuaaacaacagaaauucauuuucucauauuucuggcgaaaguccaagaucaaggugcaggcaggguuaguuucuucugaggugucuguccguggcuugcagauggccgucuuuucccugugucuucauaugguuuuuccuuagugugucuacuuggguguccaaauuuccucuucuuguaaagauaccagacugaguuaagacauauccugauaucucauuuuaaugcaguuacuuuuuuaaagaccuuaucuccaaauagagucacauucugagguacuugggguuaggguuuaaacauacuaauuuuggagggacacauuucaaccuauaauaauacaauauuugaaauuuguucagcuguuguuuaaaguaaauaugaggggacuucaaaaaguucauggaaaaugguauuaaaagauaaaaacagaaaauauaaacuuuauuucucaacauaagcuccgucaaguucaagacacuuuuguaagccaugauaccagcuaguuaguucaucccuaaagagcugaacauccugguaauuuaccuauaucagugcagucuuuuuuuuacauuauuaagugaagaaaaacuaauacucuuuaaaagcuuuuuuaaguuuaggggaaaaauaagucagaaggagccaaaucaggacuguaagguggaugccuaaugauuucucaugaaagcucucaugaaauaccccuguuuaaugagagggauuuagcaggagcauuaucuugguggaggaggacucucuggugaagcuuucccagaaguuuuucugccaaagcuuuggccaacuuucuccaagugcuuauaaucagguguuaucauucuccugcccuccagaaagucaauaagcaaaaugccuugagcacccaaaaaacuguugccaugaccuuugcccuugaccuguccaauauugcuuugacuggaccauuuccacuucuucauacccauugcuuuaucuucaggauuauacuaauagaaccauguuucaucuccuguuacaauucuucaaagaaaugcuucaggaucuuuauuccacuuguuuaaaauuuccauugaaaguucugcucuugucugcagccgaucugggugcaaugguuuuggcacccaucaaguggaaaguuugcucaacuuaaauuuuucagucagaauucuguaagcugaaccagaugagaugucuaugguguuggcuguuguuucugcuguuaaucauugguccuuuugaauuagggcacaaacaagauuaauuuuuucccuugcaaauugauguggauggucugucgcugcuggcuucgucuuccacauugucucaucccuucuuaaaauaaguuauccauuuuuagacugcugauuuauuuggggcauacuucccauaacuuuucauaaagcaucagugauuuaaucauucuuccacccaagcuucaccaugaauuucauguuuguucuugcuucaauuuuagaauucauguugcucuuacaggggcucuguccaaacugaugucuuauccuucuuagucccucaaacuugauccuguacagucauguuauaacaaaucaguaugaguuaauuuuggugcagaaauuuuuugaaaucugugcaugguuuuuucauaauacacauuuuccauaaaguuuaugaagacuacucaagaauauuauauauucuagaaauuuguaaugaaaucugaaguuggggcauucugaugauuuuugugggacugcuucuguucaaguacuguggcaguuuuuuuuuguuguuugacgaggucuugcucugucacccaggcuggagugcaauggcaugaucucggcucacugcaaccuccaccucccagguucaagugauucuucugccucagccucccaaguagcugggacuacaggcaugugccacuacacccaacuaaauuuuguauuuuuaguagagaugggguuucaccauguuggccagucuggucucaaacuccugaucugccugccucagacucccaaagugcugggauuacaggcaugagccacugcacccagccauacugaggcaauuuuuuacaagcccuacccgacaauguuccccauauacauaauguagggucuuugcuucccuacaaauguuuauauuccacugaguugucuucaccuucagggacaggggaaguggaagggggaauaaugcuuccuagaaugaauaucuugacuaauguauagagaaacaaucaaaagcaaaaguaguuuucauucaaagccuucacauuguaaaugcuacaguaaaaagaccuugagaucaagaaaccuagguuuuugccgcuccaguucuuauucguauaauuuuuggcaagccauuuaaccagugucagcuuuaauuuccugaucucuaaaaagguacacuacaugcucacugacgucuuacucagcugcaagacugaaugauugauucauuuauuccgcaaauauuguugaaugcuacuauguggcaaggacuguuuuaggaguugggaauaucacauuagugcaacacaaaguuccagaggagacaagugggaaacaaauagcaagaugguaaauuuaaucuuacucguaucaauaaucacauuaaauguaaauguucuaaacaccacaauugaaagacagagauuagacuugguaaaaagcaagaacuaccuauaugcugcuuauaagaaaccaacuuuaaauguaagauauaaguagauuaaaauuaauagaacagaaaauuauauacuaugcucaaccuaaucagaagaaaacuagagugcuauauuaaaucauaugaaguagauuucaaagcaaguaauauugcuggagauaaggaggaacauuucauaauaauuaagggagucauuucaucaagaaguauuaaccgucuuaguuaugcaucuaauaacaaaacaaaauauuugaagcaaaaacuaauauaaggaaaaauagacacauuuacaguuacuauuggacaguucaauauccaucuucaaauaauugauacagcaauuggagagaaauugguaagguuauauagcaacuugggcaauacuaucagucagcuugaucuaacugacauuuauggaacacgcuacccaacagcauaagaacacuuauuuuucucaaggucacagaucauuuaucacaguguaccauauguugagcaaaacaacuccaugaauuuuaaaggauuuaaguacuguaaaacauuuucucuuugaaggaaaugaaauuaaaaaaacacagaucuauggaaaauccccaaguucuuggaaacuaaauauuaauccauggaucaaagaagaaaucaaagggaaaugagaaaguauuuugaauggacugaaaacgaaaacacaauguguuuagcugugauauacagcuaaagcaauacuuaaauuuauaguacuaaauacaauuuauaguacuaaaagauauuuuuaaacauuagaaaagaagaaaaguguaaaauuaaugaccuuagcuucuaucuuaagaaacuaggacugggcacaguagcucacaacuauaaucucaguacuuuugaaggccaagguagaggaguucgagacuagucugcacaacauagugagaucccaucucuaaauaacaaaauauuagcugggcauacuggugugcaccuguggucauagcugcucaggaggcugaggcaggaggauugcucaaggaggcugaggcaggaggauugcuucaggaggcugaggcaggaggauugcucgaggccaggaguuuugaggcuucagugaacuaugaucacaucccugcacucuagccugggugacagagccagauuuugucucuaaaaaacaagaaaaagaaaaaggaauuagaaaaauaagaacaaguuaaacacaguguaagcagaacaaaggaaauaaagauugggauagcaaucaaugaaauagaaaacaaaaaaucauagagaaaauugaugaaaggaaaacugggcuuuugagaagaucauuaaaauugauguauuucucaccugacugaaaagaaaagugagaagacaaauaauaaauguugacacugcuacagauucuauugguauuaaguggauaauauggaagcauuauguauaacuuuaugccaauaaauucaacuauuuagcugaaauggacacauauguugaaagauacaaauuaccaagaagaaauagaugucaugaauagccuuguaccugcuaaagaaauuauaguugugguuaagauccuucugacaaagacaccagacccacauauuuucaccaacgaagucuaccaaacauuuaaggaauauuaucaguucuauacaaauuauuccagaaaauugaagaugagagaacauuucucaguucauucugugaggcagguauuaacuugauaucaauaugcaagagauuuuuuuuuuuuuuugagauggagucuugcuccgucgcccaggcuggagugcagugacgcgaucucagcucauggcaagcuccgccucccggguucaugccauucucccgaguagcugggacuacaggcaccugccaccacagccggcuaauuuuugguauuuuuaguagagacggggguuucccauguuagccaggauggucuugaucuccugaccuggugaucugccugccucggccucccaaagugcugggauuacaggcaugagccaccacaccuggcccgcaaagagauuuuuaaaagaaugcuauagaccaauauucuuaaugaauauauaugcuaaaauguuuaauuuaauuuuagcaaaucaaaucuaacaauagauacaaagaaucacuaccaguguggucuguucuaggaauauaagauugauuuaacauucaaaaccaaucacuauaguucaccuauuaacagaguacgaaggaaaugauuauaucaaaugaugcaaagaaaaaacuaagaaaaauccauccuuuuuaaaacuuauuuaaacaaaaaaugaaacgcucugagugaauuaggaauuggguuuuuuuuuuuuuuaacaugguaaaggaaaacaauuugacaguuucuggaaaagucaaauguauaccuaccauacggcccagccauuccacuccuuaguauuuguccuaaauaaauuaaaucauaugucuacacaaagacguggacauaaaaguuaauagcaauuuuguuuguaauugccccaaacugggagcaggcccuguguucauugacagaugaguguguccauugugauacaucuauguacugaaauauuacccagcaaagugaguaaacuauugauacauguggugacauggaugaauaucaaaguaauaaugcuaaaugaacaagccagauaaagaguacauacucuaugauccauuugcauaaaauucuuuaaaauacaagcaaaucagucauggcagaaaguaugucagucauggccugcaggggaugggaggauggaaguacacaugggcacaagaagacauuugaagugguagauguuuucaucaucuugauuuuggugacaguuucauggguauauacauaugucaaaacguaucaguugcauguuuuuuguuuguuuuuuugagaggguuuuacucguucgccccggccggguuggaaugcaauagcauaaucuuggcucacagcaaccucugccuucugggcugaagugauccuuccacgucagccucccaaguagcugggacuacaggcgcccgcugccacacccagcccaaguuguauauucuuaaugugugcuguuuaguguauguuaauuacgcaucaauaaacuuuuuuuuaaaguccuugcccucguggaacuuauauuuuauuggugaugaacauugacaguaacaaauacauguauaucauaugugugcauguauacgugccuguguaucagaugucgcaaagucuugaagaaaaagcaaugugaagauagaaagugagggggaggauagcuguuuaauguaagaaggcggucaggaaaguccucaguacacguggcauuugaaacagagacuauuuuaagcuccccuauaaucuuuugaaaacuguguuaagauagguuucaguuuguuaaaguuacaggucaucauucucucaucuaaaaggacaaguuuccccuaacuugaaggcaaauuuaaauuuuugacaucacaaagaaccagaugaaaaggauggggcagaggugagcaaaccuacuccuagugcccaagagaagccgauuccagccacaggaauuucuugugguuaacuucugauuggaaagauaaagaccuauuuugugaacaucuguagaauaguaaaucagaaaaacccaaccagaauuccagucuucccguuuucugccagauaggggcaauuacccccuugguuuucuaaaaaaaauaaaaaaaacaaaauuguuccagccucugucaccucugggguucccugugcgugugcaugugauaugugaggcugguguggagaauuuagccugagagucagagggaggguuucuagcaguggagugaccugcuugcucauguccaggggauccagcagggcagcuagaaagaaauauggucuggcacaauggcaggcuucuccuugccacugguggaggaguuuguuucaguuuagggauuagucgccauuaccagcugaucaguggaacguagaguugguucauccccaaaggagugcuugcuaaucaugaagaccuuagaauagcugugugcuggggguaaacagaaagaauuauaaaaagaagagauuaagaaugcuuuguagcauguaccauaaacugaaaugucccuuauuuugaaaaccugcuuuuaauucugcucaucccacgauucuuaaaaauauaguucugucuagagaauaauuuaaagauuuuccuuauuauuuaacauacauuuggugacagaaagagugggaaaaugcacugaucucaagccaauuguguauuuguuuuuguaaaauuuuuauaaaacaugcugauuucugucauucuguuugccauguuccuauccccgugagaacuguauucuaaagcagcauccccuguucugaaugauacucugcagagcacgcacucugacccuaaugcucugggacugggcauccugugcuagaaggaaccuguggguuccaccugucccucaaggcuagagcccugagaagcaggagccucguguuagcuccuucucccucccaaccaguggagguucacagggcuccggcuccugaaaccuccaguagcccgagacuuuccuuccacccccaccuucccuaacgccaugccugccgcaggugcagugcgaaugagaugauuccugcccugucaaucucaggggagcuacucuuaaucucuucugggcugugguccccuuugaggaucugaugaaagcugugggcaagauuuugcauguaacgucaggggcuaccaggaaacccuuuuccagagcagggcaggcaucaaugcccaucucuuaucagcaaauucuuagcaaaguacaaaguuguaguucuuuacgaagggcaaaggcagcacucucaucuguaaccuggugauagcuguauuauuaaguuguauuuuuauuacuacccucuucagcuagcacuagaaagagguugcccgaggaagagcccacauccuggcacacugcuccccaucaauaugguuuugcauguauguuuguuauuggggaaaaaaaccagcacagauuuuucaauaucccucucccguccuauucaaugguuuucuuuuguuguuuuucgugauccauuagauuuuauacagaaccaccaauuacccaccgguugguuuagacuguugacugggaagccaaauaucaugucucccuuacccagcgacucagcauuguagacuuuuguucuguucauuuaacuacgugcucucugcuuuuuuccuagaaaggaauuuuccugaauugaaaucaguuaauaaaacucuuuuucuuucuuuuuacagcuuguaccuccuuuuaaaccucaaguaacaucugagacagauacuagauauuuugaugaagaauuuacagcucagacuauuacaauaacaccaccugaaaaauguaaguaaauuuagaaggcaauugauaaauuucuaauauaauuucuccuaauguaauugaagaaaacagucuuuuaaaaacucaucugauauuuucaagaucaaauuccacagugacuuacuccauucuauuuaagaauauugaauauugaauugaauuuaagaauauugaguucccagugguaauaucaaaagacugcaagaaaugcuuuucuggguaggacaaauuauauagagagaaauuguagaugaaauuacagacuagcucuuccuuacuguucaccaauagauuguuuugacaccaacugaaaggauugugaaauagagacuccccucuuuccuagacuucguucauucccacauaaccuucagaauuuugccaguuuuggucuccuacuuacuuaauaguuuuaaaauucauguagagucacuccuuuuuacuuagcucucucuuaaauaguauuaucugugaagacauaauuuaguuugcuaauacuuuuggauaccuauaaauuacauauuuaugaaaacuguguguucauguaccacuucaagucaauucauauacauuaguaugucucacacuuggagaaauaccauaaauaaguggagcuguaaugagggaaaaggugaucagacauaauugauaaacauuuucaugcugacagaggucuguguguaucaucauuaacuuaagaauguggauaagauugcguuucagggcaauauuuggauggcugcaagaaugcuucaaguuacacaucuuuggguucacaucauaguuuuucuuuccuuuucuuuuugauuccuucccuauaugucuucuccucucauuccuuuuuuggaggcagauuuauccauagugcugauguggacucaguguccgggagaggggcgauuggaggcuaaugcugugccagagauggucacaggcagcagauucuacugucgagaggcaaacaaggggucaugugggccaagaggucuuaaucuugggaccauggucuggccacaaggggauugugaacacccugaaagugaagauaugaugacgugugugugcuuuucuuucuuuagauucacaaaaaguuaaggugcuccagguccugaaguugggucagccauagccagaagcagggcuuaccaacuugaccgauguccaggcuaaguugugaaauaccaauccauugaagugagcuacucauggucaguccuguggugaggcagaguuuccacucaaucuugugccauugcuagaauuuuagaaucacuaagagucacagacaauguuggaaagccuguggagucaugggcaaguagcucagcgcugaguagaaaucaugggcauaggccuuggccucuguccccagcauagacuguggcauuagaauuguccaaaaugcuggguaacaccagugaguuuucggaucggcccaugggcaguuccugccauacagccuuugcuaggcccuuucauuuggauauaauccuaacuguaaucagaccacaucauuccucugcuuaaaaccuuccggugccaucccauugcacucuaaauccaaacuugcucacacugguuugcacagcacugacugaucugggcccuguccaccucucugaccucuuccuguuccaucuucccccacugucccuggguuccagccacaccucgaacaugccacacgucaccaugccucgggcucuggggacaguauuuaugguguccaggccuggaaugcucuucuucccugaucuuacuuggauggcuccuucuuguccuucagcucuaagcuuacaugucauuccaucagagaaccuucuuugaccuccuagucugaagagcaucagucugacaacauucccucucucucuucauucucugcauuggcaccuugacuugcugguauuuuucuguuuguuugguuagugucuauuuccgccacuaacaugcaguggguuggagaggaaggaucuaguuugucucauucguuauuagcccaagcuccuaguuagaugccuggcacagugugcguauucaauaauacuuguuaggugcaugaauacacagaauauggugagggccuaggaacuucagagccgggaggacacccaggcuugccuccccucugaauauccaaagcagauauugggauaggaaggucuugacaggucucuuuccucagucucagccucugagaaaguuuccauucuuaaauagagcauuuggcauuugcguaccuuuagagcaaguaaauauguuauuuuggaagucauagaaauaagaaggcucuaaaaugucaagccaggaguagauauuuuacuuaagaaagcuaaaagugaaaucccaauuugggacauggagugaggcugaaaaagcccaggacucagaccuggggaaccugccuuguguccugccugugccccuuacaguucugggcgauggccggucacuuuguccccuggaaaagcagggagcagggcugauagucucucaguggcguuuuuguccucccgugugccugagaagccgucucuuuaggagaggcaccgagaguucugccaauuugaaucacccuauuuucaauucugcucaagcaccagauuggcuaguccauaguguuacuguaugcugugggccaguccauuuagggggaugauaggcccaacgcagcaagcaccuggcugcaggggugguguaguggagggccggcggacagggcugacuaaugcgaugcucagaaaugugagacuagaaagaccagagcaaaucaaaauggauuuggguacaaauaaggucaauuagaaacuguuguauaugacucuuaggcuagucagucauuuuuucaugauugacuugaauuucaaagcccuagcuuucaaggaccagaaucucuucgaaauucaucuuaccugcuuuauuccuuacucgacacccgcggggcacuuguccugaugagaauuugucauuagugugcauuuuauugcucaaucucuaggacuucuaaaaugagacugaaauguuagaagguguuagaagucccccagcacaguuucuagaacauaauuugaaccuaguuccuuggcuucauuaaucagcaauauaaaagccaucaagaauguuuuuccuggcaugucauauuuuaccacugacagcaccucuguucuuaaauaacaugugucauuucagacauggaucaugcuguaaaagcccuacaaccuuggugucuuuaaaugauaauagguucacuucuagauugagacagagauaccuaggaagccuguacauuguaguaacuuucaagaugguuaucaaaauccaccugcaauuguaggaccacaaaagucuggcuuuugucuaggcgcaguggugcacaccuguaaucccagcacuuugggaggccaaggcggguggaucacuugaggucaggaggagucugagacuagccuggccaacauggugaaacccccucucuacaaaaaaaaauacaaaaauuagccagacgugguggugcauuccugugauuccagccacucgggaggcugaggcaggaggaucgcuugaacccgggaggcagaagcugcacugagcugagaucacaacauugcccuccagucugggugacagagcaagacucugucuuuuaaaaaaaaaaaaaaaaaaaaaaaaaagucuggcuuuugugggugucagaaauggggugugguccugcccugcuccugggcccuggacaguacggaaacgagagcccagcaaugucaucuguuucugacagggcacaccgcaauugagggguggggagggcgcuauggacuugcuguguuuuucccuauucaggaccucuguagcaaggaaagucagacggaagagcucagcagaguaugcccaggcaaagacuagcaucgacgcaucugcaggcaccucuguucagcagccucuccugcugucuguguggcucagcagagcgcagcgcucagcacugggggccauggggcccugggcuuccugucuuaggggagcagccuugauggugguuaacugcagcuucuggguucuucuagggcaacggggcaguauuuuuaguuugacaguuccuggauacauccuagauucccuuaaggagcagauaaaaugagaaucacugaaaccuugaacggugauuacauucaacauaaccuuuuucuugcagcuuugaauaguuuaacugguaagaaaccguugcagcucccuaagugcuaacacacagagguuuuguugauaaaaguccaggguaguaccauucguuagcaauugucuucccacuugccaccuugcuuguauaaaacagaauacaguuauuguuuagaacaaaucagcaguuagaaaggcaaaauguuccauuuucuacaaacagcugcagugacaugccagauuguccucacuggcguuaauaauggaacagauuugggaaugugucaucuuucguuaucgccauugaugguccuccuccuuccucuuacagaaaaagaggguuucuuugagaucuggucgcuuuuacugccauauaaugccauuuguuaaauguucuaagaaaaucaggcaacugauguuccuuggaugcagggauucaagggauguagcaaguagaguugaucauugucuucuuuuuccagauaaguguuuuugaaaaacauaguucauguucauuaucaucacuauucccuaugcacagccucucacagcaggaacuaacuuguguacauugacaggcuccgacucagagucagcugccacuuccuccagcuccccucccaccgcagccccugcccaggcucucagcucuuuuagggccaugaucagauguucacgccucauuguuuccaagccugacaacagaaaggggcaggaaugauggagggagaucauuggcuuuaaagaauaucaaggauuggggcccucagggauaucugugaaauuuccuagauucagaauugugaugaauguguuacugaagugacagaaugaaggcugucucucaauucuuagcugacaccagcaagagucccuccucuuccaaaagggugucuagcaccugccccuguugagcaucuggcuaaccugggugcugaaccucgccgggcuggaaugaguccuggccauggccccaggaguccaggcagcuccugcccuuccuggcugagcaggacaagcaccaggcuccccacugcuguccagagccagcugcagguuugcugugcagaaacacugaguaaaauaaagcuguuggugaggaaaauuguuuauuugaaaugugauuggcucaugucagaaucugaacauuaagguuuuagcugcccguauucucuagagaguuuuuauacucuggggcucaaccacggguacaccaucauucccagcuccuuccguuuuuacuguagcuaaaaauacugcugaagguauuugaucuaaaagaugugugugacuugcuugguacaaauauuggaaccaauaacuuuauaaggagguagagauuuccccaaaucucaauaccuucuagaaaugcugacugcaguuacaguggucuauuugcagaagaagagagggccuccgaguucagugucuuacacagagcagggagccacaaaugcuucuugauggaucaguucucaccuaauacgaggauaucuucugguacauuaggggucagaaauuuuggcuaaugccagcuugaucccauuucuagaaucuucugcauuaagagugggauacagaaaagaaaaacagugauacaagaauggaaguguuuauucuucagacaaaggcagagcccccuccucuucggagugacagagucagagccucagugcagugggaucuggccuguaugcuuucuuuguuuacacccacauccagcggaugcucccuggagagguuagaauauucaaaaaaauugguaauguacuuccuauauggguuugaggacaucgaauuauuuugcuugaagagaaaaggguugaguauuggaaagauucacugauuuccauugcaggacagcauaugauuaaacaagcuuagaggcaagcacgggggauuuaaaauggagcaccucccccaggagacugugaggccagggggcccuugggacuuuguucaaaguucugcgguccuugggccugacgggugcucagcccagagcagaugcgugggagcgcauguugacugaguggcugaccacguggccacauaccaggaagagcuuccaacagcacaggacugucaucacaggacauuuaugagaacagggugcugaucaucugugaucuuugaaauacaggaaaccaggaaagcugacaggaggaacacugugauugucagcggccuguuuugaugccuuucaagucucuuccauuguuuccugaugagcuaggacucagauguugacauccuucccucuuuuucuuucacuuagucccuucaugcuaaaguuuuaucauagggaaauugggaaaggugaguuaagccagaugcuagauguugaaugaaauuucauaagaagcuuuauuuugcaguugcacuuaaagcaucacaaagaaaaaauauaagcacuugaagacauucgaugaugaauucuauacagacuuuggaugcuguggauuucacugacuugcaguuuugauauaugugguuacaugaaaugaaagguuacugaagacugcuccuucuuaaaaacuucuguuuucuucaauaccauuuuuuucacuguuucauugagucuugaaauuuugaugucuuagagaugauucuauaguauuauuucuucauagacuauguauuuaugaaaaucagaugauuuuugaaguauaauuacucuacagcuuauugaugaacacaaguuuaugggagcuauugccucuguucaucuuuccuauguucagaguuuaaaaaacauagacuagagauaauguugcaaaaaaugaauguguaaaauuaaaauagauguuuccugcccacagaugaugaggaugguauggacugcauggacaaugagaggcggccgcauuucccucaauuuuccuacucugcaaguggacgagaauaagucucuuucauucugcuacuucacugucaucuucaauuuauuacugaaaaugauuccuggacaucaccaguccuagcucuuacacauagcaggggcaccuuccgacaucccagaccagccaaggguccucaccccucgccaccuuucacccucaugaaaacacacauacacgcaaauacacuccaguuuuuguuuuugcaugaaauuguaucucagucuaaggucucaugcuguugcugcuacugucuuacuauuauagcaacuuuaagaaguaauuuuccaaccuuuggaagucaugagcccaccauuguucauuugugcaccaauuaucaucuuuugaucuuuuaguuuuucccucagugaaggcuaaaugagauacacugauucuagguacauuuuuuaacuuucuagaagagaaaaacuaacuagacuaagaagauuuaguuuauaaauucagaacaagcaauuguggaagggugguggcgugcauauguaaagcacaucagauccgugcgugaaguaggcauauaucacuaagcuguggcuggaauugauuaggaagcauuugguagaaggacugaacaacuguugggauauauauauauauauauaauuuuuuuuuuuuaaauuccugguggauacuguagaagaagcccauaucacauguggaugucgagacuucacgggcaaucaugagcaagugaacacuguucuaccaagaacugaaggcauaugcacagucaaggucacuuaaagggucuuaugaaacaauuugagccagagagcaucuuuccccugugcuuggaaaccuuuuuuccuucuugacauuuaucaccucugauggcugaagaauguagacagguauaaugauacugcuuuucaccaaaauuucuacaccaagguaaacagguguuugccuuauuuaauuuuuuacuuucaguucuacgugaauuagcuuuuucucagauguugaaacuuugaauguccuuuuaugauuuuguuuauauugcaguaguauuuauuuuuuagugaugagaauuguaugucauguuagcaaacgcagcuccaacuuauauaaaauagacuuacugcaguuacuuuugacccaugugcaaggauuguacacgcugaugagaaucaugcacuuuuucuccucuguuaaaaaaaaugauaaggcucugaaauggaauauauugguuagaauuuggcuuugggagaagagaugcugccauuuaaccccuugguacugaaaaugagaaaauccccaacuaugcaugccaagggguuaaugaaacaaauagcuguugacguuugcucauuuaagaauuugaaacguuaugaugaccuggcaacaaaaaguaaugaagaaaauugagaccugagugaagauaagaaaugaucuuuacguggcaaaaugaacacaucuugaguauuuaggaaaugggcagugaaggcuaagaaccugguguguuucuugggaucaugguacauuuaucacugaauuaagccaucagggaaaaaacaacaaaaaaagagaacaccuccagcuuuucuuuuucuguauauacucaugucccccagauuccaacauuucucacugaaagggggcauguaugcaaaccucaucuuucuccuucauuaaugaugaucuucagauuaaacccuuuggugcuaggagcugacaauuuccaaagcagccugugaaguccuaggggcugggggccacucuugcggcaagcagaaggccauccuacuccgcggagugaucauggaaauguauuuuaguuaaacucugacagcucccaaacggaagacuacagcaugacguaguauuaugauugcauuguaugaaagagcaagugacuuucuaaguaggaugaaucauauucauaugcagaugucuuagccucuugacgcuggaaguguggauuuauagcuaugaaaccacugcuggcagugggugggccacugggacugacggggguuaaagggcauuuuacuaaggcagcuaagacauauucagacaucaacguuauccuucuuuuucauauuucuaccugagugaaguucauccuuaguauugaguaggaaguuacaguaaaugguaguucauucuuacuuacacacauagcuaaucuuuuuuuuuucacuuggaauuauguugaauguuucauuuugacaaaaaaguagacuagaagguauguucuuuaaguugucuugcauccauuauauaagaaagaaacaggugagaggaagagcagaaagcugagacuggcugauguucagagcacuuacuccucuagagggaaagcaugacaccgaacacuaagcacacagcuuuuuguuguuuugguuuuuucucccgcaaaucuuaaagugauucccaugaccuuggccaaggacacuucuuaaagauuaaugacuggcacugacauugccccaggcgggccacuccucacacuggcucucaguucccagccaugccuggggcucagucacuucuauuccacccucugagacuccauuggugucacacaaggugucuucuuggcuuugauuuugagaauccccuauuuucacuuccagaucugucagcugccauggaggaauaauagaaaaccagaaaugcguguagagggagauuucuaaaacuucccuugugucgcccauaguuguaguuuuggguucuggcagguggaacacccugaaaccuggaaucauucuaugagaauacaguucagacuuugcagacuccagcccauacuaacugucaugaagcuugacuucuugucauaaugcagccaucuuggaggaaauuggccauuucugcuuagaugguuggcagggucgcgcucagcuuugcuuucuacacuaauuacauagcauuauucaaguauuguuuuccauuucccaucccugauuuccagcuucuuaaagcugacuguucuugcaggggccacuugcuucuccuagaguacaaaaguaagggccuuccuuacuaacugcagggucucucuauuacaccucaacauacacacuuugcugcuacuguuuguacugucuacaguagaauuuccuuaucuugcuccugguagugcauuacaggcaagcaugaaauguaaaguauuuauuuaaauaaaaagaaaaccucuaaauugguaauugaauuaccucccuguagcuuuauaguuugugacauuucuugaccuugcuaguucuuucauuagaucugcgcaagaucuagucaucugguuaaggauuuuaagcagaugcaacuauaaacccaagaaacuguauuacuauuacuguuggucauacuaaaccugucuauuuccugaaguauaugacccacaaggauguggaauaacuaggagaaacuguuuuuguacacuguacauccuuaguauuuuuacacguauaugauagggaugaacaugauuuuccuucguacagacagcuuaaauaaagcacuaugucaaucugcuacuucucuguuuauuguuguuggaugugguucuauaauccccccaaauuaaaucuucuuuaaugaaaacaugauuuuuaauagccccagcugguauuaaccuaccuuguauaaaaugugacaggaaaauauagaaauaauuccuuguagcucacacacacacacauaggggaucauuuuuacuucagugaaauggcaguagugcgguugugcaaacuuugaugaacggcugcuucugaggggaaacgcugaccucucagcacuggauuuaggauggauguacugugaagccagggaugaaggaggucucagacccuggggacauucagacccgaaucaucuauacaacacacgguuuggacccagaaucugaaggaauguagcuuuucauuaacgucuuccugauaauguacugcucugcauauuuccuuucuuagaguguauuucuaacaacaugucauggcaaauuaacaaacuuagacgugggugauguagauggguaggauggcuggacugcagucugacuucacguugaaucauucuggauggggccuuuuucugauuuuaccucauaaagcuacuauuguagaaacuuggcuuugcuccugugacgaagccagacagaggaauggcuuuugggaccagagugagucaagcauguauguguaugucacacggccaaauuugagggcauucucacaugugcucuucucucaaaaccacugggguugacagauccaggaggcuaaaaaaaagugaccucuauaauucuuuaaaggugcuauuuuuagaauauuguauaauuuauucacaguauaucuaaaacagaauuaaggacaauuaaaauaucuuaugugacagccuuuaugucuagcacauuugaugaaauaaaaaacuucugaaucugaauagaaguucuacuguuucaggcuugaaccuuuuacaugcucaagagauucaaauggucucuguguguagaucaugccaccgccuccaaagccuaauccacaucacuucugagaggcaaggcugagcauauggugacaucagcucuguguugagauggugaugaggaugauggcucgcuggccaggcagggcagccgaaggucagggaccuguccuaacuaacugcagccuugccuuuaguguuugucauucucagauacaacacgguauguccaguguccguuuuuauuacuuuaaagcauuugagggcuuaauuguguauaguagaaauacuauuuuagacaaauaauuaucuguguacagauauuugauauacucuaaguaaauuuucuaauuucacuaaguacguuuuuaggcuccucucaaauacugcguauugaagaaaaaaaucugacaccaccgagccaaagaugcuuuuuugucuguuuucguuguuuaacagaauggaaagaguaaugcauagugcuuccuggugucuccugauugauugauugugcacaaaguaggacgauaaauaaauaaaauggagucugaugggacauugauuaaaggugaaggaugauugauauauagaucaugaaaagaaaaaugaauggcaggaaaaaaaguuugguccuuaauauacuuuggccuaguuaaaauaugugccuuuuugguguguuuuguucaucacuacaagauaaaaaggaaacauuacaacucaagucuuuaaaaaguucauuuauugaaaaucauauguauaaccuagcauacgaaugagcagauuuaaacacauaacuucaagccauuucugaaaacauacaccaggagcucugcucagcuagagucagacuccagcuccagcccgacugcgugcggggacagcgcccgcguugaugaggaccagccccacugcaggcugaggcggugucacccugggaaggucguggugcguuguggcauauuaagucuaaaccagaugaauguaaauaucucuuuguaaaucauuuauuucacucuguuccauccaggucagcaaucagauuguggcaugcuggguaacuggaaaaaauaauaaaaaguaaguuucaauagcu

SEQ ID NO: 12985 - RNA, 820 nt, Homo sapiens
agccgaucucccagccugagucucccuauucuuuuccaggggcugaauugugauucaccuggaggguuggcugcuuggaagucaagacucuguaaaccagggucccagacgcuuugugggaaggaguggcguuccuucuccugaguccuggugauccuagaguggucuggggagagauguaucgaccuaucugugccaggcucagcugcgugccuggccgaguaaggacaagauuggaagccacugcuccuuucugggauuuuguggaaaauaucucacuguuucccuuuaugcagcccagagugcccuaaacaccuugauaguggaaaaggugggcuaagcaucucguaugucccucuggcuagcucauaucuuggaaggaacaaaaaucaauagagaucugauguccagcuugcccggaacaacucuggaaggaguuuccgaaggcaacaguaaaggaagcuuugcagguuuguuaggaugaugaagaagagggacccaaggggggccucauucuaccccaucagaaaccaaaguccucagggaaggagggagagcccggagguaccugggcuuauccucugcuucugccuucucuguggucccucucgucaccgagggggcucugcagacucuucacugaggccugccugggcugccaucuaugcccacggggagauucuaccuggauuaaguagagagcuucuaagagcugcucuguauguuuucaagagaaaagcaagcaugugguagaaaacauggagaauaugucucauaaacaggaucaggggaagggcagggggagagagaauggugauua

SEQ ID NO: 12986 - RNA, 720 nt, Homo sapiens
cucuguuucuuuuucuuucuuuuuuuuuuuugggaacaaaacaauaaacaccuuuauuacaugggugaagacaaaacaaggauuuauuugccuuucugggccuugauuuuccuaagauagaacuccaacucuuugcccucuagcacauagccaucugcucggccacacugucccggccuugaagccaugcacgcaagaagcuugcccugcuggaacugcucccccaggagacugcucauuuuggcauucuucuuccuuucaucauauuucuucugaauuuuuuuagaucguuuuuuguuuaaaaucucuucuuccucaggagucagcuuggcucccuucuugcggcccaggggcagugcacagugggacucguaccacugucgguagggcgugcugucgaugggcacgaugcaauucuucaccacggucuugguacgaaccagcucguuauuggaugcauuguagacaacaucgaugacccuuguuucaccagcgcagcauucugagccccaggagaaauuccccacguccagccucggggcacaguauuucuuguuaccuccucgcacacggacuguguggaugcggcacgggucagucuugcuguuggcagcugggcgccccaacucauacuuccgcuucuuguggcagggccuucucuugcccccagcuuugcggcccuugugccaguugucccgagaggugcccaucgcucggcgc

SEQ ID NO: 12987 - RNA, 879 nt, Homo sapiens
aaugucagacucaaauuuggauagcagcaagaagaauuucuuugaggggggaaguaguugaugagggaagugugauuuugacacuggugccaguuaaagaugacccaaauauggaacaaauggaaccaaguauuucuucaacuucugaugucaaacuggagaagccuaagaaauauaaucaaggucaucacuucaaacacaugaacaauuuacagcuccacaaaaagcuggugcaaaauaccagcccuucccuugccgaccacuuugccucccauuaauaaggugugucgggacacuuagcgggacuggugucaacaacuugguuugagugcuaauggcaagaaaauagaaguuuaucugaggcuccguaggcgugcuuucccugaacaacagcaagauacgccugaaacaucacauaagaccagauuacagcgaugcucgagaaaacacaaggcagugaccgagagagcaagaggcuucagaaaaguuaugagaugaaugaaagaacagagagacuaauauaguugaagugauaacuucagugcaggcauccauguuggcaucaugggcaagaauuggugcaagagcuguucagccaaaggcuguaaauucauguuccauuccuguuucuguugaggccuuuuggaugcaaaccucugaugucagguggugugugguccauggcagacgucucucagcagacacaaagagcuggguacaccugcaguuucaugcagaucaggccugggugccuaccacucacaggaggaugauuucucucuucuuguuaccugccugcauuuucccauccccaggcauagaagauaacauauuaugccccaacugugcuaagaggaauaagaagaugaugagaagauu

SEQ ID NO: 12988 - RNA, 879 nt, Homo sapiens
aaucuucucaucaucuucuuauuccucuuagcacaguuggggcauaauauguuaucuucuaugccuggggaugggaaaaugcaggcagguaacaagaagagagaaaucauccuccugugagugguaggcacccaggccugaucugcaugaaacugcagguguacccagcucuuugugucugcugagagacgucugccauggaccacacaccaccugacaucagagguuugcauccaaaaggccucaacagaaacaggaauggaacaugaauuuacagccuuuggcugaacagcucuugcaccaauucuugcccaugaugccaacauggaugccugcacugaaguuaucacuucaacuauauuagucucucuguucuuucauucaucucauaacuuuucugaagccucuugcucucucggucacugccuuguguuuucucgagcaucgcuguaaucuggucuuaugugauguuucaggcguaucuugcuguuguucagggaaagcacgccuacggagccucagauaaacuucuauuuucuugccauuagcacucaaaccaaguuguugacaccagucccgcuaagugucccgacacaccuuauuaaugggaggcaaaguggucggcaagggaagggcugguauuuugcaccagcuuuuuguggagcuguaaauuguucauguguuugaagugaugaccuugauuauauuucuuaggcuucuccaguuugacaucagaaguugaagaaauacuugguuccauuuguuccauauuugggucaucuuuaacuggcaccagugucaaaaucacacuucccucaucaacuacuuccccccucaaagaaauucuucuugcugcuauccaaauuugagucugacauu

SEQ ID NO: 12989 - RNA, 1327 nt, Homo sapiens
gggguguggagcauguagguguuauacaccccugccaaucaccaggaaggagcugaguguggaauucacauuugaaagugaagaugcaggaagccugauagcucccaaaagaaacggccaccagauuuuguuuaaaacaaacaaacaacaacaacaaaacacacaaaaacaacggaaggguacacuuuagaaaaacuauugacuuuuucccaagauaucuguaccucagccacaacuacaaaaaagagucucuuccucuguugcuggcaucuagucugcuguaauuguagaauuuucugaugcuccauggccaucguugcuucuuuguccuccccacuauuucauccgccggcuccugggaggggaggguuccaguucacucggcuaacgugugugaguccgacaguaacgagcaacgcagaccccgggaagaggaacaagaauaggacauuccuauauuuuuauguggagauugauaaucaaggcuaacaauccuggcagaaggugaacaacacauuaaacagaggggaaaagauaauaaaauaucuccugaugcuuaacaaucguuggguggaaacauucccuggaauuauacagcuguugcauuugauggcucauaaagccucaguaaaguccgucaagggccuuuuuucuuggcgagggaccauucuucucaugcgguuaugauagcaucugcuuccugucccuggaagugcacagaauccacagacacuggcagacggaagcaggggaggagcccuacugcagaggcaucuggcccuuugauggcuuuuggguaacuucugaucuacagggcaucguaucaaaaugcagacugagauuuaguggguagccagugagcacuugcuaggugccaggcacuggcuuaggguauuucauuaauccugacaacuaugaggucaguauuaccauuuuuaaaacaauacuauggaaaacagagcccuagacuccuuaagaaacauacccagggcaugcggcugacaaguggcaggcugaaguccccacgccugguagccuuuuuucuguuacugcaaagauggaggaagaggcgagaguugcuuccuguccgugcucuggguacgugugaaaucuugugcaucuucuuauaccggguguucaggcacauguguguugagaagggaugcuguuuuccagaagacucaaaaacaaugauggggguccuaggugacuuacuguuuuaggucgggguccccagaagcagaucuugaugaagugaggauuucucugcaagugauuuauuaagaaugugguccucagggaaacugggaagggaguaaaggaggca

SEQ ID NO: 12990 - RNA, 758658 nt, Homo sapiens
acgugugcgcgcagggcgcaggcgcgcgggucccggcagcccgugagacgcccgcugcuggacgcggguagccgucugaggugccggagcugcgggaggauggagccgcugaagguggaaaaguucgcaaccgccaagaggggaaacgggcugcgcgccgugaccccgcugcgccccggagagcuacucuuccgcucggaucccuuggcguacacggugugcaaggggagucguggcgucgucugcgaccgcugccuucucgggugcguaaggagcgcccucgccuaccugagucgcgagcuguguggggugcuggggaggggggggcgucgggcggccggcagccgcgggacuccugcuggauggggcugcacaggcagcuuggcggugcugccccugacgcgcgugugcccgggggcgggucgcugcugacaggccccgcccggacaccccccuagguugccgcagcggggcugggagggggcccaggcucagccacugccccccaaccugggcugcgguggaaaugggaaagccauugggcagacuugagggggaagcguugugccggggauaauuuugcugggagacgaaaagucugugugcuggacagucuuccuuggugcggcuguggaaaucacacguggcgggcguggggcugggugggagcugggaugaguauaaaucaggcuccccugcagaggccccgccgguaaagcaucaggcuugcagcagguggaagaaucuugaugucuacggugcaccucuguggucuggguuguguguggccuggggauacgaagaggaacgggaccuccucaaagagcugaucaagugagagagagaauuacaguguaccagaagggcugaaauagaggggcaauuaaugugcugugggagcaucagacacgggucccccgugugcugugccauuuaauggcugugcaggcaugucuaacucuuaaccaccauucuagaugcagggauucacgugaagguguuuuggaagccuggacgcgcugugccgguguaaagugcuaugugaaagcaauuuauggaaauguguaacauacaugaauaauaggaacugcauucagucaacaaauauuauugagcuucugugugcgaggaagaagaguucuauuuugagaugagugcgaugauuuugugcauggccgcuuuucagaccugccagucugagauuuagguggguggaggugggacgguaagugcaaaacucguaucuguaauuugaccauuguucuuacuuuguucucauuugauucauaauucaggaauaugacuuugcauuuuagagcuaccaaauaauaauuuugucuguugcuuucugaaguaaugauaacagcgaaaacaucuguucgggagagagcagcaucuugaaguuuuuguaaacugugugguugaaaacaauucguuccuuucaagauaguucuuggaacagaaaaguuuuggaaugaauaaauggugacaaauuggcaauugaaucauuagagcugaaguugagucuugugacacacggaauugugcauuuccaaaauaagcuacacaaacccuuugugggugggaugcuuguugauuuaccauacuauuucauuagucucauucauuuuuccuguuugcaguaacuggggauuuaagcaaaaaaggaauuuaaugaaagaguuuugggggaguucucaguguugcuuuaaagucugccaagacuugacugggcaucggcugaaccaaguuaggauugcacugcaaaaguagcuggggcugggaucugggguguauaucacuucugucgccugauaauauuggauucugcaguagguaccacgaacaccauagacacuggacccuggugcugcugcugcugcugcuccuugggaaacucacuguugcuggagagugauucucucaaccauucuucuuugugauacuggcuuuuauucaaaguccucagugagugucuuggauuggcuaaacuuaggucacugccugcaccccuagcgcgagggagguugagacgguauuuagccuuuuuggcuuuuaagauagaaggcaggcucacucuacuucccaccgauaguuauccaguggggaaaucagcaaacauaaacauagaaaaagggauauaaguaaaugcuaagcaucuaaacaaaacaagcuaaacagauucuucauaaugacugacaaauacuuacuaguauuuuacacagacacaaaauauuugcacuuacuuuggauugccaggauacacaguucacuuguguugugguaguaguugcucuguuugaacacucccauuuuagugguuauaguguuccaaagagccugguugggaaucacugcaaccugaaaauaguguuagggaaauguuagcgcauuguuugaugcaguuuucugccacuguugaaugccuguccuugagggauaaguuucuguauuacuugucaucuuguaaguaaaauuuguuucucuuuauucacuguccauugugaagucuuuaagaauagugcaucuuucaguuuuuguagccccagugucuaacacauaguaagcccuuaguuuuaguaugaaugucuggcagaauuuuccuccuaacugccccuguccuucugcugccuuccaucugaauuaaguauggaaugaaaauguuaguuuguagcaauuaacaguuacaugggaaaggaaaaaucaaaauagaauuaaaaaaacagauauugaugauaauuacagucaugcacugcauaacgacauuuuggucagcgaaagaccagauacaugacaguggcccuguaugauuauaucauuuuuuaacuguacuuuuucuguguuuagguacauuuagauacacaaauacuuaccauuguuuuacaguuaccuacaguauucaguacaguaacacgcggugcagguuuauagccucagagcaguaggcaguacagacaauaccugcuagccuagguguguagcaggcuguauguacagucuggguuugugugaggauacaccaugauguuccuacaacaaugaaaucaccucaugauguccuuaagggaugcacaucucuacuuccuuaggcuccagaaacaaugguuaccaaguuuuacaugauuuccuuugcucuagagcuguuuugauuaguagcuuuaguucuguauacuuguuuuuguuaauggagaaaggugaaccugcuucauggcuuaucuuaccuuuuuccucucauuaaggaauggcuucugguuuuuccguguugugccuggaaaagaaaaugaaguauguaaguuguagaaagaguaaauggcaaugaaauuauaaccugaaaucacuuuuuuuuuuuuuuuuuuuuuuuuaagauggaguuuugcucuuguugcccaggcuggagugcaauggugugaucuuggcucaccacaaccuccgccucccaggugcaagcgauucuccugccucagccuccuuaauagcuuggauuacagaccacgccuggcuaauuuuuguauuuuuaguagagaugggguuucaccauguuagucaggcuggucucaaacuccugaccucaggugaucuacccgccucagccuccuuaagugcugggauuacaggcgugagccgcuguccccggccugaaaucacuuauauuguccuucugccguugcaugcauuuuuaauuugauggagguagaacagguugguugacaauuggguaugaguuauguguauuucccguuugcuuuggugagugcagcacauaaaauuccauuguuaugauuguauuuguaaaccuucucacucccuaguguagugcucuaagucuaaucuuuuuuauauccccagggccuaccacaugggagauguuaaucauucaaggauuaauauuuuggggaacuugaagucgcuguauguuugucuuugguuuucucaaguuccaaguugccugcagcuuccauaucaagaguuacuucuggcaaacucuaaugauaguuucuucuguaggguaaagagaauagcucaucuggcauuaaggcugagaaugaggcuuagugccucccaggaggaaggaggaugacuuggaaguagacgugucaucccuuucaguccugguggauugugggcagcggggggacagagguagggaaaacagauugugagaaauauguguucugaucuuucuuggcuggcuaaaguucuaggguuaggguggggauguuaaauggguugaggggacggucagcaguagaaggccuuuugcucugcuccuuauguggaaucuugagaggagauguuaugcagguuagugauaggccaacacgggccuauagcacagcagugguagaaggaaguggcuagauaguugaguuugugguaccaggggauucugaaaugcucucauaccacugugaaggagguggaggagcuuauuggccugguggaacagcuggcgucaugacaaaagacugugugacuauagacugaaugucaggaucacagacuccagggaugagagccagcaugacauccuaaaagaugagaugggaccaguucagccauaggaccugauuaccuccuugcagcagagaccagugaggauccagagaaacaacacagauccaaggucuucuugccacuauuucuucuaggauguccgauaagaccuuggagggaaaucuacccgaaagcagccauuuaaaccagcccggguaaggaguuaaacaaagucugaguauuaacuggaagagauugagauauuguuugacaaguuuuaaauuuccuggauauuuauuagaguagauauucaugaggaauauuagauuaauuauagaaaaaauggcgcauauucaggagacagauuagaugaguuauagaagauaaagcaggcugggcaugguggcucaugccuguagucccagcacuuugggaggucgaggcagguggaucgcuugagcccauaaguucaagaugagccugugcgacauggcaaaacccugucucuacuaaaaauacaaauaauuaccugggugcaugccuguagucccagcuacucagaaggcugaggugggagaaucaauugagcccaggagguggagguugcagugaguggugaucacgccacugcacuccagccugggugacagagugagacccugucucaaaaaaaaagaaaaaaaaaaaggcagcugcauuugaguugcagugugaguaaaugugaccaggcaauaaaggguaauaacucacuguguuuggugagaugauggaaugucucuuggccaaggacugaaccugggguggagauggaagggaacaucuucauauaugaggguaagaagaagaggugccagaaaaggcaacagcaguggugauugaaaaguuuaaggaccgcuagggaagugguugcuaagugacucagccuuaggagagauuggaaauagucuucuaggagagaagcauaaauugccucgugaaauguaggauuguugaaaagugcugagggucuacuuaaaacuuguguuuguuuauuuaaagugggaacaguuaguugggucauguuuccuuucucucccaauugccagcugcuuggcuaugagaacuggauuuaccuaggauugcuagguuagcaugauggacggagagaggggacgggaaguugaaguuguaggcaagggaggguguaauuguggaucaugguuucucagguagggaaugaggucguaaggaaggugauggccagugaaauguggccgaaucaauggauuagagguccucauguggucagagaaauggugaguggucagauaauggguugacuugauauguacaugcuuagaaguagugugugucuugauacaacagguacgggguguggcagaauguggccaagguagggaguaagaaaagauuuuuggucaggaaacccaaaggcugagguuaguugaauuaucuaaauaaugaaguuacuaagaauguuagacauuggcaugaauaguuucagcaaaggcagaauucucacauuggcuaaaauaacccaagguuuaagggucaguagaguagaagaggcuaguggagacaaggaagcacuuaccucugugaaaauaauguaaaaagacguuacuggguuuacggcugauuuuguaaaauaugguuagcaccaggcguaagugaauugcugcaguguuacagacucuuccuuggaggcccugaaggucaagcaacuagcaaaaucauuucaaagagcagaaccuugaacgauggcuugaaguaggauuugcaacuuccugggcaguggcuaaugggucuaggauuugaaauaagguggaagaauugauaauaaugugguuugggaaaggacuuuauggaugugacuacauuuuucuuuuuaagugggagucauaauuccuguuucuucuacugcuuccuuuucuucuguaacgagguuugggaaagggcuuuauggcugagcccuggugaaaacauuugguccaugugaaugccacagcagagggcguucuuaaucagacaggaugaccugcuuuguggauagcaguaaguuguucuucagacagccuggugcuugcucaaaaggcucaagaacagagcaaccauggggacggggauagaggcuggugccuggaacucaacaauacagacuuccccucaugauagccauguggcuucugcugguacagagugcccaguuugcugccaguaguaacugguccugauuccccaaauggcaacacaucuucaggaccagccagccaccuugugucggguuauuaugguagaacuuuuugucauggaggagucaguuggaauaucaauuuuuuuccuguacuuggauuugucuucccuguguguaauaccaccaucucuaagauccacugagaaucuuugauagagcugugauauuccccacaagguugccucugaccuucccagaaagaauuagagcaaugggcuaaugcuugugguuuugacuguuuauguuugccgauuuccucauuggaagacuauuggugggauguagaccaagucugccuucuaucgaaaaagccaaaaaggcuaaauaccuucucaaccucccuugcagcuagggugcgggcagugaccuaaguucggucaaucuaagaugcucucugaggacuuugaauaaaagccaguaucacaaagaagaaugguugagagaaucacucuccagcaacaaccaguuucccaaggagcagcagcagcagcagggcccagugucuguggugaugguagugcagaauccagcauuaucaggcaacagaagcgauacaguccccagccccagccccugcucuuaacauacucuggcauuuaaggcagcugguguuauagaccagugguucucagaccuuuuagucucaggaccccuuuauccuuuuacaaauuaucaaaauggauuugauagggauuuaaaaaacguuauugagagugcugaugauguuuuguuuauguggguuuuaucuauuuauauuuauugcauaaaaauuaaaacuaaguuuugaaaauaccuauuuaaacauaaauuuaaggcagggcgugguggcucacaccuguaauuccagcacuuugggaggccgaggugggcagaucacaugagcccaggaguuugagaccagccuggccaacguagcgaaaccccgucucuacuaaaaauacaaaaauuagccagaugugguggugcaugccuguaaucaagcuacuuuggaggcugaggcaggagaaucgcuugcaccugggagguggaggcugcagugagcugagacugcgccacugcacuccagccugggugacacagugagacccugccuccaaaaaauacccaacaacaacaaaacaacaauaacaaaaauauauauauguguguguguguguguguguguguauauuugaugguuugguuacuuaaaaaauuguuacauauauguaaauuuauuauguuguaacaauuuuuuaaggaaucaaacuauauuuucuuuuuuugagauagagucucgcuuuguugcccaggcuggagugcagugguacaaucucggcucacugcaaccucugccuccuggguucaagcgauuguccugccucagucccccgaauagcugggacuauaggcccguguguauuuuuuaaaacaacgaaaauuuaaugagaauugcauugcuuuacauuuuuuucaugucucucuaaagucuggcuuaaucaagugguggcuuacaccuguaaucccagugcuuuguuaggacgaggugggaggaucauuugaggccaggagcucacaaccaccuugggcaacauagggaaacuucaucuuguuaaaaaaaaaaacaaaaaauuaucugggugggauggugugcacccuuguaaucacaguuacuugggaggcugaggugggaggaucacuugagccuaggaggucaaggcugcagugagccaugaucgugccacuggacuccagccugggggguauaagcauucagaccguagcgucugguucaucuuauauuuuuucuuuuuaagauaagcaaguauauauguguguucuuuuuuuuuuuuuuuuuugagacggagucuugcucuguugcccaggcuaaagugcaguggugcgaucucggcucacugccagcuccgucucccagguucacacuauucuccugccucagccucccgaguagcugggacuacaggcacccgccaucacgccuggcuaauuuuuuguauuuuuaguagagacaggguuucaccauuagccaggauggucucgaucuccugaccucgugauccacccgccucggccucccaaagugcugggauuacaggcgugagccacugugcccggccuauauguguguucuuauuuuccauucuuaguuuugcacuugcuucauuaucuuugugucuacuggaaaucacucuacuaucaguucauggagaucuuccuuauucguuauagcuccauaaugcucaauuuuauguauccacuguacuuucuaauuuccuauguguggauauuuaggcaauuuccaguauuuugcaauugugcauauugcucuaaugaauaaccuugcauguguguauuuuuauauuguugcugguguaucuucaggguagauuccucaaaaugggauuucugggucaagguguaaauaccuaugugggguuguaccauuuugcauucccacuaaugauguaugugaguacuuguuucccuuagcuuugcagccugaacuuuugaauuuuugcuaagcuuaugggugagaagugggaucuuaguauaguuuuaauuugcauuuaaauugcauuaugggugaaguuaaacaucuuuucauguguuuaaaggccauauuuauaucuuuuugugauuugucuguauuuaucuuuugcucauuuuucuuguuuuuuccuuuucuuuuuuuuuuuccucuagagacuggggucucccuguguuacccaggcuguaaugcagugguuugaucauaggucacugcagccuugaauuccugggcucaagugauccucccuccucagccuccagaauuuucugagcagcugagaccacaggcgugcaacaucauacccagcuaauuaaaagaaaauuuuuuuuuagagaugagaucucccuaggaggcuguccucccacucacuuugagauucuuuuggggguucucugauuugauuuuacauuuaacuguauaugcuaccaucuguagcaccucguagaucaaguuucagaugauuuuccauuucuaucugggaguuccccauuaucucuuaaucagaugugaugcucccucugguggacaauggaguaaaaagcauacaaauauuuuucagaaaggcaacuuauuuuuuagccacuaaaacacugucucugaguggucuccuucaugaacccccuuuccaaacuguucuuagccucugacauuugccauuaacucuuauuuugaauuagaccaaaaaagggcaaacaaguuaaauuuugucauaaauaucuauauaaaacucacuaaugaaauuuacaugguauaguggcuuauugaugaugaccauguuuuucacaauaagagucgaaaccuauguuugaaacuaguaguuuuacuuggaguugguaugaucuggagggaaaauugugcuuguugaucuccuuacaguuuauuacuacaagaagauucuguguaaaugaguuuuuccccuaguuuuugacauaauaauuacuuguuaguauagaaaaaauaaaggccacuugugggauaaccuuguguuuuauaucucauucuacuauuugaaaagugaaaauggacagagccauuacuaguuguuuaaauauaguacaaucaagaauguuuccuuuuuaaaguuuacuuguugccaguuuacuguuuuauacacggccuauucauguuuaguuuuaaacauuuaaaagcauuuauaacaguaggcuaauauugaucuuuuuguuuguuuguuugagacagagucucacucugucacccaggcuggagugcaguggugugcuccuggcucacugcagccucaaccuccuggcugaagucauccuccuaccucagccuugaguagcugggaccacaggcaugcaccaccaugcccggcuaauuuuuauauuuuuuguagagaugggguuucaccauguugcccagccuggucuugaacuccugggcucaagcaauucaccugcaucggccucccaaagugcugggacuacaggcaugagcuaccgcaucuggccaauacugauuuuuaaaauucauuacuuggguugagaauuauaauguaagcaaguccucuuuuuguuguucuuauagcauuugcagcaaaaauaaauaagagcaaccacaaggggauaagauagauugauagacugggcagauuugaauauauaaaaguuaaaaacauccuuauguuaaugaaccaucuuauaaugaaaaaaaucaagaaacuggccaggcgugguggcucacgccuguaaucccagcaccuugggaggcugagacgggcagaucacgaggucaagagauagagaccauccuggccaacauggugaaaucccaucucuacuaaaaauacaaaauuagccgggcgugguggugugcgccuguaaucccaaccacuugggaggcugaggcaggagaaucgcuugaacccgggaggcagagguuacggggaguugagaucaugccacugcacuccagccuggcgacagagugagacuccauaucaaaacaauaacaacaacaacaacaaaaaaucaagaaacugacgaaaauauuucaacauaaaaaggaauauuauuauuauuauuauuauuuuuugaggugaagucucacugucacccaggcuggaguacaguggcaugaucugagcucacugcagccuucgccucccagguucaagcaauucugccaccuaagccgccuaccuccgcccucugaguagcugggaccacagaugcgugccaccaccccuggcuaauuuuuuuuuuuuauuugguauuuuugguagagaugggguuuugccauuuacucaggcuggucuugaucuccugagcucaagugaucccccugccuuggccucccaaagugcugggauuacaggugugagucacucgcauggccaaaaaguguauauuuguaauauguaaaaauuguucauaaacugauaagagaaagcaacuuacuucugaaguaacuaacuaguucuugggacuuuuucccucuuuguguuugucuuugaacagcucucaucuuuagauuuccuuugagaaauucccuuguaacucguugguucucgacauuggcuacacauugaaagcacucggggagauuuaagaaaugcuggugcauggguccugcccucagagauucucauuuaauuugucuggaguguggcuggagcauagaccuuuuuuuuuuuuuuuuuuuuuuuugagacggagucuugcucugucacccaggcuggagugcaguggcaugaucucggcucacagcaagcuccgccucccggguucaugccauucuccugccucagccucccgaguagcugggacuacaggcgcccgccaccacgccuggcuaauuuuuuguauuuuuaguagagaugggguuucaccguguuagccaggauggucucgaucuccugaccucgugauccacccgccuuggccucccaaagugcugggauuacaggcgugagccaccgcgcccggcagagcauagacauuuuuaauacuccccagauuauuauagagcagucuggguugacagcuccuaucuuucuuuuccaucuucacugacucccugcuucucugugccuuuauauccaagggcuaagguaaaauugccacagcugggauuaguccaacugcuuauaauaucuauaaauaauucugcauguucaguuuuaaacuggacauugacauuagcauguucuguuuacauuuaaauaauugucauagguaggacaaacaggaauuauguugaauuuuuaauuggcaugguuaugauagauguuucucacaaaugaauuugaguauauaaaaauuuaauccuuguuagcauuuuuuagcugcuguguuuacgucuuguuagaaaguagauguuaauuggaaagauuuauguuguaccaaugaucaagaaaccuuggguaguagguaacaguuucucugggcaguuuaauuuuugaguuuuugacucuaauauuggaugcucaguuuuaguggugaaaacuuaagcaucuuacaaaaagacuuacuuaaaaucuaugaaucauugguauuuuacacauuuaccuguggaauuuaaaaauauccagaugucugagcaacauccuuaagggucccauaauuguuuaaagcuucacagguaaugcuaaugcauagccagaguugagaaccuuugggaaaggaauaaaaaaaaagucaugauaccagugaaauaagugguagagauaacaacuauggaggaauaacuaauugggaaaugugcauacauuguuuaguagaccauuaugacugcagcgaagugcuguuuguauagaugauagauuauaaguugggauagcgucugugauacagaaggccuugcugagguuaagagauuuugaacuuuauuuucuagguacaacucuugaggagcccauagagauuuuugggcugcaguaugaggugcacauggaagauuuguguaggaguccugauuugggugaauuuugugaugagggagagaaguggaaagacuggagaugaggauuccaguuaggagaaaaugugcguuauucuagaugugaagugaugaaggccugagcuaggggacugguagagggccuggaaccaaacauguugaggaguucacccacguuguugaccgauuaaagggcaaggaagcagugaagggugagugcuggguuuugagcuagaacuauuggaauaguggugacaguacugcucuguggugaagggugagugcuggguuuugagcuggaacuauuggaauaguggugacaguacugcucuguggugaagggugagugcuggguuuugagcuggaacuauuggaauaguggugacaguagugcucuguggugaagggugagugcuggguuuugaacuauuggaauaguggugauacuacugcucugugaagucauuggugugagugugaucucccaguaguaaguuaggcagcaaaagauagcauugcugaggaucaagcuuaagagaaaaagcuucucaggauugggagaccauagaagaccuccauaaauggguuaauagugccccuuuuuggccuaguuuuuacugccuggguaaguaggguaaguaaguuaaucugagucucaguuuugccuuuuugaaaugaagguauugagugauuucugacauccuuuuuaaguuuucugcaguuuuagaaaccauuuauguauuugcuacagcugccuccuccuacuccucuuucuuuuuauuuauuuauuuuuucagagagacaaggucucacuauguuguccaggcuggccucaaacuccuggccucaagugauccuccuaccucagccccccucuccucccccccaguagcuaggacuacagaccaaugugccuggccaccuccuccuuuuuuuguaacagcuuuauugagauauaacucauauaccauaccauuugccuauuuaaagugauauaaaguaacauuaacuuuacccuuuuauuuauuuaaguguacccuucgguggcauuaaguacauacuaauaucaccauaaucaacuuuagaaaauucuuaucacccacaaaagaaacaauguaccuuaaggcugucuuccacuguaauuaaacagaggaaaacauaaggauuaaacccuugaauugaggcuuuaccauguaccugccuugugaauuuacagggccaguuagaaaucccuuccaguucaaaccggcuccuugcagugcugacccacgagguggcagugugggaacacuaggaaggaaaagggcuggaggaauccaccucuauauuuagaaacaggcuguacacaguuaacaucuauuuguagugguacauguaguuguuauccaggcauccucagaggaucauagauugaaagucuccuagcugaagauuuugcuaaugcagaguaguggccuuacuuguuggucauguuuccuagucaucuaaaccuguguuaaccuucuugccugguuucuaucguuuguuaaauagugacucuuucaucauuuaaaugacucuugcugugucugggaaucgucugucuagucuuucagccauuuuuuguuucucgcuuaccuuuuugccccaguacuuucuugggucccuuucuacccuauccaucguuuguccuuuuuccuccuagucaggagccaucggcguucucugagauaccgguucuuagcuuuagcugcacacuggaaucaccuggggagcuuggaaaaauccugaugccuaggcuacacucaguacugaucgaaucagagccuuuggaggugggacgcaggcaucauuauuuuuuaaucucuaauuaccuacuaaauauuuuucugucaucaucuuuuauucagucugaaaaacauggacuaauuuaacuagauuaaauaaaaauauagauuuuaaauauuauagauuagauuuauaauauuucaguuggaugcuauccacucaagcgauguaugagucucaacuuuuucucuugaauugccuacuaacaguuuuuuuuauucuuacuuggaaaugucacuuauauugcuuucuuucuucuauuccuacugccaccauccuagaacaggcucuagcuuuaguuccugccguccagccagggagcacaucgguaguugaacagaguugcguucagacaugauuacagaguggucuuguuuucguuuugauccaucacggucacagaguggccuugucugagguccauguucugugaaauuguguauguucaacagaaggacaccagugccucccugugagggccuggccagcuuggagcaacaccugccuaccugauaguaucggucaguuccugcagcuccucucuagaggaccgaugguaucagccaggggcagcuccucucuagagcugugucuuaguugauuauaucuguuugcagauccucccuacugcaaucuguucuaugaaguguugccauauuaguagucuuccuuaaauaugccuuuaaugacugauucuuauuucucucucuuuuuuuuuuuuuuuuauuugagacgaaguuucgcucuuguugccgaggcuggagugcaauggugcgaucucggcucacugccaccuccaccuccuggguucaagcgauucuccugcuucagccuccccgcuagcuggaauuaccgguguccgcuaccaugcuuagcuaauuuuuuuguauuuuuaguacagacggaguuuugccauguuggccaggcuggucuugaacuccugaccuuagguaauaugccugccucggccucccagagugcugggauuacaggcgugauccaccgcgcccggcugacagauucuuauuucaucaagcauaacuagugguccuuucuaaucuggcccaacucuggccagcuuuauuucccaguguauccuguguuuuagucugacuggucucagugccuugugaaccggucauacuuacucucacuuuggugcuuucccuugucuuauccucuuuaugaguuaugugaguuggggcaaacuacuuaacagcucugaacuuuguuuucuuaaucuugaacccugccucuucagauuauccucagaauuaaaagagauaaaacauguggaaguauuuuguguauaacagguacucauacuuaauacguguucuuuccuugcucuacuuaguucucauugauugaucuuuuuaaaagaccauuuauuuauuuaauuugagacagggucucacucuguugcccaggcuggggugcaguggcaugaucauggcucacugcagccuugacuucccagacucaaacgauccucccaccucagccuccagaauagcugggaacacaggugccugccacuauaccuggcuaauuuuuuaauuguuuguagaaacagagucucacuguguugcccagacugaucuccugggcucaagcaguccucuccccuuggccucccaaagugcugggaguauaggugugagccauugaguccagcccucagcgauuggucgguggaauuuagguauuauuauauaauuuaggucuuaauuugguuauuagguuuuauuaguuauuugcccuguggucuuagccuucuugaggacggagaccuugucuuauuuuucugugaaucccaagacccuaguucauugcuaaguacacaaggauguucaauaaaugucucagugacugaaauuugcaggauuaucagagcacucugucugcagauaacaucugagacauuuucugaguauuuuuugaaacugacuccuucucuugauuauuauuaccacucuuaguugguacuacugauuauggaagcuaguaagauuagggucacuggcugaauuauuaguaucaaaucuauaauucuguguagucaccagaaauaguaugucacagcgaauguuuauaggugguuauuuaauucaucuaugaaaaugacuuaagucaggcacaguggcucacgccuauacugccagcacuuugggaggucaaggugagaucacuugagcccagaagcuccagaccagcuuaggcaacacagcgggacccuguccugacaaaaaaaaaaaaaaaaaaaaaggaaaaaauuagcaaggugcgguggucguacuucuagucccagguaguugggaggcugaggcaggaggaucacuugagccugggggguugaggcugcuaugagcugugauuuugucacuccacugggugacagagcgagacucugucucaaaaaaaauaaagacuucaagcucaaauaaugcaaauuuuaagcauaaauaacuucauacaguguacuuucagccucuaccuuggcuuacguacagccuacuacaaacagcugaguugcauuuuaaauauuuaaacaguuauuuauaacuuucaauauuggccuuccacaucucucucucucucugaaugacacaagauauugaagcuuucugaucuauugauacuuuuguuuuuaaugauguuuuagaaugucagcuucuuuauuuagaauacuuugaaaucgcugucgaauagagcaaauuuccuuucuguccuuuuucuuucuccuuaguuguuuaaccuucugccucuuaaacccugggcuucuguuuucucauucauaaaauagggaaauagcuaccucgugaucuucaugaggaguaaaugagacaacacacacaaaaguacuaggauaguaccugaaauauugcauugcuucuuuuucuuuuauuauuuuuuuugagauggagucucgcucugucgcccaggcuggagugcaguggcaugaucucggcucacugcaaccucagccuccgccucccggguucacgccauucuccugccucagccuccugaguagcugggacuacaggcgcccgccaccacgcccggcuaauuuuuuguauuuuuaguagagacggggugucaccauguuagccaggaugaucucaaucucuugaccucgugauccgcccgccucggccucccacagugcugggauuacaggugugaaccaccgcgcccggccugcauugcuucuucagaagugaccuaccauucaccucccucagaaugacuggggagugggagguggagagagagagagaggacuuguuaaaaaucuggcucucagugccucuccggagaauaucuaguguuuuaaggcacagaaucuacauucuugccaagcucccugggugacgcugguacucauaaaauuuugauaccuguuuaccuacaggauggagacgcauuccuuuugcaaucugucuucugucuacuuuauuggucuuauuggcacuaaaguuugaggacacuagggcuaaauccauaguaguuuuauaugaauauuugcagcaguuguaaauaacagccugcuuaaaaucucuauuuuuauuuuuucuuuugagacggagucucacugugucacccaagcuggagugcaguggugcgaucucggcacacugcaaccucugccuccuggguucaagcuauucuccugccucagauuccccaguaccugagacuauaggcaugcaccaccacaccuggcuaauuuuguauuuuuaguggagacaggguuucaccagguugucagggcuggucuugaacuccagaccucaggugaucugcccgccucggccucccaaagugggauuacaggcaugagccaccacgcccagccuaaaucucuguuauuuuuuucugugcuuagcuuggacuuuuucugagcacccuucacuuucuucuguuuuugcuuuuugacugaauuucuugaacuugaccuuucuguaucagagaucuauaguaauaccuuucuucuguuaguuucagucaagauguacaagucaagcuggcagaugauucuagaagucuauuuuaaaaugcccagacuucuuuuuaaugaaauuaccuguguaauaacuaccuuuaauauaauaauuuuucggucacagaucaaauacauggauuuaauuguaguuuggagcccaacuuuuaaugagcaggauuuaaugaaugaggcacuuguggaagaucaguuuauuacgaggucacaugauucauguggccaccaugcauaggaaaugcuaaaagggagggccaggcgugguggcucacaccuguaaucccagcacuuugggaggcugaggcaugcagaucaccugagguugggaguucgagaccagccugacaaacauggaggaacccugucucuacuaaaaauacaaaauuagccgggcuugguggugcaugccuguaaucccagcuacuggggaggcugaagcaggagaaucacuugaacccaggaggcagagguuguggugagcugaggucgcgucauugcacuccagccugggcaacaagagugaaacuccaucucaaaaaaaaaaaaaaaagaucugaguggagccuaaguuagacacugggcaugguuuucugcaguagggugaaauugcuuguaacuauuuuucuuguauuuugagacuucuguuuuuuuacauuuucuuucuauagaugaacacauucuuugauugucuccugguuguuuaggguggugcucacucuuucagguacucagaacauuguaucuuuuaucacauuuaccaccuuguauuuuaacuuuuuuuuuuuccagacagagucuugcucuguugcccaggcuggagugcaguggugcaaucucggcucacugcaaccuccaccuccuggguucaagugauucucuugccuuagccuccugaguagcugggacgaguagcugggauuacaggugcgcaccaccaugccuggcuaauuuuuguauuuuaaguagagaugggguuuggcuauauuggccaggcugguuucaaacuccuggcuucaagugauccacucgcuuggccucccagagugcugggauuacaggcgugagcuaccaugcccaaccauauuucaacuauuugaaccaguaauuauuaaauacuuuuuuuaccuccucuggaagcucuuggaugcagguauugugucuuguaccgucaaugucuacccauucugacuguucuuauuuaaacaaaauucuucaguauaguucuagaccauauuuucuauuaguauagguggguaauuuuauuuauuuuguugucuuggagaccaguggaucuuuugcuuuccuuauauguccaugggccuaccuuuuugaacaguguuaugcuccucuaagucuuaucuccuuucuuuaaauguuguauauuggagaacuauaccauugcuuugaucaucaaugagaaugaguaugaugagugaauuaguuuuuuuggggguggugagauuacuuuuuuugaagaucacuuuuuaauuaguauuauucaucuguuugucuacaugguauacugaaaaauaggacuguacuuggagaaguaagucuuagguuugagcgcugcuuccauuugcuagauuugugaccuugggcaaaucacuuaaucucuuugauuuucauuuucuucaucuacagaaugaaugaaaugggguuauaauuccuaucugugucauaggauuuuagugaagagcaaaugacuuaauccagagcauuauauaaaugugagguauuauaaucuucacacuuaucccugaaauaaauauuuuagagauuaaauaucaauucaagaauuggagugggguuucaauuuuucacuuuuggccuaaaaggucagaaguucagguaguuauuagaugaauaucaccuauacuuggguauggaaucuucuauuauuacccauucuagaggaauuugaaccuguuaauacuuaugucauaucuguuaaggagcuuuguugucagauagauucugguccagguucugaugaugccguuuacuaauuucaugaaccugcaaacugacuagcuaaaccuuaguuuucccauugguaaaaugggguuaacaacaauaauaaaaacaaccuuauaagauuaguuaaaagaacaaaugagauaaucuaugauaaaguguucagcauccagcguaaagccugggauauuauaugugacugauaaguaagcaguaaugauacauuuuacucaguauagaggaggaugauggucaacacuuaaggaauacuugcuuucugucaggaaugaguccaugggcuuuagugugcauuaucucauuuagucuugcaaaaucuucugaggucucucuuuauauuauuccuguuuuacagauaagaaaagugaaguucagagaaguuauaucuugcucaaauuauguagcuaauucugucugcacucagagcccaugaucuuuauuauuauuuuuauuauuauuuugagacagaguguugcucuguugcccaggcuggacugcaguggugugauccuagcccacuacagcuuuggacuccugggcucaagcaaucuuuccaccucagcccaaauagcugggacuacaggcacgaaccaccacccccagcuauuuaaaaaaaauuuuuuuuguagagaugugggggggggucucacuguauugcccaggcugggcuugaacaccuggccucaagugauccucuugcaucagccucccaaaguguuggaauuauaagugugagccgccgcaucuggcuagaucuuuauuauuaaugaagcuuuucauuccuguuggaaacuuuucacaugucaacaguaauuauacauucugugaugcugugaguucauaauaaaaugauauuuaucuuggaaauuggaaaaauguacagacaggauuuuaucuauaaaacucugguaguguguaacuagugcaauaguuuagguauuuugguugaagugauauguuuucagguguaacuagugcaguaguuuagguauuuugguugaagugauguguuuucagguguaacuagugcaauaguuuagguauuuugguugaggugaugucuuuucagguguaacuagugcaauaguuuagguauuuugguugaagucauguguuuucagguguaacuagugcaguaguuuagguauuuugguugaggcgauguguuuucagguguaacuagugcaguaguuuagguauuuugguugaggcgauguguuuucagguguaacuagugcaguaguuuagguauuuugguugaggcgauguguuuucagguguaacuagugcaguaguuuagguauuuugguugaggcgauguguuuucagguguaacuagugcaguaguuuagguauuuugguugaagugauguguuuucagguguaacuagugcaguaguuuagguauuuugguugaagugauguguuuucagguguaacuaguacaaugguuuagguauuuugguugaagugauguguuuucagguguaacuagugcaaugguuuagguauuuugguugaagugauguguuuuuagguguaacuagugcaaugguuuagguauuuugguugaagugauguguuuuuagguguaacuagugcaaugguuuagguauuuugguugaagugauguguuuucagguguaacuagugcaaugguuuagguauuuugguugaagugauguguuuucagguguaacuagugcaaugguuuagguauuuugguugaagugauguguuuucagguguaacuagugcaaugguuuagguauuuugguugaagugauguguuuucagguguaacuagugcaaugguuuagguauuuugguugaagugauguguuuucagguguaacuagugcagugguuuagguauuuugguugaagugauguguuuucagguguaacuagugcagugguuuagguauuuugguugaagugauguguuuuuagguguaacuagugcagugguuuagguauuuugguugaagugauguguuuuuagguguaacuagugcagugguuuagguauuuugguugaagugauguguuuuuagguguaacuagugcaaugguuuagguauuuugguugaagugauguguuuuuagguguaacuagugcaaugguuuagguauuuugguugaagugauguguuuuuagguguaacuaguacaaugguuuagguauuuugguugaagugauguguuuuuagguguaacuagugcaaugguuuagguauuuugguugaagugauguguuuuuagguguaacuaguacaauaguuuagguauuuugguugaagugauauguuuuuagguuucacaucuaaggaguugggaguggcaucuguuacaauugugaaaaagcaaugguagauuuauuaaaauauggaacauuauuuggaauuaaccacaaaaugacuuggauuguauuuagauuugcucuccuuuuauuggaaaggucccaaaaagcagagaggaugagagaggagaaagaaugugaaugcucauugcuggucauuuuuuuuuccugugcuaugccaucuuaauuguucauagcucuucucuuuuaagaaagcuuaugugagagccacaauuguaucagagaacauuauuacauaauuauacagccuucccuuucccuuaaaugguccuuuaaggcuuuacaucugcaauagagauagcuuagugaauauucuuccaaauaaguuuuuuuaguuucauuuuuagauuagccuuuuguauuugcguaaaacagugcuuuugguaaauguuguguauuuaaggggaagaacaggauacuucugggggcugagguaaguguuuugauguuagucucaagacauguuuucaugcuauaaaugauaacuggagcuaaacugauacucugggugucuuaaugguuguucuuuucauugccauuuuaguaugacucauuauguaaugcucuuuaauguuuugcuugaauuaaugugaauguuuuaugagaaugccugauuucaaggacuuaucaacagcuuaacucuuaauguucaggcacaucaauugaaauauacauaucaucgagggggaagucauccuuuaccuuuaacuuggucacuuaaaaaggaacauuuuuagaggagaucgucuggguacaguagaaaauuaguuuuguuguuaugaacaguaaauccuuucuaagucugcagcugggcuuuguuuagguucaagagaggggcaaugagcucaaccuggugcuguaaggacauauggucuaagucagaagaaaccugaaauuuggguuaacuaguuucauccccuugagagaucugcauauaacuguagacucuggggaaucagaggcuccuuggucugcccuugucuguggagcaguguuugccucuuucuauccccaacugcugguuucccaggaucuuguuggacguuuccccuacugagaaguauauggccuugauuucccuguaucugaaacuggagcacuuuguguuuuuuaucguaucuuauguuuauaaaacauauggaacuuguuaccuuaguuuuauuggccaaaauuauaugucuuuuaguucaggggcuggcccuucuuuagaagaaagcacuugacugagauugccuagcuguuuaucccgcuguaugugcagggagguguacuggcaccucugagugagagcuguggagagcccaccaugacugcuaaucugcaguuagggagaggguuugaacuuggcccugacguaggccaggaaaggcgacagaguggcuuucgucaaccauuguaacuguggaaaaaaaaaaucugggguaauaccacuuugugccacaugaugcuuauguaugugauagauguagacacaugauaaaucaauuuauauggggguaagaaguaccaccaucuguaacauugaggauguaucuauaacauugaggauccuaucacuaaggagcacugcuguggcuuucugcauguugcccuuaggugauaaccauuaguguaaagauuauaugcccugggcugacccaccauuuuaccucucauggcaaacugaggaucacuuugauguuagaaguuacggaauuuuuuuuugcuucugagacagggucucgcucuguugcccaggcugguguacaguggcaugaucauggcucacugcaggcuugaccuccugggcuuaaaugacccuccuaccuuagccuucccaguagcugggacuacagguguacaccaccauuccuggcuaauuuuguuuauuuuuaguagagaaagggucucauuauguugcccaggcuggucuugaacuccaggacucgagugauccuccugcuuuggccucccaaagugcugggauugcaagugugagccauuacacccagccagaaguuauggaauuuuuuugaaccccuguauuaagguucuccagagaaaccaguagaguauugaucgaucgaucgaucucucucucucuauauauauauaucuucuauggauacacauaaucauauaugaucauauauauacucauaucaguucauauauauauaaucauauaugaucauauauacucauauaugaguuuauauauauaauuauauauaugaucauauaugaauauguguauguauguauguauauauguauguguauauauauauauauggagccugagaagucccaugauccguucucugcaaguuagagacccaggaaaguggaguccaauggccugagaaccaggaggauugaugguuuaggucucaguccaagagcaagagaagacugaugucucagcucaaguaaucagagagagagagagagaauucacccuuucuccauucuuuuguucuaauugggcccucacagguuggaugauaucuacuaacauuuaaaagggcaaucugcuuuccucaguucaccaauucaaaugcuauuuuuuuuuccagaaaaacccucauagacacaccaaaaaauaauguuuaaccacauaucugggcaucuuguggcccagucauguuuacaugugaaaucaaccauuacagaucugcagaaggaagauggcauauugaagguauuuggaacagauuaauuacaucuauagucuauguguauugcucuuucucuguuaguuauuauagaacuugagaucuaaagagaucuuuuggaugggcacaguggcuguaaucccagcacuuugggaagccaagguggacggaucacuugaggccaggaguuugagaucagccuggccaauauugugauacccugucucuacuaaaaauacaaaaaauuagcugggugugguggcacacgccuguaaucccagcugcuugagaggcugaggcaggagaaucgcuugaaccugggaggcugagguugcagugagccgagauugcaccacuguacuccauucagccugggugacagagcaagacucugucucaaaaaagaaaaaaaaaagaucuuuugaaaaaagguaacuuggauaauugcauugagauuuacuuucauuuugucagaaggacccaaaauagcauaguggaagggaaugggggauugauuacuauguuuucuauggauacucauugcugguaaaaauuauuuuugcuguacagugacauuuuguaagggagcagacguaagagccaccguugugucagauaauguaguuauaucuuuuccccuuucucucggaauaggaacuagaugugucugaauagagagguguuuguuaaucuaaccuucuaagguauuugaaacauuuuaauauaguaaaaaaaaguugauaauuauggaaauugguugaugaguacaugagagugcauuaugcuuuacuucuuuguauguuuuaguguuuuguuacagaaaauguucaauuaaaaguacuuuaaauacgugugacagaaacucacacauggagucucaggagcccgacuucucuuuuuaaaaugaaagagccuggguguguuggcucacuccuguaaucccaacgcuuugggaggccaaggcaggaggaucacuugaggccaggauggucaacauggugugagacccugucuuuaaaacaaggcagacacaacucugugaauguaaaaugguugcauuguacacuuuaaguggguuacuuuuauuguuugcaaauuauagcucuaugaagcuguuauaaaaacuaaaaagaaauuaaaaaaagauccuugaacuucuuuuagugauaccuaaaaauacacaggcugaauccaaacaagggucgggggaguaguuucugacccaccugaugcuaaacaauuuuuucaguauuuguugcgauauuuaaugugagacuuuacaugccacuguuguugguacugaagauacagcagauauuuaaugugagacuuuacgugccagccacuguuguugguacugaagauacagcagagaaccacaacagacaaaaaucccugcucugggcugggugccgugacucaagccuguaauccuagcauuuugggaggcugaggugggaggauugcuugagcccaggaguucacgaccagccugggcaauauauugagaccuuggcucuacaaaaauuuuaaaaacuagcugagugugguggcacacaccuguaguuccagcuacuugggaggcugaggugggaggaucacuugagucuaggaggcagagguugcaaugagcugagauugcgccacugcacuccagcguggguggcagagcaagacccugucucaaaaaaaaaaaaaaaaaaaaaaaucccgcuuuuugacacaugccaaacacaucacgugcauuuuaacaccuaauccacaaugccuagcaggaugccaguggcaagauguaaucucaacaaaaguguauuaaaugaacaaccucguaaauuaagugcuauuuuuauacucauuuggcaguuaaagugacugaggcuuaaagagguuacuugacccaggucacacagcugugagugacagagcuggaucuggaaccaggucuucuagcccucauuccuggaguaugaaccaugaucuuguaccagcuccaggacagaggacagguguaacuauaugagcacuuaaugcacuagcuccgggacagaggacagguuuacauauaugagcacuuguguaccagcuccaggacagaggacagguguacauauaugagcacuuauguaccagcuccaggacagaggacaggugugcauauaugagcacuuauguaucagcuccaggacagaggacagguguacauauaugagcacuuauguaucagcuccaggacagaggacaggugugcauauaugagcacuuauguaccagcuccaggacggaggacagguguacauauacgagcacuuauguaccagcuccaggacggaggacaggugugcauauaugagcacuuauguaccagcuccaggacggaggacaggugugcauauaugagcacuuauguaccagcuccaggacggaggacagguguacauauaugagcacuuacguaccagcuccagauggaggacaggugugcauauaugagcacuuacguaccagcuccaggacggaggacaggugugcauauaugagcacuuacguaccagcuccaggacggaggacagauguacauauaugagcacuuacguaccagcuccaggacagaggacaggugugcauauaugagcacuuauguaccagcuccaggacagaggacaggugugcauauaugagcacuuauguaccagcuccaggacagaggacaggugugcauauaugagcaccuauguaccagcuccaggacagaggacaggugugcauauaugagcacuuauguaccagcuccaggacagaggacaggugugcauauaugagcacuuauguaccagcuccaggacagaggacaggugugcauauaugagcacuuaugugugcauagaccagugcuuucucaccuccugacucuguuacacagaguauccuuaguauuuacuucuacuuuuaggugacuguccaaagaugcagugaaaucuccuaucauuuaaagcaucaguuguagaaacucuuauugugguuuagguuagguuaguuaauuuuuuuaaauuguuuuggucuuuagucuugaucgugucauaauguuagguaaaauguaacuggguaccuagccacauauguucucaguagguccucaacagauguuuguuaguaugaagacugggaggaccuuagaagcaaauucucucagucaucuuugcccuuaucuacauauguauuaauauuucuuggguuagcugagacugacuuuuauguuuauuuccuagcuaguugauauuuaauaguugguugucuuaguaccaguaguguagacgcagguggcuuuugugcugcaguagaguuauaggcuucuuuaaauuacagauucauucugagagugugggaaauacuuguuaccucaguuaagcagucaguaacuccacaggccguauauggcucacaggagaagcccugggcauuggagucugauagagcuggacucaaauucugauuuuuccaguuacuaggugauucaauaaguuguguaaauuccaugagcuuuaauuuucccuuuuauaaaaaugguucuauaauaucuauugcuguaacuauguaauugaauuuacuacauguaaaacaaagaacuaugacauaguaaguuuagauaaaucugcccguaggucacacagucacuaaaggugaauguaaacccaggucugccuaauugcaaagccugcaccuacuuucagguaggugugcuauaaaugauauuucccuucuaaacuugucucagguaguuucucuagguuuucaaaaacaguguuagaauauagucguguuaagagaugauuuuaguauguauguguguuuuuuucugacaucaugguacccguuggagaaagcuauuauaguaauuagguaucaguaagacuaaauguuaauuuuaaaaccuaacaaauucauugauuauauuuaucuaaguaucuuauaaggugggaaaauaggaugcauacacaaagaaaacucugaauaguccuuaaaagggagugugcaagaaaguuuuuagaaauagcuugaauuugagaaagagaaaugagguuuaaguuuaauaggaauuaaacauuuuaauuuuggucuagauugaaagaagaaaauugguuucaauucacaucagagaugucuuuaaaugucaggucugaaucauguuguuuucaauagagaagcaugacuaguuggaacaauuucuuucucuaaucccuccuuuaaaaaguugcugagcuagaguguuccagagacaagcugucuuuuacagguuuuugugacguauuugauaauugaauagucaagaguuuugugucuuacuugauguauuuguuuuuacauguaauuuuuagucaaaugccaacuggaaaagcuugucugcaaaaaagaaaaaguuguuuucuucucuguguuuguauggggacaggaagaaauaggcuuuuguccuuagacuagaaaaauaaggacauugaacaaaucaaguucuuuuuaguugggucuugaauuuuauuguaaauugaaagucuucauauagguugaaagcagccccuugguucuguauuugaauugcagauauaauugccucuuugcuuagauuguuaggaucugaguuaaauaucaccccuuucuugaugcuuaguuggguagcagggcaaagugguuuacagucuuguuacuuaaaauacagucuguggaccagcagcaucaguguaacuaaaugauuuuggaaauguaaaaucucaggcccagucuuagaccaacuuaacucagaaucuacauuuuaacaagaucuccaggugaugugcaugccuauuaaagcccgagaggcauagaggcguggauuggacuggcccguggagccaguuuaaauccugaaucugagacuuacuaacuuugugacauugggcaaguaauuuaaccucugcaucucaguuuccuuaacuguaaaacagugacgaugaugguacguuugcaauguuuagaggaguucguaggaaguacuccauuagaauuaccuagauauuuuuaaaauauagaguacacuguauacuuugauguguaauuauagaauaaaauguccauauucauuagaaugaacauuacaauuuguugguaaagugaaagaaaaauagcuuuaggaucauauacugucauuaucuuucugaacuguauuucuauauuaccugucauagaauaacaaaaucuagauagcuuauaaccuuugcuuugagugugaauaaaaucuauuuuagcuauugcuucaaaguaaaaacuuggcuggacgugguggcucacgccuguaauacuagcacuuuugguggccagggugggugaauugcuugagcucaggaguuugagaucagccugagcuaauggugaaacccugucucuaccaaaaauaugaaaaauuagccugguguguuggugcaugccuguagucucagcuacucgggaggcugaggcgggaggauugcuugagccuaggagguggagguugcagugagccgagauugugccacuggucuccacucugggcaauacaaugagacagagucuugcucugucgcucaggcuggagugcaguggugugaucucgacucaaugcaaccucugccucccugguucaagcgauccucuugccucaguuucccgaguagcugggacuacaggcacgcgccaucaugcccggcuauuuuuuuuuguauuuuuaguagaggugguguuucaccauguuggccaggcuggucucgaauucccgaccucaaaugauccaccuaccucagccucccaaagugcugugauuacaggugugagccauggcugccggccaaaaaguacaaacuuuuuuuuuuuuuuuuuucugagacagucucucgcuguguugcccaggcuggaaugcaguggugggcucucggcucacugcaaccuccucuuccggguucaagcaguucucccucagucucccaaguagcugggauuacaggcgccugccaccaugccuggcuaauuuuuuguguuuuagucgacagggguuugauagggaugggguuuugccauguuggucaggguggucacgaacuccuggccacaggugauccaccuaccucagcaucucaaagugcugggauuacagaugugagccaccgcgcccgaccaaguacaaacuuuuuaaugcgccacaaaucacugugagguuguaguuggggauuugaccaucuuugccaaaaguaccagaggcgacacccuccuuaaucugauagcacagauaggaccaauuuucuuaguucuuaccaguccuagcuacaaggcucaaagccuuccccuuccugcuacuugacagaauuuccucauacaguagcaacuucuuggaaagugggagggaaggagaaagggagauacuggaaagaaagccagagaaugaccugcagacaauaccacgcccucugucuccugucuccccuuuuccuuccauaaaccuuggaguugcugaccucugcaguaauuguuagaguccuauuuuauauauaguagagauuaaaaacucaauccuuauauuuuguauuucuauacauagaauuuauuugauguuaauaauuguuuagugucaguuuaaaaacaaguagugaaaccucauuacuccugcauuucuuuuuuuuuuuuuuuuuuuuuugagaggggagucuugcccuguuguccagguuggagugcaguggcucaaucuuggcccacugcaacuucugccucccggguucaagcgauucuccugccucagccuccugaguagcugggacuauaggcacgugccaccacgcccagcuaauuuuuuguauuuuugguagagacaggauuucaccguguuagccaggauggucucgaucuccugaucucaugauccacccgccuuggccccgcaaagugcuugcauuaaaggcaugagccaccgcgcccggcccacuucuaaauuucuauaagaacuguuuaaaacugaaugccugucuuaucugugagggauaagacuacagacuucaaaguuuagguaaaagcugaaaacacuccgauguagaauuagaacauuuugaauccuguuccaauuaauuuauuuagauguuaacuauuaguaagcauguuauaggauuagauuaaaaauaaauuguuaauaacuuuugguagguauuauguauggugaauuuaaauggccuagcagauuuuuuuguuaucuuuugaaaauuacaauuucagcuuuauuagugauggagcauuugaaaaguggcuuggguagauggcaacaaucggcugcugcaaaauuuggcaacaaagacaaaccucauuuggucucaugggaaugcuggacaaguacaccugcaggcuuuccccugaggggcagagcauaccucuuuaaaacuuaagucauggaggagugguacccccucgccccaaaaaacaaacucugaagggauugaggcauauguguuccgccucuucucuuauacuguaauaacaguaagucauaauaauaacaauaugucauaaauggcuuuuagaucaccagugcauagcuggguaguugucugucugcuauggugguggggggcaauuuuagcacauuaaaaaguguuuuugaaacccaacaaggccuauuagaaaaucaguaauauuccuagcuagaagcaacugaccuuauaaaauaauguuuuuagaaaaaugguucugaaacaagccuagagugguaauuuacagagcuaguccaaaaacacuuucuucucugagaugagcagaauacuuagcaaaaguaauaaggaaucaaggcauuuuuuuugaauuucaaaauauauaacauaaaaugaauaauaacauaauaaaucagguuuacucuaaauauauucugaacucaaacugcugaagugcuauuuaucuccaagauguagaaccaguuaacuuaauaguuucucguauugccagaaccuaagccauguaaaaagauaaacuaaaacauuaagauaccuaccaaaugagggaaugaaaaagauucauuaggccgggugcagugacucaugccuguaaucccagcacuuugggaggccgaggcagguggaucaccugaggucaggaguucaagacuagccuggccaacauggugaaacccagucucuacuaaaaauacaaaaaucagcugggugugguggcaugugccuguaaucccagcuacuugggaggcugagcaggagaaucacuugaacccgggaggcacagguugcagugagcugagauugcuccacugcaguccagcuucagugacagagugagacucugucucaaaaaaaaaaaaaaaaaaaaaagaaauuugagaguaacugcgggagacucccugaaaugaaauaguuagauaugauugccuuggggagcaggagaaggaagcuuuuuguuuuuucuguuugacuuuuuuuuggagacaggaucuugcucugucacccaggcuggagugcaguagugugaucauggcucgggguagccuugaccucccgagauuaagcgauccuccccuaucagccuccccaguagcugggacuacaggcgcaugccagcaugcccagcuaaguuuuucuguuuuuuguagggacagggucucacucuguugccuaggcuggucucaaacuccugugcccaacugaucugcccgucuuggccucccaaagugcuggggcuacagucaugagccacuaugcccagccuauuugccauuuuaaccauaugguauauauugcuuugauuaaaaauuuaaaaacaaaauaaaauucuaaucuagcagguauagcgaaaaacaaugacaacaaaaaacaacauaguaaaaggugcuuccagcuauuguagaagcauauuccacucauuaaauugcaaaaagggcugccugucacuuuucuguuuucuuuuuuuucuucuuccacaagaucaaaagccucugaugaucauaauuaccuauggcacguucuguaugggugcuaggcggguggauuuguaggagugugguguguguguuuuucugaggccccuuguggcuugugcuggaguguugccuauuuaaccuuugguuuucauuuuuccuuuuuuuuguuuuuuuucaacuuaaagaacaucuggaaucauugaaaaauuaaaaucaaauauuuugguugaaugcuuacaugcuuuuaauggacuuauucagagcauaauacaucacaaguaacaccuacuuuagguuuuuguuccccaagauuggacugauugucuucacuuucuauauuuggguugugcuuccugcuaauuagcuuuuaaaagccacugagauuaggagccaaauuugguaccugcauaguuuuuagccuaguuaacuuaagaaguagucuuucuacauuuuuaucaaacuucuuucuaugcaaauguaaugaucuauuuauagauaagauauaaaguguuuuaaucuuacucaggggaucccugaugagcccaaaaugaaauccgaguggaacaguaagcagagcgccagugcauaauugcugugcuaguugaaguuuuaauccucucauaaaauguuuaucuaugcuuuauaucacauuaauuuuuagaucuucuucacuggaaaguuuauuuuguuaccuugcuuauaugguugaaauuaaagaugacagguuaaugcagucuuauuuuaaaauauggggccaggcaugguggcucacaccuguaaucccagcacuuugggaggccaaggauggggaaucaguugaggccaggauuuugagaccaggcugggcaacauggcaagacccugucucuacaaaaaaacagaauuaacugggaguaguggcaugugccuguagucccugcuacuuaggaggcuuaggcaggaggaucacuugagcccaggaguuggaggcugcagugagccaugaucauacagccgcacuucagccugggggacagcaagaccccaucucuaaaaaaauaaauaaaaauuaaaaaaauuaaaacaucuuuuaaaauuggucaaacugcuuuuaaaaagcuuuauuuuggaauaauuuuaaaauuacagaaaaguuggaagaauaguacagacaacccuuacaugccuuuuaucuaaguaaacaaauuuuaacauuugcucuauuggcuuuaucauauuuauuuauuuccucucuauacacaccaccccccacacacaacacacauacauaaauauuauuuauuuuucuuaacuauuugaggguaggcugcauaccuaaugucucuuuccuuaccacuuuaguguacauuuccuaagaacaaggauauucucuuauauaaccauucuacacuuagucaaauccaaaauacuuaacauucacacaguacuuuugaucucuaguucauuuuuccaauuuugucgauguugcaauaauguccuuuguugcauuuuuuuccuuuaguccaagauccaguguaggauuuuuuuuguguguauguauauauauaugcacauacauaugcacuauauauauacacacauaugcacuguauauauacacauacauacacuauauauauaguguguauauauauaguguguguauauauacacaauguauaguguguguguauauauauaguguguauauauaguguauguauguguauauauuauauauauauauauuuuuuuuuuuaauuuuuuuuuauuuuuagacagauucuugcucugucuccuaggcuggaaugcaguggugugaucuugggcacugcaaccuccgccuuccacguucaagcgauucuccugccucggccuccugaguagcugggauuacacgugugugccacuacacccagcuaauuauuuuuuguauuuuuagcagagacaggguuuugccaugaugaccaggcuagucucgaacuccugaccucaggugauccucccgccucgaccucccaaagugcugggauuacaggcaugagccacuguguccagcuggauuauauauuaauacauguaguugucaugucucuuuagucuccauuaaucuggaguaguuccucagccuuuucucaucuuuuaugauauuaauauuuuugaagaaugcaagucaguuauuuuauagaauaaaaaaaccgaauuagauuugucugauguuuucucaugauuagacuugaauuuuucaaccccagccagaguauuacauaagacaguauuuauguaguguaugugugauacuguguuguucugaggauaucacaccaggaagcacacaauguccaucugcuccuaguuggugaaguuuuaaucacuugguuaagauacagccuugggugaguaguuacuguuuuuccccuuguaacuaaugagccagucuguggggagacacuuugagaccaugcaaaugucuauuccucgucaguuuuuuuuccuccauagaguuaacaucuauuauugauugguucuuaccugaaucauuauuuaugguucccuccacauuuaugucuuuauuuucuucuaaggaggagccuuaccuucuccucuauuuauuuauguaucuauuuauuauuaguauggacucauggguuccuauuuguuccauugguuccuauuuguuccauuauuguucuuauuuauuuugaugcugaaauugucacugauuugacucaugggagccccuucaagcuggcuucuguauuugaucuaccuccauaauuuuuaggaacacuuucuuacucucuggaaugacaaaauguuccaguccaacaaaauguuccaggcuuauguuguacuuugccuucucagccugguuucagccauuuaaaaaaucccuuuagcuuuuguugacauauuaacaccaugccuugacugcuagguaguaagauuuauaauaaguuugggccuuuuucggccaaggggaauuguggaauggaagaagaccaagauugaagaagucguuggugagaccuccucuguuugggaggugugucagauagaugagagugauuguggaaagcagguggcuaacagcagagaggccucuccagugaguggccaaggagacuggccacauauggcaacucugaguucuucauggcaugugcuugucaugcuggggauccagaaguucucuuuugcucuagugauggaauguggagguacugaaugggccaguggguaggcaguagccuggguuuagcgugaaaaggcuaccauguacagaggcuuaaugacugaaggcacagucuuguuggccaggcuggaguacagugguaugaucauaguucacuguagccuccaacuccuuggcuuaggugauccuccugccuuagccuccuaaguaccuaggacuccaggcauguaccaccaugcccggcuaauuuuuaaaguuuuuccagugguaaugucuugcuuuguugucuagucuggucuuaaacuccugaccccaagcaacccuuccaccucagccucccaaaauguugaauuacagacaugagccaccacacccagcccuguuaauuuuuauuuguuauuauuauuguuauuaauuuuuuuuccuuuuuuuggagacagagucucacucugucacccaggcuggagugcaguggugugaucuuggcccacugcaaccucugccuccuggguucaagugauucuccugccucagccugucaaguagcugggauuacaggcaugugccaccauaccuggcuaauuuuuguauauuuuguggagaugggguuucaccauguugcccaggcuggucuugaacuccugagcccaagcgauuugcccgccucaaccucccagaguucugggauuacagaugugagcuaccaugucugaacuguaaauguuuuuaaaaaggcauauugaauuuugucaaaugccuuuuucugcaucuauagaaaugaucauauauuuuuuguuuuucauucuguuaaugugauguaucauguuuacugauuuacuuauguuaaaccaucuuugcgucccugggaugaaucccacuccaucauggugaauuaucuuuuuuuuuuuuuuuuaagacagagucuuguucuguugcccaggcuggagugcaguggugagaucauggcucacugcaacuuccaccuccugggcuuaagugauccucccaacccagccuucugaguaguugggacuacaggcaugugccaccacgcccgccuaauuuuuguaauuuuaguagaaacgggguuucgccauguugcccaggcuggucgugaacuccugggcucaagcgaucugcccaccuuggccucugcaaguacuggugagugcucuuuuugaugugcugcugaauuugguuuacaaauauuuuguugaggauuuuugccucuauguuaaucagggauauuugucuguaauuuucuucuuuuauugugucugucugguuuugcugucagaauaaugcuggcuuuuuugaaugaguuuggaaguauucccuccucuuccauuuuuuggaauaguuugagaagaauuaguacuaguucuuuaauugcuuuuuagaguucagcagugaagcugucagguccugggcuuugcuuugaugggagacuuuuaucuuggauuguauguguuaggaauuuaucucuuuuuuuauguuauugaguugguugaccuauaguuguucauaauauuacgauccuuaguauuuccauuguaauagcuccuuuuccaucucugauuuucuuuauucgagucuucccucuuuuugucuagcuaaagguuugucaauuuuguguuuuuuaaaaaaccagcucuuuguuucauugaucuuuuguauuguuuuucuagccuccauuucauuuauuucugcucuuauauuuuuauuauuucccuuauauuuauguuggguaguucaagcaaaacagguagcauccuaaaguaugugaaaucuaauucugucaaaugaugugucucuccuguccuaaguaauagagucacagcaacuugccauuguuuuauugguaaguguauuuuauuuuuaaauuuuauuuauuuauuuuuuuugagauggagucucacucugucgccaaggcuggagugcagugaugugaucucagcccacuccaaccuccaccuccugggcucaagugauucuccuaccucagccuccuaaguagcugcgauuacaggcacacgcccccauucccggcuaauuuuuuugucuuuuuaguagagaugagguuuugccaugauggccagacugauuuugaacuccugaccucaagugauccaccugccuuggccucccaaagugcugggauuacaggcgugagccacugcgcccagcauuuuuaaaaaaaaaauuuuaaaaauuauuauucuuuuugagacagggccucacucuguugcccaggcuggagugcaguggcaugaucauggcucacuggagccuugauuucccgggcucaagugauccucccccaucagccuccugaguagcuggggcuauaggcaugugccaccaugcccagcucauuuuuaguuuuaaaauuuuuauuuuagguucagggauacgugugcagguuuuuuauauagguaaacucaugugauguggguuuguuguauagauuauuuugucauccacauauuaagucuaguauccaacaguuauauuuccugauccucucccuccuuccaaccuccacccucaaggaggccccagugucuguugucccucuuuauguguccauguguucucaucauuuagcucccccuuuaagcaagaaccugcaguauuugguuuucuuuuccuguguuaguuugcuaaggaugauggccuccagcuccauccauguuccugcugaggacaugauuuuguucuuuuuauggccgcaugcauaguauuccaugguguauagguacauuuucuuuaugcauucuaccauugaugggcauuucagcuuuugcuauugugaauagugcugcaguaaauauacaugugcaugugucuuuagguuagaaugauuuauauucucuugggcauauaccaaguaaugggauugcuggucaaaugauaguucuguuuuuaggucuuugaggaaucaccacacuguuuuccacaaugguugaacuaauuuacauucccaccaacaguguauaaguggccaggagcaguggcucacgccucuaaucccagcacuuugggaggccaaggcagguggaucacacgaggccaggaguuugagaccaaccuggcuaaaguggcaaaaccccaucucuacuaaaaauacaaaaauuagccagguguuguggugcuugccuguaaucccagcuacucaguaggcaggcgcacgagaauugcuugaacccaggaggcaagguugcagugagcugagauugugccacugcacuccagcuugggcaacaaagugagacucuguuucaaaaaaaugaaaaacaaaaaacaaguguuuaaguguucucuuuucuccacagccuuaccagcaucuguuuuuuauuuauuuauuuuuuaauaauccagaugauuuuuaauuuuuuuguagacauauggucucacuauauuccccaggcuggugcuggucugguacuccugggcacaagcaauuccugccucagccucccaaaguguugggauuacaggcaugagccaccgugccccgccccgauagguguucuuuuaauacuucuucugaacuuuucaacuuccuucauuaauuuauguuaauuaccagcacugauucccugcaucaucgaggaguuauuagugguguauuuggcacuaguuuuagaaguagaugccgcuauguuuuauucauuuacagagugauggcagcucauaguuaguccuacaagugcauuauuacugauuugugaauucguuuauuuuuccugaaacaauucaagucuuuagaaagagaauccgaauuauuuuguagaauaccaucuccugccauaucccuugggucugaugaaacagauuugacaagaaaacaucaguugguguuuaggcauuuuucucucuuuuauuaauuaccaucuugaaggauaguagcaucuggaaaacaaaaaaagagguuuagcugagaugcuuuuguuugauuuauauuuuaucccugcaguuuguauuccucauuuucaaggaauuucuuuguuucuuuuuuucuugucaaguaaagcagugggaguggcgaaggaacaaagaaauccauagcugguugugaucaauuaauuguaaacacaaggaauuuauuucuuaaagcaagaagauauauuaaaugacaaucucaaguuucccaagucaagcuaaaaucagauuauaugacaaaacccucuucuuucuuugcuuuaacacagagaacaaaggaagaugcuaguacuaauaaauaaacauuaacagauccaugggggaaaaaaagacuacacagaaccaguuguacuuuaguggcuaacaauuuauugauaaguccagacuaaucuuaacacagugagccagaaaacugagaauuuagaggaugcuguguggcuccaagaguguuuccucaaccacuguccuacagacacacaaacaguuuaccuagacaccaucguggagaggaggggcuaaacccuucacauggguccuggaucccguguauuuuggccuucuuggaaacuuaugcuauugaauauuuucugucuuucuuguauaccuuuuuuugagacagggucugucucugucacccaggcuggagugcaguggagcagucauggcucacugcaaccuccgccuccugggcugaagugagccucccaccucagccucccgaguagcugggaucauaggcacaugccaccacuccuggcuaaguuuuuaaauuuuuaguagagaugggguuuugccauggugccuagguuggucuugaacuccugagcucaagugauuugcccaccucggccucccaaagugcugggucuacaggagugagccacugcaccaggccuuuucuuguguaucuuuaaaccuuuuucucucucuacugacacauucccaucagcucuuaaacaugcuauauugucuuuccucaaaaagaaaacaaagagcacccucuccguuugccuuacacuucuuaaggcuacuguaccaucucuucuucauaaccaaauuucucaaaaccuuuguuaauaaacagagacuccagcuuccuuugcaggcucauccucgccuggcaucuaaaguguagauuuuagaccuguuucugggccaucuuuuccguccauaugccuccucuguugucuuacagaguugcaauuacuuauauaauuguuauucuugaaauuauauuucagucuaaacagaccuuucuuuuaauuccacacucuuuuuuuuuuuuuuuuuuuuuugagacggggucucgccgucucccaggcuggagugcaguggugcgaucucggcucacugcaaacuccgccuccuggguucacgccauucuccugccucagcuucccgaguagcugggacuacaggcgcccgccacaacacccagcuaauguuuuuuuuuuuuuuuuuuuuuuuguauuuuuaguagagaugggguuucaccguguuagccacgauggucuccaucuccugaccucgugauccgcccgccucggccucccaaaguguugggauuacaggcgugagccaccgugccuggccccacacucuuguauuuaacugucuaguugauauuucaacuuagauaucucagaggagcuggaaauuccacauguuuaaaacaguauucucaaucuucauucuuaaauuugcuucucuccuaccuuccuuauuucaguaacuaguaccccacuguuuuguccuugugacauccucucucccucucccugaccuguuagccuaauaacugcaauccuguugauuucagcaguagaauguuucucaaauauacauauaucccuguaucucugcuaucaucauccuaguugaaaccaucauaccauaaccucuugccuaaauuucuaucuuagucuccugauucgucaccugguauucauucuuguuccccuccuacccuccuagcuacuguucucgguucagggcuucagauuguuagcaugccuaugugucccucccugccucaucuugaaccacuccuugacuuuuuccuuuucucaaucucauugcagucauucagcaaguucauuucauuuuccuuccuauaucaccaaguuuuucuugcauucuccuuuccaugccuacuacacaguucaggcccccaguuucucaccuggaugucaucccugccacagccucuuagaugugauuuugcuguccccuaccauuuuuuucuuucuuuuuuucuacucaauuaaaauguauuuuguugcuuuguuuaccagcaaauuguauaguauguaucucauuucgaccuaaaauguuucuuaauucucauuucuuauuuacuaaucuguuuuuuguuagcucauagagugagcuaucuaagauuucucugaauccugauuucuuacaacauaaaauccaaaauccuuaguguguuuguguagcccuccaguucugacccuucucucagcuccaggcugaguuuguuucagcuauaccagauggccugauggugauucuucugcccuccgagccucggggucaagggaugcgcccagagauggggugaucugacaugcaguuuugugggugguggggucugugugacccuuccauugcucagguguacaauuaccaguggacacaguggcacagucgggggccuaugacuugaggccaggcccccauggagucgugggagaggcagguccaaggauggggguaccgcugaucacuguggagcacaguucuccagaccucuaggcaugggguccugcagcauccacgggagaauucacuauacccagcaggccccgcgagaggaugcacuguacccagcaggccccgcgggaggaugcacuguacccagcaggccccgcgggaggaugcacuguacccagcaggccccgcgggaggaugcacuguacccagcaggcgaauucuucuugccaugcccguacucacaaugcuaggcuuuccacaccuccacacacguaaaaguguucagaaaccaaaccuucaccuggaugccuccuauccuuuguuuuagauuucaccucuuuuguggaagccuuccuugcccucccuaccacacuagccuggauuagguacucuacucuguguugcacuuugcaaauuaaauuacauuugguuuauacguuuguuccuuuucuaaacugugaguaccuucaucuuuaugucucuagaauuaggcagacaaucaauuaauuuagaauaaaugagaaugaauacgugaacacagguaugccaaaaguguguggcucugugaaaaccagcuaauagugguacuuuuccugugucugagaaaacaaaguuugcgaauacauuuucucaauuuuaauuuuuuuuuuuuuuuuuuugagacagaguccaguucuguugcccaggcuggagugcaguggcgcaaucuuggcucacugcaagcucagccucccggguucaugccauucuccugccucagcccccucaauuuuaauuuuuuuuuuacauauuuuuucuuagccuuuaguuaccuaauucucucuagcaaaacaaauagauaaguagcaaguauauguuuuugaaaacacauggaaauagauugcugugcuuuauaugauuucuauuuuucuauagaaacauguuuaugaugugauuauuuuuggcacuaaaauuguucuaaguuuuuacuauggauuuuaacauaauaacauguauauaauuuggaaguauuuuaugacuuuuccagaaauauguaguguucugcauaauaccuggagcuacauguacuagguauuuaggaaauauucuuguugacuaauuuccacuuuuuuucccacuaauuuccacuaauuucagauaauuuccacuaucugauaaagauggacagccuuuaaacuagagaauaaacaugcuugaauuaauuuuccuugaaacaaaaucagauuauuaauacaagaaauccuacaagaugcccaacgcuuauuugauguauugcuacauucucuuuaacuuacauuuuucagaaguuaccuuaaacaauuuagagucauuuuaugccuuuaauaauauuugagcacagcugucuucugccucauggucuuuucuucaggcuaacuugucauggcuuguagccuuguagcugauagauacucuuaugaugauugggguuuauuuagcccagacagcauucauuguaagugugguaaaaauguacuaaauuuguacuuagcuaauuaggaguuuauaauaauucugacaugcugaauugaaguuucuuuguaauguucaaggcaaagagaaaaggauuuguuuagcuaauuaaaacuauaaacaagacggaauguuuaaucuacuugaggcaaaccaacaacuguuuucaaguacuuaugaaaucaacauaaacuaggaaaacaccaauugaaauuauuuuuuauuaaaacacuaaaggauuuucuaaggcacagcuuuugacugacuucuuccuuggcauuuguucacauuauuaggaaauaggggccuacugguauuuuucaaauccuuuguucaugacccacagugagauauacauacuauauugcuauucaguaaaaacacacauguaacugaaacaaaagcuguagaaaauaauauuuaauuucuugugaugcaguauuuuaauuuucuuauauuucaaauauuaaaaaguuccucucaggacaaguaaauugauuuuacaaauugaucaagauccacagcuugaaaaaacuggacuagacugugcuugagugcagagaccaugacauauucaucuuucuguuacuaagugcuagagcaggugcucaguagauauuugaauaaauugguaauugagaagaggaguaagaagugaaaucagaguuguaaaaggaauagauguuuuugacaaugaaguucuuggauauaauaaaggcagucgagguaaagcacugugguacuuaugguugguaugaaauuuguuuguuugcaggaaauagaaaccaguguuagcugaagcaaagaagaauauauuaaaaggauucaggguaucucacagaaaucaagcguaggggugugucuugugauuugggaagggaaugaaacuagaaaguggaaugacuucaagagccuaaguguguuaucuuguguuuuuucaucccugcuucuuucuuuguggcuuuuuuuuuuuuuuuuuuuuuggguggcggaaugguuuccucugcagccaaaugacagaagaaucuucaguucacgugacaguuuauuuccaaagcuccugauuguuuuacauuuugguuccaggcuuuaauacuguaugugacuuauaggugguagaauaaauuagucuuuugauauuuacuguaugccaugaguuaguaguuucaagucacugguuucagauaagauaccuguauuagucuguucucacacugcuguaaaaaacuaccugagacuggguaauuuaugaagaaaagcaguuuaauugacucacaguuccgcaggcuguacaggaagcauggcugggaggucucaggaaacuggaagcgaaggagaagggaaaucuuaccaugacagagcaggagagagugaagggggacgugccacgcacuuucaaauaacaagaucucacgagaacucuuauugcgagaauagcagaacaagagagugaagggggacgugccacaaacucucaaguaacaagaucucgcgagaacucugucaggagaacagcagagcaggagagagugaauggggacgugcuacacacuuuuaaauaagaucucgcgagaacucuaucaugagaacagcagagcaggagccacuuucaaauaacaagaucucuugaggacucuaucacgagaacagcagagcaggagagagugaagggggacgugucacacacuuucaaauaacaagaucucgcgagaacuaucacgagaacagcagagcaggagagagugaagggggacgugcuacacauuuucaaacaacaauaucuugcgagaacucuguaaggagaacagcacggggaagucugcccccaugauucagucacccccccaucaggccccuccuucaacacacggggauuacaauuggauaugagauuuggguggggacacagagcugaaccauaucaacauccuauucuacaguucaguauuuccaguagcuuuguuuugccuacugggucagaugaauacacauagaauauaugcguguauguuauaaucauuacuugcaaaaguguuaauucagcacauuuucacaucacauguuccuggcacuagguuaggcugcagaauaguuacaaagauggauauaauguacuguauuuagaaugacuuuuccggccgggcgcgguggcucacgccuguaaucccagcacuuugggaggcugaggcgggcggaucacgaggucaggagauccagaccauccuggcuaacauaaugaaaccccgucucuacuaaaaauacaaaaaaaaaaaaaaaaaaaaaaaaaaucagccaggcgcgguggugggcgccuguagucccagcuacuugggagacugaggcaggagaauggugugaaccugggaggcggagguugcagugagccgagaucgcaccacugcacuccagccugggcaacagagcgagacucugucucaaaaaaaaaaaaaaaaaaaaaaaaaagaaugacuuuucuacuugaagguuauggccuuguuccagcaaaguauaucaagucaugcacagaugagcuauguugaugauaucacuucagaauuagucuucaguuuuuccaacucugcuugucuuguuucucacuuuuaacucuccuuuucucaucugagauggaagaccugaauacuuugccuuuugaccuuucuucacuuucuuggcucacuauuuauauucuacaugugggcucagucauuauuuuaauaucuguccuuguagccugacccucgggugcccacagcugugaccugccaucagggaagucuuuauuaggcacaacauggaguccugagccccucuuggacccaagucagaaaaacaggaaaguuggaccagaaaauaaugcuuguuaucuucaggaaaugaacagacagaugcaggugauaaaaucacauacguuuuaaauauaacaucauaacugucauaacucaaguuugaacaaaauacuauaggaaaguuuaugcuagugacugucacauaguagggccuccagaaaaacuuuuggaaagaaucaguagugaaugaggauguccauuuauucugguguaguuauaaauagccuuacugaagagguagcauuugagcuauuucugcaggaucuguaaauuuuggauaguagguaggcaguggauuggguacuucugcuguacgcacagcuuguauaaaagcacuaaguugugaacagauggagaauauugauugugaauguaguauugauuaugugggagaaugguuggagguauugguuacagccaaguugagaaaggcuguauaggccaugguagagaauuuggaccuucuuuucuuuuucuuuuucuuuucuuuucuuuucuuuucuuuucuuuuuuuuuuuuuuuugaggcagagucucgcucuguugcucaggcuggagugcaguggcacgaucucagcucacugcacccuccgcaucccaggugcaagugauucuccugccucagccucccgauuagcugggauuacaggugccugccaucauggcuggcuaauuuuuuguauuuuuaauagagacgggguuucaccauguuggccaggcuggucuggaacuccugaccucauggaccuuauuuucuaagagucaccugagaguuuccaauagaggagugaugagggagaagauuuauuauuuuauuuuauguuuuuauuuuuucucuauucuuacccuugaacauucaccucucgaaagauuuauucuucugaaauauaacucuguggucaguguuagccugaaguggccagagaugaucaguauggacaugaauuaagaugcuguuuuaaaagucuauacaagaaaaggaaaaaaagucuacucaagagauggaaggcuccauauaaggcuguagaagugaaagcacaaaggagaacuuaaauucgauauucuuuggggaaguagacuuuacaggaccauuuucuuuaaccuagagccagauuuggauuagucugguccauucgguguacuagguggaauuuaauaaagcuaagcccuggguacaccauucccauccccuuguguccuccuucauaacuuugaucuugugucugccugcuuaaugauaccuuagccaugucuccaguuuuccaaccuugcaaugacuccuuagaccugauuauagauauuugauuucucuuuggauuuuggcuaucacucaccuucuggucccacucauuuguggguucuucgcauauuaaaacaaagcaggacaaagaaacagucuuauggggaaaauauaaguuauaauaaauggugcuaaaugcuucaacagaggcauagacagaauacuguggaagcuagguggaaggacugccuaaugcuccuggggucaguuagggcagaggagaaaaugcuuuagcuugguguugguggaugaguagguauguuacaugggaaauuugaggugccugugagauauucagguggagcugaccaguccaggagauggcuggagugauggaucuagaaaagcagugggucucgaccuugugugccuauuagggaaacuaaacaacaaauucaugccuugguccuauucguagagauacugauuuaauuuauaugacacagggacacaguuugguaugucuuaaaaucgacugagguaaugcuaaugugaagccaggguugacaaucggagcaacucaagagagagauauuccuggagaagguagagauaggugauagcugaaggcuuagauauauaucagcuuagaaacagggagaaugagaagaaaauugggccagagacaaauuccuuugggauuaccaacauugugguagguaccaaggagguggccagcaaagaaccugcaaacauaauuccuacucuuaauuguacuguuuuaauauagguuauugauguauuuuugcauaguuuuucccugcuaugacucagaguggauaucagcuaucaggauauacuuuaagugccugauucacguaucuguuguugauugacagacugaugcaaccgauaaacauuaauucuuuuaucauugauguagaaaaucaugaccuuuaauucauaucagcagcaaauaccuauaucugccuccaaguuuauuuaaaggaaugcaugaaaguaauaauuuccaagaauccuuuucagaauucaaagucaccugucauuuuugccauaaauucuuugaggcaugaaauagccugccaguugucuauugcucucaaaguuaaugaaugguuaucaauuuaucauggguaauaaccuagcugcaaauuguaaagaacgcauucuaucacuuucuagcauuuuugccucaaggcaguaucuggcuuuucuauaguaucuggcuuuucuauagcauuuggaggcucagugucccuaaagcuuuuaauagaacucauuucuuucuaggaaaccucuuaacauuugguaauagcucaaugaaauauuagcugguuauaucuugcuuuguguaauagauuuuguguaaauaaaauuucucaauguaggacuggaaauacaauuucuugauguacauucaauccaguauagcaugacgguuuuagagauauuucauuuuuauuuccaauucauauuccauucaguucuuauaagcaaauguggugguuuuccaauucucuaucuuccugguuagguaguuaaugauuggaaaacaggacuguuucaaggaacuuuauuuuuaaaggaauacuuuuucucucccuacaaagugagaaauucucuauaacaugagcucuuucagaucagggacuuggacuugacugugucuuuauuuaaaaaaacaaacaaaaaaugcugggucuaugucuuauuaaauuuagcauuucaggcacugagcacagcaucauaacucaguaaauauuugcugaauuaaugugaauuaucacccuacaucuucaguuauaaauuuguuguauuguagaguggguuaucuaagggaugggaggacauugauuuaacccaauauguggcuuuuauuacaguacuauaaauagaggugacuacagagcucaaugugccuauuuucagucacaaacuugauuucagucccaguuuuuucauuguuaaacagcugcccuuagagcuugcauccaguccuguugcuuuauauaagaaaucuuugaguauuuuuauguguuuccuuuugacucauucaguaaaagccuagcacagugacuuguuaaauuaacucugguuacugaaauuaauuagugaauauguuuuaaugaaauaggaugauaaacauugcugacguuugaggcuuuaguguguuuuuaauaaucccucaucaguuauuacuacugccguggauuauuugccuguguacauuuuauaguccuccaaaucuuuucagcuucuaaaaguuggaagaaauaaaauucuauucugauugauugcuccuuagauuuuuauuccuguaauauauaugggaacucagagagaaauucucccauuauuaguuugccuuauguauuucuuuucauguauugcuuuguauucucuucauguuuguuucuccaagcauauaauaaauauuucucuugauggaaucauaccucacauuuuauuuugacugcugcagaguugugcccauaguagcaacuccauaaguaaugguugccugguugcuugacugacugacugauuauggugcuaauggugacgguuaaagcauuuuuccccaccucaaugcauagcaguuucuuuauggaugcacaccuaucccauuaaacuauuuccuacagagaaucuugguuucccauguuaacucauuucauaguugaaugauccuuacuuuuuaggggacacuucucugaauguuuauucaggauuucucuuuuuugcauugugaacaauuucuucacguauuaccuaaucugauuugacugggcauuaacugccaaccuuaggccuuaaaguggaauaggagccgacuagaagauccacuuguuccaucagauccucacccaacuucagugcuuuauuaguaguuaaaauguggacuguuguaagguguaguagagauuuacuaacaguuugcagaaaaguguuucuguaucaugaccgugcucuugggcugguaauagaagguauuaaauuuguuaaggguuggccuaaaagauugggcauaauuggguuagcugacaaagcucaaguguauugcauacaccugauccagguagguggcgaaacggugggccuuuuuaaggcugguuugcuuucaacccuguggcuuuuacuuaggugccugaggagcauuuuaagucaguucauaccuuuugaauaccucgcuuuugguaaauuuggaguuuauguucacugauaaaccagcaggguuguaauuuuuuauucaaauaggaacuaucuacuuauuuuuauuucuaguuauuuuaccuuuuuugucaguaguguaaauagcaucuuuuuauaguauauuuucuaaguuuuuauuguuuacauauagaagcaucguaguuuuaugugauuuuguaauccaccacuguacuaaauucucacuuauaacaauguuucaacuuuuuucucccuugaauuuugcaaaugugucauaucaucugcauauauggauacuuccgccuccuucaguccgauaucguguuucauauagcauaguggugagaagcaccggcucuggaacuaugacugcuuguguguuaagccuguuucuacuaacuugcuagcuaugugacuuugcgcaagcuacuuauguucucugugccuugcucucucccucuguaaaaugagauaauaauaguacugccuuauuauuaugacgauuauaugaauuaaaugauuuaguauuuguaaaguguucagaacaguaucugacauauaguaagcacuguaaaaaugugugguaaauaaauaaaacucacauaagauuuuuuuucccuugcauuggcuaguaugguacuucuagaugaauauuaaucuagaagcccaauggugggcuuucuuuauuccucccagacuucaacagaaaugcuugugugugucauuguuuuaguguuucaguaauguuuccaguaaaacauuagaaaguuauagacugauaugaaauguauuuuuccauuauguuaaggaaauagucaucuauugcuauuuugcuaagcguuaaaaucaggaacgguuuaaaaauuucaucaugucuauuuggcaucuacuuagauggucauauaacuuuucuuuuuugaccuacuuauaugguugcuuguaugaguagaguuccuaauagugaacucuccuggaaucacuggaguaaacaguugugccuauagccuauccuucauuuagugcauuuaugaguucucauugcuauuacuuuuaaaguuuuugcaccaauauuuauaaaugagucuuuuuuuuccguuucuuuuuugaaacggagucuugguuuguggcccaggcuggaggugcgaacucuguccacugcaacuuccaccucccaaacgaguucaaacgauucucgugccucagccuccccaguagcugguaguacaggugcacaacaccacccauaauuuuuguauuuuuaggagagacaagguucugccauguuggccaagcuggucucgaacuccuagccucaagucauccacccaucuuggccucccaaagugcuagaauuacaggugugagccaccgccccuggcccgcaagugagauuugacaguaauuuuuaauguguucguugucagguuuuggugucacugugugaugcuguaaguauuugacaguuuccuuccuuuuucuauauuuuagaaaaguuuagguuuagugaucuauucuuuuaaaauuuaaaagaauguuaaauuagaauaggaagugagagauuuaguccugcugucuuaauuucacagaugaagaaacaguggcuucuuuacagccacuucaugucagcuacuugggguaagcaguugcgguugugcuacggaggugaggaaauaacauuuauugagcauuuauguaggcauuuaaaaaaacaguauauuuuugauguacuuguuagauuuggguuuugcuuauuugauaucuaaaguuaaaguaaaaaaauuuuauugacuaaaaaaaacuacuuuuuagaguaguuuuaacuacauagcaaaauugagugcguagcacagagaguucgcauagacccucuuccucuacacaugcacagccuccccuacaauggacaccccccgccagaauggcacguuuguugcaaccgaucaccuucuacucaugacauuaucacccaaagugaauaguuuacauuagcguucacccuugguguuguaaauccuauggguuuugacauauguguaaugacauguauccaccaucaucauaucauagaguaauuucccugcccccugaauccccugugcccuacauauucaucccuucccuccccagcuccuggucaucacugauccuuuuacugucucuauaguuuugccuuuuccuaaaugucauacaguuggaaucguauaguguguagccuuuucacauuggcuucuuucgcuuaguaauauucacuuaaguuuccuccgugucuuuucagagcuugauagcucauuuauuuuuagugcagaauaauauuucauuguuuauaaaaugcuguugguuuugaauggcugaaugucuuucccgaagauaacuuagucaccuuuuaaucccagaaucuugucagucagcuaacagauauuuauugaaggccagcaaagugcuuugccauucuccuaaacccugaggagacagcagugaucaacacagacaagagcugugucuguccuucuggagccuggcauaauuuccaggaccggcaggcaccugcugaauguuugugguugaaguauguuaguuugugacccaccauugggagauucuuugucuuuagggaauuuccaaaugugguaauaugcauuuauuuacacuagguggugguagagucauguacacugaacaguuggcaccuuaauuaagucacuaauuguuugcuuauaaauauaguucacuucauaaugauuaaaauuuaaauacguuuauauuaauucacuggaauguaaucauuaauuaaaaugugaacuuguaguacaucuuucagaauaaaucccaauaaguagacuuucucaaauucuucaguuugcuuccuuuguuuaauaaucacgcauuuacugagauucaguuacaugcuaggcauugugccagcguggaggauucagugucgaauaugauuccuuuuuguccuugagaugucacaguuuagugagggagacagaaaugagacuagauccauuaagugcaguggaaugccuaugucuuaaguauaccauucgaugaauuccgacaaaugcauacaccuguguaacccaaaucuuuaugaaauuauagaucacugccaucuuggggugggcauuuuucagggccgugugcagcugaguaagcaaaagaagcagguugagagaagaacaacggaggugaucaaaucaagcauuuccugagagagcagccugauuuauugaguuauuuaucaguugaaacucagucuuugggagucugggaugucccuauaguucuguugaugaguuuuuuuuuuuugagauagaguuucgcuuuuguugcccaggcuggagugcaauggugcgaugucggcucaccucaaccuccgccucccggaggcguucaagccauucuccugccucagccuccugaguagcugggauuacaggcaugugccgccacgcccggcuaauuuuguauuuuuagcagagaugggguugcuccauguuggucaggcuggucucgaacucccgaccucaggugaucugcccaccucggccucccaaagugcugggauaauaggugugagccaccaugcccggccuguugaugagauuuuacaugaacuaguuugggucauuuucugucacaguagucaaaacgguaugccgaagcugcaacacucaucuuuuaguuucuaaagugagggacuuggcucuauacucccaauaacauuacuuaaaaacaaacaaaaaaaaccuuuccacaccuaacgucagcagguucauacucacaggauuaaagguuucaaagcugaagaacauagcccagucagagcaccugacuucauugacacuucucugugucaggcacgguguccuuuuguguuuauuuucucuucuuagggcagcccuaagcagugggugcuuauuguucccuucauggagaacaucagugaggaaaugggcguucaaagagauucuagaacuugcaucagguaaucgcuggagaagucagauuuccaaacacaggucucacguucaaagagauuauagaacuugcauaagguaaucgcuggagaagucagauuuccaaacccaggucuuccuggcuccaaagcaggucccuccugccccauaucacacugucucagaagaaggaauucuaaguuaaagagcaaaaacaucacaaaaauaacuaauugauuuuauucugguuguggaaauaaaugaggucuacccaaaugaguacaaucaaaggcuacuuauucagagcuuucuuuauauaguaagggaauccaccaccaucuauucaauuugguggagauucaaggaagacagaggaaugggaaaacuuuuguuuauuuuauuuuuuuucuggagauaggcucuugcucuguugaccacguggagugcaggggcgugaucauggcucauugcagucucgaccucccaggcucaagugacucucccaucucaguccccccugaguagcuggaacuacaggcaugugcuaccauguccagcuaauuuauuuuuauuuuuuguagacacugggucucacuauguuucccaggcucaucuugaaguccugggcucaagugaucuuccugccuugucuucccaaaguguugggauuacaagugugagccacugugcccagcaggguaaacuuuagaguggaaaaaagggaagguuucagguaugcccuguuuguaggcuguuccugugggaagcuguaggugagccaacuaaaagcauagcaaccugugugauuaguuaaggguacauuuuuggcuuucucugguugguccuacauuggaagcaggagcaaaaauuagggaagcugacaguuacuaaucauuuccuggccauuuuguccuuuuuuuuuuuuuuuuuuuuuuuuaaaaaaaagagaugagaucuugcuguguuccccaggcaugaucacagauaguguggcuuuguacaaauucuuaagggcauuguugggcuuccugggcuaguugcuagacaguaaccagucugacuuccuagacugguuauuguagauaauagguugguugccugggcuuguagcugcaggucgugggucguaguuaccuacgaucuggccuuugaccauuuguuuauuuagucucucaguagauauguuggggauggguauucccugccaacaaauugauuguauaacauauucaaaguucuguuuucauaggauaaugacaguugacuuuuggaaagggaagaguagaggaugaggagaagagcauuuauugaacagcaguuuuaucuuagucucugugcguugguucucaaagcguggucuccagaauaguggcuucagcaucauguauugugaucauguaagagauuauguuauuauuuuuuuuugagacggagucucgcucuguuucccuagcuggagugcaauggcgcgaucuuggcucaaugccgccucugccuuccggguucaagcaauucuccugccucagccucccgaguaguuggcauuacaggcaugcgccaccacgccuggcuaauuugauuauguuauucuuaauaggaaucauaugccaaaggucuuagggaugaguuaaaauguaugcaacuuauuuucaaauggaugagcaaaagaacguacagauacacauauguagagaggaagcagacguggaaaguuguuaacaaauguugaaucuggggaaggguauauuagugcuuguuguauuuugaucuccucaccucuucuauuugaaaaaagugggaggaaagcaauucucuuaaaaagcuggaagugaaacaguagagcucaguaauccaagugaugauuacauggcaauuaauuccccagaggagauggggcugcuucuaacugggagaagguguagaaugaagaacugacuaagcauagagcugaccugccuacugugauuuaugguguguguguccugcuagcucuccuuauguggauacuucuguagacuauaagacugaaaaagaaauauuggaaagacaaucauuucuuguauugagauaaucuuuuaagacuggugagacaacuucaggugcguggccucugaaucagucaguuucugucucguguauuugugagagaaacuucuggaaauuuuguuuucaaaugucaaauauauuucaguauuuucaucuugucauaaguuuggaauuuuccucugaauuuuauagccaagaauuuuucugucuugaagaaguugauuauuuguauuacgguaauaauuuuacaaguacucuuuucucauagcacauuuuguuacacaguguuccgaaaguuauugggaccagaaauguaaagugauacacucuacuuacuuaauuaccuccccaauuccucugauaaaggcaagacauuauagaugauccuauaauuaaaucugguuuccgaaggaaauguuauaacaauacauuuaacauuuuaaugcagucuucauuuauaggauuugagauugcuacuugaaagcuauauaguuuaaaauauaaaacuugcucuaaguuauggugugauuaaauuagauaggaugccauuuuuuuuuuuuuuuuuuggagacggagucuggcucugucaccgaggcuggagugcaguggcacgaucucggcucacugcaaccuucgccucccggguucaagcgauucuccugccucagccuccugacuagcugggauuacaggcaugugcuagcaugacuggcuaauuuuuuguaucuuuaguagagacgggguuucaucauguuagccaggauggugucgaucucccgaccuugugaucugcccaccucagccucccaaagugcugggauuacaggcgugagccacagcgcccggccuaggaugccauuucuaaauuaccguguuccugcaguaauagacaacuccuuuuaacagugucaucagaugccucaaguuacauagguuccuaaaauucauccccauaugguaccuauuuaaaucguagauaaguuuuaauugaauuuuagaaaugaaaccugucauggagauccuguugcaagcucaaagagcuacauuaaauggguuuagaaaaacagcaccucuaauaucucugauguggagguuccauuuauuagagauuaguagguuuucucuccccggucacagaauuuauuggauaauauagugguuucauuuuugacauucuuugaaagauuauguuuuuauauauaguaaauggucaugccuuuucuuacuagauaaauagaauuauuucuagaguugucuuuaggacaaauaugauaauacuuuuuuuauggauauaucauugugaugucuuugauucucugcuuacuuguuauuugcuacauguagugauauauucugcuucacaguuuggccaguaguaaaaugagccaugauuuugggcucugcuuccucaaaagcacuaggagacaaugcaguauccucuucacuauuucaauacuuggucuuuauuuuagaggcaauugauauguuuacauccagggucuucugacuuaccuuaguagaugggaaaguaaagauuaaaaaaacaaccaauucuagugaagguuuaaaaguaugaaauggaauuaacugugugauuuugcaugaacuuggugugugggaaauucauuaguuaugcauucauaugguuuucagucuuaucagauguacaguaaugccuugcuuuuuaugaguuuuuaaguuaauucucuuauucccagguuuuuuuuuuguuuuuuuuuuccuuuuuggauguccacucaaaggcaaagcuccggucccauuucagaagugagaguguuuauaagaauuaagucuaagucauucaggcacauuaauuucuuaucuguacuaagcucucucagacaaguggcuggaaguccccuccauacuuguacaaauuaaauuccuaaucucuugguuugcaaaagacugucuuaacagcuguagggguuuucuaacucagcccuccuaaguucguuuucuuuguuguuaacuguguuguauguuuuuagaccccgggcaucuuaaaugcauuuagaaauucagauacagauuugagaguaucuauaaaaaagcagaauuuuacuagugcuguuuaucccuugggucaauaguaagaaggacaaauucuuauguucuaccuuaaacuauacucugauugggguuacauucauggaaggcaauuuuagggacauaggacaggccuguaguugaaaauaugucuccauuuugccugaguuggcuugguguuccuaaaaaccuucuuuucacucauagucuaaacugcuggcaaaaaugggcagugauuuacacucaggagaggguuuuauuugauuuauuaauuugacaguaaggacaggcuuagcaauuagauuguuugguggacauauuuuauuaaguaaaacucucccuccuaauguuguguuagcauuuauugaauguuuacuacaugcuacguuuugugcuaagugccuuguguuauuucauuuaauccucacaacaauucagugaaguacagauacuuaaaacaucaucacugccaucaucaacaucaauagugcuccugucuuaaagaggagggaacaaagccccaaggagauaaagaaauuuauuuaaagucacauggcuaguaaguaguacagguggaauccaaaccccagacuuucugauuccagaauccaagcucugcaccccuaugucaaauuugcguauccuaaagcuuuuaccacauugccuuguuaucuuuauucugcuucuauucuuagaacauuaugacugacagcuuuugcguuuugugugccuggcuuccaauguugaguuaagcacucuggagcuguuuuuuagauuaguugucuuuaaaguggguguauauauacacuucgggauucauggagacuuuucaggaauuuugcaugcaaaaauaguuuuaaugguauuuagaugcucaaugucugcauuugauaauuucuaauaugguugccugagagcaccuguggcagagugagucuuccuuccuaccucuccauucacaaauugcuuuccucccacuugacaaaggcagucagucaugcuucugacccagcacaaaucuuacaauauuugauugcuucagggaguguaaauccucugguucacccacuaaagggaccauuuaagaauucuuagguucuggggcugggcgcgauggcucaugccuguaaucccagcacuuugggaggccgaggcggguggaucacaaggucaggaguuugagaccagucuggccaacauggugaaaccccgucucuaccaaaaauacaaaaauuagccaggcgugguggcacaugccuguaaucccaacuacuugggaggcugaggcagaaaauugcuugaaccugggaggcggagguuucagugagcggagaucaagcaccugcacucuagccugggugacagaacgagacucugucuccaaaaaaaaaaaaaaaauucuuagguucugggugugaauuugaagauagcaaagugaugacugcuuuggucaaaaucauagauguuuccuccagguaacaaacccauggcaggacuccauaccuuauuucuuucuuuuagaaucaaguugauuguugucugucugugguggugauggguggugagggaggguuuauagggaaggcagauuagcacuuuuauuugaaaugaaauaugaauuuuuugacagaaaguaaguuuuauuugauuuauugauuugacagaacaggcuuaacaauuagauuguuugguggacauauuucauuaaguaaaagagugaaaucuacagcugcaggguugcaacaauaauauuuaagauacguauauaccauacuggaaacuauauccaugccaucauuaaauuaacaugucaaccuaaaaugucagaagagcacaagguuuuucaaaauucuuuuaggaaauguacaagugaaaaaauugguguuagguuccugugcccaucuucccugccacuacaccagcccaacccucccuugccccagacuggcuagcaucucuauuuguaugggaaaggaguuaggacuuauuucuuucaaguguuuuaaaauuagauuguuaucuaccugaauaacuuucauuacauuaaucucaauugcugaaucgcuuuucugagaggcugcuucuuaaugguguuacauguauauugauucuauaggagacuguugccuuuugaggaguuacauuguagagcuuccuaaauaaauugagauucagcuaauuuauaguaauguccaaccauguaucaaauuccauuagguaaguuggugaauguaacgcuguacuugcagauggagaaauguacaguuugaggaucaaacugaaagauauuaaauaggguuuaacacauuagaaucuuacuccuuggugaaaccaguguuacugauugguaagaggagguugaggaaaauuucuuaggcauguauauaugugaaccaaaauguuacuuaaugcaaauacauaagagaguaaaacaaaacaaaaacaacuggaaggaauauacaaaauccaaaauaggaagagcuaccauacauuuuuaaauuuaaauaagaagaauuuaaauacaguagagcauaaaaucugaaguugggagccuggugcacuguaagggaaguugcuaggcaagaauucuggaagggagauaagaugcccugagguggagugcacaguguggaagaacuaaccguccuucccagggcacagauucuuaccagagucuggcucccaagaucaucuauccauucccuuuuugccuuccuucauuucacaaaagcuuugaggaagcaguaccaguguuugcguuaaugggucugcuucacuuauucauaaaccucuggccuauuucaauacuguguucaaaauauauauauauuuuuaaacuuaaccuccaacuggucuccaauuucacaucaguauauuucuuuaucauuagauucuuucauuuucuuauuuucuguguaacuacuuuuacuuuguuuucucuuuucaguagucuuuuuuuauuauuuuauuuuuuuuugagaagggguuucgcucuuauagcccagccuggagugcaguggugggaucuuggcucauugcgaccucugccucccagguucaagcaauuuccugccucagccucccgaguagcugggauuacaggugugcgucaccacgcccagcugauuuuuguauuuuuaguagaggcgggguuucaccggguuggccaggcuggucuugaacucgugaccucagccugccucggccucccaaagugcugggauuacaggcgugagccaccaugccuggccucaauagucuuuuagugaagacuuuuccauaaggguuuauuguuuuugugccugugccauaccucuaauggauuaucacaucauuccuuccuucccugaagaaaagguacuucaugguaugacucaaguaacaccuccauggugcucccacagcgcuuacacauuguagcacuuauuauaugauauaguucaugguggugaauaaauuggguuccucagcuaaguuauaaaagccuugagagugugucucuauuaugugugauucuucagugccuuccauagugccuugcacaugauaggcauuuucugcuuguugacugaaugaauagauacaugaacaucaaagauaguaaagagaaagaagguggggcgcguaaguucacgccuguagucccagcacccugggggcccgaggcgggaggaucacuugaggccaggaguugcagaccagccuggccagcauggugaaaccucaucucuacuaaaaacauaaaaauuagcuggacaugcuggcaugugccuguggucucggcuacuugggaggcagaggcaggagaaccguuugaacccaggagguggagguuguggugagcugagauggcgccacugcacuccaggcuggacgacagagugagacucuaucucaagggggaaaaaacaaagaaagaaagaaauauaggcauuagccccuaaaaugucagugaggcauuuuuuguccuuguuucagugccuuuguugagccacuggaaugcuuucugaucucuugaagauuugaaagcuccagugauaauccgaaaaggagugaccuggcaguaacagguaauaucagcuuccugguuuuaaauuugccuccucaauauagugaauggugguacuuucauuucaggguucuuuucaguaugaaauaagauaacuuggagucaguguaaccacaaauuuugcagcguaguuacaaauuaugcauuuacuccauaggugaaaugaccuugaaacaaagacauuuugguacuuuaguaaggaaacguacacaaaugacgaccaagaaagaacuggcucagcgugaauuuuaccuaccacuauuacucauuagagaucuuccuguaaacuccuagucgguucuuucaaagucuuggauaaaaagcuccucuucaugugucuggaaugugcguguacuuacgaacggcaggguaaguggggacgcacaaaacagagauuaagggucaccuauaauuuacuucuacguaauguaaccagauuggaggaccauguugcuccccacuaacagguguguguaauucccaguggccuucaaccaagcaguaggcauauauagucuuacacacauggcacugagguuauuguuccauucacagagggauuucuuccucuuaggaaaauacaaaagacgggguaugccaggacauucagaaagauggucacagaugcgaaagccccaauccauggagcuuggucauuaggaaagggauuuugugaacuuguaucuuucugugaaagcucacagugcugcugcugguuguuuuaauuacccuuugcuacuccuauaucauaguaaaaaaugaggcuuuccuuuuuagucacaucgaagaucuucaacauguuucuacauuuauuuuaacguaguuuuuaugcccccaaauauuuuuuuucauagauauauacuucuagauuuggagagagaguuccuacaucacuaguuucugccugaaaauacuuuuauaaauuugacuucauaauuaaaaaaauauacugucaugauuauuuaguuugugauccaaaauaucauuagauauugauagguaguuugcauaucaguguagugggugugacgauaucuuccucacaggcuguuugugaggaugaaauaacuucugcaaagugcuaaugucgugcuuggcaaacgguaaguacucaauuugugggagguaucuuuugcuaauguuaauuuuuaaugauauuuagugacauggggcaaauaaucacauuaagugguaaaaauagauuccaaaauggcaucugaggucuugaaaaauaaaauuuucucuaucuauauauuuuuuguguauauugguuuaauagugguugucuuucuaggugaugggauuauuuucuucuuuuuauuucucauguagaguaaguccucacucaacaucaucaauagauuguuguaaacuucaagcaaaaugacuucuaacgaaaccgauuuuaccacaggcuaauggauauaaacaagaguuaaguuccuaugacauacuucugaucauagaaauaucaucaaacuuauaaagaacuaaaacacuuuuuuuugagacaaggucucacucuguuacccaggcuggagugcaguggugcgaucauggcucacugcagccuugaccucccaagcuuaagugauccucccaucccauccucccugguagcugggacuauaggggcacgccaccacucccagcuaauuuuucuguuuuuuuaguagagauguggucucgccacguugcacgggcuggucuucaacuccugggcucaaguaauccgcccacccccgccuaccagaguacuuaguacuucuagcacauuuauugugcuucuagugugagaauauacaacugucuuuuuuuucuuaagagucagucucacccauuuuaaguguagaauucagugacugugagaggagagaagcuaaaggcacacuaaggaaagaaacaggccccaugcuaaaauacuuugaggguuaccaaaggugauaauuguuggugugccuaugagcguuugucucaggagauaaaaugugcugcuucuguucuaaaaaaugggccaugucauuggccuccugggaaguauuuuuuauuguuuccaaggugaagauacaugagaaggcuucuaggcuuuuacauaaaguccacggaaacuugaauuguuggacuauacagugaauccuuugaauccaugguuuucacaucuguggaugcagccaggcuuggauucaaaauauuuggacuggguguggugguguuugccuguagucucauuuccuagggaggcucaaaugggaggauugcuugagcccaggaguuuggggccagccugggcaacauagcaagaccuugucucuuaaaaaaauaaaaauaaaaaauugggaacccccccccccgaaaauaacaauguggcaauaaaaauaguacaaauaaaaccaauacagcauaacaacuauuuacauagcauagucagggguccccagagcccgggccgaggaccgguaccacucccauggccugucaggaaccaggccgcacaguagggagugaguggcgggugaacgagcauuauugccugagcccugucuccugucagaucagcagcggcauuagauucucacgggagcgugaacccuauugugaacugugcaugugagggaucuagguugcacacuagaucucacaguaugagaaucaaaguaaugccugaugaucggaugauuggaugaucugaugguuucaucccaaaaccauccccacuccgccccccgccccagcaucuguggaaaaguugucuuccacgaaacuggucccuggugcuaaaacgguuggggaccacuguuauacguauucuagggaugauauaaaguauacaagaggauaugcauaguuuauaugcaaauacuaugccauuuuauagaagggacuugagcauccauggauuuugguauccgugcugggggccagggaggggguugguguccuggaaucaaucccuggaggauacaagggagggaagaguaccaggaaaguaguuccucugguccugaguugacuucguuuuucagugucuuacuccacuugucucuuaucauucaccccuaagccugugcucuugaugguugaaaauuuauuuuacuauguguguuuuauauuagaaaucugaucauacgauauauuugcaggaagaaauauauaaauaagagacuacugacuagauuuuguuuuccuauuguuaacaucauuuauauuuuggcaaaagggaguuggaucucauauauaaaaauucccucugaacguuugccagaaucaguaugcugucauuccuaguuaaaaagauuuucuuuuuucaaacuuaacaugcaucuccuuuuuugcauagcagaugggaaagaucaaugagcugcaguagagaauuacaggguuuuuccccccucuauuugaucuuugaucuuaaaacagcuuuuaacccuauaguaaucucccaagagauuugagaaaauauuuuguaaaacaaaauuaugaggacuaugaauacguaauugguauucucccagcauucugacaaacuuuaagcaaaugcuuuuaagaaaucauugucagcuguuauguguuuuuuauuagguugaauucucaguauaauuuauguccacaugcauuauugcauuucaguuuugaauuuuauuguuauggaaauaaugagaguuuucuugauauaacaacagcuggaaaaaaugacagugaucaacagucaaaacucuaaguuuuaagauuaaaaauuauauuagaauauuuuggaaugcugcuuuuaaguugauuuuucaauaaacuuuaaauuuguuucauagcguuaucuuuuagcaaacaaauucacgcauuaauaaaaacaaaauuguguacagaaaaagcauggcuucuaaucuuaaaagcaagacuaaacacagaaacaucuggacaaugacaaguucaugacuuuuguuuuuuaacccaucagauugcugagguuauagggcaaucggcuagcuugacgucuaagaagagacagauguagggaaagacaucagcacuugcuuaccuggggcacccacagcuggacacugguaagcauucagcuagaauaguuaaccaaauugauggaugcugcaugugggcuggcaagaaagugugaagacccugggaacuguggaugaggggaguucauacccaccuguaggcuuuuucuccaaaaacucuaccaggugcucccaaaaagacaggugagauuccugagaaagcauucuuugucucuaggagaagagcagcugcugcagauacaguaagaaacucugaaaucccagcacugugggaggcugaggugaguggaucacccgaggucaggaguucgagaccagccugaccaacguggugaaaccuugucucuaauaaauacaaaaaauuagcugggugugguggcgggugccuguaaucccagcuacuugggaagcugaggcaggagaaucgcuugaacccgggagguggagguugcagugagccgagauugugucacugcacuucagucugggcgagagugaaaacucugucucaaaaaaaaaaaaaaaaaagaaagaaacucuggcaggacccuuauucccuaucguccuuuucccuucuacugaaugaaagcagagaaaggacaaaacaaugaccauuaccuuuggggcucuggugaaaacccuuuacaccuggggaaaauagaaguaauagaaguaaaccugcccuugggggcgggagcauguugggucacagauuggaggagacuaacgaagcaggacaucuaaauacaucuuuaccuuguggaacagaaaaagaacaugauuuaggcaagacaccugccuaaauaacugaucauuacucuucaaaaguaucaagugucaaagacaaggaaagacuuaggaauuaugacagaucggaggagacuagggaggcaggaaccuagauacuuucuauguauuacuguggugaugucaauguuaagggaagcugagugaagggguagaugggaauccucugugcuauuauugugacuuuuauguaaguguaaaauuauuuuaaaaucaaaggggaaaacauuguaggccccccuuuuaaacugcugccugagauagucuauaagaacaaaguucuugccuucaauuauuggagauugaaauuuguaacuuuuaguucacuuuaggaaaauuagguucuuuuuuuguuuaaguccauguuuccaugaaggaagauuagguucuuuuucaacuuucuucuauuguuguauaguuuuuuuuuuuuucaaauaagaaagaaugguucauaguuuuucucccgacacauuucauagccuuuauauuuucucucucaagugggugaaggaaauuugaauauguaacuacuacccacugaaagcuucugguuuaauaauuuuaaaaaaacuugccaccuauuuccaacccauguuuucauuacugacccaggaaauguugaguaacaacuaugugagaaguacugugcuggaacccgugauacaaagacuauuaaggucagugucugcccucgauaaaccuucagggaaauguagcaaaaacucuaauagagggaaauucaaaugccacgugggacauucuaauuaauguagcuucauuuagcguguuuuguccaguuuccuuguaucuucuccuuggaauucuuggaauucuuguaucuucuccuuggaauucuuggaauucuuguaucuucuccuuggaauucuuggaauucuuguaucuucuccuuggaauucuucuaucauuuagagucucaacgcuauuacucuucccuuauucccccuuccucauucaagcuauuuuggaauucucaggaguuccugauguuuuccuaacuuagagaaaagcaguggcuuuguccugacuguuccuuaucuaguauuacaguuacucagaauaccucuuugcguaacacacuacccuuaccaaagaagcuucagagucugaauauaaaguuuucacuuaacauuuugcugcuuuguuuuguuuauuccauggucucuucauagaauaaaacaguuaacuuaugaaauccgugaaaccucuuuggaaaaaaauguauauacauuuugcaauaauuucagauaaucacaaacacauucuuuaaaaaaaaauaauuucaacuuuuauuuuagauucaaggaauacaugugcaaguuuguggcauggguauauuguguaaugcugagauuugaaauagggaugauccugucacccagguagugagcauaguacccaauaauuuuucaauccuugccuccuccuuuccucuucuccuuuaauagucaccagugucuauuguugccgucuuuauguccagcaguaccagugauuagcucccacuuauaagugugaacuacauguuauuugguuuuauuguuuugcauuaauuugcuuaggagaauagccuccagcuguuuccauguugccgcaaaggacaugauuuuguucuuuuuuuauggcuaaguauuccauggggagcagaauacuauuccacacacaccccauguuuucuuuaucuaaaccacuauugauguacaccuagguuaguuccguguuuuuugcuauugugaguagugcugcaacaaacauauacguacaugugucucuuugguagaacaauuucuuuucuuuuggauagauaccuacuaauggcauugcugggucaaaugguagcucuguuucaaguucuuugagaaaucuccaaacugcuuuccacaguggccgaacuagguuacauucccacuaacaguggauaaacguucccuuuucucugcagccucgccagcaucuguucuguuuugacuuuuuaauaaaagccauucugacaggugugagaugguaucucauugugguuuugauuugcauuucucugaugauuagugauguggaacauuuuuucauguuugucugccgcuugugugucuucauuugagaagugucuauucauauauuugcccauuuuguauuggggucauuuguuuuuugcuuguugaauuaaguucauuauagauuuuggauauuagaccuuugucggaugacaaauagacaaauucacaguuugugaauauuuucucccauucuauauguugucuguuuacucuguugauaauuucuuuugcugugcagaugcucuuuauuuuaauuagguuccacuugucaauuuuuguuuuuguugcaauugcuuuugaggacuuagucacacauucuuuucuaaagcugauguccagaaugguguuuccuaaaccaauccuuuagaagaaugguuuucuucuaggauucuuguagaauguggucuuauauuuaaaucuuauccaucuugacuuaauuucuguacaugaugaaagguagagguccaguuguauucuucugcauauagguagccuaucccagcaccauuuauugacuagaggguccuuuccccauugcuuauuuuuggugacuuuguuaaagaucagaugccugugggugugcagcuuuauuucuggguucucuguacuccauuggucuauguguuugguuuuguaccaguucuaugcuguuuugguuacuguuuggccuuauaguauacuuugaaguuggguaaugugaugccucuggcuuuguuccuuuugcuuagaaucgcuugggcaauccuuugggcucuuuuugaguucuauauuuuagaauaauuuuuucuaauucugugaaaaaugauguugguaguuugauaggcauagcguugaaucuguagauugcuuugggcaguauggcuauuuuauuuuauuuauuuuuucgagacggagccagccuugcugugucacccaggcuggaguacaguggcacgaucuuggcuuacugccaucucugccuccugaauucaagcaauucucccgccucaaccucuugaguagcugggauuacaggcgcgugccagcaugccuggcuaauuuuuguauuuuuaguagagaugggguuuuaccauguuguccaggcuggucucaaacuccugaccucaagugauccucccaccuuggccucccaaagugcugggauuacaggcgugagccaccgcgaguguggccauuuuagugauauugauucuucuaauucaugagcauggaauguuuuuccacuuguuugugacaucucugauuucuuucagcaguguuuuguaguuuuccuuguagagaucuuuuaccucuuugauuagauguauuccuagauauuggugugugugucuauuguaagugagauugugaucuuaauuugacccucagcuugaauguuauagggguauagaaaugcugauuuuuguauaccaauuuuguauccugaaacuuuacugaagucauuuaucaguuccaggagucuuuuggcagagucuuuaggguuuuauagguauagaaucauauugucugcaaagagagagaguuugacuucuuuuccuguuuggaugccuuuuauuucuuccucuugccugauugcucuggcuaggacuuccagaaaugcauucuuaagcuuaucuauugaucuaggauagauccauugaaccugcuuuggccaaaaauuaaguaucaacuuaaccuugauuauuucuuaucauauuaguaauuaauuugagggagugaucaugauaauucaaacacugaaaacuuauuaaaaaaagcuuucggaauguuuuguaaugaugagugugacugugaaguauacagcaagaucacuguaaaauagaaggcugccuuuagaguaggaauaugcuuuagauaauagucugccaucaguuaggcagucaagaccaagcgagcgaguggagucuuacagucuguuacacagagaagucuuccaguauauuuaaaacucaaccucacaucgugaacugaagauuuucuuuuaaagugaacaugaguaaacucauuaaagagaaucuccugcuguuucuugacacugugcagauuacauauuuuggauuuuugauaaacuuuauuuccuggaugaucucucuuucugggugcccucuaauuaacuuuuauaaagcaccaaacaccaccucuccaccuccuuuaaaaucuuuuugugagaacaaguggaaugauuaacuuucuaauugauguauggugguguagcuaucuaaaauacuuucauuaaagcaacuuaauuuuuuaaagauagccaaguuaaauauguaaucacucucuagaguaauuaaaaugaaagaauggauauaauuagaaauuguguuugucuuuuuauaggaugucacauaacugauaguucugcuauuaugcaguggaaaauaaaugguucugauaguuuccuuggagaaagugcuagagagguaguacuuucacacauguaguccaaucuaaguuuggcauaauuguuagauuacucuuguuugucuuaucugcaauuauucagugagauuuuuaaaaaauacaugucuauugaguugccagacuauauacuuuuuuccagaguauagucagauaugucggauuuuaggaauggaaugauuuucccaauuccuaaaauaaauaaaaguuagaguuuuuucauggcucuuucuauuauaaaauauggaauccuuuuuaagaaaagaauugagucaaaaugaaauuugagauugaacuuguugccuagaguuaaacagauuguugcagaaauggagaguaauuuguauagcagauauauguaaaguugcuccuuuuauuuauuuauuuguuuuuugagaugggaucucacuguguugcccaggcuggagugcauugguggcaucucagcucacugcaacuucugccuccuggguucaagcgauucugcugccucagccucccccgaguagcugggacugcaggcgcacaccagcaugccuggcugauuuuuguauuuuuaguagagauaggguuucaccauguuggccaggcuggucucgaacuccuggcuucaagccauccacccaccuuggccucccaaagugcugggacuacaggugugagccaccucaccuggccuaaaguugcuccuuuuagcaagaggucauacaaaagguguggcuuauuugcauaccuuuucaucaaauuuugcugagcuguguauuugcuggauuuuuaauuggguucuuuuucuuaaaaaguuagcauuguaauuaaagcaaaagaucaauuugugugagguaacaaauuaguuaugcuuguugaauguaaaaauccuaugugugcguuuauuguuuuuuucuuuuuuuugauuaagauacauauuuuuguauuggauccagccuauucuuuguagauacuauuuuucuucccuuacauuuggugauuuuuccuguuuaucugguuaacuucuuagcucaaaagcaaucuuuucuaagcauccuuuucugaccucccuguguggacuaccccauccuugcuaguccauguguacugcuuucagccagcucaucaauaaucuaaaucucagggguuauguuucaguucuuauucuaucuugcugugaaacuggucaguauuaacuucucucuuuucuuacauacucuuuucccacguuccugguuuuccuuccucuuguuguguaguuucugcugcuuuuucuacauaagcuccuucucuucugcucauuccacuaauguugacguuccucagguaauuucucugggcuccuuuguuuuucuggcaugucagauccuccuaagaaaaugucauuuauuucauaacuucaguuaucaucuaguccugaugacccccagauaaaaacucuuagcuuagaucuuucuguggauuccauacuuauaucuggguggcuucugggcaguuucagugaaaacucccuagaugucccacaagccccguaagcccagugucugcaaacaacucguuagggauucuucuccaaccucucugauaaugucauuucucugcccaagaauguucagugucucuucuugccuaccaaaugugcuggcuccaaacuauauuucuagcuuuuuaguccacucugccacauacggccuucgcucuaguucaacucaaguacuugauuucuacuacugugaucugaaauaccuccauguuauuuacucuugcuucuugccuuccucucuuaaauagauccucauuucuuacagaugcccaggcagcucugauguuaucuugaugcuggaacugucucuguuccaguuagucuauauuaaucuuuccuuuuucugagccccuguauuuuauugauauccauuuaacagcauuacuucauuccguuucuuguaugauuauuuaguacuugccagucauauccuugaggcaggaguuaccauuucucguaugauuauuuaguacuugccagucauauccuugaggcaggaguuaccguuucucguaugauuauuuaguacuugccagucauauccuugaggcaggaguuaccguuucucguaugauuauuuaguacuugccagucauauccuugaggcaggaguuaccguuucucguaugauuauuuaguacuugccagucauauccuugaggcaggaguuaccguuucucguaugauuauuuaguacuugccagucauauccuugaggcaggaguuaccguuucucguaugauuauuuaguacuugccagucauauccuugaggcaggaguuaccguuucucguaugauuauuuaguacuugccagucauauccuugaggcaggaguuaagacauuuucccuuguaggacccagacacugugccuggcauaugguggauauugcuugucugacaugguguuugauugagggguugaggagugaggccucugacgacucuuuuaguuaauaucuuucaucuuaaguucugggaacacagcaggguugauugcuguuucauuucucagccuguguauagagucauagccuagacuuauguagauauaugugggaaagcaguuauggauuuuuacaacuccagcugauggcacuucauauuuuuguuuuauuguaagauggacguuuccuccuacauuuuugacauaacugaaauuaggaugcguccuacauuugaaggccucuuaagaugauacuuggcagugcuauacuguuuuuaaugguaucuuuaauaauggcaugucuuacaauccauagcaucuuacauuugaugaauuuuaguaaguuauaccauaagguuauaucuugauucccuuucuuagaguuguaucacccaagaguaucacugguugcaguggacaguguggcuucuacucaacauucuuuccaauccagcucauuacauggcaguuuugcagguuuggugggguagacuucccuuauuacuguaccugugguggguucccauuggcauagauaacucugggcaaccuuauucccugucuacggugguugguucuguggugggaacaauaccugaucuguccuauuaaagugagacucagagcuuuuguuugguaggaaggaaugcuugugcucuccccuuuuauaugaguacaggguaguuccaggacccauuggcaucuauaauauuccugacggggagccagacugagcugcaagcuagcucuggaagagggcagagcagagggaacuggagagaaaggagucacagccugagaagccaucacgaggcagcagagcaucggcgguuaagagcaugggcugugguguagauugcauggguuugaaucagcaguuaagagcaugggcuguggucuagauugcgcggguuugaaucagcaguuaagagcaugggcuguggucuagauugcacggguuugaaucagcaguuaagagcaugggcucuggucuagauugcacggguuugaaugccagcucugcuacucacuaacuguggcaugcugggcaaauguaauagaugcucucuguaccuuuagauaauuuccuuaucuguaaaaugaggauaacaacucucagaaaguuguggcaaggauuaaauagauuaauacacacaaaauggagagagcaguaccugacagauaguauuugcuguuguuacuguugucauuauuauuucuaaccaacucugaaaccugcccacuaucuggguuuucuuuucuuuuuaaugcaaaucuguuuuuuuguuauuugcaacugaaaaacacccuaacucuuacacugguuaguuaacucugagacuaauuugaauucaacuuaaagauaaguauuaaguaacuaguuugacuuccuucccacugcauacuuuacacaguagguuaaaggaacucuaaaaaugugaaaauuacuauugcauagaccaauuuuuuccaggauugaacaaaucaauccgaggguguuuacaagagcuaacugaacuaccuuccuucccccuuacuuuaacaaauaagcacuaauaaugguacuggcugucaauuccuacauugucaagaggucuaaaauuuuuuuauauuugaacauuucauugaguagauaagcagauauuuucaguuacuuucagucauguagauaucccccauuuucaugucuguauuuggaauuccucuguaauaaguuaaggauuuaagaaucuuuuaaccuuuuaagcauaccucuaaauucuaaauucuucuucugcuuuacuuuuuuuuucucuugagacaagaucucacuguaucaccuacgcuggagugcagugacacagucauggcucaucgcagccucaaccuccugggcucaagccauccucccaccucagcuuccugagcagcugggacuauaggcaugccuggcugauuuuuaaaauuuuuguagagauggagucucccuguguugcccaggcuagucuugaacuccugggcucaagugauccucccaccuuggccucccaaaguguugcgaauacaggcaugagccacgacaccuggccugcuuaaucuuucuuaaauguauguaugcucacauuuauuuuuuuuuauuuuuuuuuuuuuugagacggagucucgcucugucgcccaggcuggagugcaguggcgggaucucggcucacugcaagcuccgccucccggguucacgccauucuccugccucagccucccgaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccacuauuuuaauguuuaauauuagaaguccuuuaggucuuuaaguuuggugauaguucugugaccagaaauaugucagaggaacuuagaaaacucaguguguuccaauaugacauuugcuuucuguagcuagcuucuuuccuucuuuguuuacauaccuggauggcugaaugaucuagucgccuugcuucuugucuacuaacuucucucuccuugguaguaguuaaaaacacacacuuucaaaggaguucagugguuucuaaaauuauuuuuaugguauaguaaauaggcucucaaauuuacauagaguuuuauuguuuauaaaauauuuuauauauauuuucuuuuuaggauuucuguaaaguagagagggcagacauuauuuuauccuguuguagaugaacaaauaauggcuucuaguuaauguaauaugguggugacauauauagaaacauaugauuuuccucucagaguuaaaguaucaaauaaucagcacuuuacuuuauuaggaagacacuaagaauauucccacaaagguugggaccauuguacuggcaguauuaacaaaagcacuugacaggaggaaacaguuggaggcauuguaauuggaaaaugauuucuaucugcagcucauaugacauuuuacuuaaaaaaacccuaguaaaucaaugauaaaaccuuacucaaugaaccucagaaaacauuaugcuaagugaaagaagccggacauaaaagaccgcaugucauaugauucguuauguaaaauauccacaacaggcaaaucuauauagacagaaaguagauuaguggcuguguagggcugggaggucgagaugggguagggauagggaguaacuccuaaugggccuaaagguuucuuuuuggggugaugaaacuguucuaaaauuacauuguggugauggcuguacagcucucuaaauauacuucaacccauugaauaguacauuuaaaaucagugaauuuuauggcauguaaaugauuucucaauaaagucguuaaaaaaucccaacucaguaaaauaacucaauaggguaauagguaugauaaaauuaacauggaaaaaucaaaagccuucauaaauguaaacaauaaugaguuagaagguauaaggaaggcugguccaaagguccaacugaguuaucucaauugacuuuucagucaguuauagauuaaacuccuuguucuagucuuucuccacuuguuacuacugcgcuugacuagucuuaaaaaaaaagagauauaaucgaagagaaaaccccauuuacaauagcaagaaaaaaagauaaaauacucagcaauuaaacuuuaaaaauguacaaaacuuacaggaagaaaacuuuaaagcacuccugaaaggcccgaaaguagaacugaacaaaacuaaaggcaucccuuguucuuggacgaaauggcaucauucugaaggauggcauuaaaguaaucaaggauuugagugcaaguaguuuauuagggagaugaucccaggaagcaccuguaaagagcugaguaaguaagacagaaugaagccacuacaggguaugcuaaugaacaggccgcaacuauuggcaacugaagcucaaucccauuggguacuuuugugaagcuacauggaaucuaccucauaguuaucuuaccugagggcaaagaagcgggaguauuuauucauucacucuuguccagcucugguuucuggccugucucagcaagcucccagccagugaacacucucaggcagagaguggcuguggcuuacuguagaaagccuuaggcauguaagagaauggugagugcugagcuuauguuacaguggcguuccaaggaucugugcuguggagauguagaagauacuccaguuacagaccaaacugaggagauggauguacucuguggucuuuguuaucuagguugguguuguaucuccgguaccaggagagcuguggucguuucugaauggaaccauauguggguggggguaacuuugcgguuucugguguguguugaaaaaguuuugggguuccucuaccacucaccgcaugugcuuugcccauggucacucagaagucuggacuggcacuuuggaaagagaucugaccuagucuugcugugaccaguuuuacauugagccugggguuuuugccgauuaaauagaaucaaguaggauaaauggcaacaucaauaagauaauuauuuauuuuuacaaaguaagcaauauuauuuugcuccauuuaucuccgccaauaugaauucuaucauaguuaguacuugauuacuauuaucgcuauguaaaguauauaagaaauuauauaaaguauaauuacauuuuugcaaguggguauguugaugugacaacuuuuugcauguugauaaaaaagcuguagcauauauaagauaaacauaaugguuccaugaaccaaagaugauaaaacgauuuugcaaauaacuauuugacuuaauuuucuuuuuacaaauccucaacugcuauuuuuauuuggcgaugucuaguaguucaaaaacuuauuugagugagaagauauuaucaguaaacuaguuggcuaauuaaaguuaauuuuuuaauuuugaaaaucauacacagcuauuuuaugacagauggaaaggaaagcaauguagaaugaccauauuacaguaaaucaucugugaaaacuucaggcagacauuuauaucaauuaguaaagauguugguuuucagcuuuauucccaacagaugcacuaacacagaccagcuuaaauauguugcuugguaggcauuuuucuugccauguuuuaguaaguuuacuuauuuauuuauuuuuuuaauuuauuuuuguuguuuuuguccucucuuuuucugucuuccuuugaguauuuauuaauauuccauuuuaucucuucuguugacuuguuagcuauacuuguuuguuuguuguugcuuuugguuuaaaacaucuaucucuaacucaucauaaucuacuguaaaauaauauaaauuuaauauauaauguaagaaccuuacaauaguuuacuucuauucuccccuccuauuuucugugcuauuuuaucaugcauuuuacuuguacguguuauaaaccccacgguacauuguuacaacauuucuagcacucuucauuucuuuguauucaucuguuuccagcugguauccuuucucuuuaaccugaagaacuuccuuaaaaauuucuagcuuuaggucugcugguacccaauucuucuugcauuugucuggaauuuuuguuuugccuuuauuuuuaaugauuuuucugcuagauauagaauucuggcuugacuuuuuguucugucuuucaucacuuuaaagauguuccauugucuccugguuugcacuguuucugggggaaacuucuguggcaaaguuucuacaguggucuauaagauucuacuuguucugaaacuuagacuucaaccucauuuucuucucccucccucuuuuaaacaggcugcuuaccugcucccuauuuucucauuuauugucuagucuuuggggaccacucuucuacuggauuucuuauagugcaggcuaucuuuuuuuuuauuuuuuugagauaaaauauauugcccagcuuaguuuuaaacuccuggccucaagcaauccuccugccucaggcuccuggguagcuggggcugcaggugugcgucuccacaucugacuacuuuaaaacauuuuuuuagagguagggucuuguuaugcuucccaggcuugucuugaacuccuggacucaagugaucccaccaucucauccccucuaggaggugggauuacaggcacaagccacugcuccugguucaugcagaccaucuuaugagaugguagucuguggcugcucucuguguacuuauaauaccuucuguucugcacuuguuuuccuucugacucuauuuuucuuuucuuuuucuuuuuuuuuuuuugaguuggagucucacucuauugcccaggcuggagugcaguggcgcgaucucggcucacugcaaccuucguuucccggguucaagugauucuccugccucagccuccugaguagcugggauuauaggcaugcgccaccaugcccggcuaauuuuuguauuuuuagaagagacaggguuucaccauguuggucagacuggucucgaacuccugaccucaugauccgccugccuuggccucccaaagugauuggaauuauaugccugagccacugcgccgggucaucucacuccauuuuccuuccuaacacuuaccacugugugauguauguguuuguuuauuguuuuuuuucuucuuuugaauuuuagaucuaaccagagaauuaauuuuguuauuauccucuagaacagugccuggcacauaguagggguucaguaaauauuuguggccagaaagaaagaaagacuucaguucauuaaagaggugguuguagaaauucugggagauagagcuaucuuaaaaaaaaaucauaauaaauauaagaguacuuaugaguucauuguuugaaaacauuguaaaccaggugcaguggcucacgccuguaaucccagcacuuugggaggcucaggcggguggaucacuugaggucaggaguucgagaccagccuggcuaacguggcgaaaccccgucucuacuaaaaauacaaaaauuagcugggcguggugggcucugguagucccagcugcucaggaggcugaggcaggagaaucccuugaacgcaggagguggaaguugcagugagcugagaucaugccacugcacuccagccugggugacagaaugagacucugucucaaaaaaauaaauuaaaaaaaaaggcaaacauuguagccuuugucacuaauuuuccagcugaccccgaggagauuauacuuucugagucugauaaaugaaggaaugggaucaggcaauauuuaaaguccuauccaacuauaauauauauauuuaucuauuuauucuaaacaagauccuaacaaggccucuuccuuaguugucugugcaaaaauccauuuuaaucagguuaaauauguaguagagagauuaugucauuuuccuaugcaaaaaucuuugcccuaguauucuuugaucuguggcuuaucaucaaagggccuucacagugucaugcuauucugucuccgguauuccaugucaccauuccuuacuugugaugguuaacugggcuaagggaugucuagauagcugguauaauauuacuuuugguuguaucugugagagugguccgggaagagaugagcacuugaaugugcaaacugguaaagaucacccucaucagucuauugagggcaugaguagaccaaaaaggcagaggaaaggugaauuugcucucucccuuuugagcuggcacauccaucuucugcucuuggcgcucuugguucaggggcuucugacucagauucagucccccagcuuucgaguguguucuguuccucacauugcacuugauguuuggggcuuugagcucagcuucccucucccugagcaguagcucagcuguaggccuuucugagcugcuuuuagacuuaaucaucucuucuauuuuacuguuuuuaauugcuuuguauuauuuucaaauaccucugaauuauuguagaugguuuuuagucuuuuucuguuuuuucuuuuuuuaguauuuuaagucuuauaaauauugccuuuaauauagaccugggggcucugugacuuacaauaaaauaaugaaaugacauuagaacuuucauuuuaaggucaucuuguuuuuuugcuuauuucuuucauggauuugaaggucaccuuuucuauuuuauuuuguuacauuuuacugccuuuaauauuuuacaaaauacagugggggucuugagaucuuuuuauuaaaauucuuuugguaacuuuuacugguuuacagaauuaguaauggcacuuuauuuuuuuuuuaaaaggaucuugucaagcuauuuauucuuuguuguaagguaaauaaaagugguacaacugcuuuagccuuauugguaguuuuguguaauacaaugaaacauaauauaauguuaguagauauuaaagaagcuucuuccuuaaacaucuguuguuucaucaauaugagacaugcuaaauguaauuaguaauuucgauuauuccuugccaguuaaugaugcaaacaguguugacccuuaccuaucagauaaaaauauacaguguaaacauuagagaagaauagcuauuugaggaguuuagaguuuauuucuuuauaggauauuauacuuuuacaaggcuauguguugacauauaguaacuggacugccuagaaagaucugucuuauaaaaauagucauacuucagcacccagacaaagaaaaagguaaaguucaucaauuacugcauuaaucccuccaaacuggguugguuaucuuuccagcuaaugauuuuuugcccugcuccacggcaauuucucuucccuaaccuaugcuauaauuuuagugggcacuaccuuucuuguuaacauuuccauuuuaauacuuuuuugaagauuuaucuugaaagguuuuuauuagugggcauuugcuauauuagaacaagccaaagaucagauauuuuugggcaguugaaucuuucaccugcguaggaaaucaugccaaauauaagacuaucuucucuguccauucauaaacuuucucuagauaaggucaugaauucuuggaaauaaaacuguuguucuucacauauucucuccaaacuguuaaauuauuuacaaacgaaccuuggaugaugaugauuucagcuugacugaauuaucauugacugcagugggcuuuaggaaguaggugcuuaauacauguuuauugcgugcugugaagucacugugccuuuaauuauuuuauuuacuuccaaccccaagcuguaggagcagucucuugcaugauggagucaguuuucuuuuugcuguacuuucaguucaacuucaucuucuaaacuccucaucgagugguuuauguauuagcuucuuauugaugcuauaucaagucaugacagacuuuuuuuuuuuuuuugagacagucuugcucugucgcccaggcuggggugcaguggcacaaucucagcucacugcaaccuccaccuccuggguucaagugauucuucugccucacccucccgaguagcugggacuacaggcaugugcgaccacaccuggcuaauuuuuauauuuuuaauagagacgggguuucaccguguuagccaggauggagaagucucgaucuccugaccucgugaucccccugccucggccucccgaaauucugggauuacaggcaugagccacagcucaagucgugacagacuuuuuagcugaaaacagugguccccaaccuuuuuggcaccagggacugguuuugcggaagauaguuuuuccagggauauagagugaggggggcggaugguuucuagaugaaacuauuccaccuuggaucaucagguauuagauucucauaaggagcaugcaacuuagaucccugccaugugcaguucacaauaggguuagugguccuaugagaauccagugccaccacugacugugauacgggagugcugggaagggaagaguguggucccuuuaaaugaugaggaaggggguaagggaagugcuggguagaggagggcauggucccuggcuagggcgcuacccccaucgaccuaggugaggacaagcacuucugccuuugcgcccaaauguugcauuuuccaagacuacccuggucuaccacgcccccauccugggccuauaaaaacccaagacccuagcaaggcacagacagaagcagcuggagggugagaggaacacauugguggaagaagacaaguggccggacaucgggaggacguggagggugucacacguguccaugugaagagaccaccaaacaggcuuugugugagcaauaaagcuuuuuaaucaccugggugcaggcgggcuaagucugaaaagagagucagcaaaggguggugggauuaucauuaguucuuauagguuuaucuuauagguuuaucccuauaagaacuuaucuauaguucuuauagagauaggcgguggaguuaggagcaauuuuugcuagugggggguggaucuuacaaaguacauucucaaguguggggaggauauuacaaaggauauuacauucucaagggcggaggaauaucacaaaguccauuaucgcaagggcggggaggggguauugucacaaagucaauugaucacuuaggguggggagggaacaaaucacaauggugcaaugucaucgguuaaggcaggaacuggcuauuuucaguuguuuuguaguucuucaguugcuucaggccaucuggauguauacgugcaggucacgggggauaugauggcuuaccuugggcucagaggccugacaaaggggagcacgcaggcagaagagcacagcaacagaugccagcacgcugggaggccgucggccagcagaacgacguggaguuuggcugggacgguuggaggagagcccaggucaccgagcgcccgacuccgggagaaaaccauuucccuucuggcucccccaucugcugagagcuacuuuacucaauaaaaccuugcacuuauucuccaagccuacaugugaucugauucuuccaguucaccaaagcaagaaaccccaggauauagaaaucccuuuguccuugugauaaggaagggggucuaauugagcugacuaacacaagcugccuacagacggcuagauuaaaagagcaccuuguaacacaugcccacuggggcuucaggagcuguaaacauacaccucuagacacugccaugggguccgagccccacaacgugcccaucuguaugcucccccuagagguuugagcagcagggcgcugaagaagcaagccacucccucuguggcagagggggacaagggaaccuuuacucuacuuucucuucauguuucuuauaaguggaaccauauaauauuugucgguuuauccgucuuguagcauguggcagaaugucuguugcuuuuuggucuuagagaguauaggugugaagauaauuuuuccucccccucuggcucugaaauuugaaagugcugaaaugaccugacauuagacugauuaacaggggaagaggcauauaaauguauuaaugugcagaagcacaggggccacacaguauaugagacucagagaacugaaaccaccuugcuaagguuaugaugguuagagaaauccaacacagcugacuuuaucuugcuucugaccccagaagcugacuaucugcucauuccuggguguaggucaagcuaacuaaaaaggaguuuaguuuacaguuuaacuuuaaagcaaggaugauaauagucccuuccugaaacugguccccuucuugcuugggaacugaaacugcauuuguaaaacuaaugaaagucaauaagauuagaauuaugauaagggccugaauucugcuaaguaauaagcacagugaagaagagauaaccagccauuguucccuagcuugguuacugcuggaggucacaagauuugagauaacaucaccacuguaaacccuaagauggguuuuugagauauuuuucagaccuuugcauucugguaaacugacugaugccaucuggaccaugacucauaccaaggaacagacucaacucguccugugacccccaccuagaaacugacucagcacgugaagacaguuccaacacuccagugauuucaucuccaaccaaucaguagcauacauucccuggcccucagcuugccaaauuauccuuaaaaacccugggcuccaagcuuucgaggagguggauuugagagauaccuccccuccuucugcucagcugccuugcaguaauuaaacucuuucucugcugcaacaccccuacuguucuccguguauuggcuuuucugggcagcagguaagaagaaccuguugggcuguaacagaaaggccagauagccacagcuuaaauggcacucucuuucuagcagucagggagaugggggaauauaggcaauuuugggggauagugauuuuaggagaguuuaauggauccaaggagcagacaguaguuuguaaaugguucucuuuggaaacugaaugggacccacaaguuaugggaaguugagggaggaacuguagggugaacagagguuguuguauuaugcaguugaagucucucggguaaugucucaaagcugcccucugaagaacagacgaacagucugucuggucuuggcaaugacuuauuauagauucuuuucuucucagguuaaucuuuccugguaauuuaaugagauuucuggggaggagguuuaagagaauuguauuucuuaaggaaaaaguuuccuuagucugauaaggaaauuccagagagagccccucucugugcuuugggaguuggagagauacaggagaagguuacagaguccuugguucugaggcagcuucuaaggucuucuguuuuuuuaaaauucggaagugcccagcauaugaaagcaccauacuucaggauaucauuuucugagccccaauaauagucauaguaauuuucugcugaaaacguuuguaugauuuucaaugcaaaaaugaauucuuuauuuucccccuuuacuuucauuuuauaugaccuuaguaaaaguuuuuuuuuuuuuuuuuuacuuuucccaguggacacuguucuaauugugggcuuguugauucaugcugaugaauaguaauuucuugcaaguuauucuggcacauaggguucauuuuucaugugaucugcauaaaaauaaugguggugaauacuaaucaaguaagaaugcagauuugaauacuaagcuucaaagaaaaaaacuuaauuagaaccuuuaagucacaguaguggucccucugcagggaaaguaugcuuuauuaguucuguaauguaaaacuuuuuucuuguuccaaccuauaaauugauuagugacaccgcauggguaagaaauugggaguggguugggcagaacugcugucucauaugauguucuuaaggauuguuuauuauuaccaguagcauaguuuaaacuaaaacuauuuaccccaggauaaaaauuuauuugaacaguuaaaucaaguuuauuucucaaaaaauuuauuugugaaugcauuguacuguaugcaacauaggagauauuaauuacuuuuaauggcaaaacccacaguuccuuuugcaccaaccuaauacaaagaauauaaguucucuaagaacuuccagucuaguguacuuacgugugggaguuucuacguacauguaugcaguucaaggcauaacauacggaaaguuaacuaacagaauuaaacagugcaaccagaacaccauaaaaaugacaucagaguuugaguggcaauagauaaauaaacuauauagacuaguggugcucaauguuuuuauuuuaaaugguauaaaaccuuuuuucucuaaaugaaaucuuaaacugaaccaaaagagugaaaaaauggugaaagccgggcaugauggugugugccuguaguccuggcuacuugggaggcugaggcaggaggaucacuugagcccaauaguuugagucuagccugggcugagcauaguucacuggucuuuaaaaaaauaagugagcaaagauuauuuauuuauuuauguaauuuuuagugcuggaggccaggguucuagaucuaguucuaugaacuagcuuuaugaccugggacuauuuaccucaacucugggucaauuuccuuguuaguacauggacuaauaaugggauuguugugaggauuaaaaauaauggaguaguuaaagcauuuaaaaacagucugggacgugguaaguacgauauacauuuuaucuauuauuauugcuguuauauuagaaguggggggugagcccacaacacuugccuuucccuuugcaucucuggguccuaagccuagagaagguaaaugcuguaacuguucagagaagaaaagaucacuuaagcugacauggcaguuuuuguagaaaaauuguugacaguguaucuguguuaacaauuccagggguuuguuaguuuuauuaucauguuuuggcuauuaucuucauuacaguaauaugaaacagaccuagcuggaauagcuuuaaauuaaggcaguauuuugugaugggugcuguucugcucaccaggauuuacccaauguggaugucaaaaaccuggcuccagccgggcgcgguggcucacaccuguaaucccaggacuuugggaggccgaggcagguggaucaccugaggucaggaguucgagacuggccuggccaacauggugaaacgucgucucuacuaaaaauacaaaaauuagcugggccugguggugugugccuguaauuccagcuacucagaggcugaggcaggagaaucacuugaacucaggaggcagagguugcugugagccgauagcaugccacugcacucuggucugggcgacagagcaagacucuaucucaaaaaaaaaaaaaaaaaaccagcaaaaaaaccaaaacuggcuucaguuuccugguaugauuuaccugaaucagcuguacauuuauuuuuacauauguauuugugugugugugugcauuuauguguauaugaauauauauauuuuacacauauaguaugcaguuaaaauauauacguaaaagccuuaaaaauaaugacagugagagugauuuacaugacaccaugcauucuaaaucucuuguuucuuccucuaggaaacucaaaccuuaaccuuguagagaagagacaggcuuugguucuauguggacccuccucugugucccauguggcugauuugggauguccaaugcuugcuucagggcuuugcuaacuuaccaagauaauguucuuaguuuuuccuuucauauuuuccaagaaaaaucuuuaacauuuaaaaaugacucuuuugauuuccucuaauaugucugucccaucucucacugcuggcuuuauuuguaaauaacagugggugauaucucagcccugguggucucucucuaaagacugcauucuguuuugcauuugguagcuaugucucucugacugcucuagggguaggaggagccuggauuccaaagagaaaaugaauuuucaaccaggcacauguagggauacauuucuguguugugcuguuauauaccaccccucuuuccacccacagacagaaauuuuggggaauuacuuucuaaucacuucauauucaauauuacauuagcccaucaaaagaagauauuuaauucguaagguuaaugguuuuguuuuuucggaguuuuaaucacuuguggacuaaacaaaaaucccacuuugauuugcuagugcauuguauuaggcugcuguuguguugcuauaaagaaguaccugaggcugggcaauuuauaaagauaagagguuuccuuggcucacacuucugcagccuguguaggaagcauguguggcaccuggcaucugcuugguuucugaugaggccucugggagcuuacaaucaugguagaaggcaaagcggagcuggcccgucacauggaggaagcaggagcuaguguguggggguggggcaucauacacuuugaaaugagcguaucuuaucaugagcacagcacugggccacgagagauccucccccaugacccagacaccucccugcaggccccaccuccaacccuggggauuacaauucagcgugagauuugguggggacguauauucaaacuauaucaugcauccucaugaacauagcuauuguuaaaucauucuguugggaauagcgcuguugugauuuccucaguaaucuuuacugauaaaaauuagcuauuuacucauuuuuugccugguggauuuuaauucuauccgagagugccgccuaaugauuaagggcauagguucuggagucagguuccuggauuugaauauaagcuggacuauuuacugugugacuuugggcaaccugacuuucuuucugugcccaauuuucucauuuguaaaaugaagcuaaauuugguaccuacgucauaggguuauuauaaagacuaaaugagauacuuagcacaguucuugguaugaaguuagcacuaauuauaauuacuguagagugguagcaugauguaauagaauuagacaaauuggguuguaauccuagcacugguugagggugaggguggaggugucuauacaugaccuugagcaaacuguuuaaccucucugccuugauuucuucaaccuauaaauuauggguaaccuuccuuaucagguaauuaggaagaucugguacauaccaacauuuaaaaacugcuacuauauuaaucucuucucccuuucuucccacuucuuuuuuuuuuuuuuuuugagacggagucucacucuuguugcugaggcuggagugcaauggugcgaucucggcucacagcaaccuccgccucccgaguucaagccauucuccugcaucagccucccaaguagcugggauuacaggcaccggccaccacacccagcuaauuuuuuguacuuuuaguagagauggaguuucacaauguuggccaggcuggucuugaacuccugaccucaugauccgccugccucggcugcccaaagugucucuccacuucuuacuucaauuuaagaaugcugcaaauucaggaagcuuuuuaguuuacugaaaaaaaaaaaucagguaguauucuuuuuaacacauuaaauaguugucauucaauauguuuuauuggaaucuauuuuuuucaauggcugaacuauuuuuagcugaauuacagaaacaaauagaaggcauugaaaagagaucaaguauuaaagaauguuaagguuuucuuucuaaaggauaauuaggcaaugcaguuuugucuucauuagaagccaagagggaagaaaguaaagauaugccagcuaguucagagaaaugagagagacagcaguccuguguucagucauugauuagcaucggcaacaccaggaagagccauucaggcugggagagggcuacaggaacuacucaaggaauugugaguuuccuuacuuaacugaguagguaaagaugcugagagguuugagaugauuugguaguaacaagccaagaucauagaccuuuucuguaggcucuuggggaugugugagaaagguaguuaacgcaaagcaaguuggcucagccagggagaggugacaaggggaagagacaggauaguggcugcuguaccuuaaguuuuuuuuuuuuuuuuuuauuauacuuuaaguuuuaggguacgugugcacaacgugcagguuuguuacauauguauacaugugccauguuagugugcugcacccauuaacucgucauuuagcauuagguauauauccuaaugcuaucccuccccccucccccaaccccacaacagucccuggugugugauguuccccuuccuguguccaugcguucucauuguucaauucccaccuaugagcgagaacaugcgguguuugguuuuuuguccuugggauagauugcugagaaugaugguuuccagcuucauccaugucccuacaaagggcaugaacucauccuuuuuuauggcugcauaguauuccaugguguauaugugccacauuuucuuaauccagucuaucauuguuggacauuuggcuucguuccaagucuuugcuauugugaauagugccacaauaaacauaugugugcgugugucuuuauagcagcaugauuuauaauccuuuggguauauacccaguaaugggauggcugggucaaaugguauuucuaguucuagaucccugaggaaucgccacacugacuuccacaaugguugaacuaguuuacagucccaccaacaguguacaaguguuccuacuucuccacauccucuccagcaccuguuguuuccugacuuuuuaaugauugccauucuaacuggugugagaugguaucucauugugguuuugauuugcauuucucugauggccagugaugaugagcauuuuuucauguguuuuuugggugcauaaaugucuucuuuugagaagagcagaacugaaggaaauggagacacaaaaaacccuucaaaaaaucaaugaauccaggagcugguuuuuugaaaagaucaacaaaauugauagacugcuagcaagacuaauaaagaagaaaagagagaagaaucaaauagaugcaauaaaaaauaaaggggauaucaccaccgaucccacagaaauacaaacuaccaucagagaauacuauaaacaccucuacgcagauaaacuagaaaaucuagaagaaauggauaaauugcucgacacauacacucucccaagacuaaaccaggaagaaguugaaucucugaauagaccaauaacaggcucugaaauugaggcaauaauuaauagcuuaccaaccaaaaaaaguccaggaccagauggauucacagccgaauucuaccagagguacaaggaggagcugguaccauuccuucugaaacuauuccaaucaauagaaaaagagggaauccucccuaacucauuuuaugaggccaucaucaucgugauaccaaagccuggcagagacacaacaaaaaaagagaauuuuacccaauauccuugaugaacaucgaugcaaaaauccucaauaaaauacuggcaaacugaauccagcaauacaucaaaaagcuuaucuaccaugaucaagugggcuucaucccugggaugcaaggcugguucaacauacgaaaaucaauaaauguaguccagcauauaaacagaaccaaagacaaaaaccacaugauuaucucaauagaugcagaaaaggccuuugacaaaauucagcaacacuucaugcuaaaaacucucaauaaauuagguauugaugggacguaucucaaaacaauaagagcuaucuaugacaaacccacagccaauaucauacugaauggacaaaaacuggaagcauuccuuuugaaaaugggcaaaagagagggaugcccucucucaccacuccuauucaauauaguguuggaaauucuggccagggcagucaggcaggagaagggaauaaagggcauucaauuaggaaaagaggaagucaaauugucccuguuugcagaugacaugauuguauaucuagaaaacccgaucaucucagcccaaaaucuccuuaagcugauaagcaacuucagcagucucaggauacaaaaucaacaugcaaaaaucacaagcauauauaccaauaacagacaaacagagagccaaaucaugagugaacucccauucacaauugcuucaaagagaauaaaauaccuaggaauccaacuuacaagggacgugaaggaccucuucaaggagaacuauaaaccacugcucaaugaaauaaaagaggauacaaagaaauggaagaacauuccaugcucauggguaggaagaaucaauaucaugaaaaaagcuauacugcccaagguaauuuacagauucaaugccauccccaucaagcuaccaaugacuuucuucacagaauuggaaaaaacuacuuuaaaguucauauggaaccaaaaaagagcccgcauugccaagucaauccuaagccaaaagaacaaagcuggaggcaucaggcuaccugacuucaaacuauacuacaaggcuacaguaaccaaaacagcaugguacugguaccaaaacagagagauagaccaauggaacagaacagagcccucagaaauaaugcugcauaucuacaacuaucucaucuuugacaaaccucacaaaaagaagaaauggggaaaggauucccuauuuaauaaauggugcugggaaaacuggcuagccauauguagaaagcugaaacuggaucccuuccuuacaccuuauacaaaaauuaauucaagauggauuaaagacuuacaugucagaccuaaaaccauaaaaacccuagaagaaaaccuaggcaauaccauucaggacauaggcaugggcaagacuucaugucuaaaacaccaaaaacaauggcaacaaaagccaaaauugacaaaugggaucuaauugaacuaaagagcuucugcauagcaaaagaaaccaccaucagaaugaacaggcaaccuacagaaugggagaaaauuuuugcaaccuacucaucugacaaagggcuaauauccagaaucuacaaugaacucaaacaaauuuacaagaaaaaaaaacccaucaaaaagugggugaaggauaugaaccuuaagguuuuauacuuuaaagacuuggcugggugcgguggcucacgccuguaaucccaacacuuugggagaccgaagcgggcagaucauuugaggucaggaguuugagaccaaccuggccaacauggugaaacccugucucuacuaaaaauacaaaaauuagccaggugugguggcaggcaccuguaauuccagcuacucaggaggcugagacaggagaauugcaugaaccugggaggcagaguuugcagugaacugagauagcaccacuacauuccagccugggugagagagcuagacuccaucucaaaaaaaaaaaaaaaaaaaaaaaagacuugcuucugagauagggauuaggauggggagaggccagaacuugauggagaacucauaaauuucauuuuucucucuguuuaucaguaauucucauuacuuaucaguaauucccucaccagaaagcugguguuaaggacauguagcucugauuuuccuguauaguaaaauauugauaggaaacagcaacagcuuauucuguagaccaguucuuucccagagaugccgagcagaggacaucaccccuauuaagcacaaaaccccuuuuuauaaacauguauuuugaaacacacaugcacaugcacgcacacacacacaaaugcuauccugaagggagagucuuagauaauauauaacuauuuauauagacaguuucaaaauagcaauauaaugacccaaugaaaauauaaagaagaaauaaauggaaaauuauuuaucaaauggugucuauuaccuguuguggucagaguguuuguguccuuccaaaauuuauaugcugugugaucuuaaccccuaaggugauaauauuaagagguggugcuucggggagguaauuagcucaggaaggcagaguccucaugaaugggauuagcgcccucauaaaagaggcccaagggagcugacuuccccuucugccaagugaggacacacagcaacaccaucuguaaaugaagaaaccugcccucagguuucuucauuuacacugaaugagcagugagcucucagacgcugaauaugcagacguuuugauuuuuggauuucccagccuccucaagagugaauauauauauauaauuuauuuauuuauuuauuuauuuauuuugagacggagucuugcuguugcccaggcuggagugcaguggcgugaucucggcucacugcaaccucugccucccagguucaagugauuuuccugccucagccuccugaguagcugggauuacaggcgcuugccaccacuccuggcuaauuuuuguauuuguaguagagacgagguuucaccauguuggccaggcuggucuugaacuccugaccucaggugauccacccgccucugcuucccaaagugcugggauuacgggcacgagccaccaugucuggccgaaaaauagauuuuuguugcauauaagccacccaaugugugguauucuguuauagcagccucagcugccuaggacauuguuuuauauaaauguuuuggcacuaggagagcggucauggcgcagccuuacugugaaugugcggcucuaauuggagacugauacagcuguguugucuuugggauucaaauagcaugaccuuauagucucagaugaugaacaacuccugcuaagguuuugaagacaaaaguaccaguuucuuucauuuuaccuggugguugcaaucuuagaacuauauuaaauacacuagaacaauaugagaauugcuccuuauacauaaucagcaguuacaaucuagaccuaaauugucuaaaguggacauuugaaaauuguaugugauugugacagauaaugugggauauaagcaccuuugucuccuucagagugaugguaccccccaauuauugugaaaaccaaacuauccucauaaauuuccagaccucccagggggcaaugccaacccuucugaauagcagaguuuuauuccauccacaucccccaggggauuuagucagaagacaggacaaugagagcugcugucauauccaaaucccaagagacuucuccuugccuguccugccaaucuaauuaaauaaacuauaauaauauuaccaggucgauagcuugggaaagguguuguuuguuuguuuugaagggaggacugcugcauaucgaagcaauuuugcacgauggcugugauggagcagagauucuucauccauacugccugcuuuuggagccagugacacugucacuuacuagcuaugugauccugcacuaguuaccuaaccucuaagugucuccguuuuuucacuugaaaauaaauaggcacauugaguaucuaccuuguaggauuguugugagaauuuauuaagcugguacaugucaugugcuuugaauagugccuaacacguagcacuauggacacggugcacugaagagagacuuacaagaagagcgaaaaggcaaggacaagcuuuuuaaaggugagaaaggaaauuauuaaacuacaaggcugaagaugaaacagaucauauguguugauuuucucucauagugcaucuuuaccagagcuccgauauuuuuuaaugggcaaaauucaaaaauucagccucaugcuuuucuucuccuuccuuuuggcaaggauaauaauaguuaauagcuaacaauuauagagcucuuacucuaugccaagcaugguacuaauagauuuacaaacauugugucauuuaauuuuuaaacaaaucuaugagguagauacuauuaguauccccauuuuggcugggcgcgguggcucacaccuguagucccagcgcuuugggaagcugaggcaggcagauugcuugagccugggaguucaagcuccugggcaacauggcaaaacgcugucucuauuuaaaaaaaaaaaaucccauuuuaaccuacaggagaaugagagaguuugaauaauuaacagacuguugcagcgauuuaaccuacaggagaaugagagaguuugaauaauuaacagacuguugcagcgauucaggcucaaaccgucuaauucuagaguccauucuuuuuucuuucuuucuuucuuuuuuuuuuuuuuuugagacagagucuugcucugucgcccaggcuggagugcaguggcgccaucugggcucacugcaagcucugccuccuggguucacgccauucuccugccucagccucccggguagcugggacuacaggcgcccgccaccacgcccggcuaauuuuuuuuguauuuuuaguagagacgggguuucaucguauuagccaggauggucucgaucuccugaccucgugauccgcccgccucggccucccaaagugcugggauuacagacgugaaccacugcaccuggccucagaguccauucuuuuaaucgcugugcgacaguaaacaaugaaauaaaauaaagacaccacuuaagagaagccucaacccuggaagccuguggaccaucucagauuaauugugcugggugacuaauccuugacauuuucuggcuagcucugggauuuugauguucagcaugcugguggcgguuuugguuuuguuuuaaaaguggauuagugucuauuaaccacaacguauuguauauuuuccaguagcuagaaaggcagauuuugaguguuaccaacacaaauaaaugauaaauguuugaggugguggauaugcuacuuuacucugauuugaucauuacacauuguguauacguguaaaaauaucauacuguauggccaggcaugguggcucaucccuguaaucccagaacuuugggaggcugaaaugagcagaucacuugaguccaggaguuugagaccagccugggcaacauguugaaaccccaucucugcaaaaaauauaaaaauuagccagguguggucgugcacaccuguagucccagcuacuugggaggcugaggugggaggaugacuugagucugggagguugagguuguagugagccgugauugcacuauugcacuucagccugagugacaaaguaagaucccgucuaaaaaaagaaucaugcuguaccucauaaauguuuacaauuauuaugagucaauauaauaagaguaaaaaaguggauuagugucuaagucaggacugcccaaagcacuuucuguaaugaaagaaagguuuuauacuugcucuguccaauaugguaaucagccaguagucacaugugguuauugaucacuugaaauguggcuaaugugaccgaggaaguugauuuucaauuuuauugaauuuucauuaacuagccaaauguggccaguauuggagagcacaagucuagaucacguaaagagggcacagagaucaaguaaagaggacgcagagaucaagugcuugcaggggcuuucuaaaugcugcaguuuuguugacuuaguucugucucuuuaacuugcaaacuccucacuguacuuuuuagcagaagcaggagucugcaagcagauauagacauaauacauauagaugaugggacuucugucuuuuuggauauggaggccucguggccaugucuucaugucugucuuugucuagcaggugggugccguaugugaagucuucuagugugcucacagguuaucagucucagcauccuggguucagcugaacugacucaaggaagcucuaauuauugcggcauauguuucaguuuucaggcuggaggaaauguguucccuucagucugaagucagcacagaugggaucuugagccaaggccucaacacacaaaaacaaaacugcuaaccuuucacagcugccguggugcugcugaccucagcagcgguggccaccaggguauguguaaagcuuuuauaacgaaaagcaaaaaauuuccacuuacagcuaucauugugauucgaauuuaagauaggucaaugaagggugauaugcuggcuggcuuuauuuauuuuaaagguuagcggccuuagagcaacacuagguugguuguguuggguguguccuauguagagcagcauacaugccaagucaggugugcauccaaaccugaauaaauuuccaugagacccuugacuuugaaucaggguaucugagacguuucacaugcuuuguauauguuuucuaugcuugucacaaauguaugugugcuugaacacggauauauauuucuuguuuuuugagcccuauaaaugguaucauugcugaauauagucuuaugaaauuuaaaaaugcucagcauuacauuuucagcauguauguguuauugcacauagcauuaguuauuaauuuucaccacuuugugauauucugugguauagcauagaccacacuuuaucaguuuuucugucaguggaccucuggguuauuuccuaguuaaauguucuuaccacugauuauaccuucucuuauacuacuguuagaaggcagcaaggauagggaauaaauuauccauaucucauagaaggagagaccagaggagaugaacuaggaagauaggauauauguuuaaaacagggaguaaagaaggaaacugggauauauuuuucuugguaugugcaaccaucacuaaugccaucugauuuaacuccugggcucaagcaauccucuugccucaacuucccgaguacuuggggcuacaggcaugugccaucauuucuggcuaauuaaauuuuuuuuuuuuuuaagacacagggccuuacuauguugcccaggcuggucucaaacuccuggccuaaagcaguccuccuaccaaggccucccaaauuucugggauaacaggcugaaccacugcaccuggccaacuguaauuuaugcaacuaguucuguguaguccuuacucuucuaguaauuuuccauuagucagggaggaacuaaaaaagccauguaguccaggaucacccuuaaucagccacaaauagaguaaauugguuuaucagaaguuugccauaugaguuuuguuuguuuuuaauggugacucuuaauggacaguucggguagaauggggugccagccuagcaaaugagugagcuucauuuuuauucagucugugacauuuuugacuaccaccagugcauaauagaacuuaaguauagauugaaaauuuauuuucaugauuuuaaauuauugacugcuauugcuaggccagagaucauguagcccaagugauugugcagcugaauagagaaaaaucucuuuauaguaaauggaggcuggaaaauggcauugcucguugcagguggcuauuguacuugcucauguuuuauuuagguguuuagcagugccauuugagcuucuaauuaaaguugugauuacacuucaguuguuuaggaagccucacauagacuuaaucaucagaucagcuugaugaggauuugcaaagguaagcuuuauuacuucacacaguggcuucuagccucuaucuugacugugaagggagcauugauucauaagaacauaacaaauaguucaaugauguuugaaguauauugaguggagaaugaaaugcagaagucuguuacagacacucugucucgauuaaccucucuaacccuucuauuuaguuugauggauagagggauuugugcccugaaaucacagagguaucacgugcucagauaugggaucaucuuuaagauggcguuguuaaucauuuuagcugaucgagacucauuuuaacugguuugaacaguuuugccucacauuuuauuauggucuuuuauaaauuuggaaaauaguuggcaaguuuaauaauaaauuuguucaucaggaugaagaaacaucuguauuuugauauuugcugaaaugugugauaugcuaauccuauauauguugaauugauguuucugugauuacaguaaaaauaucacaacucugucuuuugccauuauauuggaaaaagagaggaugaagguaauagguacuguuuagagagguuauucuucuuucagacuacaauguauuauggaugaacaaucuuaaaauaguauuugaggccaggcacggcggcccacgccuguaaucccagcacuuugggaggcugggaugggcggaucaccugaggucgggaguucgagaccagccugaccaacauggagaaaccccaucucuacuaaaaauacaaaauuagccgggcgugguggcacaugccuguaaucccagcuacucgggaggcugaggcaggugaaucgcuuggaccugggagguggagguuguggugagccaagaucgugccauugcacuccagucugggcaacaagagugaaacuggcucaaaaaaaaaaaaaagcaccugaauuacugggauuuaagaacauugcuacuggauguuuuagaacuuuauaugauuauuacauacucuauuuuuuauuuuuaaaaauuuaaggcugggcaugguggcucaugccuguauccuagcacuuugggaggcugaggugggcagaucaccugaggucaggaguucaagacuagccucgccaacauggugaaacccuaucucuacuaaaaauacaaaaauuagccaggugugguggcacaugcuuguaauccagcuacuugguaggcugaggcaggaggauaucuuaaaucugaggggcagaguuugcagugagccgagauugcaccacugcacuccagccugggccacagagcaagacugugucucaaaaaaaaaaaaguuuaaauagagauggggucuugcuguguugcccaggcuggucuugaacucaugggcucaagagauacuccugccuuggccucccaaagugcugagauuuagaggugugagccaccaugccugggccuuauuuuuuagaguuuaauaucaucagcuuuuuuccauuugaaagacucuccuugguuaccuagaaauuuuauuuuagcuuucauaaaaagcuuugcuuugaaagugaucacugaauuaaucuaaggaaauaugagucuuaagauacugugaugauguucagcugccucgaauacuuuuuaaaaaguuaguauaguguucaugauguaugaacaguuucuuuugauuuaugagcuucagauuuugugaauuuuaugaauuuugagugugucugaaaaagacagugguaggaauaaaguaauuucuuuccacaugaaucuguuuuucaguguuuuccgaagaaaacauauuuguauacuguauaauucauagugguuuuuuuuuuauuugccuaggauaaugaaauaaaguacauuggguauuuuauuacauggcugauauuguuucucuuggcugcuuuguuuguuuuguuuucucuuagaaaaauaucucaagucuuguaucucaacuacaguagccugaaaggggcaaggaauuuucuauuggaaauggccaggaaacuauacugcaucaaaagauugaagucauaaaauagcacaauuaaugaccgauaccaaucauaauauuguuucuuaaaguugucuuaacacugaaauaauuuuaaaaaaaugguuuuggauccagacacaguggcaugugccgguaaucccaguuacuugggaggcucgggcgggaggacugcuugagcccaggaguuugagaccagccugggcaaccuaacaagacaccauuucaaaaaaaauaaacaaacaaauaaauaauggcuuugaaauaaaauguugaaaugcaaguaguagcugguauagcugcgaagaauauuuguaaaaggcacuuaauauacuguuucagugucuuaaguuacuauccugcuagacuaagcuuugugaaggcaggcacuguuucuguucugugcuuauuccucacugccuaucacaguauguggguaaauaaauguuagaugaauaaaugaacgagugaccuguuaaacugauggcagugucuuaaaauuagucaccuagcaauggagcauuuuuuaggauuauauaucugaaauauauaacuuuugaucuuuaccuuuuuuuuucuuuugggaaaacagagaaagaugaaacagagaaagaugaaaauuuuagcauacaacuuuaguauaaaauuaauguaaucuuaguggucuuguuuaauggcuugcuaaugucagaguuuugaggacguggauacagugagaauauaacaaauucauaauuguaauuugcugauuuuuagaucagacucaauuucuaugcuugaauuuuauguuugcuaauacaaauaauuugaaagccaauguuaauacaucucauagccucaguaauaaaguugacaggaugacauguugcuacaaauccauaaaugguauggcuuacuuuauaguuugguaggacauaaguuccuuaaggauaggcaugugucuuuuucauuuuuguuucuuuuucacaguacuuuuuaaaauaguaucuauuaaaaaugagaggcugggcaugguagcucacgccuguagucccagcacuauuggaaagcugacccgggcagaucaguugagcccaggaguucgagaccggcuugggcaauguggaaaaacccaaaaguacaaagaaguaaaaaaaauacaaaaauuagccagguaugguggcacacaucuguagucccagcuacuugggaggcugaggcgggagaauugcuugaaccugggagguggagucugcagugagcagugaucaugccacugcacuccagcccaggugacagaaugagguugugccucaaaaauaaauaaauaaaaauaaaauauggggcugggcaagguggcucacaccuguaaucccagcacuuugggaggccgaggcagguggaucauuugaggccaugaguucaagaccagccuggccaacauggugaaacccugucucuacuaaaaauacaaaaaaacuagcugggcgugguggcacaugccuguagucccagcuacuugugaggcugaggcaggagaaucgcuugaaccugggaggcggagguugcagugagccaggaucaugccacugcacugcagccugggagacagagcaagacucugucucaaaacaaauaaauaagauaaaauaaaaauaaaauauaugaaaaauuuguguacaguugaaaucucaagagaaaaucuacaacuaucuacuccuuuaugguaugacuaauuacgcugggcaaucagucuuuuuauuaauaguagaaagagggcuggguguuggauguuguuugauacugucuauuuuauauagcucuugucagacucaucacuaguucuugaauucuguuucuuuggguucugugaaugcucucaccuguuuaucuuccuccauugugcauaccucauucucaguuuuucucuuccagucuccuccuccuuuuggcuccugcugaucugacuaaccugagccccagugucucccucuuugugcucugugcuucagucacucuauacuauuuacaguccccugaauguacuguuuaccauuguacaugcuuuuccuugucagccugguuuaacccuugcccuuuaagaaccacucuaaguauuucauuugugaagcuauucccaaguagaggucaucaccacugcauguuguacaucucucuaugguagcuuuuaccauaccuuauuauagauucucaucuaugaaaccagcuuugcaaugauuaugacagagaaguccagcauggcugacuccgccuucuaagcucacaggcgggcuguccuugcccauuucugggcgugggccaaacuaaccacgggaagaauugagugugucguuuaaccuuggagcaaggaugaaaacagucccucccucaaauuaacucccuucuugcucagggacugaagcugccuuuguaaaauuaaugaaagccgaugagauuaggaugaugggaagagccugaaauucugcugagauguagggauaguuagaccauaaccagccauuguuccggagaucacaagauuuguaacuucuccaauugcuccuacagaugacgucucuauuguagagccuaagauuggucuuuugagauguuuuucagacuuuagcauucuagugauugacggauuccacccagacccacgacccaggacucaaccagucuuguuguuguuguuguuguucuuucuccccuccccuccccucuccucuuuucuuuucuugcuuuuuuuuuuuuuaugacucaaccagucuugugcccccaccccagaggccgacucaacacacaaggccuguuuucuacaccccuaugauuucaucccaaaccagucagcauuccccauucccugucccccugccugcugaauuauccuugaaaagcccugguccccgagcuuguggggaggcugauuugaguaauaaacuccuguucuuuugcuuggcuggcucuguguuuguaaccucuuucuccacugcugucauuuauacuguugucucugaaucagcucuaucugugcagcaggcaagaagaacccaucaggugacuacaucugucuagguauauuuuuccuacuagaccauucacuucuugagggccuggcaauaauaaacauuuguuuuuuuccaugauggauaaguaaggaauuuaggauagcuguguuaaaauagcuccuaucuucggagaugguuuuucaaccgagagcacaaaagguaucaucugaaauaguuaagaaggucacagagcuaauauaugauguaccagcagucccaaccuuuuuggcaccagggacugguuucuuggaagaucauuuuuccacagacuggaggacaggggauggcuuugggaugauucaagcacauuacauuuauuauuagauucucauaaggagugugcagccuagaucccucgcacacacaguucauagcaggguuuaugcuacuaugagaaucuaaugcugccgcugaucugacaggagguggagcucaggugguaaugccugcuugcccgcuacucaccuccugucgugcagccagguuucuaacaggcaacagacugacagugguccaugaacaggcaaagagaugguacaguuuuccgaagagcauacccauccuaaggauuccuaaucucuagaaauucuacaucacagugacacacuccuuuaguaucuucagccaugcuugguaaauaaauauuguugcugugguuaagccguaguuuuuguacuuguugaguguauuaguucucacacugcuauaaagacacaugggagacuggguaauuuauaaagaaaagagcuuucaucagcuaaugauucuguaggccauacagucuucugcuuccuugggaaacauacaaucauagugaaagacaaagcggaagcaagcacaucucaccauggcuggcaggagaacaaccaggucucgugagaacguacugucacaagaacagcaagggggaaugugccccaugauucagucgugccccaccaggcccuccuucaacacuggggauuauaauucagcuugaaauuuggguguggacacagagccaaaccauaucauugaguauaugaaagcacugguuaucuuaaguaucaaaauaaaccgauguugcauaauaguuuguucuuuggucuuaggaaaguuauccugaauuaguccagugugcguugaugauguauauccaguucugauccagaagcugucugaugguccagauaggaugcuaaggagggagcagaaacuucgagagcuuugugguuugauauauaauuaguaagugagccguugggaacaaaaaagcuuugauaaugaauaaucagcuagcugagaagcuaacacuaaaauuuccaaacaguauaggaucaagaaaaauggagacauguaccaguaggauauugauguacguauaccuauaaagcccaauuugcaaaagcuaauuuauuucugucauuuauauaugagcaacucauacuuccauccuaaaguaaauaguauuuuucuagacuguccgauaauuugggguguguuccuaaggccccuuacaugaugagauauagugacccucacucucauaaaggcucuugaccaaguucuuccucuaaacauuuuucuuuuuccugguaaacuaccucagauauuuagcuaaccuuguaaucuuaaaaucagguuuuaaaagccacccuaucaucuuaggugucuaucauaggugucuugacgucugcaggcucuugccaugugauuuucuuguucuuauucacuaggugguggcagagcauagaggcagcgaucgggcuccucuccccugacagugguggguucgucuucccuguccagccgugguggguuccucuucccugucugaccaugguggguuccucuucccugucugacugugguggguucgucuucccugucugacugguguguucgucuucccuguccagccaugguggguucgucuucccugucugacugugguggguucgucuucccugucugacugugguguguucgucuucccuguccagccaugguggguuccucuucccugucugaccguggggguccacucgcaguaguagugcacauuguccacuugugaaaaagguggaacuugugagaggcacguaacagccagugguuuugccuugucuauuuuaagagaacccgugaggaugauugaaaugacucuuugaaaagaaucaauuugucucaggcugaaggaaaauagaagaaacggaacauuuccacuuggacugcaugagagauguugguauugagguugcuauucagacagcauugaaacauuucauugaaacauuugaaggauggagcaaaauguuaagauauauuucuacacuuggacuuuggcauuuagagcuuuccucguuccaaaagauccaugcuauuugguucugguuugguugcuuggggauagugguaaaaauagagccuucuguuuuaaaauggagggagcaggaauugcuuucuugcuguugacugcuugucccaggagguucuacccaacaagugaccgaauugccucucuuauaucauaaagcauagcuagguucaggagccucucuuauaucauaaaguguagcugaguucaggagccucucuuauaucauaaagcauagcuaaguuugggagccucauaucauaaaguauagcugaguucgggagccuuucauauaauaaaguguagcuaaguucgggagccucucauaucauaaagcauagcuacguuugggggucugucuuauauaagaaagcauagcugaguucaggagccucucauauaauaaagaguagcugaguucgggaggcucucuuaucucauaaagcauagcugaauucaggagccucucaaauaucauaaagcuuagcuaaguuugggagccucucacauaauaaggcauagcuagguucgggagccucucuuauaucauaaagcauagcugaguucgggaggcucucauauaauaaagcauagcuaaguuugggaguugauugcugcuauguucauuguucagucuuuacaacaauaggacuuaagagccugauauuggugauuucuuguuuucgaauauucugauuucucugucaaaagccuguguuccagugaaauccaaagcagaauuccaaagguugguggaaaugauuaagguucggccucugccauagguuccugcuguauguuuacauuguacgccccucaguauugguguucugacaucaggaucuugugugugcagugagguuuguguacugugggguuaaacuuccuuucguuauggcaaggagguacacaggaguucucucacaguguauauuggugagaaacagcuguuuggauucuauucuuaaaggaaaugaauacuuacauuccaauguguuagagaucuuggguuuugucaguuauacauacuacauagcugugcuauauaugaguuaguuugccuaauauuuuagguacuuauugauaagaguaaucagaaaacauacaugauuguccuacuaguaucauuucuuucuugaaggacauaaggauaacaguuauuuauuaggaugugacaccagagaggaguaauuuaacugauuagguuuucuuuauuuucuguuucugugaaauaaaagcaaagcuaagaaagauggaauucauguggaaaaauccuuugcuucuuucuagcuguuaaugcuaguuuucaauuuucaccauagaugucaccaaagcauagaaaguaguucagaguuagaaauaagacaauuguuuuuagauuuuuuuauaaagacagggucuugcucucuugcacaggccggagugcaguggcgcgaucuuggcacacggcagccucacuucccagggucaagcaguccuccuaccucagccucccaaguagcugggauaacaggugccugccagcaugccuggcuaauuaaauuuuuuuuuuuuuuuuuuuuuuuuuuuagagaugggggucacgcuauguugcucaggcuggucccaaacuccuggguucaaacaguccuccuacuuuggccucccaaagugccaagauuauagguaugagccacuaggcaauucuaugccuagccuguaauuuuaucuaauauuauaaauuucucaugcuguuuaacuuuuugagaaauauuacaucaguacacaaagugcuuauguuagaauguauugcuuugguugagagaaauagaugaaguccuuuuugaaaaugagcuaauugugaugcuucucuuagugauuuugugauguauguaggaauccugaacacgggaucaggcagccucugguucugucacugaguaacuggauuauaauggucaagcuuaaacauuuuuuaaguuaguuuuuuaaaaaaagaacuucauugagauauaauucacaucucauauacuucacucauuuaaauuguauaguucuguguauuuuuuuuaacauagucucagaguuguuuagccauuaccuauuuuagaacauuuuccuucuuucuaaaauaaaacuuguacucauuauauggauuguauaauuacucaguauuuaacgauuugugggacuaccagguuguuuccuaagugauaaaccauuuuacuuucccaccaguaaguaugagggaucuuucuucucauuuuugucaacaccuguauucucuguuuuuuaaacuacagccuucuaguguguuugaagucgccugucuuugugguuuugauuucuauuuccauaaugauugaugauguugaacauguuucuauaugcuuauugacuauuuguguaucuucuuuuagugaaauguuucuuuauucuaauugaguuuuuuuuuuuucuuuuucuuuuucuuuuuuuuuugcuguugaaccaucucuaaaaacuaguaccuucaaggccaggcauggugggcucacaccuauaaucccagcacuuuugaagguggaggugggaggaugacuugaggccuggaguucaaggccagccugggcaacagagugagaccacaucucuacaaaaaauuuaauaauuagcuggauguggugguguguucuuguagucccagcuauucgggaggugaaccugggaggaucgcuugagcacaggagauugagacugcagugagccacacugcacuccagccugggcaagacagugagaucuugugucuaaaaacccccucaaaaguaguccuucauaauggaguuauuaugaggauugaaauaauugauauaugugaaauacuuagcacaguaccugacacauagugagugcuccucucauguugguuauuauuguuauuauugccuaaaguaauucuuucaugcguuucauguuuccuggucauucuauuuuaauuccucugauaugaguugugaaaaaaaucuucaacucccauuuucaccaaccuugguccuuccuacauguguucaauuguucauuuguucguuuauccuucauuuagcaagcauuuaccgaaugccuauuaugugucauguuuugugauagaaccugaugcugcaaacuggaaaaaaaaaggaugaaagucuggagggaaauucaaaugauaguuggagagcaaugagagcuuuauuguagguauuugcaagcuucggugaaguauucagagaaggguuuggugauaagcugaaacuggagggaugagugggaguuucugaugcaaauauugaggucaguguuauggauagugcaaggguauguucaaaggcauaggaauuugaagacauugaauguucgggguaagaugagauuuauaggaugcugccauggguugugcugauaggaguugggaaugugauaugaacagcuggagacgggaguaccaaauaggaaagcaccucucuugcuucuggaucuuuaaugcucagaaaauucuucccucucuccuuuuuacauauuuagcuuuucauuaugaaauguguuacuuuucauuaucaaauguuccuccuugucucuaguaauaugugugucuuaaaguguauuuuguuugauauuaauauagucacugcagcauucuuaugauuacugguuuguuuucuuuugaacuuguuuguaucuuugaaucuaguauauaucuccuauagacagaauauggucgagucuugcauuuuugguucucuuuuccuuuccccuccucucuccuucucucccucucucccccucuccuuuuucccucucuccuucucucucucucucucucucuuuuucucucucuuucucucucucucuuucucucucucucucucaauaaggucucgcuuuguuucucaggcuggagugcagugguggaaucaaagcucaccguagccuuuaucuccugggcucaagcaguucuccuacuuaagccucccauguaucuaggaauauaggugcaugccacugugccuuuuuuuuuuuuuuuucagauauagagucucgcuuaguugcccaggcugaucuugaacuccuggccucgagugauccucucacuuugaccucccaaaguguugaaauuauagacaugagccaucgcacccagcugaagcuugcuuuuaaaacuccagccugauggucucuuccuuuugaugugaauguuugguacauucaugcuuaauguaauuuuggauaugguuggauuuaugucugccauuuugauuuuuguuuucuauagguuugaugucuuuuuugucuuccucuguucuucuauuacauuugcguuaaauauuuuuggaguguaccguuuuaauucaucuguugauuuuuuuaaaagucaucuguuguuguuguuguuguugcucuagugcuguacugcccacugcaguagccacuagcuacauguggcuguugugcacuugaaauguggcuagucugaauuuaugugugcuaaagugaaauacaaaucagauuucaaugacuuaauagggaauguaaaauauucauaauuuuuguauugauuauauguugucauaauacuuuggauauguuggauuaaauaaaauauguuguuaaaguuucauguuuuaaaaaccuuuaaaauauuacuagaaaauuaaaaauuauauaugugacuuauauuuaugguucucauauuucuguuggauagcauugcuuuaaggauuacaggaugaaucuugaacauagcauaaucugaaaguuuuauaguuacuuaaucuagugaaguaugguaacuuuguucccauacagcuucaucccuccccauucugcauugugcuauuuuugucauguacuguccaucuauauauguuauccacugaauaaugguuuuuaccuuaagccaaucuuaggauuuguaaagaaauuaaaaauacaguauauaauauacaggcuuuuauauuuaccuacauaucaacaauuuccaguauuccuucuuauggaguuugcuuuuuuuuuuuuuuuuuuuuuuuuuuuuggagacagaaucuugcucugucacccaggcuggagugcaguggcaugaucauagcucacuguagccgugaacuccugggcucaagggauccuccuaccacuugccccaacuuggacuauagcguuagggaacaaagguaagguuuuucccuuuuugucucccaccacauuugcuacuuuagcugauaaagaccuggaguuuugccccccaucccgcagcagaucugccccuucugguagcaaagauacuggcuuuugcagacagccccaaguuugucaaaguuuucaccacggcagcugaguguaggguagaagcagccugaggcaaggagguccucuagaaacugacuucaaccucgaggugauuuucaagaaugaaugcuuucuacaaggagguccccagaaacugacuucaaccucgaggugauuuucaagaaugaaugcuuucuacaaggagguccucuagaaacugacuucaaccucgaggugauuuucaagaaugaaugcuuucuacaaggagguccccagaaacugacuucaaccuugaggugauuuucaagaaugaaugcuuucuacaaggagguccucuagaaacugacuucaaccucgaggugauuuucaagaaugaaugcuuucuacaaggagguccucuagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccuagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccuagaaacugacuucaaccucgaggugauuuucaagaaugaaugcuuucuacaaggagguccccuagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccucgaggugauuuucaagaaugaaugcuuucuacaaggagguccccuagaaacugacuucaaccucgaggugauuuucaagaaugaaugcuuucuacaaggagguccccagaaacugacuucaaccucgaggugauuuucaagaaugaaugcuuucuacaaggagguccccagaaacugacuucaaccuugaggugauuuucaagaaugaaugcuuucuacaaggagguccucuagaaacugacuucaaccucgaggugauuuucaagaaugaaugcuuucuacaaggagguccccuagaaacugacuucaaccucgaggugauuuucaagaaugaauguuuucuacaaggagguccccuagaaacugacuucaaccucgaggugauuuucaagaaugaaugcuuucuacaaggauguccccagaaacugacuucaaccucgaggugauuuuccagaaugaaugcuuucuacaaggagguccccagaaacugacuucaaccucgaggugauuuucaagaaugaaugcuuuuucauuuguucucugcuuuggucuauuuucagugcucugaaauguuauuuuuaauauaauuuuuuccaaauuuuauaguuguuuuauauaguaacaaauuacugacuucuccacauagcuguaacuagaaguccuucagaacucuuacuuuuccuucagguuuucuuccuccgaggagacuucccugccucacacugcugcuuugcuucaggucucucugcucuguguucugguaauauccugugcuuucuauugucagauuaauuguccuuaugcuagacuguaaacuccaggaagccagguacuuuuaaaauauuacauuucuuucuaaacacaaugucuggcacaugguaacaaauaucugugggaugaauaaauguuaaacuggcauuuugaaucugguuugguaccauguucacuuuaaaugccguugagggccaacugugagguacuuaauacauuaaauguuuugcauauuuuauuuacuccuuaaaacaaaguuaacaguguugccuccauguuauagauaagaagucugaagcuagaaaaguuaacuaaguuguccucuaaauauuauaaauauuaagugugaagccaagauucucaguccaugucuaaagcucauaccguauaccauaugcuaaguacguugccucaugcggugguuagaagggauauuuauccacaguuauuuucauuuaaaggaagcuucuaaaugguaauauuauuucuuaauaguauuucugagcacugcccuuuaccgugugcaaagcagucugcuugcuguauucucuaucugcuuuucuugugcguuuuucaugagagucauauaacauagguaguuccccaaaggauauuaauguacuggccuauaccucgaagacucucgcuuauuguguagucccuuuuucauauucugugcacaaaaagguuuuuuuuuuuuauaucagaaaguauaacauuguauaacauaggauuguauaacaaucuuauaauguauaacaggauucacaucauacacggcgggagggguaaacuauguaauaaguggucaauuucucccacccuuucucucauugucauauugucuauagagaccaagagguaaaacauaguuuguuguucuugggucagucucaguucuuauauggucuccucaguaacaugagugacugacaauuuuuuuuuuuuuuuaacaauuaaaagauaacagaggugaaaucucacuauuggccaggauggucuggaacaucuggccucaagcaaucuuccugccacagccucccaaaagugcugggauuacaggcaugagccacugcaccuggcugacaauugcuuuuuuaucaacuuuagcgccucuuuguuccuccugcucccuggauaaaaauuauuaaaauguuuagucuaccaguaaucuuugguuccugacaacacugaauucacaacagacuucuguuuucuuuaccuucucccauaucacccaguagaaaacacaaucucuauagcaaguucauuuuaacuccccuuugcagaaaugcccaguuuccuagaguacgcauucuccuuuuacuguagcaagccgauaaaccuaacugguggucuucuggcacugggcuuucgcaccuccagauaacauguauguauuuuaggccagacgcgguggcucaugccuguaaucucaguacuuuggaagguugaggcggauggaucacgaggucaggagaucgagaccauccuggcuagcacggugaaacccugucucuacuaaaaauacaaaaaauuagcugggcgugguggcaggugccuguagucccagcuacuugggaggcugaggcaggagaauggugugaacccaagagguggagcuugcagugagccgagaucgugccacugcacuccagccugggcgaaagaguggcggaaaaaaaaaaagguguauguguucuacugccuuccuacucaaaguaugguccguggacaggaggcaucagcaucaccuggaagcuuguuacaagugcagaaaagccccacuuucagaccuacugaguuagaaucugcauuuuuagugauuguguuuguuuuaaaaaagugauuuguuugaaaagcaccgcucuacacaguucccgcuuuugaugguccauguccauuucauuucuuguucauagacaauauaaugcacaguuuggagggcaguacuauuuauacgggguucuuuacugaauucuuucacucagauaauucuuuuuauuuccuuuacuggaaacauuucuaguguuaauuuuaaguuacagaagguggguccuuucucuccuaggaauaugacuuaaugcaguauacacagauuugaggugggagcagaaaugcaguaaggcuuaauauuuauaacauuuuaauauuuuuaaaauauuuauauuuauaaaauacuuuaaaagcccguagugccaugugaauuuuaaguauuaagaauaaauugaaauacuuaggaaauggguauauccuaaguauacuuaggaaaugggcauauccgaaguauuucaauuuauuccuaguacuuaaaauucgcauguaguucucugucucaaauguuacaugcucaugauucacucagaucaauuuucaaguaaguauuguguuaugcacauaguuuaaauaauuuaccaauuaaauucaguuugaaagacaugcuggagacaaaagauaaauuuucaauauuugagcacauaggaaaaaccuagucuuguaagauuuuauucaguaaaauucuuaggcagaaaauaccuaagcuuuauccugcaugauuuugauuuguuucauuuuuuuuaaauguaugaaugaaagauuucuuuauuauaaauuuggucagguauuuaucacugcguaaguccuagagaauauuauguaaugucccaugggugaaauauuucugagguaugaagaaaaucagcucaauucagcuacuacaaauaaugucuuuugacagauaguaaauaggagaaucaguuaacuaccuuaguugucuuuuacugagcugucacaguauguuucccauuauaauuuuucuuccaaaccuaggcuuuuuaaggacaguaauugugauacuuuuauugauauauauacacacauaaaauuucuauuuuuagaccaggugcaguggcucacgccuguaaucucagcacuuugggaggccgaggcgggcagaucacuugaggugaggaguuugacaacagccuggccaacauggugaaaccuugucucuacuaagaauacaaaaaauuagccgggcgugguggcgggcaccuguaaucccagcuucuugggaggcugaggcaggagaauugcuugaauccggguggcggagguugcagugagccgagauggcaccacugcacucuagcuugggcgacagagugagacucugucucaaaaaaaaaaaauucuguuucuaaauauaaucuaauuuuguucaaugguuacauuuucuuuuuguguguguguccaucucuguuuagaacauuaugggaccugauuuuucuaaauuuagucucaaccuauacaugaaauggaaacucugaagguuuaugagaccugauuuuagggaaagaugaagaaacacauuauuuagccugacagaaaaagauaucugaaggauaauuaucucucagcuuccauauuauaauauugcuccaaaauaguugcauuuuauuuucuaguuuacccagaagaaaauacuucauaugagauacauauauaguaaaagugagucauuccauuuuccauccuccuuuuuuuuaaugguuguuuugucuaagacaccaggugucugcucccugacuaaucagacucaccauuccagaucuuuuaauuuuauuuaaugccuuuguguuucccuugacuauaaauguuucuguuuaucuugcacuuccucuucauguauugaagauaucaauaacagagugaaagcuagcaagcuuguaauauauuuaacauggcaggagaaacaaacauguuggcauuuauucuggccuaagaaaaaggagcaggguuuugcugaaaggaguuauuuguuaacuuugguagaacucuugaccucaagugaucaacccaccucggccucccaaagugcugggauuacaggcaugagccaccaugccugaccccaucuugauauuuugaucaucuuccaaaaagcaucauaacagcuuuuauuucaugugauguauuaccucuugcugccugcaguuuaaaggauaaugcauuuuuaaaccaaagaggcuucauauccaaaauaauugucuguaauuccauuucagauauggcuuuuuguuguuguuguuguauauuagaccagugcuuuucuaccuuuagugcaauaugaaucaccuagacauuugauuaagauguagauucugauucauuggucugggguggagucagucucucaaaugaagucaggcuuuguguuucaguaguuguggccuucugcccuuuugggaggagaacguucucagaaagauucuuuuuacugaauauugagaucucugaucuacccauccccaacacucauucaaaugcauucccagcugguagauccugcuguguaaacagaggccaaguugaugauuccuuuggugucuuucaugccuguaagguaauuugccuucuuuccgccuccugagggaaggagggcuaccucaaguucuugggcaggcuagccuugugccugggucaauaggugggcaggccugggaccuggguccaugggggugggucuggagccugggcccacugggacaggucuggaucuuggguuugaaggacuagaccccggguccaugggggaaaccugguggugagguccacugggugagucuguugacugagcucaugggugcgagccuggagcaugugucuguaggggcuggccugaagucuggccagccuggcccuggagugggccuugagccugagucugugggggccagccuggcacuaggauugucugggugccuggguccauguggaugggccuugaguuugaguccauggggguuagccuggugcuggggugagccuggagcuugaguaugcagaaagagaccugguucuugggccuguggggaccugucuggaucuuggguccacaggggcaauccuagagccuggaucuguggggcaaccuggcacuaggguugaccaggguggacuuggacccugggucugcuggaaugagcuuggauccugggucuauuagagucuggggucacagggaccagccuagagccugggauuggccuggugcuggggugagccuggguccacggggcuuggucuggagccuggguucacaggugcuagccuggugccuaaggcuguggaugcugaguuuacugaggcaggccuggacucugagucuauagagugggcauggguccuggguuugcuggagcguggguccaugggugcuggccuggagucuagggcugugaggacugaccuggcauucuagugagccuggaaccuagaguuguagcggcugacauggggcuggacugggcccggaggcugagucuuuggguuucagucugaauccuggggcuacaggagcuggccuggagccugcguugggccuggaggcuggaucccauaggugucagcuggagggguuuggggcuauaggaacuggcccggagccugcgguuggccuggaggcuggaucccauaggugucagcuggaggggucuggggcuacaggagcuggccuggagcccacgguuggccuggaggcuggaucccauaggugucagcuggagggauuuggggcuacaggaacugaccuggagcccgcgguuggccuggaggcuggaucccauaggugucagcuggagggaucuggggcuacaggaacugaccuggagcccgcggugggccuggaggcuggaucccauaggugucagcuggaggggucuggggcuacaggagcuggccuggagccugcgguuggccuggaggcuggaucccauaggugacagcuggaggagucugaggcugcaggggcugcuuugauuuucuucuaaaagugucaacaguuauugguguugaaggccugguugaaaauacuuccauauguaaacacauuuguuucuuuagcaaacauuuauucacuguauaaaauaugcagggcacugcgggagacauggauggcgauauaaagagguacuggauguacucacuccucuaaggaaguccuuguugccuccaguacauugaccagucugaguucauuggucuuccuucaugguaugagaacaucuucaagucuucuguuuugacuugauugcgguuuguguaugcaacuuuacacaaaagcaucgauaaacuuggucucuguucgccucuguuucucaccagguagugucuuuaaucacuuuaaugccaucccaaguuuaucauuuauaccuguuaaaauaauuucagguaucauaauagguuuuguuuuuauuuuuuuauggaaaaacugcugguuaucuaccagauauucgcugggcacuucuuuaauaaaagaacuucaguuuuauucgagguggcaguaagcccagcuaaagaaugaaauguuccgacuuucuagacauggccaugugacugaguucuggccagugagaguaaguccuuuaagacuagaggccuagagagucagagagugucaguuuugcuccucuucauccauuuacaccauuuuuccucuuccucaaaauugccagcuccucugaagcauuugccauucuacuccccauuaccucaccuuccaguuauuccuuaacauucauggcucacuuuuucuuucuuuaucauuacuggcaacaucauucuuagcgaauugagcauccaucugacaccugggcuguuuguccccacuuccaauucucuuugccuuuaccuuacccuagcuaccucuucccauggccauagccuaggacaguagcccauggcuauacccauggccacaccccagcacaguaacuauuacuucagauaucucaauuucaagauuccuacuuuucaacaacugcauguuacagguaucuagcacagaaccugacaucacauaauaggcgcuuggugagcauuauugcuguuccugcuauucugccucugucguagcaucaacaguccuugaaaauaggaacugucuuauugauccuuauauauccagaaccuaccagagccaugguacaaaaagacucuuaguguauuuaugggaccaguaaugaaagaacagcaacaauaggaaggauauggcauucagaagaaggucuuuaaaagauaauuaacauuuuccauuuaaaauaucacauaguuuuuaaaaagcauucaaguaaugacauuucaaaaguuguuuucuuucucauuuucucuggggggaaauagauguuauaguuuauugccauugggaaucuuuuugcuuagucaagguugaucaauuacgaauuuccauuucugaggauuauuauaaaugagcuauaaacagggagauugcuuuuuagugaaauggguuaguuuaccugaaaagaguuaauuaucuuuuuucuccuguauugaaaacuauucguauuagccuaguguguauaggagaggaugaaggugaugcauuaagauuuucucagccuuccuuauuaucuagguagaaaaauaaaaguauuuaauguacuguauuaucucugaauauuuuucugagauaugagaaaaauguguagaaguuuuccaucuauuuggguauggacguugacuuuucagaacuuuuuuuuuucuuucuuucuuucuuuuuuuuuuugagacagaguguugcucugauccucaggcuggagugcaguggugugaucucgaccucccugggaggugcaaccuccaccucccagguucaagugauucuccugccucagccucuugaguagcugggauuacaggugugugucaccaugccugacuaauuuuuguauuuucaguggagaugagguuucaccguguuguccaggcuggucuugaacaccuggccuuaagugauccauccgccuuggccucccaaagugcugggauuacaggcgugagccaccauacccggccuuuucaaaacuuuuaaaagucaguuggauuaaugauuuuuccagaaacauuagguucauuguuauuguauucauauuugguugcuuucaggcuaagaaguaguuacuguuuagcuauaccuaugguuacuucugcgaauaacuucaacuguuacguuaauucaguaauuuuucauuguuagauaugugaaggaccugaaaauaaccaggaaaaacaucccaagaguuauaaacauucaaagcuuuauaaaauucugauuuucuagaaaggcuaagcuguuuaauauauuaguauuguuuaaucuauuaguucuaagauauuucaaauaauaucuagaaacagcuuuugaaaguuugcaauuuaaaaaucuuaauaauaaaaccgugaugauaaugaguaauaguuacugagcacuccugugagccaagaaugauauuaaguuuuuaaaaguuuuauucuuauuacacccauguaauguuauuauuauuauuuauuaucauuuuaguucagugguuucaagagauuaaauugcuuaguauuacacaguugcuaaaugguuguauuaguuaggguucuccagagggacagaaguaauggaauauauguguguguguguguguguguguguguguguguauguauguguguguaaguauauauauacuuaauaauauauauauaaaauauuguuuucuuucucauuuucucuggggggaaauagauguuauaguuuauugccauugggaaucuucuuguuuagucaagguugaucaauuacaaauuuccauuucugaggauuguuauaaaugagcuauaaacagggagauugcuuuauauauauaauauauuuauauauacuauauaaauauauuauauauaauuauauauacuauauaaauauauuauauauaauauauaaaaauaauauauuaaauauauuaaauuauauauaauauauuaaauauauuauauauaauuauauauaauauauaauauauuauauuauauauauaaaggggaguuuauuaaguauauauauguguauauauauauguguguguguauauauauauauaugaaggggagauuauuaaguauuaacucacacaaucacaaggucucacaauaggccaucugcaggcugaggaacaaggagagccaguccgaguuucaaaacugaagaacuuggagucugauguucaagggcaggaagcauugcaugggagaaagauguaggcugggagacuaggccagucucucuuuuuacauuuuucugccugcuuuuauucuagcugugcuggcagcugauuagauggugcccacccagauuaagggugggucugccuuucccaguccacugacucaaauguucaucuccuuuggcaacacccucacagacacacccaggaucaauccuucaauccaaucaaguuuacacucaguaucaaccaucacaguggucaacuaaauuuuaauuccaggccacguggcacuaguguaagcuauuuaauuacaguauuauauucuuucauagugccuaguugugaaauacagacacagucugugagaaaugaguuuguaaaacaggcacucaacaaaugauuaaauucacuaagaaaacucaguagaaaauaugcaaaugcuaugaacaggcaguugauaaaagggaaauuaugcauggugaauagacaugaaaagaugcucaaacccugaccauuugucaagggaaagcacauugagauaacauuuucacccaucagaccggcagaaugugaaaugacgguaucaagaggugaugagauacagauuuaggggaacucucauuauauggcugugagaguguaaauuccuccagcugccuuggagaccuguuugucaauaugcaaaauuguucaaguugugcuuucuugcaacucagcaguuuuacuucuaggaauacauacuuuaaagaaauggaaugagaguggaguccggaggccucugggaguacccaugggacuuucagggauuuaagugaaaacuauuuucaugauaauaauucagaauuaugguugggcaugguggcuuacgccuguaaucgcagcacuuugggaggcugaggcagguagaucaccugagguugggaguucaagacuagccugaccaacauggagaaacccuaucucuacuaaaaauacaaaauuagccaggugugguggcagguaccuguacucccagcuacucgggaggcugaggcaggagaaucgcuugaacccgggaggcggaguuuguggugagcugagauggcgucauugcacuccagccugggcaacaagagugaaacuccgucucaaaaaaaaaaaaaaaaagaauuauuugccuuuuuuauucuuauuaucucaugaguauacugugggucuuccagaagcuacauugcaguagauugaaugaagaaacauaaaaaaaauuagcugcuuucuauuaagccagacauuaaaaggauuaucaaaaaaguaaaacauuaccacuuuccucacuaacuuauuuuuguuuugaaaaauuuaguuauuuuuuauuaaaauauguugacauguaauaggauucuuacuuuugaaugaauuaauacguuauuauuauuauuuugagacaaagccucugucgcccaggcuggaguacaauggugugaucucgguuuacugcaaccucugccucucggguucaagugauucuccugccucaaccuccugaguagcugggauuacaguugugcgccaccaugcccagauaauuuuuguauuuuuaguagagaugggguuucaccauguugcccagucuggucuugaacuccugaccucaggugauccgcccaccucagccucccaaagugcugguauuacaggcgugagacaccacucccggccaauacguuauuuuuuuaacgucuuaauuuuaaucuguaauacauuaaauaucaguagagaagucgaccuaaguaaagccucuuuaagauccuucaguaauuuuuaagucaggacugagaccagaaaguuuuggaaagaauuguauaagugcacaguucaaguauguguucauuguaauguuguuuauacugguuuauuuauguuuaguuuuuuuuuuuuuuuuuuuuuagauggagugucgcacuguugcccaggcuggagugcaguggcgugaucuuggcucacugcaaccuuugccuccuggguucacaccauucuccugccucagccucccaaguagcugggauuacaggcaccugccaccacgccuggcuaauuuuuguauuuuuaguagagaugggguuucaccauguuggccaggcuggucuugaacuccugaccucaggugauccgcucaccucggccucccaaagugcuaggauuugggcucccaaagcuacugugcccugcuuguuuauaauagcuuaaaacauuguuaucaacacuaauguccaucaauaugaacauaagaucgguucuaucaauaugaaauagcaagacacguagagagcuguguguguauauauauguaauacuguaauauuuauaccaucauauuuauaucuuaaucagaccauaucuguuuuccagacauuccuuuaucacgugucaaaauaguuuuuuugagaagcuaggcauauuucuaaguaauaauaaaguccaaaacuuuauuaagaauuggauuuuaaggccaagugugguggcugaugccuguaaucccagcacuuugggaggcugaggcugguggaccacuuaaggucaggagcuugagaccagccuggccaacauggugaaaccccgucucuacuaaaaauacaaaaaugagccaggcgugguggugcacaccuguaaucccagcuacuugggaggcugaggcaggauuguugcuucaacccagggggcggagguugcagugagccgagaucaugccacugcacuccagccugagugacagagcaagacucugucucaaaacaaaaacaaaaacaacaacaauaaaaaaauuagauuuuagccaguucacauuauugccgaucuuuugaccuuaauuuugaagggcagaaauauaaguauuaacacgugcugcucuauuugacuagaaaauaagcagcauauguaagacuugguaugcuagaauguagaacaucuucgcuguguucuuucaggaccacuguacuguuuacugacaaggaggaagcaccauuuuguuacaucuuugugaauacacuuccacuguaguggcuuaaacaaauaguuaacuuauuuuucucauccaaaaauuggaaguuggcuauuugauguaacagagugguggcauuuacucucauguugugucuugugcugagaagguugaaaauugguaaaaaaaaaaaaaaaaaaaaaaaaaaaaaaagucucucauuagaaauguaguucauuuuuauuauuuccaguagguauguuuuauaaaguuacugugaaaacugaauuagccaauacugagccauucauuccuccuaguagauauacaggauuagguuccugaaagccucuagucacaacauauuugucaccugaucaguacauaaccuuguuuuauuauguguuucuuuuuaaagacaccuuauuuuauuuuuuuuaauuuuugcuacggagucuuacucuguugcccaggcuggagugcaacagcgcgaucucggcucacugcaaccuccaccucccaaguucaagcaauucuucugccucagccucccgaguagcuggaauuacaggcaugagccaccaugcccugcugauuuuuguauuuuuaguagagaugagguuucaccauguuggccaggcugguguugaacuccugaccucaggugauccgccugccucggccccccaaacugcugggauaacagacgugagccacggcgccuggccaguagagaugggguuuugccauguuggccaggcuggucuugaacuccugaccucaagugauccaccaaccucggccucacacuccugcugggauuacaggcaugagccacuaugcccggccaccuuauuuaauauauauuguugauucauuaacauugaacucagggucagcagcaccauaacuuaugccucagugaagcuuaucuaaaacaugcauuuucucugugaggcauauauuacaacuuucuugugcuuagggacacgagacagcacugugguacugugcuuaggggccauauuauacagucaaaucgagaaaaaugagaaaaacagagcaccaaguggucugcaaaaaggacgcuuacacugugagagcugagaaggcagugucuucuuguuugacuucagcugggaacauacauauugggcgacacacauuuuuggccuuuccucuucuguccacaacugacugcagacaugcugugacuguugauuuuggaguuacagauaaauauaagugaauaagugaauuugcaaauauggaauauaugaauaaugagaagugaguguaccuguuuacaggucauuagccaaaaccgggccacauggcuuguucuuagaguggccagugcccaugagggauacauuuuuuuuuuaaguuuagauuaaucaugauuuauuccccggcucuggcaaucuccucucccugaaaucaagaguucuguguuugcuacaucagcaaaucacaguauuucuucaugcuaggaaagaguggggugguuuuuggguaaacaauggacagugcccacuguguuucuaauuaagugcuuggcauuuggaagggggucaguauauuuuuguugaaagaaugaaucagugaaugaauggcaggguuguuuuguggaauagccuuuaauuucugucauaucuugcuuguuaaagauuucuccaugucuauauuuucaaacaaguaauguuuugauugacuaacuccaaaucaaauaaaaguuaauauaaaagaauaaaguuuuacuuuaucugggugaccuucaaguucauauaagucaaagaaaaugauaaaauaugaaccaucagaugaaguugagacaucuuuucagaaaaaggcugagcaacccaaguuccauauggcaaaagcuuuucuucuuuuuaauaacgguuucuuuucugaaaugauugcuuuuuauauuguggaagauauuaaauccagaacuauuagauuuuuguauuuagcauaugauacugauuuuauuauuguaaguugucagcuucucauguuaucaaaaacuaagaaauauuucauuugauaacauccuuuguagcuaaugccaguuagaaauaaauucaauuaauaaagaauauuuaauuuaaauuauguuugaauaaaguauauauuuguguuuacuauucuaaacauuggaauaaauuguaauuaaagcugacauaccuaucugucugucuguccuucucucuaugcccugcguuagacuagacacaauuuaaggcuguuaaauaauacauauuuccuuuucauuaauguuuauguuuauuugaucauggaaguaaaauaaucuuguuauauaaaacugaaaaauggaaaaaauaaaaggagggggaaaucaccccaauucguaucauuuaaagaaaaaaaucaauauuuuggucuauuucuuuucagucuuuuuuuuaauacauugaaaaaacuuaauuuuacaauguauaugugauaugaaaauuccuuuugacauucuagguagcuuuuauuauuaugauuagaauaccuuuagggguggauacauuuauucauugccuguagauggagagcaguaaaugaagcagccaggcuuaaaguacaguucucuucaguucucuuagaauuuuuccuccuccuuguacuuucuguauuucauacuugagagcauguugggccugacuccaaacuuuauggaaaaugaaauguucuuauacauucuaacucccuuuuuguuauacugcauuuucuccucucuccugaccucaggugacccgccugccucggccccacaaaguccuuggauuacgggcgugagccacugcagcuggccaguagagaugggguuucgccauguuggccaggcuagucucuaaccccugcccucaagagauccacccacuuccgccacccaaagugcugggauuacaggcuucuuucuaggcuuuuuaaauguucagcacuguuaucuccucuuucuguaccuacucuaugcaaaaucucuauuccuaaaaucucagcuaaguggaaaaaggaaguaagauuaucugaauaaauuaauucauacuaagugcaaaugacuuguagucauagccuuuuagagggaugucuauacuucaucucaagguauucuuaaacucucuggcugcuacagacaugugcuaaaaaaauagaauaaaaagauaugcucaaacucagauggguguuugauaagaaaaauaucugagugguauuuuagggccauggagagccuucucuugggcauacaacaugcucacuagaggagggucagcaggcaucaaagugcuugcaccaacccccguuaacugucguuccauggcuaucagcagaugauugaccucuuaauaaaaaucgaugagaauuuguaauuaauuauagugcacuugcagcuguaacauuuaauuccaugucucuuaaggccucuucuuugaagguuucuuuacuuaggaacuaggcagcaugcuagucuuucuuuauaaacuuaaagugucauuuuauuuuccaaaagagagaaugaauuaauugagauuuugucauugcuuaguuccaaggagacuugaggcaauuuacaguuaaaaguuaaacaaaguauuauacauaauuguaaaacagaagagcaaauauuuaaagcaggcagaaggagaagauggcuucaggccucuuaaaugaacaaacgacuccaauuagugaauuuagcuuuugauuuucccacccccgaagcugaaguggaagcauggugcugauguguuguuuucuaauuggaggaaguaagagagagaauuuuucuagagugacaaaauauuuucuggaacugaacucaaggugggcaucuguugccauuuugaaggcuuacgucauaguauguuaugaaaauauugaucaaauauuguuauaccuuauuugaaauuuuacccaugguacuuuuuaaaaauguauuuacugugauauuuguacuagcaauaguuauacaccuaaaggguguuugauuucaaucuuugggaaaaaucagauuuuuuucuucuuccucauuuuuuaaaaauuauuuuagauuucaagaagacuuagggaaauugaacacaucucuuagaugaucagaguuguguuacuagacuagacugaagagguugcuuauuuagggacggguguuguuacuagaaaaaacuuccuuuucugcaguucaucuuggucacagcuuucuccagucuacucacugugcuccaccugaaaaacaagccaguguauuuuaauaccgauucuuaauucacuuauuuccaaugauuagcuguccgagugacuuacaacaggcaguguauaaucuuuuaaauacuguuaguaugaugaggagaguuuagaaccguguuguuauaaaacauaaggacccuggcguuuuaauuugcuccuuagcuuguuacagacauuaccuugccuaaagcaaacagaauguuaggaguuguaauugccuuuuaauauuauugaauauuuaauagucuuuucaaauuucauuucuacaaaugcaaccuucaaaaagcauuuuuacaacuuuaaaguuggagcuucuugaauuagaccacuuugaagucaguuauucugaucacauuaaaacuuaugacuucagugaauguagauugagguaucaaauacuuaggauacuagucaaaauuugaaauuagagccaaguagucuggcuacauguggguuucaaaaagugguauuaauaaauggucuguguaccuguguggagaugacgacauuugugacacacguagauguagcuuuuuuccguuuuuaguaaccauggaagugauauagaagaaacuuuucugauagagauggacaaaacuauccugaacaauuugagaauacacccagcagccucaguuuuaacucugcacuaaauacuuugcuuggugcuguguuagcaggcgcuccauauagauuaucucauaguuugccuugcagucccgugaguaagucacuuauucccacuuugcagaggaggaaauugaggcuacaagauguuacaaggguacgccccuaguaaguauugcagguuuugaacccuaaacuacuaaaaccuuuuauuuccuugucccccaaaauaguccuaccauucucugccacucacucuuuauucaucagaaagugacauuuccuucaccugaacugggguccuguauagucugugucacuucucaaaaaaugguuuuguauuaugguucauucugcaagugauguguguuggucugccuuucuugauugccaucuccaagaagcagugacugcauuacccucuccacugucauccacccgggacguuaugcgaugaugcccaugguggccgguugcugagcacuuguugaauucacaccugggguuuguguuuaucagauggcacaggcuccacaaggauauuagcuuuaguuuagaggguugcagacaguggaaggggaguacucaagcagcuggucugccucucggauucuaacuggguccacauauuuugcugugcuuuucccaaagugcuggauuuaaggugcuuguguuucuccuaggaagguauggugccagugaaguauagauuaauuuuccucgaaauacuaaccauuacauuuuuuuuuuuguuuuauacuuuguguuagaaaugugaaauaagaugaaauggaauguagaaaaaggaaucccaggcugggugcaguggcucuaaucuaaucacgccucuaaucuuagcacuuugggaggcugaggugggaggauugcuugaguccagaaguuugagacuagccugggcaacauagggagacccugucucuacaaauaauuuaaaaaauuagccaaguguaguggcaugcaccuguggucccagguacuugggaggcugagguaggagaaucaccugagccugggagguagaggcuucagugagcuguguuugugccauugugcuccagccuggguaacagagcgagacccugucucaaaaauaaaaaagaaagaaaaaugaauccaaaucaauucuauuuuccuaugagucuguacaauuuugaccacaucuacugguguguguuaauagccauuugauagguggaugguggguguaaucacuucaauuuuuaaaaauucugaaauuuucccaaaaauaacuaggaaaaauauucuaaggauuauaaacauucaaagguuuauaaaauucugaauuuguguacaguggcuaaacuaguuaauauauuaguauuguuuaaucuguuaguacuaagauauuucagaugauaucuagaaacaucuugaaaguuugcaauuuaaaaaucuuaaaauaauaguaaaacugugaugauaaugaguaauaguuaccgagcacuucugugaaccaagcaugauauuaaguuuuuaaguuucauuuaaaucucagggcccauguaauguuauuauuauuauuuaugcucauuuuaguucagugguuuugagagguuaaacugcuuaguauuacacagcugcuaagugguuguauuagucagauuucucuagaaggacagaacuaauggaauaucuaucuaucuuucuaucuguauauaugaguuuauuaagaauuaacucacaugauuacaaggucccaauauaggucaucugcaggcggaggagcaaggaagccagucugagucccaaaacugaagaacuuggagccugauguuugagggcaggaagcauccagcaugggagaaagguguaggucgggagacuaagccagucuagccuuuucacgaucuccugccugcuuugauucuagcugugcuggcagcugauuagauggugcccacccagguugagggggggucugccuuucccaguccacugacucaaauguuuaucuccuuuggccacaaccucauagacauacccaggaacaauauguugcauccuucaauccaaucaaguugacacucaguauuaaccaucacagagacuuuuagguaauuaagacauguuacuaggaaggagcucugaauaaugaguugauuauauaggaauguguuguagaugaauuuuuuucucuauaggaaguuuaaaguggauucugugggucccagggcuggggggaauuugggagucacuaggauuuuuuuguuuucuauauccauuccaggaaacuuccuuccuacugucugguaacugguuuuaugguuuuagcacagaguuucuaaacauggacauacucuuucccucugacacccaagaaggauagagagauggucccuaagauaguacccccauaguugagauuugagugacucaauuaauuucacgccccacuucuuaaaaauuucuuagagaugguuguuccugcuauacccauaucuaaguuuuuaauuuguauacuggaagacugaagaacaauuaauuuugcccaguuuuuauuuucuuuuuacauuucaguagcuuaggcuguuggagaaacuaauuauggcccagccuauacccagaagagaggacuuaacuugugcuccaugaaccacugugucugggacacugaguaaccuaagaauuuucuuugauaugacacuccguucucuagagucagguuuguaugaacaagugauaggggauuccuuuuugcuuuuuuugaagaggguggguugcuaacgaucccauuuauuuugguaaaaaauaauaucaauaucuucucuuauuuggugguacaaugcuaauauucaucuuugaaaugaagggaaaaaagguaaaaaucacuuuucucugacugauacauuccucacuuauuuuuuuaagauuauuuuuuggcugggcaugguggcucacgccuguaaucucagcacuuugggaggcugaggugggcggaucacuugaggccaggaguucgagagcagccuggccaacacagugaaaccccaucucuacuaaaauacaaagauuagcugggcguguuugugcacgccuguaaucccagcuacucaggagguugaggcauaagaauugcuucaacccgggaggcagagguugcgguuuuucauucagaaacuccaguucuggaucgacuuuuuagacaaacacucugcaaacagcauguucucuaccuuucugagaccaccauacuuugccuuaaaauaugcacaauuucugucaucuucaaauuuaguuuauauuuauugguugcacaagagaaacaaaaccaaauaauuuuggaguuggaagaaaacuuaucuaacuccuucucuuuugcaauacuggaaauucucuuaccucaugucuagcaaauauacuuacuacuagauucuccuuaaacaugucaagucacugggaacccuacgcuucucaaggcauugcauuagacuucugaacaguugcugucaccagaaaaaucguuacaauuuagguaaaaucugcccuccucuaacuuccauucacuauuucuuguuuuagccucugaagcuaccuaaaauaagugguccuuuuucuauaaacugcuaauuaauuauguuuuugauuugacauagacauuucucuuuuuuuccccaaaaaauacggcuuuguuguucaauuugaaaugacauguggugauuuuuuuuuuuuuuuuuuuuuugagauggagucucgcucugucgcccaggcuggagugcaaugacaugaucuuggcucacugcaaccuccaccucccagguucaagcgauucucuugccccagccuccugaguagcugggauuacaggcacacaccaccaugccuggcuaauuuuuguauauuuaguagagacaggguuucaccauggucaggcuggucucaaacuccugaccucgugauccgcccaccucaaagugcugggauuacaggcgugagcuaccgugccuggccaauuuuguuuuugagaugauucuaugcuccccaagcgugucacugagguugaaauuacagauguggcccucuugcuuuuuuuuuuuuuuaagagaaaaagaagguuuucucguacugucugguggcuguguuucugcugaccuccuguucccucucacugcugcccaaguauuuucucugcaggggagccugccagggggcugcugcucugaaccaugccccaaagagaaaagcaguaacauaucaaaguuucaguaguugguuuaaucaagcacacaucacuuuuuucuuggacucaacuugccuuuuuuuugaaaguaagaauuuagauuuauuuauuuagucauuuaauauguaaaaacaaucccaaacauuuaaauaacucauguuaaggaauugccaucacaccuuaaaugacacauaaauuauucaaguacucugaauuaucuuguuaguuaguuuaccaaacuucugugucaacauuuauuauagcguuuuuuugguagcuaugggagggaggaggaaaugaaggauugauauuugcuagguguucaucaccugagcuucuuagguaucuugauucugcucguuauuuuuuaaaaucaagaacaaacauuuuguauguacuuguggaucuuuauuuuuagccaacagacauagccucugauuaacuuagacaagagagagggaagugagaaaaucugaggagccaggucuagggaaggcaggguucagagcagcccuggggaauucaucuuaaagagguuugcuaaagaaagaacccucucccaguuuuggcugcgguucucagauuggcuuggcauucuaugcuggacagcuuuuggcgauuuggggccuccuuguuuacaggucuguuggaaguuaaguugccuuguuuccuacaauaaagauacugauuuaauucugcucucagaaccacucauaguuuuuuccacccagucauauuuugagguuuguuauugauguuuuccaggguggggaguggugauuagguuuuacuguccuacuuuuuuuuuauggggagagucgaggagauuaaaaaauuacaucacugccaucauuuccccagaauucccuuguuuuuaacccgacugaaucuugaguaauauucuuauauuccuaauuuuuuuuuuuuuuuuuuuuuuuuagacagggucucacucuguugcucaggcuggagugcaguggugugaucacagcucacuguagccucagucucucgggcucaagccauccucccaccucagccucccaaguagcugggaccacaggcuugugacaccaugccuggcuaauuuuuuaauuuuuuuuuuuuuuguagaaaugagggcucacuauguugcccagacuggucuuauucuuaucuucuuuaucuacuuauucuuuaucuucuagaucuaugaauuucugaaagagaauuuauaaugucuaacucuuauaugguaccugcuguauuccaggcccugcuuuaacuuauuguauaugggucauuuuuuccuuagagaucugugauguauacuuuauagauuuugagacuggguauauugguuacuuuguauguaacaguuggugauggaagucuuuugucacuguguauuggcuuuaucucuauuaaugcuuuuaaccuucaagucucuuuuuuucagaaacuuauguaguuacacaggcuuuuuuugaguucauauuugucugaacuauccuuuucauuccaccauugcauguccuuuuguuugaagugugucucaugaacagcuaaguguugacuugauuguauccaguuucacugaagaaugguaguguggugugugguuacaaucaagaacucuagggcccgauuguuuggguuuggcuuguugcuggaguauugauaccuagaagcuagaguucugcacuuggggguggauggaauuuuuugauguugcuuuauuuagacuuuuaaccacuccccauguuuuacgucccauaacucacuucuguucuuucaggggugagguaccugauguauucaaguucugauucucuauaggauuccguuuuuauccuuucaguaucaccugccacuuucacuuuauggugugaugccuuagcaguguguacuacuccaucuacuuuuuaucuuuugaaaacguauugaaauaucucuaaagucggcauaauaagacugcuuaccuuauacagaacuguuucaaauuuagugugaguuaauagauguaaagagcuucguacugugccugucauaucagaagugcuuagaaagagcuguucuguuuugucauugauguuaguauuauagguugacuuuuagagcccuugaccaccuugaaacuauacacagucccgucugauccuugucacugugaauuuuaccaucagauuuauuguuuuuauuuuacaauucagguuuuuuuuuuuuuuuuuggcuuacaaccacacgcauuuauuaccuuacaguccuggagcucacaaaucugagaugagucuuaugggacuaaaauccagauguuggcuuccucugggaagcuccagggaaaaucuguguccuugccuuuuccagcuuguccugcaucccuugguucagugucuuccuccaucuucaaagccagcaacugaccaucuuccagguucuuuuucucagaucccagcaccacauugacuucucugacucuaagccuccugccucucucucuuuuuuucuuuuuccuuuuuauuuauuuauuuuuuuauugaucauucuuggguguuucucacagagggggauuuggcagggucauaggacaauaguggagggaaggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcacagcccuuaauccauucaacccugaguggacacagcacauguuucagagagcacaggguugggggguaaggucacagaucaacaggaucccaaggcagaagaguuuuucuuaguacagaacaaaaugaaaagucucccaugucuacuucuuucuacacagacacggcaaccauccgauuucucaguuuuuuccccaccuuucccccuuuucuauuccacaaaaccgccauugucaucauggcccguucucaaugaacuguuggguacaccucccagacggggugguggccgggcagaggggcuccucacuucccaguaggggcggccgggcagaggcgccccucaccucccggauggggcggcuggccgggcggggggcugacccccccaccucccucccggacggggcggcuggccuggcgggggcuaacccccaccucccucccggacgggguggcugccgggcggagacgcuccucacuucccagacgggguggcugccgggcggaggggcuccucacuucucagacggggcggcugccgggcggaggggcuccucacuucucagacggggcggccaggcagagacgcuccucaccucccagaaggggcgguggggcagaggcgcuccccacaucucagacgaugggcggccgggcagagacgcuccucacuuccuagaugggauggcggcugggcagagacgcuccucacuuuccagacugggcagccaggcagaggggcuccucacaucccagacgaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccugggcaccauugaccacugagugaacgagacuccgucugcaaucccugcaccuccgggaggccgaggcuggcggaucacucgcgguuaggagcuggagaccagcccggccaacacagcgaaaccccgucuccaccaaaaaaauacgaaaaccagucaggcguggcggugcgcgccugcaaucgcaggcacuuggcaggcugaggcgggagaaucaggcagggagguugcagugagccgagauggcagcaguacaguccagcuucggcucggcaucagagggagaccguggaaagagagggagagggagaccguggagagggagagggagagggagaccgugggaaagggagagggagagggagagggagagcuauaauucagguuuuuaaaaauaucugcuuuuuugucacccaggugauuugggggagauaguuaaagcaucucaacucagcaugucuaaaguaguaauugaauuaaauggaauuuuaaaaccauuucucaggaggaguauauucauaauuaaacuauaugauaauuuaagacaaaauuuguauauuugaaggguauaaaauacuuuuaaccaguuuauggacuggauuugaauuugauauggagagaucaguaucuaugaagugaaguagggcacuuaaaaugguuaaaauagugaauuuuauguuacguauauucuaccaaaguuuuuaaaaaggacauuuuuuugugggggcggugcugggggugcguaccacagcauucuccuguaguacauggagaucuauggguccagggccaugcguuauuauuuuuuucucugagauucuuuuucuuuuuuaauuucaauagguuuuuggggagcaggugguguuugguugcaugaauaagcucuuuaguggggauuucugagauuuugguguauccaucuccugagcaguguacacuguacccaauguguagucuuuuaucccucaccccuucccaacguuucuccugaguccccgauguccaguguaucauuccuaugccuuugcauccucauagcuuagcucccacauaugagugagaacauacgauguuugguuuuccauuccugaguuacuuuacuuagauuaauggucuccaauuccaucuagguggcugcgaaugccauuauuuuguuccuuuuuaugguugaguguuauuccaugguguauauauauaccacauuuucuuuauccauuuguugacugaugggcauuugggcugguuccauauuuuugcaauugcaaauugugcugcuauaaauguguaugcagguaucuuuuuuguauaaugacuucuuuuccuuuugguagaauacccaguagugggacugcugaaucaaaugguagauuuacuuuuaguucuuuaggaaucuccacuguuuuccauagugguuguacugguuuacauucccaccaacaguguaaaaguguucccuuuucacugcaucugugccuacgucgauuauuuuuuugauuuuuugauuauggccauucuugcaggagugaggugguauuacauugugguuuugauuugcauuucccugauaauuagugauguugagcauuuuuccauaugcuuguuggccauuuguauaucuucuuuugagaauugucuguccaugucuuuagcccacuuuuugauggaacuguuuuguucuugcugauuuguuugaguucuuuguagauucuggauaugaguccuuugucggauguauagauugugaagauuuucucccacucugugguuugucuguuaacucugcugauuauuucuuuugcugugcagaaacuuuuugguuuaauuaagucccaucuauuuauguuugcuuuuguugcguuugcuuuuggguucuuuguuaugaagucuuugccuaagccaaugucuagaaagguuuuuccgauguuaucuucuagaauuuuuaugguuucaggucuuagauuuaagucuuugauucaucuugaguugauuuuuguguaaggugagagaugaggauccaguuucauucuucuauagguggcuugccaauugucccagcacuauuuguugaauaggguguccuuucccuacuuuauguuuuuguuugcuuuguugaagaucaguuagcugucaguauuuggguuuguuucuggguugucuauucuguuucauugugccuauuuuuauaacaguacuaugcuguuuuggugacuguggccuuguaguauaguuuggaguuggauaaugugaugccuccagauuuguucuuuuugcuuagucuugcuuuggcuauguggucucuuuuuugguuccguaugaauuuuaggauuuuuuuuuucuaguuuugugaagaaugauagugguguuuagaugggaauuguauugaauuuguagauugcuuuuggcaauauggccauuuucacaauauugauucuacccauccaugagcaugggacauguuuccauuuguuugugucaucuguguuuuguaguuuuccuuauagaggucuucaccuccuuaguuagguguauuccuaaguauuuuauuuuauuuuauuuuuuugcagcuauuguaaaagggauugaguucuugauuugauucucagcuugguugcuguugcuguauagcagagcuacugauuuguguacaucaauuuuguauccugaaacuuugcugaauucauguacuaguucgaggagcuuuuggaugagucuuuggggcuuucuagguauacaaucauaucaucagcaaacaaacagcagcaguuugacuuccucuacuaauuuggauaccuuugauuucuuucucuugucugauugcucuggcuaggacuuccaguacuauguugaguagaagugguaaaagugggcauccuugucugauuucauuucucagggggaaugauuucaacuuuucccuguucaguguaauguuggcuguggguuugucuuagauagcuuucauuaccuuaagguguaucccuucuaugccgauuuugcugaggguuuuaaucauaaaggaaugcugaauuuugucaaaugcuuuuucugcaucuauugagaugaucaugugauucuuguuuuuaauucuguuuauguggcauaucacauuugaguuauggauguuaagccauccgugcaucccugguaugaaacccgcuugaucaugaugaauuaucuuuuugaugugcugcuggauucaguuagcuuguauuuuguugaggaauuuugcaucugugucaucaggaauauuggucuguaguuuuaauuuuuuguuaacuccuucccugguuuuuguacuagggugauacuggcuucagagaaugauuuaaggaggauucccuuuuucucuauccucuggaauagugucaauaggauugauacugguuccucuuugaaugucugacagaauucagcugugaauccuuaugguccuagacuuuucuuguuggcaauuuuuaaagaauuacuauuucagucuugcugcuuguuauuggucuguucagaguuucuauaucuuccugguuuaauuuuggaggguuguauauuuccaggaauuuauccauccccucuagguuuucuaguuuaggcacauaaagguguucauaguagccuugaauaaacuuuuguauuucugugguaucaguaauauuucccauuucauuuccaguugagcuuauuuggaucuucucucuucuuuucuugguuaaucuugcuaauggucuaucaguuuuauuuaucuuuucaaaaccagccuuuuguuucauuuaucuuuugcauuuuuuuuguuuguuucaauuucauuuaguucuucucugaucuuuguuauuucuuuucuucugcugcauuuggguuuggauuguucuuguuucuccaguuuugugagguguagccuuagauugucuauuugugcuccuucaggcuuuucgauguaggcauuuaaugcuccgaacuuucugcuuagcaccgcuuuugcuguauuccagagguuuugauaaguugugucacuguuauuguucaguucaaagacuuuuuaaauuuccaucuugauuucauuguugacccaacaaucauccaggagcagguuauuuaauuuccauauauuugcaugguuuugaggguuccuuuuggaguuaauuuccaauuuuauuccacuguggucugagagaguacuugauauaauuucgauuuucuuaaauuuacugagacuuguuuugugcccuaucauauguucuaucuuggagaauuuuccaugugcugaugaauagaauguacauucugcaguuguugaguagaauguucuguaaauaucuguuaaguccauuuguucuaggguauaguuuaaguccauuguuucuuuguugacuuucugucuugaugaccuaucuagugcugacaguggaauaauaaaaucccccacuauuauuguguugccgucuaucucauuucuuaggucuauuaguaauuguuuuauaaauuugggagcuccaguguuaggugcauauauauuuuggauugugauauuuuacuguuggacuaguccuuuuauuguuauauaaugucccuccuuguuuuguuuaacugcuuuugcuuuaaagucuguuuugucuauaagaauagcuacuccugcuuacuuuuggugcccauuugcauggaaugucauuuuccaccccuuuaccuuaaguuuaugugaguccuuauguguuaggugagucuccugaagacagcagaaauuuaguuggugaauucuuauccauucugccauuccauaucuuuuaaguggaguauuuaggucauuuacagucaauguuaguauugagaugugagguacuauuccauucauugugcuguuuguugucugaauaccuuguguuuuuuuuauuguguuauuguuauguagguccugugaaauuucuguuuuaaggagguucuauuuugguguauuucgaggauuuguuucaagauuuagaguuccuuuuggcaguucuuguagugcuggcuugguaguggcgaauucucucagcauuugucuuaaaagacuguaucuuacuucauuuaugaagcuuaguuuugcugcauacaaaauucuuggcugauaauuguuuuguuuaaggaggcuaaaaauaggaccccaaucccuucuagcuuauaggguuuuguuacagaggggguucauagauaucaugcaagaaauaauucagggugaguccauagaguaaagugaaagcaaguuuauuaggaaaguaaaggaacaaaagaauggcuacuccauagagcagccccgaggccugcugguuguccauguuuaugguuauuucuugauuauaugcuaaacaaggggugaauuauccaugccuccccuuuuuugaccauauaggguaacuuccugacguugccauggcauuuguaaacugucauggcacugaugggaguguaacagugaggaccaccagugaccucuggucacucuuaucacuaucuugguuuuggugaguuuuagcaggcuuccuuacugcaaccuguuuuaucagcaggguacuuaugaccuguauugugugccgacuuccagucucauccugugacuuagaaugcccuaacugucugggaaugcagcacaguaagucuuagccucauuuaacucagcuccuauucaagauagaguugcccugguucacaugcaugccucugacaguuucugcucagaaaucugcuguugcucugauagguuuucuuuuauaggcuaccugaugcuuuugccucacagcucuuaagagucuuuccuucaucuuugcuuuggauaaccucuugacugugugucuaagugaugaguuucccagguguucuuugagcuuguauuuggaugucuagaucucuagcaaggucagacaaguuuuccuugauuauucccucaaauaauguuuccaaacuuuuagauuucuuuuuuuugucuugggaacaccaauuauucuuagauuugcaugcuuaacauaguuccaaacuucuuggaugcuuggcucauuuuuaaaaauucuuuuuucuuugucuuugauggauuggguuaacucaaaagacuugucuucaagcucagaaguacuuuuuucugcuuguucgauucuguugcugagacuuuccagugcauuuugcauuucucuaaguguuucuuugauuucuagaaguugugaucauuuuuuauuuaugcuauuucacugaagaauuuuccuuucauauucuguaucagguuuucgauuucuuuaaguuggaguucacuuuucucuggugccuccuugauuagcuuaauaauuaaccuucugaauucuuuuucuugcaauccggauauuuuaucuugguuuggauccauugcuggugagccggugugaucuuuugggggguguuaaagagcuuguuuugucauauuaccagaauuguuuuucugguuccuucucauuugggugacugugucagaggggagacaugggacucaagggcugcuguucagauacuuuuguuccaagggguucucccuugaugugguguucucccuccucccccagggauggagcuucccaagagccaaacugcagugauuguuuuugcucuucugggucuagccacccaguggagguacugggcucugggcugguacuggggagugacugcuaagaguccugugaucugauggagguagcaggggcgugaaguggacucuacaagggcccuugguuguauuuuuguuuagugugcugguuuuguguugguuggccuccagccaggaguuggugcuuucaggaacacaucagcugugguccuacagggaggaagcaaacuugcccuaaggucgccugguuaccuauucagguuucuuaggugguaggcagggccauagagcucccaagagauuauggccuuugucuuuggcacccagggcugguagagaaagaccaccagggggcagggauaggugugucugagcucagauucuccuuggcuggggauugcugcggcugcuguugggauggggaugugguuuucagucuaauggaguuauguucccagggugauuauggcugcuucugcugggucacacaggcugccagagaagugggggaaagccagcagucacaggccucaucccacucccacacagcccgcaguccuaaaggcuggucucacucccaccgugcccccacagcagcacggagucuguuuccaggcagcuggugacuguggcugagaacuugccccagaccgccagccucccugcugagcaagcaggcagcucacaucuuuucagagucucagggagccugcaguggcgauacaguuccuucagagggucuguggauucucuuaguuuaccugguauguugcuguggcaguuguuggaucaaaaguucacagugugaguccccacacgcugcucugucuguccgaucgggagcugcaagcugguccugccucuuccccgccaucuucugucagacaaaaggacuuaguuuuucuaucagugucucacauggaagguucaagaggaggcucaucagugugaaaauccaaaucuuaagggacuguacauaauggaguaaacagaacauacggguguccguauguugacuuauguuuucuuucuucaacuauguacuauguuucccacucauuucuuaaugcagaauuaauuuuuuuccccacaggaaggaaaagcugaugcgaugcucucagugccgcgucgccaaauacuguagugcuaagugucagguaagacuuuucagccauauauaagugaagcuuucaaauucuuuacucuuaaauuuguccuucacuauaccuguuggccugugucuacuucuuuacagccuuuaauuuacuuuuacuuguuauucaccugcugagucacacagguugccagggacauuaaaauguuaaaacugauguuaaauauauaugguuaaaaauuggguguguguguguauaugucuacuaugugaaaguaaaugucuauuccuccccaucuuauugccccccgacuucaauucucauuuccacaggcaaucacuguuaaguuucucaugugucuuugcagcauuugcuugugcagacauauuuguguaucuacauccuauguuuaaaaaaaaaaagauauaguuuaaucuggcaugaauucuuguguacuuuuuuuuuuucauuuaacgaucuacuuuggggaacauuuuguaucccauauguuucauuguaugaauugaccauaauaauaauuucuuuguuaaugaaugcuuggcacuuuucuaauauuugguauugccaauaaugcacuucacauccuguuuugcacauuuugcacacuuccccaaauuauuaguaggauaaauucuuauuguauugauuguugaaaggauauaugccuuuugaauuuuuaaagauaaugccaaauauccugccaagaguuugaguuaauuuacgaguacuguuguuaacaucuuugaaauucuugaaaggauguauaauuaacauucagcaugaccuuuucuucuaaccuuaugauuaaucauuuaauaagaaauguaauuauguccuaaugaguuacaucuuauuaaaagucuaauuagagguuuugugucuaugucacuugccuccucccugccacccuccacucauccuuuuuguuucuuauguuuuguauaugcacacacaccuccagaguuucuucuuuccuucuuuuaaauuuaggccaugcuugucucagggguuuucuucucucucauuuuauccuuugaaaguaauuugagacgacacaaaaaguggucuuaauggaaaagaaaucaaaaguucaaaaauaucagggguuccagguucucaugcuaauucuggcauuugcugguuaaauuaucucagggaaaacacacacugugugggccucaguuucugaaucuguacuaacaauaagaguuaauauuuauuaggcauccacugugugccaggcacuguauuauuccauuugauuuuccaagagucuugugagaauuagguacuauuauuauuuuuauuuuauuaauaaggacaaugaggacagagagacagccaacuugccaaauauucuguaacuaguaggcucugaaguuucaggaaugaaacccagguauucagacuuuuaacugcucuuuuaaaccuaaauucuguucuugcucuaacauucugauuaggucuaguuuuccauuauauauuguauuauucuuuuguuucuuggcuuuuggguuuuuauuuggggacagucuugcuuugucucuuggacuggagugcagugguguuaucaaguucacugcagucuugaaauccuggguucaagcggucucccugccucugccuccugagccacugggacuacagguacgugccaccauggccagguaauuuaaaaaaaaauuuuaauggagacgagaucucacuguuugcccaggcugauguuaaacuccugagcucuagugauccuccugcuuuggccucccaaagugcugggauuauaggugucagccacugugcccagccaguauaacacuuucuaauuaaaauaggauaggaaauuucaaaacaauaauauuauuucuaccucauuuuuuaaacaaaaguuuugucgaagcuagaaagaucccugauuuauguaagauuguuaccaacaagaguaacuaaaagcaaaaagugaaacauuaauacugcuuuuuauacaguauucguuccagaaagcuugguuuauggugauguucuagguguuuuauucacgugaagcucagcuauuuguuucuaggaacuucagauuaaacagaguacauagagaagcgacagauuaucauauuauuugacacaagucuaggcaaacuugcuuucuaaucucaaugaccuaaacaguuuauuaauaaaacacuuaauaaacaguuuacuuaauaaaacauuuuuuuccccuguuuugugacuauuuuuccucuagugccacaucauccuuuuguaguacacucagggaagagaaaagccauuaucugauuagaaugaguagcaggaguuugguggguggguaugucauuuugauuaccuguagugcauguguuuuuacuacauauauuagcuguuuacuguggcaucaauaacaaugucacugucagauauacuguggaagguaacaggaaaacagcuagcaagaugaaggauauauguaauaacagcuagaguauguguuuguguguguggagggggaguuaaagauuggccagaacauaugcguuuaaacugcuguguuuaucucaaccuuaaaauacaacauuaaacauuguaauuauuguggauacccacaaaacuacgcaaaauuaaaugacauacugaacugugaacagugaugaacagaacgcaaaagcacuuggaauggaaauugaaacagaggauguaaaucuguaguauaaaauccauaauauguauaccccagggggacaugauuuugguucacuagcuuagcauuugaugugugggaccauggcaucaaguugucugagagaggcuauugggguauugcagguguaacauguaccuugugcccacaggauggugucagugcuauugguauucacauuucuuucuuuauguuuuuuuuuuuuuuuuuuuuuuuuuuugagacagagucuuagucugcugcccaggcuggggugcaguggugccgucucagcucccugcaaccuccaccucccagguucaagcaauucuugggccucagccuccccagguaguugggacuacaggcaugugccaccacgcccagcuaauuuuuucuauuuuaguagaggugggguuucaucauguugaccaggcugcucucaagcuccugaucucaggcagucugccagccuuggccucccaaagugcugggauuauagccgugagccaccgcaucuggugcacauuucauuuuuaaacauaagcaauacaaggauauguuuuuauuauaaaaacaccauauagaaucauacaggguaaaacauaaaagucuuuccccagcuuccuucccccgcuucuacuucuguuuuucagagauaauccauaugugucuauuuuauggauggaggauauacaccaaacuauugguuuaugcaucauauauagcguacacaucgacauauguauuuacuccuguguacaguacuguuucuguuacuggucaaaauauuuuugucaucacuggcuuuauauucuggucuauaccuuauuaucaggugucuaucauauaauuucauagaaggagguccagucuuuuuucucuauugcuauaaacagaacaucacacaugauuaugagaucaaagaggaggagcaggcuaaaauuucuuauaaaaaagcauuuucaaaacaaaaaauggcagcaguggugauagcaaguaagucaauuucaaguaauucaccaaguauuauuuuaccuuuugaggauuuaauaugauugauaauauauacauuucuaguugaaugaauuaauugcugagcaaaauaaggaguuaggcacuccaucaaauuguaauuuauauacuuuuuaaaagcacuguauuagcagauacaagcucuauuuuauauugauaauuauagaccucuuuaaaaaugugaaucguauuuuuggguuuacauuuuaugcuuaguuguggaaugauuugauucauauucgauggguagaaaauuaaucccacauuaguaagcacuuaacagagugauuuaauaggcugguucuuagacuaccauaaccaaagcagugauaaugaaggaagucaagcuuuguuuacuucauaaauucggccugaaacugauaggcuuugcacggaauguacuguagauaagucagcuuuguaucuaacugucaacacaaagggaguacuacaugaaguuuaaaacgauuuggucguauuucaguuuuugaccuccacaggugucuggagccggaaguuuuucuuuucccacuuuaccuuugccugcugugugauguuaucugcuccuaugacuucaaguggcaucuguauauuaauccuucucaagacuccgucuccagccuccuuucuccugauuuccacuuggcuguugcacaggcgucucugguguaacguguaaaucugaguacauuaucuucccccagacccacuucccuucauguuuuccagccucagugaacaguuucaccagccacccagcagucugaguugccaggugucaucuccgauucucauccuuucuuggcgacagauccauuuagucaucaugucgugcugauuuuacuauuuuacuaccuaaagaucugaauugguucccuucucgucagcuucuuuaguacuaccuguuaccauggucucuuuucuggauuagcugcauuguuaacuacgauucuuuccaacuucuaauuuauuuucuacacaggaguuagagugauuauuaugcucuaaguccuggugguugguaugauaaguaauaggcagugagcaaguaaauaagguccugacuuugauaaagcuucuguuauggaguagagagacagugacaaaugcccaugauuauaugauugaaugugauuggggugagcacaaacucaccugugaguagguggauacagaaggguuuccuguagaggugacauuuaaccugaaaucuagaauuaauguagcucuuucugcuuuucuuuugauuaguguuagcacgguauaucuuucuccauccauguacauuuaaucuauuuauauguaaaauggguuucuuguggaugacauaugguuggguuuugugucuugauccacugcgaccauuccugucuuuuaauugaugcauuuagaucauugauauucaaagugauuauugauauaguuggguuaauauuuaucguaucuguuuucuauuuguugcccuuguuauuuguucugauuguugucuuucacuauuuuuugccuuuugugguuucaguugagccuuuuguaugauuucuuuucucuucauuagaacaucagauauagauauaucuccuuuuuuagugauugccccagaguuugcaauauacauuuacgacgaauccaaguuuacucucaaauaacacuuuaccacuuuacagguagaaugaguaccuuagaauaacaaaauacuuuuaauuccugcucccucucuuuaaaaaaaauuguuuuagaaaugggaucucucucugucacccaggcuggagugcaguggccugaacaccccucacugcagacuugaccuccucaguucaacucauccuccuuccucagcaccuccucaaauagcugggacuacaggcgugcacuaccaugccuggcuacuuuuuguauuuuguguggggaugggauuucacuauguugcccaggcuggucucgaacuccuaagcucaggcaguacaccugccucagccucccaaagugcugggauuacaggccugagccacugugcccggccccugcucccucucuuaugucauuuauuuagcuuauacauaaacauacauaauuaaauacauugaugcuauuagcagucuuuugaacaaacuauuaucuguuagaucaauuaagaauaagaaaaaugaaaguuuuuauuuuaccuucaccuauuccuucuuugauucucauucuuucuuuauguagaucuaaguuucuaaccuuuauaauuuuccuucucucuacagaauuucuuuuaacauuucaugcgggugggucuacuggcaauacauuuccucaacuuuuguuuuccugaaaaagucuuuauuuucccuucacuuuugaaggguaauuccacaggguacagaauucuagauuaguaauuuuuuuuucucucaguacuuuauuucauuccacucucuuguacaugguuucugagaaguuggcuaugauucuuuguuccucuauauguaaguuguuuauuuuagucuguuuugugcugcuauaauagaauaacugacacugaguaauuuauaaagaaaaaaauuuauuuuuauuguuucaaauuuauuuaauuuguuuucaacauuuauuuuagauucuggggguacaugugcggguuuucuacaaagguauacugugugauccugagguuucgaguaugauugaaccugucacccaaaaaguaagcauaguacucaaaagguaguuuuucaacccuugcaccuccuccuccuuccccuuccuuauauucuccaaugucuguuguucccauauuuauacacuuguguacccaauuuuagcucccacuuguaagugagaacauacuguauuugauuuccuguuucugugcuacuuugcuuaggauaauggccuccagcugcauccauuuuguugcaaaagacauauauauauauauuuuuuuuuccgagacagagucuugcucuggcacccaggcuggagugcaguggcacgaucuaggcucacuaaaaccucugccuuccacgcucaaguaauucucgugccucagccuccugaguagcugggauuacaggcaccugccaccaugucuggcuaauuuuuguauuuuuaguagagacaggguuucaccauguuggccaggcuggucucgaacugcugaccucaggcaauccaccugccuuggccucccaaagugcugggauuacaggcaugagccaaugcgcccggcccaagggcaugauuuuauucuuuuuuauggcuucauaguauuugaugguguguguguauauauauauauauauaacguuuucuuuauucaguccaccaaugaugggcaccuagauugauucccugucuuugcuauugugaacagcgcagggagagacauauggguacaugugucuuuuugguagaaugacuuaucuuccuuuggguauauacccaguaauggaauugcugggucacaugguaguucaagacuuaguucaagucuccaaacugucuccacaguggcugaacuaauuuacauucccaccaucaguguauaagugaagagcggaaauuuguugacucacauuucuggaggccuggaaguucuauauuaagauggcuauauguagugagggccuucuugcugugacaucacaugguggaagggccaggagacaagagggcaucaaauacuggaauuaauccugcccaugaggacagagccuucauggcugagucaccucuuaauggucccaccucuuaacacugauauaaugguaauuaaaguucaacaugaguuuuggaggguacagaccuucaaaccauugcacacaccuuucaaguguuuugagauuuucagaaaaugacauauuacugaaaccauuucaguaucuauaaacaccuaaaacagacauauacuuaucuuuagcuauaaaaaucuggcuucucucaguauuuuaaaaaacuuuugauuuucuguaguuugaaaaugacaugccuaaguauagauuuuuggacuuuuauccuucuugguguucucugaguuuccuggaucugugguuuggugccuggcauuaaucugggagaacuucucagucauuauuacuucaaguauuucuucuguuccauucucucuuuauucuucuucugacauauccuauuacacauaucuuauaccuuuauauaaucauuccacaguucuuggauauucuguuuuuuuuuuauaaagucuuuuuuugucuuugcuucuuaauguuggugguuaccauauugagauaauuucagcucagagauucuucucuccagcuacguccagucugccaauaagauaucaaaggcauucuuuauuuuuguugguguuuuugaucuagcaguucuucuugguuuuuagaauuucuguuucuaugccuauauccccugucuguucuugcaugcugucuccuuuuccacuggaauccuuagcauauuaauuauaguuuuuuaaaauuccuagucugauaauuccaacauccuugccauaucugagucugguacuaaugcucgcucugucucuucaaacuauguuuuuuugccuuuuaguaugugacauaguuugguuguguccccacccagaucuccucuugaauugugguucccauaauccccaugugucgcgguagggaccaggaccagguggagauaauugaaucgugggggcaguaucccccauccuguucucuugauagugaguuaguucucacaagauuggaugguuuuauaaggggcuuccugcuuugcugggcacuucuccauccugcugccauaugaagaaggauguguuugcuuccccuuccacuacgauuauaaguuuccuccacagcccuguggaacugugagucaauuaaacgucuuccuuuauaaauuacccaguauugaguauuuuuucauagcagcauaagaauguacuaauacaguaugucuuauaguuuuuucuugauagcuagacgugauguaaaaggaaccacuguaaauaggccuuuaguagugugauggcaagauguaagaggagaggaacuguucuguaguucuuuuuuaguuuguuuguuuuuuuugagacagagucucacucugucgcccagacuggagugcaguagaacgucucggcucacugcaagcuccgccucccggauucacgccauucuccugccucagccucccgaggagcugggacuacaggugcccgccaccacgcccggcuaauuuuuuguauuuuuaguagagaugggguguuaccguguuagccaggauggucucgaucuccugaccucuugauccaccccccuuggccucccacagugcugggauuacaggcgugagccacugugcccggccaguucuauaguucuaugauuaggucuuggguuuuuggugagccuuugucccuggacuguggcauucauagguguuucucaguuuaggauuggcuaguuugaguaauaucaggggauccugggguuuaaggguggucucuguuugccugguaccuggcccugggaugauuaaggcagaagaauauugccucuuaggguguuagggccagacagaggauguauggcuguggaucauuuaguuugccuaucaaaggcaugcucaggauugagcuuuuugcuauuucuuagaauuggcugucccugggaggagcaggagcagucuucuccuuagucagaaagguuuuuaaaaugucaacacaucauaauacaaguugagcaucccaaaucaaaaaaucugcagcgcuccaaaauccaaaacauuuuaagcaccagcaugauacccaaaggaaaugcucauuggaguauuuuggauuuuggauuuuuagguuugggaugguucagccaguaaguauaacgcaaacauuucaaaauccaaagaaauccaaaaccugaagcacuucuggucccagguauuucaaauaaggcauacucaaccuguauucagaaauaaaaauauaaaaacuauagcccuacacauauauggccaguugauuuucaacaaaggugccaacauaauucaauaaugaaaggaugaucuuuucaaaaaauugugcuaauaugcacauggaaaauaaaugauaaaaguaaaaacaauucuucacuagauuuaauaagauuuagguucaauaagcuuaaacuuaaaggcuaaaacuauaaaaccgagaaaacauaggagaaacucuuuggauaugggguacauaaaauuuccuauguagaacacagaaagcacuaagccuccaagaaaaauugauaaauugauuuucaucaaaauuaaacccuucagcuccuuggaaagacaaacuacagacauggagaaaauauuugagaccucucuuucccccuguuucccuccuuuucucuuucucucccuccuucucucucucucaccccaaccaagaaguuguuuccagaauuuauaaagaauacuuauaauucaguaguaagaaaacugaguaaaacagguaaaagauuugaauagauacuuuaagaagauauacauuaaaagauaaucauugucacuggucaccagauaaaugaaaauuaaaaccauaaugagauauuacuacacacccacuagaaagacuaaaauuaaaaggacugacuuugucaagugcuggcaaggugauggagcaacuggaacucuuguucacugguggugagaaaguaaagcguuaucauuguuuugggaaaguuuaguaguuuguaauaauguuaaagguguacuuacuguaugacccagcaguucugcuccuaguuauuuaccuaagaguuaugaaaacuuacaucuacaaaaacaacuuguacauaaauguucaauguuccaaaccuggaaacaagugaaauauucauccacagguaaaugaauaaagagaugcauacuguacuauuacuuguccauuaagaggaacaaacuacugaugcaugccgcaacguuagugaaucucaaaacacuguacugagggaaugaagccagaugaaaagaaguaagacuguucuaggcuagacaaaacugaucuuacaauuauagagacaaaaccacugaguugccugggauggaggacuugaauguaaggggcacaagggaacuuuuggggaguacuaacaucuguagcuuaauuuugguguugguuauauggagauauaugugucauaacuuaucaaagcugggugugguggcacgugcauguaaucccagcacuuugggaggcuaaggugggaggauuguuugaacucaugaguuagagaccagccuggacaauauagcaagaccccaucucaaaaaaacaaaaauuuaucaaacuauacuguuaaaauggauacauuuuauuauacguaacugugguuuuugccauuaaaaguaauuacuuuugcaccaaccuaaauauaauuuaauaauguaaauuauauuucaaguaaguaguuugaaacauauuggucaccacagagcuauuaaguaugcauagauuuuauuucuuuuucuguaauacagugaucacaauuuuuaagccacucaaagaauuagacuauuguuugaagaagccguuguagaaggguaagagucagggcaggaagaccaaauaggaggcuauagcaauaaucuggaucagagauaaucuuagcaucaaauucaacaagauucuguacauuaaccuuccauugcuuacucaaucaagccaaaaguagagaagggguguuuugagacucuuuggcauacagacuugugguuaauuuucucuuucucaucuauuuuucaauuccauucuaccaauguauagucuuugauucuagauccuuucuggaauucugcuuggcaggcugaccuucccucucagaugggacugucccuacauguggccucuuugacccugcuucugcagccuguccucuuaccaccacuuuuucacucucaaauggggcuaaccacauccuucccugccacucauccauugauggcuguuccaguucacuuugggaguaaaaaauuugauaauuacuuguuuugaggaaauaaaauacaugugcucaccuaccguauucagcuagaagcugguguugauauuuugauuaaucuaggauagaugcuuuuuccaaauaagauuggaagucuguggaagugcaugauuuauuuugcuuuccagccaaacuaucaauuaagucauuucgucuucauaugaucucucauuagaucaagcauuggcuaauuucuguaaagaacuauauaguaaauauuuuaggcuuuguggccauaugauuuuugucguauguguucaacucugauguagcaugaaaugaaugaauguaacuaauaaguguggcucuaucccuguaauguacaauuuuacuaaaaauguagcacgaauuagaacguacaugaauuugaauuuuacauaaauguaaaaauguaaaaugaauuuuaccuaugagccauauauuuuuggaacccugcaguagaugaugauugacuuacuuugggggcacuguuguuauuauugucucauauuauagguuccucacuuaacaggagaccguaauucccauuugcccaagaaauggucauuuauucacguucuuuuuuuccucuugucaaccuuaugcccuaagaccauuuucauggcacauuccuucuuuauauuuagcucuauucaucuaauuugauuaagacuagugagaagaugcucuugcucuacauuugauacagcauucaguaagcuuuuaaagugagaagucucauaucuaucacuaaucucuagugugcucuaaagagauuuuuuugcaagaucuuaaucaauaccugucagucaacuguagcuguuagacaaccugcuuagccuuccaguuuucuuuucccagauuccagcuuuucagaucugccugcaucugacaaucuguaauucaauauuggacuacauuucaaggauaaaggaggaggcauuauuuauuugcuaucaagcaaacuggauguaaauggaaaacugucgaguaucuuuuauuuccugcaaguugcguggcagcucaacuauccuaaguuuugcccauaggaaaccucuguagaugauuguuugugaguggaguaaguccugaauauguaggaaaaaaaucacugugauauuucacguagaagauguuuaguuaauauuauaugaaacuguugaauaagugggcucaaaaaauucauuuucuuuucuauauuuuuaaagacagcuucuucauccuuaaugaccaaauagcugaggaaaauacuguugcaaauuuucaaugauuguaagccuaacccaagcagguuucaaaccuauuuugacauaauucagauauuuguuaggaauggauguuacagacucagaauuuuaucauuggaagacugccuugcagaucuuugaaucuaaucuucuuauggaauaaauaccuagugagcugaugucaugaauuggauguauuuuacccaauccaagguucaauacaggaugacccuucuuacacucuaucccaaacaauaaugagcuacccuaaaauggauauccacuccaaccaaaacuugguguuuaacagcauuuaaauggguucuugagugagcaauagggacuuuguauguaaagaggagagggaaauaugauaauagugcaaauguuauuuugcguaagaaagaaauaaauugauuuucucuuauuaguguaacaucucaucaauacacuccuuucauaaucauguaaucaagaccaucucuuauuggucaaagaaagaauugugagagucuacuuucauuucuucuuuuuguauggccuuaauuucaaauaaugauaauauauaguaaauuuuacccccugaaugguacugguuuuagaauaaaucauaaaauauguauugaacaccuguuucaugcaagguguacuuaauugguacuauacucauuuaagaaaaacagacaugaauauagccaaacuaauaaaagaauuuacugagugaaucucugaauuaaaaaagauugcaucagcauuacagaacaguucacugaagcauuuuuuaacauuuaaaaauuaacacauuuaaaucaugcuuugaguugcaacuagauuuccaaaauaaacauuaaaaaguuaagaagcaccagugccuauuaaacaguaauuuugcugucccuuucguauaaaaguacuucucccugauucucaguuacuacacauaaaauuauauuuguuuuuauucauaaacuccaugcucuuuguagaaaauuuaaauaguaauggaaagcuauaaagagaaagacaaaaauagcaauuucuuuuaggaaaagcuggaaaaguuaacuuucaguauuuuaaucaucuucuauugugagcauucuuuuuuuuuucccccugagaccuggggucucacucugucacacagacuggaaugcaguggugugaccauggcucacuguagucucgaccucccaucuuagccuccagcauagcugggagugauccucuccucuuagccucugguguggcugggaauacaggugcaugccaucaugucuggcuaacuaaaaaaaauuuuuuuuuauagagaugggauuucccuauguugcuuaggguggaacauucuuaaauuuauuucuuuauacuauuuaaauuuuuuaaaauaaauuacuuuaugaauaauauuucugugucaacaauaugcacauuacaauuuugauauucauuaccaaauacccaucagaaagaucagagcagccuacaacucuacuaacaaggcuggaaaaugccuauuuccccaaauccuagaugcuucuaaauacugccaguuuuauucauuuuugccaaauuaaugggacacuauguuaucuaguuucuguuaucaugucuuugagcacuggugugguuuguauuaguugucuauugguuuuucuuuuucagucaugaauuuccuauucauuuccuuuaccuuuauuuauauuuuuugaaauauucaaaaguuauuuguaaggccuuuuuguauauuggagacauuuaacacugugucuauauauguauuuuagacuguuucaugguuuauuaccuuuaaaccuuguuucugguuuucuucccccaagacaaaaauucuuuauuguuauguaauugaauauauauuuauuuuccuuuaugguuuuuacauuuuauguucuguuuaaaacacuuuuuccaccuuaauauuauacaauauuuauuucuauagaacaauaguucaaugauaauuauagaauuguauuuuguuucaucuauuuaguauauauaacgaccuccuuuguaauuuaguuuaacucagugguuuuucaacuuuagcuacucauggaaugcccuugucuugaucuguuuuugugcugcuauuaacagagugccgcagacugggucauucauaaacaauagaaguuuauuuggcugguguuucuggaggccgggaaguccaagguugagggauuacaucuguaagggccuucuugcugcauccuagcauggcagaaggcgucacaugacgggagcgugcuccugagagggaacaagagagggccggacucucuuuuauagcaaacccacuguugcaauagugacaugaauccguucgugagcgcugugcuacugaacgaccccaccucucaacauguugcacuggggauuacguuuccagcacaugaacuuugagguacacauugaaaccauagcagcccugcagugggaugcuugauucugucucauggguagugucagaaucccuaggguggguguuaggcuauguguuuaaaaauauauucuuguguauguguguggcauguguaacuguguagcauuuuuuuagaucugggcuucucaguucuuuucagacccaacuccccauuuuugugagaacuauuuuuauugcccucucuacuaucuugaaaugaaauuuuacagguagugcaauauaccuaguuacauauuuucaaaacauuaauauaaugccauaauuggaauauaaggaaaaagaaaauuaaaaccuaugauaaaauaauauguauuuuaguauauaaaugcugagguauuagacuggaagacaucauuagucacauauuugcaccuauacauagagucacugugagaagggaaguagagaugcgggucagaagccguguuguauugguaacucaaguacucuaagugguguugccuucagugauauggcuuuaauugaguaauuuagguaaaauucuuaaaauacagucuuccuuugauuuaccuagaaaauucagugcuguuaggauuauguaaaaacgagcucuuuguuuuuaaauguaaaaggagauuuaguucuaggcucagacaauuauaaacaaguuuuccaccgucauggaauuugguuggacacuugaaaguugcauuggauuuggauaauucuucauuguggagaacuguccgacacagaaugucuggcuccuuugguuccugcucauuaagugccuguaauuuuccauaaaccuugugacaaauaaaaauacccgcauaaauuucucaaacaacccucaagauaggcgucacucccauugagaacuacuggugugguuaaugaguuuaugucgugaacuguuauaaauacuauaaaaauacauuaugaaacuguauagauucugaaguuguuuuuugagucaugcaugcacugaaagaauuguguuauagaugucauuuccuuuuuuuccagcaugaaacucuugucuccuuuuguuuuuacuucuuaauguaguauuuuaauuuccuuugucucucaagccaguucaugcuuauuguacaucauuguuaauuuucagcuaugacaaaagaaaauacuacagccaauguuaugagcaaaaucuuaauuauauccuguauuggaaguaauguaagaaaauaggaaaaaauguaaaucaggaagguugucuuuugagaaauuggcaaauauauaugacaaaugugucaucgaggucuugaccaagguuaguuuguugagugaagauaaugccuuuuguuuuuguaugauugucacguuuugcuucaaagucaaaggagcugcguaaaaagauuucuuuguaagccuuuucuaugguaugcuuguauucguaacccuuaugguaagaugugauaggugaagcugaaugauaaauuuuaacaguuaauguuuuaaaaagaaaaggaaugggcugauaugugguaccauauuacagaccaauuuuaagugguaugauugcuuucucuauuuaugccuaaaugaucugauuuggcuuuucauggaaauaaugaacauauuuuugcugaagcaaaugagaaaauaaguauguuuucaggcaaugaucuaggaauaaguuuaagaaacauuuugucuaguuucuaguuauuguugagaaaaggagcucuauaucaauuauguuaaggaccuaaaguuguuuuaacaggaauuuuccaaaauuuggauguuuaauuccaaaugcugucaucuaacugaucgguuguucauuaucugguguacguuuuguacuuaucucacccugguaagcuaucaggaggcugagcugcucaaauauuuagguuuuaacagagggguuauggaugaucucuuguaauuaaaaugagcauugauuaaaaucugcucuuaaggucuuuugccucaaauuaucucugccuuguuuugcugagugugagcccuguucagcuggacacugaggcauuugaacagagccuaagguacuuucugauagacccacuggcacuauguuauccguuccugccuacacgcucuguccaugagagcaucugacagguuucucaacuucuauaaucaaaggaaaacuaacgccaaaguuaugguucucccuucuaucaguaaaaaaccaaaaaaguuaacauucuuguuucuugugagugcaaaugaauguaaauuuguuagcuuaacccacucacauacaaagaccaggugaaaaaaaauauauagauauaucugaguuagugaauaccaaccuaacucucuaaagggugacaauaacaagcaugggaaacuguguuaaauaauuuauacacauuucuuuagugcauagacuuuuagaacuuuuaggaugcuaaguauauuuugaaucucuaaguagggucaacaugauauuguguuuuuaaaacuuacuugacaauuguaccauguauauuuuaggccucuuacacacauugguaauugcuaauugcuagucaaggacuagcccccugagcaacagaagcuuguucuuucacugaguuguauuuuaauauuaugccuuucagugaguacugauauuagaagucauaugaaaggccauuauaguugugaacuguuguuaaggacauuguucaguguguugauuagcauucuuggaauaaaucccuccugugauuuaauacuuggugaaacuguauguuuuuacuuucugucaguugaggauuauauaagccauuaugccuucuuuuuugccuugcuuguaaggcaucucaaauaaaugugacguacaaauacucaaauguaaugcagaaauuauucagcucucauguuuagcaugcuaagaauuuuuacucucucuuuuuguauuugggcaguuugauaguuagauaucagcuuuugagccuuuauuuguaauagagggauaauaccuaccauuuggauuguuacgaaaaucaagugaaacgugcuucguuauuugcuuagccauguaucuaguaccuuguagaaugcuaaguaaaugcuagcgugcuuuccuuuuucccccuuccauaauuuuaauauguucuguuucugguuuugcagucuuauuucauacacaucuuuacuuugaaucagcucagucuuguuuagaagugagugaaguguaaaugcuaaaacaaaaauuaugaacagcacauugauuuuguagacccagaaauugaggagcagauuuauaauuuuugaaauaagaaugaguaagugguaucaggcauuucaguaauggaaauuccaauuuucagaauauaacacgagagacauuugauugaggcuucuucuacucaccagggcuaaauauuagaugaucuggauuuuauuuccauaugaaagugauuccgugugaaaggagccgucgccuuucugauccaaggcucaaggauaguguccuucccuuuaguccauucaucuguacauuggcaacugacucaauggucucuuuagccacaucaacacauggcuaggaucauggcuuaggugaccauauaauuugucaucaaaaccagaacuuuucagagugaaaaggggcacuauuaauauuuaagccaggacauagauacaaaccuagacacauccaggacaaacuggacauuuaaugauuuuagcuaauaguucuuuuuauguugcuuuuaaaacaaagagauuuuauauuuggggguguguuagcccuccugauauuucuguagcagcacagaaauucagaaggcugucaucccuauuuugagucuucugaaccacguuuuauuuucuaauuuggagugacauuuuccuuuuguauucaaaaugacuauuguugaauccuguuuaaucaguuccaagaccaucuuauacauuauuaaguaagcuguaauggcucuuucuuuggacuccacuagccagguaauaaccaggggacaaaugaaagcacagaggugaagcugaggcuuuuaauguccuugcauaguaauugcauauuuggcaaagacucauccuggauuauuuucagauuuagaauauugcuuuuauuuucuauugugcaguuacauuuggacuauuaaaauuuaauguuuaugacucuugauguucaaaaccaguauaaaugaaaguuaaauuuuaggucaccuauguucuccccacucuuguuuuaauagaaaaaagcuuggccagaccacaagcgggaaugcaaaugccuuaaaagcugcaaacccagauauccuccagacuccguucgacuucuuggcagaguugucuucaaacuugugaguauaaaacucaugaaauauagcuggguuuugguuaaauaaacauaugcaauugcauuuuccgguauaccucagagauguugcagguucaguuucagacuaccacaauaaagcaaauauugcaauaaaaugagucucacaaauuuuuuggcuucccaguaaauauaaaaguuauguuuacauuauaccguagucuauuaaguguucaguagcauuaugccaacagaacaauguacauacuuuaauuaaaaaauauauuucuaaaacugcuaaggaucauuagacccuucagugcaucaucaucuuuucgcugguggauguugauggcugcugacuaaucaaguggugguugcugaacuuugggguggcuguggcaauuucuuaaaauaagacaacagucgaauuugccgcauugauugccucuuccuuucgcaaaugauuucacuguaacauaugaugccucacagcuucuucaccaggaguagguuccaucucaagaaaccaccuucuuuguucauucauaagaagcaacuccucaucuuuucaaguuuuaucaugagauugcagaaaaucaguuaauuuuuaaucaguuaauuuauaauucuuuaggcucuacuucucucuguuuuaaaaaaaguuuugcuuuuauuuuagauucaggggguacaugugcagauuuguuacauggguauauugcaugaugcugagguuugggguaugauggaucccaucaccgagguagugagcaugguacccaguagcuagcuuuucaucucuugcccacucccugcuucuuaccucccccucguauuccccagugucugcuauucccaucuuuguguccauguccacccaauauguagcucucaguugugaguaaaaaccugugguauuugguuuucuguuuuuauguuaauucacuuaggauaaugcccuccaacugcauucauguugcuccaaaagacaugauuucacucuuuuuaaugguugcaugguauuucauaguguuuauguaucacauuuucuuuauccauugugcuguuaaugggcaccuagauugauuccaugccuuugcuguugugaauggcacugugaugaguguaugaguacauguaucuuuuugguagagugauuuauuuuccuuuggauauauacccaacagugggauugcuggguugaaugguaacucuuugagaaaucuccaaacugcuuuccacaguggcugaacuagauuacauucccacuaacaguagauaaguguucccuuuucucugcagccucaccagcauguguuuuuuuuuuauuuaauaauagccacucugacuguuaugagauggugucucauugugguuuugauuugcauuucucugaugauuaguaacguagagcauuuuuccuauguuuuuuggccaccuguauguugucuuuugagaagugucuguucuuguccuuugugcacuuuuuauuuucacuuuuugagacagggucucacucuguugccccaggcuggagugcaguagcaugaucauggcgcacugcagccucaaccucuggggcucaagcaguccuccuaccucagcuucccgaguagcugggaccacaggugcaugccaccacgccccgcuaguuuuuguguuuuuuccuuuuuuuuuuggaaagacgaaguuucaucauguuucccagucuggucucaaacuccugggcucaagaaauucucccaccuaggccuccccaagugcugggauuauauaggugcgagccacugugguggcccuuuguccaguuuuuaaugagguuguuuguuuuuuacuugugaauugcuuaaguuccuuauagauucuggauauuagaccuuuguuggcugcauaguuugcgaauauuuucuucgauucuguaaguugucuauuuacuccauugcagguuucuuuugcugugcagaugcucuuuauuuuaauuagguccacuugucaauuuuguuuuuguugcaguugcuuuugaggacucaucauaaauucuuugccaagacugauguguagaaggguauuuccuagguuuucaucuugauuccagcuccuucguucuugcuaucacaucuacacuuacuuccucuacugaagucuugaccccucaguguuauccaugaagguuggaaccaaguucuucugaaucuucugaacuccgguucauguugcuguuuugaccucccacugguaaagcauaggcaaagucgauuuaccacaaauaguaagggcccuggcauuuuaggaaugguaaaugaacacuggcuucaaccuaaagucaccagcugcauuagucccuaaaaaaaaguccacuuguucuuugaagccaggcauugaauucucucuagcuaugaaaguccuaagugacaucuucuuccaauauaaggcuguuucaucuacauuaaaaaucuguuguuuaguguagccaaauucaauuauuuuaguuaggucuccuggaucauuugcuguagcuucuauaucagcacuugcugcuucaccuugcacuuuuuuagauuuauguauguauguauguuuugagauggagucuugcuuugucacccaggcuggggugcaguggcgugagcuuggcucacugcaaccuccgccucuuaggcucaagcgauuguccugccucagccuccucaguagcugggacuacaggcgcccaccaccauggccagcuaaauuuuuuguacuuuuaguagagacaggguuucaccauguuggccaggcuggucucgagcuccugaccucaggugaucugcccgccuuggccuuccaaagugcugagauugugggcguaagccaccgcaccuggccaccucgugcuuuuauguuauggagauggcuucuuuccuuaaaccuuaugaaccaaccucuguuaacuuccagcuucucuucugcaauuuucuccccucucucagccuucacagaauugaagcaaguuagggcuuuccucuggauuaggcuuuggcucaagggaauauuguggcuguuuugaucuucuauauccaggccacucagacuuucucuagauuagcaauaagacuguugugcuuucuuaucacucauguguucaugggaguagcucuuuucauuuucuuucagaacucucccuuguguugacaacuuggcuguuuggugcaagaggccugacuuauggucuauaucagcuuucaauauuucuuucucacuaagcuuacucauuuuucuagcuuuugauuuaaaaugagagaugugugacucguccuuucacuuauaggucauuguaaaguuauuaauuggccuaauuucaauauuguugugucagagaauacagaggccugaggagagggaagagauaggggaauagccaggcagugggaauaagccggucggcggagcagugagaacacgcacaacauuuauugauuaaguuuguggucuuauauggggaugguuugugguaccccaaaacaauuacaguaguaacauuaaagaucucugaucacaggccacaguaacagauauaauaauaaccaaaaguuugaaauauugugagaauuccaaaaugucacacauagacacaaagugaacacguguuguuagaaaaaugguauggacagacuuguucgaugauguaaaucuucagugcaaugucugcaaagcacuauaaagugaagugugauaaaaugagguaugccuguguuauuccuauuuaaggcugaaauuaaccccauguuaauguagaagguagauuauuccagggagugucuuagacaaaaaaauuuguucuuuuccuauuaaucauggaaucuguagcagugaagaaauacacagucucucuuugaaggcccugcuaucuucuugugggaauaaagauggaggagguucuaucucugagguaugagaugguaguaaucucuguuacauugccuuuauaacuuggguauuguaaacuaaugcacagggcgagcaugucauuuucuacuuuccucuucaaggaagauacacauacauaauuaguauugacuggaagaguacuuaucuuauuuccuaaaauucacugaagugauuucuucggcccuuuuucauaaguggcaaaacaguaaacucugugaaaucuugcuguggugaagccuuuuagauuuuuuuacccaucuuuagugugaauaucuuucucaaauuauuguaggcucccgauuuguccuucuccuuuuuuucuuuuuugagacagggacuugcucuguuacccaggcuggaguauaguagcacaaucauagcucauugcaagcuugaacugcugggcucaagugauucucccuccucggccugcugaguagcugggacuacaggugcaugccaccaugccuggcuaauuuuuguauguuuuuuaggcauaggguuucgccauguugcccaggcuggccuugaacuccugggcuaaagcaaucugccugccucggccucccaaaguaucggggauuauaggugugagcuaccaugccccaccuuuuccuauuguuuacugacucuuuuggccgguacacgauuuuauagaggguuuuaugaauauaaaaauaugggaacuuuuuguacaagaguuuugcauuuggagauuaaacuguugagugaagauacaaguuagauuuuuauuuuaaaguuguugauuaauucagucuaaugagagugaugaauagaaagaauauauagaaaauguucuuuuugauggacuuucauuuaaauauacaaagguacucaaacuuauuuguuuauauauuggaacacuugaaauuguuauuggcguuuuccccuuuuccuucacagauggauggagcaccuucagaaucagagaagcuuuacucauuuuaugaucuggagucaaguaagugauugucuaucagcaucuuaaaaaaguuucuauaauuuguuugcugaguuggugaauggauuuauuuuuaacuauguuuuucuguuucuuuauaaugugaugcaaaccuaacaaaauuuauuuuuauauacaacugucacacugguuuauuucacuuauuccaggguagcuucguccugauaaggguuaguaaagcgccaugaagauguucagguuacaugggguaguguaaccauuaguccaguugacaaaaucauuuuucuucuuuuuuucuucccuguuucccuucuucugucucuugguuuccuguucuguuuucuuuuugaugucagagaagagugauuagugaacagggggauuccacagagcuuuuaggguuacugaucuuuuagacauuaaggaagguagaaggaacagaugacucagucucuguggcagugugaagcaucauucuucucugaaacuaccauguagguagccaccuucuugugaugacuuaaaaagcuucccauaucugagugcuaagcaaagguagguuucguuuugauuuuguauuggcgcagauccuuuucguuaagguuguaagugauuucaacucaaaacuagccagggcacauacaguaaauuugcugcacaguuuaauacuucuggauggagacaagaagaugaucuaguacagauuuauauaagguugugggaucugaaguucccaugguaauaaauuauuauuuaagaaaagcaauggcaacaaaagcaaaaauugacaaaugggaucugauuaaacuaaagagcuucugcacagcaaaagaaacuaccaucagagugaacaggcaaccuacaaaaugggagaaaauuuuugcaaccuacucaucugacaaagggcuaauauccagaaucuacaaugaacucaaacaaauuaacaagaaaaaaacaaacaaccccaucaaaaagugggcgaaggacaugaacagacacuucucaaaagaagacauuuaugcagccaaaaaacacaugaaaaaaugcucacaaucacuggccaucagagaaaugcaaaucaaaaccacagugagauaccaucucacaccagauagaauggcaaucauuaaaaagucaggaaacaacaggugcuggagaggauguggagaaauaggaacacuuuuacacuguuggugggacuguaaacuaguucacccauuguggaagucaguguggcaauuccucagggaucuagaacuagaaauaccauuugacccagccaucccauuacuggguauauacccaaaggacuauaaaucaugcugcuauagagacacaugcacacguauguuuauuguggcacuauucacaauagcaaagacuuggaaccaagccaaauguccaacaaugauagacuggauuaagaaaauauggcacauauacaccauggaauacuaugcauccauaaaaaaugaugaguucauguccuuuguagggacauggaugaaauuggaaaucaucauucucaguaaacuauugcaaggacaaaaaaccaaacaccgcauauucucacucguaggugggaauugaacaaugagaacacauggacacaggaaggggaacagcacacucuggggacuguugugggguggggggaguggggagggauagcauuaguauauauaucuaaugcuaagugacgaguuaaugggugcagcacaccagcauggcacauguauacauauguaacuaaccugcacauugugcacauguacccuaaaacuuaaaauauaauaauaauaaaagaaaaaauaaauaaaauaaaaaaacauauauuuaccaucaaaaaaaaauuaacaagcauauaaaauagaaaaaaaaagaaaucauuggguuauucuguugaauaaguaaucuaaaggauaugcauagacauaagcaacagaguuaugcuguaguucaacuugauguaucuuuucaaguuuuaaaagacagcaaaguauucaaauuuucuuguuauauuacugcuagguaaauaacaucuguuaccauggguuuuacucuucacauuagcccuacucaguacuagugucauacacaugaccuuaagugaaaugcucucacauguuauuaauugaccuguuguauccuuucagccuuaacaccccauuugugguaugauugaaaaugauauuuaaggggguaguauuggcguuagaacuuuucuucuucuuuuguuuuagaaccaucuccuucuguuuggguugaugccacaucauaucuuguuuuuugucuuuguuuuuuggagauggagucucucuuuuuguccaggcuggagugcaguggcgcgauguuggcucacugcaaccgccaccuccuggguucaagugauucuccugccucagccucccgaguagcugggauuacaggcgcacaccaccacgcccugcugauuuuuauauuuuuaguagagaugggguuccaccauguuggccaggcugcucucgaacuacugaccucaagugaucugcccgucuuggccucccaaaguguugggguuacaggcgugagucacggcgccaggcuccuuuaucuuguuuauucaacucagauaacuugaaguugaaauugcugugcuugaucccuguucuauucaugauguacuagccauaugacaaauuuaaccuauuugaacuuuaucugaacuuuuuaguucuuauuuucugucuuuuugccuuagaggugaugcuguuuauuaguuuagucaugaccuaguuguaaauuauuucauggaaaagucugcuuaaguuuacugacuuaauaagaacugauaauuguuuguauguguguacagaaugauguagaaaaucugguaacacacaaucucagugauuuugguuuuaaugcuuuuucauauaugugcguacuuauguuuugauagguguuugaucuuacauugcagacaaaauuuggcagaauuuaauugauaacauaugcaucauauuuaguugucaaaagauaaaacaauauguauuugcucuuugucaaaauccaauguaagguaggaaauaucugguuuaacagccagcauugaacacuugaaaauuauccuucagaaguuuacuuugagauugugcuauuuauuuucucuuuaaaaaagauauuaacaaacugacugaagauaagaaagagggccucaggcaacucguaaugacauuucaacauuucaugagagaagaaauacaggaugccucucagcugccaccugccuuugaccuuuuugaagccuuugcaaaaguaaguguuaaguuugcucuuugcuaauuccauacaucaaccauuugcuccuuauuuuguuguuaguuacaaaaaugucgagaaucuugacaggaaauucaagacccuuaaugccuuauauuacuuccuuaucauagugaguagagcaugagagaauguauugugugcauugagaaggguaugaauuuuucuguuugauuaauauucuuguuauugccugaguauguucauugugaauucucaaaguguacccuuggaagaaagaguaugcuuucuuuucucagaagaaaauagcauaucccauuauuuuuugugaauggacuuguuugccguugcauugcauucauugaguuuuauggugguuguuuaagcauagagccugucuuugaaaugaaaaauuuauugaaauccauuucuuuucuuuucuuuuuuguuuuuagacagagucucguucugucacccaggcuugaguguaguggugcgaucucggcucacugcaaucuccgccucccagaaucaagcgagucucaugccucagcauucugaguagcugggauuacaggcaugagccaccacgcccagcuaaauuuuguuuuuuuuuuuuuguuuuuguagagacggauggucuugaacuccugaccucaggugauccacccgccucggccucccaaagugcugggauuacaggcgcgaacugccacgcccggccuccugaaguauuuuuuuuuuuuuuaaaugauuccgaggguuuaucuuggccuagggaggaagagugcgaugauugauuuuuuuuuuucuucacuagcccauaggcaugaaaugauugcuucuugauauuuacccugggauagggaugacagaaacacccccucacugcuauggaucugcuguccucgcuuucucacauuguguguuugcauuuguuuuaauguugaucacaauuuaauaacaaguaaaacuuuacuuuugacaauuuugccacuuauuuuguaauuuguaagcacacguuugaagauauauuuaugccauuaauauuuuaaggcauguuuuaaaauuuacuguuuucugaaaaauuaaauguaauugguuugauugcuggagauuuauuccaguuuuucucaaauguauuuuuauucuguaugguacauuuuuaugauuuucugauuaaugucaucuuagcauuauauucugguuaucuauaauuuaaaauugauuucaaaauuuacugauuucuuacagugcaucugaaaacuuucucaucuauuucauaugcuucugaaaauuauaaccuguaguaguaucgugugccgugcccaaggcuguuuucauguucaacacuauaaacacgaacaccuacugaaagauaaaaauauaccuuaugaugauuauuaccucauuccuaguguuaaguuuguggcuauucugugguaauuauuucuauuguuggaaaauguuccagugauaauuacugauguuauuaauauccaugaaaaauauuuuaaaauacuuucuguugcuacauguaaaaugugaauuacuauccuaguucuucuuucuuucugaagauuuuagucucauguauuuuauaaugaaauuaucuccauguuguauagggggaaaauucuguugcuaugauuaaguguaccaauuuuuaauauaaugcuuacccuucuccccacauaauauuuguuauugcuagaaaauacacaguuuugagauuuuugggcauaauuggccuuagugugucacuucugcauuaaaauauagguuaauaaucagaugaaagcagccaauaaccuauggcuucuguacuuucuggugaaaguuuuguuaauguuuuuaauuuguauuuuucugcuuauaaauuuguccuuaaaucacuccccuccuucccgcccccccaacuccuucucccuccuucccgcccccccgacuccuucucccuccuucccgccccccgacuccuucucccuccuucccgccccccgacuccuuuucccuccuucccgcccccccgacuccuuuucccuccuucccgcccccccgacuccuucucccuccuucccgcccccgcgacuccuucucccuccuucccgccccccgacuccuucucccuccuucccgcccccgcgacuccuucucccuccuuccugccccccgacuccuucucccuccuucccgcucccccgacuccuucucccuccuucccgcccccugacuccuucuccuuccuuguucaugaaagauccuaaauuaaccuaaauagauccugcagcuuucagggaugagucacugagcccagaauguugacggugugugauggugcaagucacaucaagcacacgggaacugggugaagaucccugggcagagauuuuuaucccagucuacugcuccucuccucauuuuacucugguauaaaauuaauuaaucaaagagaagaaacgggcaccauaaaaaaauaacauaaaacaggauuuuguuuauugaggccagguaaagccagccuucuucacagcgaaaauucaaaagucaguucauuaggcuguggaaagcgggucaacaugcaacuaucccugacugacaguuuguacauacagaggaagcugcugacuucugaauuuacgcugucaacaaggcuggcuauaccuggccucaauaaacaagaucuuguuuuuuguuuuucuuuugguuccucucauuuacauucauucagguucugugcagauaauagacauacuaagcuuauguuuuagcccaucuuuuuuuuuuuuuuuuuuuuuugagauggaguuuucgcucuugucgcccaggcuagggugcaguggcgcaacaucggcucacugcaaccuccgccucccggguucaagcgauucugcugccucagccucccaaggagcugggauuacaggcgccugccaccacaccuggccaauuuuuguauuuuuaguagagacaacguugcaccacguuggccaggcuggucucaaucuccugaccucggaugauccgcccgccuuggccucccaacgugcugggauuacagacgugagcuaccgcacccggccaguuuuagaccaucuaauuuucauugaaaggcauauggaauucugagagcuuuucuaaaauugcuuaugucuuaauuuuuuugacuuuuaaauuauggacauuuucaaacacacacaaaaauagagggacuaguagaaugaaucuucauguuucuaucagcugguuucccuaauuuucagacucauuuuauaucugucauuuuuaauacuuacaguucacacagauguucuuucucuucggaguuuuaaaccuucauuagaauuagucuuuucuuaccaagucucuugcccugcugagagguguuuguuaguugaaucugaauuugcuuagcaaguacagcagacuuuuauuuauuuauuugcaggucuaguguguacaaaauacucuugacacaggguuguagaaguauguggcuaauucuaaaucucaaaauuaucuaucaaggcagaaaacuucagcaggucaaaagucuuacuugaagaauaugcauaucuuuaucaaacuugcacuuccccugaaaggaaagggcucagggaggaugagaaaguucuuaaucccgagagcauauuucgucgucuggugagcugauggcuuuuucuaauggaagcucaugauuauugccugaaaaguuggcaguuuguauuuugaacacuggaguuucuggcggaaaaauggugugucuuuccugucggaccggguucucaaugcugaacgugcaucugcugcguaagccuuaauuuuaccuggaaaauuucuucuguuacuuguaauuuucccggucauauucccagauauuccuccuuuucaccccacuucuuagcaccaguguuagucugacucugacucuuagcaccaguguuaauacacacacacccuaauagcaauuggaguuugauuguggaguuuucuauauagauauauccuguccacuuaugaauuuguugccuggcuguaaaaacugaguaacaugagccauaggaaggaggaauuuuucuaggggugggugucaaggaggaccucauaucagaaguggaaacugacguaaauuucaaaagcgaggcugguguugggaaacagugauauacaguggucuagaaaugcuguuggggagugaggguguugauuccuccaaccuccugagggaaauauaucaaccuccuccggagaagguuuucaaaggaaguuguuaccuguggaauacagauuucaguuauauuuaguaauuacaguagaguuagaauaagagcuugauguuuaaaauguuuguuuugcacuaaauguaauagaaagugaggguagggauacucccagaauuucucuagaggaggggaugcugagugauaaucuguuggauggagaggcuagagcaaauuacuugcagcuuuauuuggauaguuuuguuuuuuuuaaaaaacuuagauuguauguucccuggggaguguguggcugaacggagauaaaaguguaaagugugagcaaugaaagguguuaauuuccacagacagcaaugaagguguugaaaggauaggaagugcaccggggauauacagaugaacacaggagaugugauuauuuauaugcauauaaaaaauaaaggccaauuucaucucugcuggcucuuuuucacauuguuuagagaagagaagauguaugucuccaucucuacaagcuguuucuccucucuaccacacacuuuuuuuuuuuuuuaaaucuccacuuccauuuucaaacaaaauuuccuuugagauuuuuuucccccucuuugggaauagggucucacccuguugcccaggcuggagugcaguagcgugaucucggcucacugcaccucugccuccuggcuuucaaguugagucuugugccucagccuccugaguagcugggauuacaggcaugcgccaccacaccgggcuaauuuuuguauuuuuaguagagaugggcuuuugucauguuggccaggcuggucucaaacucuugaccucaagugauccacccaccuuggccucucaaagugcugggauuacuggugugagccaccccacccagcaccuguuagauuuugaaauggauuuauuggucaggcacaauggcucacuccuauaguccuagcacuuugguaugccgaggcaggaggaucacuugagcccaggaguuugagaucagccugggcaacauagcgagaugccaucuuuacaaaaaaacuuaaaaaaaaaauuagcugagagcagggugguacacaccuguaguuccagcuacuugggaggcugaggugggaggauugcuugagccuaggaagucgaggcugcagugagcugugaucucaccacugcacuccagccuggacuacaaagugagacccugucucaaaaaaauuuaucauggcaugacaaaugcugugauucgguguacugauuggguccgaaacauuugcuacaaauauagaaaauguauauacuccuaagcauaaauauauccuucgaaacucagaaaauuacaauuagcuacucggugugcugagaugggaggauugcuugagccccggaguuugagacugcagagaaccaugagugcugcuugggggacggagugagaccccaacucaaaacaaacaaaaauuacaguuagagagaggccaaauuuaaaugggaggcugaauaauaugaugguuaggucauuuuccucagucaaguaaauaaaauucucuccaucucaauuuucuuaucuguaaauggaaauacuaauaucuacuucauagauuucaaggaggaucaacuauaacguacuuaguagugucugacacauauuauuaauuucuacuacuguugcucccaccucucagcuuuauuuuuauuggauuauagaacuuugguguuuuaaaucucccugugcugucaucuagccaagagcgcagucugccacuguuuguaaacuagagucucagaugguugcucacaguugugcccagugcuggugucucuugagauccugagaauuaccuguuuuguugagaagaaauuuugcaaacaggcaauggugucuuuucuugaggcuuaguuucagucauagccauuguggacagaaaucauguacuguugccaacauucuuagaaacuccaugguaucaaaguaguuucuuggaauuucacgugggaaauguaaaaguaggcuucccuugaugauggaaaucuuucucacacaugcaucuuaaaaggauggaauuaagcgugcuucaguugucauguucuaauuaauugaaacgccauggaauguauuguauuucucuauucuaucccuuaaaauguccauugauaauuauuggcaaugguuauugauagucucaacguaauuucaguagaauuuguuuugagauuuuuuuuaugcacauaaaagauuucuuuagggauuauuguacagaguucuagaaaaauauauaauuuuuuuuucugggcuuauaacuuucuuuucuaaaaauuuauuuggcagccugauuagaaaugugguaaaaucugaacaauaaaauagaaaauagacuaguugcauagaauguuucaaaaacaggcauuagauuggcggcaacaagaauaaaagugaccuuccugaccacagaacauaugccauuguuaguguuuccggagcucugcaaaguacugcugaacuuuauaauguugugcaacugccacagaauuuuuuugauuagaaauuccacaucuguuugagaagauguucucuccuucuuucuuucaaauuaauaauucuccugguagcauguuauuuuuguucuuuagggcacguaugugaccuccggagcuugcuuuuccaaaaucuaauuuuuaauuauauuagcuguagcugguuuugcaauauguacugguugcauagauuggaaagugaguauuuuagaggguguuuuugguacuaugauauuuaaauuuuacaguuucauucugaguaaauuauuuuuuauuggaggauucuuuuuuuuuuaaauuggagaagcugugaagguguuaaaacgagaaucuuaccaauucacaauacgauaagaaaucgcgauuuaauauuuugugguauguuagaaauaaagcaagagaaaaucgugauacuauauucaagauuacaugcuuguguuuggccgguaugugccuuuacauuuagagugaucauaaauaauggaugugauauucugcuauaaccucccucauaauuuuagugaaguauauaaaucagcauggagggaaaauuacuaaaugacuuuuuuguguauccuuuucauccucuggugaacaguguaccucaauaaaaagcgagaacaaaguugaucauguuauauucagcuuuuaagcuuaaauuuucaguucuguuaaccaucucauucuggauacacuggugcucuguuacuucauuguuguuggugggcuaauuugugggaagaguauuaccucuguuguuuugaaaggucaggaguguguauauguuugucacuugaggguuucaaguucauguaggaccagauuuuagagccuuuuuuguugaugagcucuguuggguuucacugcuguagccugcuauaagguaguaaagaaagcaaucuuuugaauuaauaaagugauggauuaucuaauuacaaaguugaugugaaauggcaguaugauaacuuugacugcauuacuaaaugaucccagugacugaucagaugugccuggguuccauuaaggaaaaauaugccauuaaauauuuaacacuaaaagcgagcaggcacaccaggauugcuaaccuccagucaccggggugcuuguguguuuacgugugguggugacugcuacaugccacaucucucuacucugcucacaacagcugcuagaauacuuagcuguugggauuauacuucucuucugguguuaaguaaagcaggcaaacagcuaggaugcuuaacugcaugcagauccuggcauucuaauuaugaaacggugucaugcaucuaugauuuauauauguugucuuuauuacaacagauugaaucucgaaguugauucaggagacaauuauucucagaaauauuucucuaccuucaaauaaagugauguuuguaggacacuugggcuuucaaagaaaacaacucauuguuuggauuuuuaaugaugauauuuguuuaucguguucuucauucguagccauuugguuaaauauuucuuuucacuuauguguuaauaaccuaugaugaguugguguauauuuaucauaguuaaaaaccagaugccagcuaaacuucugaaguugggaaggauaauuaguaaguucuuaaucagcauuuuuguuuauacccguguuggucaagguuaauugcuuauguaaggcuaaugcuuugcuugaaaguauugauggauaaauguguuugucaagccuuguugcuuuaucuauuuaaguguauaacuugccauuaaugcagacagaggugauauuuuuuaaaugucuguaugacauuaugaaauggcaaagguuacugucauugcuuuggcuuuuccuuuagugacaacaaucuacuggaauacugugucucucuacuagaaugcaauuacguggagccaggaauuacaucuuauuuauuuugaauuccuagcaaccuucauuguaugcaggaggucuuuaauuuuugacggauugaaggaaugugagaaaacaguaucccuuuuccguuuuguggagcacacuuugauaaauguuuuuauauuuuauuucauuucauuaaaaaauuauuuuuaaagacaggaucuugcucugucacccaggcuagagugcagucaugugaucauagcucacugcagccuugaacuccuaggcuuaagugauuccccugcccagcugggacuacaagugugugccaccaugccuugcuaauauuuugcuuuacuuuuguagagacaaggucuugcuauguugcccaggcuggucuugaaguccugggcucaagugauucuccuaccuuggccucccagagggcuaggaugacagacaugagccacuacagcuggcccagauaauguauuuuuaaaaauuaauacauaauauaaauauaugagacuugacaaaaagaaacacuaauaucaugauaagauucaagaaaucuaguaauuacuugauagcucugacucauagagacugccauuauacuaaguucuucaaggaaugaugaauaacuauauuaauuauuccagguuugaagaacauuuuucucuaaaagcucacauuguaaauauuuaggcuuuccaggcaggagacaaaagugagucacaacugccucaugacaauuuguaguguguaaagagagugcuacuuauggucucugugguagcugcuucuuuaaaaaaauuauuuuaaauuggcaaauaaaaauuauauauaucauguacaacaugauuuuuugaaauacguauauauuguggaguggcuaaauggagcaaauuaacauaugcauuaccucacaugcuuaucguggcaacucaacucugccauuguagccugaaaggccccguguacaauacgugaaugaauggguguggcuguauaccaaagaaacauugacacugaacacugauuuuucauguaauuuucacauauucaaaaauacucuuucuauuucuccccaaccauuuaaaaauguaagaaaacauccuuagcuugcagacugagcagguggugggccagauuuggccucugggccuuuauuugccaaccccugaauuaacauuuguaagcuggaagguuuuuugcacacaauuggaaauaggaugugcugggagaaaauucucuacuuaaaaaaggaucggaaauacuuuguuauuuucuaaaaagccauugguucugucgguuuacauugcuggucacauuucugagcacaguacacacacaguaauuguuuuuugagucaauuuuuguuuuacucuaaagccaauuuaauucaauaauuuaaaaauguuuuaucucaaugguauaguaagaaaacugcaauuauuuuacuaaagagagaaagaaauuauaaaauagaaaaagcagggacuuuauugucuuaauauuuuaaacugucauucuuagcuguuuccuuuuuuuuuaaauuuuuauuuuauuuauuuauuuauuuuuugaguaggagucucacuuugucaccaggcuggaguguaguggcgugaucacagcucacugcaaccuccaccucccagguucaagcgauucuccugccucagccucccgaguaucugggacuacaggccgcacaccaccacgcccagcuaauuuuuauauuuuuaguugagaugggguuucaccauguuggccaggauggucuugaucucuugaccuugugauccgcucgccucggccucccaaagugcugggauuacaggcaugagccaccgugccuggccuuuaauuuuuaauuuuuuaaaagacagggucuuggccagccacgguggcucacgccuguaaucccagcacuuugggaggccaagguggguggaucaccugaggucaggaguucaagaccauccugggcaacauggugaaacuccgucucuacaaaaaaaaaaaaaaaaaaaaccaaaacaacaaaaauuagcugggcgugguggcucaugccuguaaucccagcuacucagaaugcugaggcaugagacucccuugaaccugggagggggagguugcagcgagcugagauugugccauugcacuccagccugggcgacaagagugaaacucucucaaaaaaaaaaaaaaaaacccaugaagacagggucuuaguauguugcccaggcugaccucaaacuccugggcucaagcaaucuuccugccucagucuccugaguagcugagacuacagacaugugcuaucaugcuuuugguucuuaauuaaagguguuauauuuuguuauuuuguuuugaaaugaaacauaaagauaaaauuuucuauuagaaauauugugguuauguaacucagguucaaaguuuuuguuugauuuuucuuagauuguggauuauugcccucaaacuuuaaauuaugauuuggcuguuucuauugcaaauaagaaggaccuuucaugggaggaaaaaacaaauauguuuuagagauauaauauuaagagugaugaaaaacugugauaaacugcucuauuaaauuuuguaauaggcagaaacagaguguuuuuuuuaggggcaaaaaucagacauugccauuugauguggaaaauaagaugacuugguauaucauaaagguaagcaggcgaguuuggggauggcuucgccaaaccagauucuuuuaaagcaucuuaaucaaagaggaagagucuuccuucuaucuucaaaaguugauuuucauuacaguuucuguguuuaguaccuaauguuacauguuuaaagagacauauucaaauaaaugucuauuuacaaagcaugaugaagaaaggacaaaaauacuguuuuauuaucuagaagagcuuuauaaccagagcguuccaacaacguaucagcguguccugguacagcuggaagcuacuucuuccuggaagaguuucacugaggauuagaauuacgugucaggauggguugucucuauaagguaggccuagaugauauguaaacugcucuuugaauuugugaguuugugauauuucuggugcaucauggaaggguguaguuuaucuucccucgcccucucuauugagguccugcuuauucuuaagguuucuacucagaucuuuggugaaaucuacuugguuaggauugagcuuucccuuuuguaaaaucaguagucacuguuauuuucuaugccaagcauuugacaacugugacuauccccuacuuucuaaguugucuguccuuuuuucuuagguucccacuuagacuauaaauuucaugaaaauaggucauguguccccauuuucuuccuuaagcaaaauaaaauuauacaacuuuagggcugaagagaucacagaaacucucugauaccauagccuucccauuuuuucuccucucccuuucuccagaauacaucaguuguggcuuagagagggggaaguagucacccagugacaggaagaaagcuagaacugaagucuucugaguucugucuaaugcccuuucuguuaguugaugcccaagugcucaagaacuuagcugcuaaguugaagugaaaaugugauacagcaaacagaaguuaaauuacagacaaccuuucagcaauaucuguuucuuauauugaagccuaucuguguaaaggcagaaaauuaaaaauaaguuacagaauaguaucguucgacauuugaaacuagauuagcuugucuaaugaugaguuucaauucagagauucuguauguccguguuuaaaugauuuuggcuucccaaaccagcugucugccuucccuucagauaacucaguuauaaacagaacugcuguauuacauauuugaguauguggauuugucuuguauuucccauuuuuuggcccauacuuuccaggaagcaaaugaguauuagacacugguaccugucuuacaucaacagaucaagggacaauuggcggauugaucacaaguuuccuagugccgcacuccuuuguuuuaauuuuuuauucuaccaaguacuuuaauguguacuuucacauuaucuucuauaguagcccucugaguuauggguaucgugccuuuguagaugagaaagugcguaaggucacacuauauuuaaguaaaagagacagagcuuuaacauggcuuucuucauuccagaguucuuauuuucugcauuccaccauacugcauucuguguuauauuaguucucuguuagagcccuaauuauggaccauuauaagccuuagcaaaauccagaaugauggaaauaagaauauuugauaauauucucuaauacuaaaguauugcucuaggcaaaacuguaaauuauuuaaucaggauuucugcuauuuuuauccaggugguacaucaugccuuacauaccucuguccuucauauauucaaaucuaaauaaaugcugguaguuugagugggaggaggguggauuauucaugucaaaugauucugugcugauguugccacaacuguaugugaaaauaaagauaauugacauggaauuugcauggaguuaagguaccuuuugaaaucugcauucuacaaucuuuuaguacugcauauuaaaacauuaauuauucaggagcccuccagauugagucuuuaucauuuucaagccauuauugggugugcuuuucccuaugauucuauagauacaugcauuuauagauuuaaacauuuucuaugcuauaaacuauauaugcaguguauaagaaaauacucuuuggccuuauuaacaccucuuuuucuuuuagugauauuuauuugaccuuaacauuuauacuugauauuaaugacauaggcaaauaauuuuaaaauguuguuuuugaauaaauacuugucaaguaaaagaaaagcauuagagcuacaugugaccagacuuggcagucaugggcgcuauuucaaguuuugauugacauuugguuuucguuuugaugcuuauaggaaaaauuuaucaagacacuguuuaugcagagcuguuuaauuaggaucaccugaauuaggaucagaauuaaaaauauccuuaauagaauuuccuuuccuuccccgauggguggcagcauuuucuucagccaauacagcaucugcagaggcgugugugacuugcugguugguguccuagggucuguuuuuccuccuucacaaucauucaguggcugugggucuuucagguuagagcagaaguugguaagguauauuguuugggggccucaaaagucuucuguaauaagaagugacuauacuguggguuuucuuguuucccauuuggccaagauuuuauggaacaauacccacuuugcccaggugcaguggcucacacauguaaucccaguccuuugggaggccgaggugggcagaucgcuugagcucaggaguuggagaccagccugggcaacaugacaaaacccaucucuacaaaaaauacaaaaauugugguggcucaugccuguggucccagcuacuugggaggcugaggugggaggaucgcucgagccugggagguagagguugcagugagccgagaacgugccacugcauugcagccuggguaauagagcgagacucggucucaaaaaaacgaaaaacaaacaaaccaaaaccaacaauacccacuuaaaucucaagguaugcagauuugaggugugauaguguuuaaccuucggaagucuuuuaaccugcucaucauuguccuucugccugucucaccaguuuguuuuaaaaguuauuugcugauuugucucugguuaccuguugaaugacaauauggugcugccauggcuuuacuugccugccuguguuucugagcucaucccauauuuucuauauaccaacaaaaaucuucaucuaugugaccugguuuuacuucagauucgucgugugcagugccuaaacucugccuuuucuuccgcacagcauacugcuucuccaccuuugcugucuucucucuugacguugcaaucuccugagccagccgugccaggaauaucaggaauaccucugauucuucccccaaacuucuguaugcccugcuuaugcugcuuuuaaagaucucuugacucuauuguuuuauuuuuauauuguuuugucacugucccaguuauuauuaaaauccuuccgaucucaccuaaauggccucuaacucauauccuugccucucacuguuucccugagucucaauucauuuuuauauuuugccauuagagauaauugaaaaaaaacccagauuugaucauuuaaucucuugcaaaaagaugucuguugauucccuacugccuuuguaugaaaucaaggcuuuuaaguauggcauuugaggacccugcaagcuucaucucaugccacguuccuggagcuggcugacugcuugcauagacugcaagcagcuugagggucguaaccauuuuccuagcaccugguguagugacaaguagauugcggagauucagugaguguaugcuuuuccuccauggcuugcauuaugcuuucaguccuucccauuguugcauugccuuuaugccuccauuccuucacguugcauugucacuuacauuacguuuuagcuccuucccauuguugcauugccaguguguuucuucaagccaccaaagcuugacgaugccugccgcacuguugcuaugacauuagcaaacuaauguccauaggguauuucucuagauauagaugucuguaggguauuuuucuagauagggaauuauuuuugaaaggcuggguauuuuugaaccaauucguaaagcugcucauauacacgaaggagggucaugaaagcaaaugacaauucagcaaggccuaguuauggcuggggugugugugcgugugugugcgcgcgugcgcguguguguaugcgugucacgcgugugcgugugcgugugaguguucaaggagggugguuccuaaggcuaaugagcuucuaccuguaaguuauucugauuugguagaaauguagcuuugaauaauaaucauuagcaguagcugagugggcuugugcuuugucaacacugcugaguuugauaauuagaugauuacaaggaugugaugacauuuuguaaauccuuuccuggagauaucuauaugaguuugcuaaucauuauggcaggcuucuagcuuuucuuuagagcaaugaugaugcuacaaagauuuuuuuugugcugaaaauauuuuccuuguaucaguaagauuuggaugauauuugucacuuucugccaccucagagucagcaaggagaaucuugcaaaguauuuagcauuuuguggaaacaagacauuauguucuguauaguuaaaaauuaucuuuuaguuuauuggaguggaagggcauuuucuccaugacaaggaagguuuaaacuugcaucaucuugguauuuaaaaguucuuuugaaaacaacucauguuuucaauuacaaaauaauauagagcucucagucagugugaucauucuauagagugugaucauuccauaggucacauauuuacuaacagucuucaguauuaguugaguaggcucuuuaaagccuuacuguuaggccagguguggugggucacgccuguaaucccagcacuuugggaggccgagguggguggaucacgaggucaggaguucgagaccagccuggccaacauggugaaaccccgucucuacuaaaaauacaaaagucagccaggcgugguggcacaugccuguagacccagcuacucgggagacugagacaggagaauugcuugaacuugggaggcagagguugcagugagccaagaucgcgccacugcacuccagccugggugacagagguagacucccucucagaaaaaaaaaaaaaaaaaaaaaaaagccuuacucuuuguccuuuccccuaaaacucaggauuccuuuucuucuuccaagcuuugcucguacaguuucuucagcucugccuggcaaauuucguuuaaacauggugccuuuucuaggaaaccuuucacaacucucuuagacauguccauuaggacaggaaugggaaagcagaaguguaaaauauaaguggguaagagaaagggcagcaacuuccauuauuuugcuccuccaguuaggugcuaguaucuuaagcuggccauuucaucacuaaugggaagagcuaaaagcuccaguccaucaggauugaauggcugcugaaaaugaaugucagugucucaccuccagacauuuuggagcucuuuucuuccagucuauucgugucauucucucuuuucagguagacuugccuccgauuucucuuguccucuaugaagaaucaaaggauuaaugguuucugaaaaaagcaggucuuguucauuggagcugccaaguuacuaauuacuucuaauuaucuuuauagcaaaaugauaaacauagaauucagugcuguauuguacagcaaauuuuuuuccugaaaacauugcuuauaauguuuauaaauaauauaccagguuauauuaacuaggaaaauuuagaguuuaacaggguucuauuaugaaccuuuuuguggaagaagauuuauuuuggcaagcucauugcucugucuuaaaaaccuagauuuccucauguagugucugguauuccauaaaguaaagcucauuugcagucaguuaaaucuuuuucuuuuuucuuuugcagagacaaaucauuuuuuaaauggaguucaccagauucuuagggccuauuugaacuuauauuucuagaauugggugggaucugccuuucuaaauuauaauucauaggaagagugcuauggaauuggcuaguaaagacucuuggccgugaaggcaaugucucagcaaguggcuuccucuuuucuaaaaccucauuaguguccuugggagcauuucauugauaaauaccuaucccacaguccagcuugcuuuuuucugaauguaauuucaaagcccgguaacuucaguagauuuuuuugauugaccacaguagacacagaguaugagaaacaaaauagaauccucaaacuuucuaccugguaaacagaggaaguaaggauaguguuuucaggggcauucauuuucaggcagccauucaguucugacauguuugauguauuggaguuuuugguuauucuauuccuguuuguggugaacucucuaguucacuauaccuucgucuggcuggaggaguaugauaauccaagugccugcuuuuauuuucuugucugcauguauuuuauauuucuguuuucccauccauggcauaaugugaucauguauuuugauaaaugcauuguuuugcuagaauuguagccuagucugugaaaugaaaauuaaaugagaauuaaacuuuuuuuuaacaauuaagcuuuuuuuaacuuuuuuuuaguauugcuaguauuaaacuuuuuuucacaauuaaaaaauacauauugguuuuggaggcaccuuugauguucuacuaauuauauuaauacagaacggaugcuucuuaaaaacuuuuagugcaaauaagcuuuuaaaaucuuaguaucuuaggcacauaaguaauuuucauuuuuuagauggauaauaaaaucuuacuaucuuaggcacauaaguaauuuuacauuuuuuagauggauaauaaaaucuuacuaucuuaggccugugagucauuuuacauuuuuuagauggauacuaguuuaggugcccauuuugauguuguuuuuaaaaauacugaccuuacaguccuuuccaucuuuauuuuugagugacagcagaaucccgaguauaagaaaaugugauuaauucucccauauugaagucauuuaaucaugcuuugccuaacagcugcuuucuauucaguacacugaacauaaaauucuggagugccuuugugcuaucauaaauuguaaaugugaaccauucuuccucuuaaguaucauaugguauugcuguuuugaauuugucaguuugguaggggguuuuucuagagauugcuguuguagucggcuaggagggccuucuucugggacgaaacucucucccucauucucuauaucacugugauauuuaguauuauauuauuauaauauuuaguauuauuuguuugcaguaaagaagugggggaaaauugguuugacuugucauccuuuuauuucuauggcauauugaaaaaguggacaaauagggccaaaacaaagcagugggauucuuacuuggcucuuuuaggucagaaagaaccaguuuaauaaauuucaguucaacaaauuuguacugacucuauucacagcaccauguggagaaauaaggauaauuaagacuucauuuccgcccugucugguaggauaaaugaaagaaauauauaaauaaauauaguuauauugaagauucguugaaagcaaaacugugcugccuucuuuuuguaaaucuugcuuuccacguucaguacauggaggugcucacaguauucuccagcagacugcgauaauggugaugcggagaccuaagauggagauuuggaguggggagaucauuugauuuggccuuuaauggaagauacuguagguggaagagucagugcugacuuccuagaauuuaacagucaccauugcaaauaggcuaccgagguaccuggaguugagauuagauccuugugacuggaugccaaggagcuucuugcugcugguucaugcuugacggacgugccuguuuuggguuaggagcaguugauuucagguuuccccugcaauuuaugccuggggcuguucuagugagccucacuucccuuugugagcccuccucgugcugcuuucucuuccugauaagaauccccuaauuuggccgggcgcgguggcucacgccuguagucccagcacuuugggaggccgaggcgggcggaucaugaggucaggagaucgagaccaucccggcuaaaacggugaaaccccgucucuacuaaaaauacaaaaaauuagccgggcgugguggcgggcgccuguagucccagcuacucgggaggcugaggcaggagaauggcgugaacccgggaggcggagcuugcagugagccgagaucacgccacugcacuccagccugggcgacagagcgagacuccgucucaaaaaaaaaaaaaaaaaaaaaaaagaauccccuaauuuaugagagcaggguucuucaaaugggaaacguggcuguaggccuuuguuuguuuauuuugcuuuuuguuuucugcuuuucagaauaaacugagaaggauuuuuagaaagacaugaagagaaagagccacuuaaggugacucaggauuugggaucucaggugguuugagaucuauaaaagaagagaguuucaaaaaggagguggccaauauauaaaaggacaaauucagcacuaaauacagcaauuagaaauucagcggagcuauuuuucauguggacuaaaagugugaaaacuauuuuauacuccagaguagaagcugagugauuaggcuucuccuguuuuuaccaaaaugauaaguuguuucucagaauauauugcucugaaugaaaagcugaguuguuuuuuuuuucauucuuaagaaaaacccauccuccccuauguuugaaacucaaaguuacuuccaucugacuugaugucaggucauuggucugaggaucagccaguguguuuugaaguacuguaucucaccaggaaccacagagucacuuaaauccuacaugacucggcaaaauccuugucauuaggauuggcuuugccaagucauuuaggauuaguaaacuugugacuguuuuguucuguaaugaaaaugucuagcgugaagaacagaggucaaaaugaucuuaucugagcgaguuugcuucaauuaauucuuuguagugcagaguuuuacaauauuacaccuuaaaagugguguacaaauuuaauuuugguaauacuuauaccauaauaaauuggagauagagguuuauuuuuauguauugugugaucucuuaaguauuauacuaaaguacuaaagugacuauccauugaaaagccauaucuguuagugguuccaccaugcuguuaagguauuauaauuuuagaguauaaaauauaguuuuauucaugagcauucaaauaggaaaaauauaucugucccaguuucuaauuuuuuuuuuauuucaagggaaaaaauggcacaaaguuugaagauacaccccgcugaauuuuuuuuugagacggagucuugcucugucacccaugcuggagugcaguggcacaaucuuugcccauugcaaccucugccuccugggcucgagugauucuccugccucagccucccaaguagcugggacuaugggacuacaggcaggcgccaccacgcccugcuaauuuuuguauuuucaguagagauaggauuucgucauguuguccuggcuggucucaaacuccugaccucaagugauccgccucccaaugugcugggauccuguugaauauuuuuaaugcagcuuaaauuuguauaagccuucaauuuugauuuguaaugaagacaggagcagaaauauauuuuguggugccaccaagagaguucagcaaauccacuguaaguugugugaguacauggcucaccuaucaacaauagcucuuucuaaacuugaaggugagaacuuuaguaauuuugcuuugucaugguugaacgcugccauuagacaucaagagcaaauuaaagaggagaguugggcuguuaaauaucauacucauuuauuaagauaagauaaugacugaaaauuguaggacaagcuaacuuuguguacuuuuugaagaaaggaaccuuaaaauguuuuuuuauuccuucauguuagauuuuguaauuaagaauucugugguaauuaauacaaagucugacuuuaguuagaauguuucucuaaauaugacuauggaagcccauguguuauuucaaauaaucuucuucaaauagcuauauuuccuuuaucauccuuauuuguuuauuugacauggugucacguuaucccucuuuaauauucauuuuuaagcagauuuaugagaaaauaccccuuaucuguacauuauaaaauggaugcagccugaauugaccauuaacuuuuuuuucuaauguaacaaagcugugaaauuagcaugauuccuaauauuuuauguuaaaaagaugauuuguguuacauugaagauaacaaggaagcucuucugcugaggcuuguguugaaaugagauuuucuauaauucuauuaaauuguuguuggaguucaacauuuuucuggaagcgauucuguaucuucuuguaagauuuuagaauaaaauaugaaacagaaucuuuaaucauuguuucacugaaugaggucugugcuccucaaaaugagugcuccgaacccuuucggauucagcauuacugugagagauuuaggacaccuucucauguaagcuuauggcaaccucaggaaaagggacuuauguuaggcaauagauuguaaaguaacacaugcuccuuauuccaaguaaucguaugagaauuuagcuucuaucuucugugccuguugcaggguguaagaccaagcagguauauguuaguuguuccuggugggcuguagcaagcaaggcugcucuuaaugauggagugcaggaacauaaaaaaucucaacaaagaugaaaguuucaugucucauugguaguuuuuaaaaacaaacaagccgcagcccacagagguuuaucauggggcuuuuccucuuuacauaugaaguuauuaauuuguagccuauggcucagaaagcagcagaggcauugacagaacauuaaguucaaacuuaaugucaagaguuguacagcgauuaggcugcaggggguguauuuuaaagauaauggugacuguguggcuaaugggauaaaugcuugggauaaagagaaaacuccaaacucuagcagugcuaguaaguggauuuucaugcuuugggcuugcuuuacuuggcuuugaggcuaaacaucaaaaucuuuaugauaccuuuuuccucucuauuuuuuuuccugcuuauguauucauugaagucuauuuuuaucauauuuucaguugcuggucauuuacuaauguucagagaaauauguacuuuuauggcauauguacacauuacauugaaagucuuucauguuuauuauuuuuacaaugugcuuugaacuaguuuuuuaaacugaaauaaauuucuauauguauuauggcuauguccaugggaaugacuucaaguucauuauauuuugcugccugcuuuauacagauuuauacuauuuguuuuguacgugugcuauauaggaguucaugcaaauguauuuuguauuauggcuuguuuucuuaguuacgagcaucugaaauauaguaucuuuauuuaauacuaucacauacauaaaacuauaauuucauuuaccaguaaaauuauuaugcuuuguucucugcuaaguauuuguugacccaauauguauuacaaauaacuuugugauguuauauuuuguuuuuagguuaguagacuaucauugaauauccugaacuuauuuccaacuggauuccagucuaaaguagaugaacacaauaauuaguuuccuucuacaaaaucacuuuaaaaucacucucaauacacguguuguagaaaguauuuuuuagucaauugccugcccuaguucuuuguaucacugggaugcaucugucugccugugcaucuucugugcuagcaaacaugauauggacaaacugaauuuuuguaauuagaaugcuauuuuaaauguaccagaauguacacuuaaauagaauccaauaauaauagcugauauuuauugagggcuuccuaugugucaagcuguguucuaaguacuuuaucgcuguacacauuuuucuauugcugcauaauaaauuacuacagucagccaucuguaucuuuggguucuucauagauucaaucaccacaaauaaaauauguuugaaaugaaaaauaacaguacaauaaaaauaauauaaaauuuaaaaaagaguauaacaacuaauuuauauaguguuuacauuauauuagguauuauaaguguauagauuuaaaguauacaggaggauagguacaggcuauaugcacauaguaugccauguaaucuaagggacuugagcaccuguggauuuugguauccacaggggugcuagagucaauacugagggaggaauguaugaucuuaguggcuuaaaacagcacucauuuauuauacagaguguguacuccaggggugcaggaaucuuggggccaccuuaaaauucugccaaccacaauaaguaucaacucaugcacuccucacagcaacucugugaagcaggcacuauuauuagcagaauuuuauacuugaggacacuuggucaaaggagucacagaacaacaaaguaggagagccuggguaggaacucaggcagccugacuugagagcauagacucugucugcucuucagcuauuguuguguuaggagcucagugcuguagcuauucauuccauugcuuuuucuguauauccgcaauucucucuucuuucucuugucauauaguguuccguagaagacccacauauuugugguguuuaggaaaccuuuacuuggguccacauaccuuuuguauggauuugauuuuacuuucuuggccauuuaaguaaccucugagucacaaagcuaacugcuggauccugccucauagacuugcuuauugguucuguauguugcuauaaacucauucuuuugcuauuaacuccugccaguucuuguaaagucuagauugagcuuuuuguuggaaaauugggaguuguggccauauugggucaguuuccacaucgcaguaauuuucuugagcuggguagcagccaccccuucgugaagcaugaacuguccaauuugcuauacucagccuacuuagcuaacccuaacccauucuauucagucuucaucugaacuuaaacuugaaauauauauauauaaaucauuguaacagaaguagucuucuguuuucuuacuucacuuauuguuuauacaguuuuuuucaccugaauuccuucuguauuuaaaaacccacugcaguuuucagugaugaaaucuaauucagucuuuucaugaaaacaguuucacaugacagaaaaauccagcccacauugaaugaagcacaaaaggaauuuguuggcuaugacugaaaaaugcuuccuuuuagcauugcuaaggccaggggcucaaacaacauuauuagggucuggucuccccccauugcuaggcuuuccuucugugaguugcuucgauucucugauagccuuucuucuuaggguggcaagacaguggccaaaaguucuagguuuucauccucucagcuccaaauucaacaggaaaaguaacuuauuauuuuguugcuuaagcauaauccccaagauuaguggugauuguauuucacugguggggcuuggggcagguaugcacucuugaagcaauugcuauaaccagggaaacgcgguauuucuaugugcuugccuuagcucgcauguccucccugggagucuguuccaaggaaucacagagacagauaaugaggaagggaugauuuucagaggaauaugaggagugagugcuagaugacagaaauagugcagcuuccuugcuuacuuucugucccucucuuaaacuucucuaauacggauuaucagugacacguauaauauucugcuuuguauuauagucacuuauuuauuuauucauuugccagacauuuagugccagugauguugcagggauugugcaagaggaugggaauagaaagauaaaaaagacacaucaguugcccuuggggaauucacaauacaauaugcauaauuugcuccccagcuggauuguaaagcuuaggagaugucagaaauguuauuguguucccuuauagcacguaacauuauauuucuuauaaaacagacucucaauagacaguauaaaaugugugcaugcaguuuauuaaaacauauucucauuacuucagacuugcuaggugaaucaaucuuaauuuguggccaucuuguuuguacucauaccugaaaaccauucccacuguagcuuuauuguuuucccuugucccugcaggaaguguacuaccucccuuucgggcaccuauggaauuuuuccagcacucaucucauccugucuuuuaucacaguuacuuauugguuugucuuggcuccugcacgagaauugaacauucuugagagcagugaauugcuuaauaaauguuugcugauuugaaucugucgaaugguggaaguguccuggggacuaguuucaauauuuuuuucauugucuauuuauauuuuauuuguucauuagacuuuguucagauuuucccuuaaguucccauuuaugcuuaauaggcagauuuggguuuugcucuucauuagucuuccaugugcacauuugguacugguaguauuuuaauacuuuucacacagucagaggguugguauugauaaucagugacgacuucuaucucuacaaagcugaacuacccuuaggacggguagcauuauucuagaaagaaaaugaacuucacugacaggcuggguguuuucuauuaucugaucugaaguuaauaucccuuguuucuauuuugcuugcaauaaaauccagacuuugauuuccugaggucuuuguaaucaguaaugaaaaagcaaacuugaugugcuuugagaaggauaagagccaacauugaauacuggcuguauuccaggcacuguggcuugcauauauuauauuuuaaaucuucacaacaguucuauggggguacguacuauuauuaucccuguauuccaggagacaagacugaggccuaggaagaugaaggaacuugcccagagccacauagcuagucagugguagaacugauccuuaaccuaggugucuguaauuuuagaguucauguuuuuaguaccuggaaagcacagaggcauuugaaaauuccagauucauaccuuggcgucccacaccaccacaaagaucaauagcauucucauucagguaauacuuuaaacauugcuggccgcuuuccucacccguacaccuaagaaggcaauuuuggguauuuuagaaaucucuuugguaauaacaacagcagacuauagacagccaucacauuaccuuuaauacaucuaaguccccuugauccuucaacacaacaaaagccauugucuauaauacaugcaaaugugcauuuucaacugugcuaauacauuuuaucacucauuugaaauguuuauuggggucuauaaaaaaacuaugugcauuaugaaaaguuaaaguaaguaaaagcacaaaugagaaauccaaguacccuagaaaccuuacuucuuagagaccaacacuguuaacaguuggguccacauuuauaucuuuauuuaguauauacacagcuacaugcauaccacguauaauuuuuuaaugguuguauacuauuccauuguaugaacauguuaaacuuuguuaacuuuuuuuuuuuuuaaacuuuaauuuuaaguucagggguacaugugcaggacuguuuuauagguaaacucguaucaugaggguuugucguacagauuauuuugucaccagguguuaagccuaguaccuaguagucauuuuucagccuaguacccaguagucguuuuuccugauccucucccuccucccauccuccaccuucaagugcgccccagugucuguuguuccucuccguguguccauguguucucauuauguagcccucccuuacaagugagaacaugcgguguuugguuuucuauucuauguuaguuuacuaaggauaaugaccuccaguuccauccauguucuugcaaaggauaccaucuccuuuuuuauggcugcuuaguauuccccagugcauauguaccacauuuuaaaaauucagucuaccauugaugggcauuuaggguguccaugcuuuuucuauugugaauagugcugcgaugaacauagaugugcaugugucuucaugauaaaugauuuauauuccuuuggguaugugucaguaaugggauugcugggucaaaugguggcucuguuugugggucuuugaugaaucgccacacuguuuuccacaaugguugaacuaaccuacacuccgaccaacaguuuguaagcguuccuuuuucucugcaaccucaccaacauguuauuuuuugaguuuuuaauaauagccauucugacugcuaugagaugguaucucuuugugguuuugcuuugcauuucucuaaugaucagugauguugagcuuuuuuucauacacuuguuggcugcauguaacauuaaaauuuaaugaaccaguacgcuauugaaguauuuccauuuuuuuccacuguagggaacaucaguauacaucuaucuuugcauaugaaacugguuuuuacauaggauaaauuaguagaaaugaaguugcagaaacagauuuuacauuuuuauauauguugccagguugugcucuaauauauauugcauuuacacuccaccaacccuauacaagaacacugcuugcuuacucacagccuugcuaguacgggauacuguuacucuuuuucauccuugccaaucuuaaaagugauauaaguaaugccucuuuguaauuuucauuuucauuuuuuaguuauuugauucugguggguuugaaaucaugaaguuuugcauaauaaaaccaugagacuuugacucuuuuuuuuccccaugaaauuuuuaaggccaugacaguucuaggcagaccuagacauuuucucuggcuuuuaaaaguagagcuguuccuucuuuauaugaugaaguauaauauacagggaguguugcauauucuugaugguccagucaucaucauuauauaaagauagcuuuugguacaaucuuauuuuuaaagcuguuagguccagaaaguuuuuaccugguggaaguauaccuuuuacuuuauuaguacaaaaccuccaucuugucucugauauuuuaugaagggauacuugggaacaaauguggcagcuccuauaauaacacuuaaauuguauugaaaacacaagauagccucuuuauauucagcuuucuuuuacauucauguacuuugaacuuaaaugaguucauuaggcauuagguuggguuuguaagcuuuaauaugauuuuggucauagaaaaaaauuaauauucaguauuuagauuauuucaauuugccaccuuuguaguucuugauauuaguaugcacuuauguuuuauucuuuuuuuccugcuguaauagcuucuauuuauuauuauuauuuuuuuaccucagugugcucuugcucuuuaugaauguuuccccuucugaaguucuuuucuuauuucucuuuagcuguugacaaguggcacugucugugaaccugcagguuuauauagacaaaggaaaaagcuuauguuguuuauugucuuuccagaagaggguguagcaagagaggaaaagagcagcuagacugucccaucccccuucauuuuaagcaucucauaaaaauuaaagaugauggaauauucaucauacugaaaagcacucuuacaguuauaauucauaaauaacauuggcaauuaaauucaagauguccuguuaacagaaaccaaagaguaaagcugucuaccucuaaaauaugaagaucauuguccuaugagacaaggaugaauggagauaacacauauuuagaacugaaauggaagucuuagaaggaaaaauugcuuaauuuaauugaaaaguauugugaaucuuggguagauucauagcauucucuggucaauacagugaaucucugguauuuauacaucagaauaauugaauauuugacauuugaugcaucagaaaaauauucuagucaagaaauuuauucuuguuuaggguuaaaaacguuuucauuacaagccaguaauuucagguucuguccuuauugaacaaaugcucuuguccuuuuaacuuaggaaggguuaugauguaagccugaaucacuuaccuuuguucguugaggguucuugaucuuagaauauaagacaaauucuuggaugcguuguuucccugcuaacucauuaacccauuguaggcuagcugcugccucuacuaccguacugaagugaauucacucacguaacuaguuacauccuaaauguugaauacaguauuuuguucucuuucuguguccuguuugacuccucugaggcauauauuguugacuguuuccuuaaugaaacuccucuuuuaugacuuugaagauaccucugucaccuuguuuguuucaccuccauggaucuuuaaauguuggcaucucucaaagaugguccuuguuucucuuucuuacuuucuuuuucacauuguuuuucuaaauagauucaacuauuacuuaauugugaaugaguaaauuuuugucucugugucagagcccccuccugaguuccaacucuauuucuaacugcuggccauuuaugucccugaaucauugcccaaacuauuuaaagucuggaugauuaucuagcacuuuccucaaaucucuaucacucaugaguuuccuuuauuguauucaucgauuguuagcuuccucuaccuaaguuccucaaccuagaagcauuuucagaaucucugugaucuuuaagaacgcuaucucaacaaaaauauguuaucuguacuaaguauaguacaauaauacauaaaugauucauuaaucacuuaaauaggaguuuauuuaaauaggaauaucauauuguauuaauauuuugucugaacuucauagaauuuaaaaugucugauuuucuaagguaugcugaaccuucacugugauuuuaacaaaugucuuuucggagggguagaggacagugcuccaauuuuauagagaaaguagaaggaaaaugacuuacagaaaaugagauuacacacaauguucaaggcuguuucagaaaauaauuuaguuauuuuguauauaaauauacauuuauaaaaauauauguucuaaaaaguauauaauguuauuuauauauaaaucugcauuaacuauauagguuaaggcaagagccaguuucuucugucaugaauguagguauuuucuugugaagccaauuuauugucgaagccaaaggaguugcaguuuuuauucugguugucauucuagacauucagcaugcauauacaguucuguaaaguuauuaacacauugaagagaaaugaguuguucauggcuaaaguugugggggcaaguguuaccauuucuugaaucguuguagaaacaaguacuugaaaagucuuaacuguagagaaaauccaugugauuuucaugggcgugacugaggcuucggugguuguggaggaaguuucucugucugcauagucugcauguccagacucagagcggccuaauuccugacagucacuuccuuccucuccugucuagaaucaguucauuuucaauauguccuucuaacauuuucuagaugaaagcagcaaguuaaaaacauccaagaauguccuggagugcaaaaccuaccuccgcaugcauacaugcauacauacaacagcagaacaaaacacccaaaucaaaccuuugaauuuucugugagaaauuuagucuuuauaauucauaccucccuuggggauugauuuuguucuccuucugaugaauuuugacuuucuugucccaugccugucaucucaauuguuuaacgauuuauuuuucuugcucagaggauucagauuuccagaucauauggcuauagcuuguacuggugucaaggucaaaaucuuuuaauuuuauugauggaacugguauuguaaccugagggucucuugcuguauauuuaaauccugucauauugccuaaaaacagucauaucuugguuuugguccaacagauacuuuuauuaaauuccuuggcuacaucuaguuuacuuuuuccuugagagaaauauaacagaauaccaccagcaucuugauugcaaauagauuguuaccguggcaaccugacaguuuuuaauauuagaaucuucuuguuaaaucaaaacuuaugaaauuggagaccuuucccugacugaaaacauuaugcugccucuuauaguuggaauuacacuguguccaagcagaaaacuguuuuucuuuauuaagaaaacaaacacuuuguuugcucaucaacuccucggcuacuaucuuaggaccuuuggcuucucaacuguagacccuuuucuggguaggaucuuuuaugcugcugggcagcagugggaucuguaagagauacuaaguaaagagaaucacaguuuggucucugacacuaaagaacguuaccaccuagggacugcgugagugggcuuggggagauugcuuagguucuggugcugcuauuagaauacuaauagaauuaguauucugagugggaauacuaauuccugccuuaacuugucuuauaagcuuguuuuaacaaaggaguacauaaaauauuuauuauuacauauuauucacagugaauaacagacauaaguaauaugcaacauauuagauuuauguauuaucucauguaaccuccacaguaacccuguaaaauagauauauuauucucaccuuauauaugaagacauuuguaggcagaaaggcuaauugggucgggcacgauggcucaugccuguaaucccaacacuuugggaggcugaggugggcagaucacuugaggucaggaguuccagaccagcuuggccaacauggugaaaccaugucucuacuaaaaauacaaaaauuagcugggcgagguggugggugccuguaauuccaguuacuugggagacugaggcaggagaaucaugugaaccugggagguggagguugcagugagccgagauugcaccacugcacgccaacaugggcaacagaguaagacucugucuuaaaaaaaaaaaggaagcuuaauugguuugcccagaucacacacagauguauacauggacucagaaagaguugucuguuucuauuuucagggcuuucuccacgaauucuuuggccuaucauguagcuggcacauaguaggcacugugcugacacauagcaggcacugcauauuuguugacuaaaugaacacuuagcugaacacuuacaggcaaugguagucagcccucaguaagacugaccauuuguagauagauuuaaucuggucaagaaauuagaauuugcuaaagcuaacucugcaacauagugggcccugguugcuucuguaauugucuaucauucaucaggcuuucaucugaccuuacugagugagugcuaugugcuggggacgccgguauuuagaaaugaggaagacauucucuagaguauacagaugauggcuaaugcuguggagguggaaggaauguagggagaggguagguagaaaagaaaauaggagcagcauggauggaacacuuuggaacaggaacauuuaaggggcaagcugaaaaagagaagccagcaaaggcgacugagagggaguaaagugggaggaaaaccuggagagaaagauaucauagaaaccaagggagaaaaagcacuucauggaggucaacagcuucaagugcugcagagacgucaguuaacgugaggacugaaaagguucauugaguucaauaauagggaauccuuuggugagcuuugcuagagcaccuuagagucaugagugcuugaucauuuugagaaaccugacugugaauagaagaaaagaauagggcacuaauuaggaguguggaguuuuugguucuguuuuuuuguuuugaagagauuugaaugugugagccagcaaagaugaagauuuaaagauaagugggcaaaaggguuauuaaugaugaagugauauuucugagaaggugagagcaaaggaauuaaccuugaauccugggauagacgcucuucuucugagacugucguggguuuuuccacugugccgggggagggguuuucuuggaguagucucacuagcaggagggcugcuuuugcuccaugucugcaaaaguggaagcacgugggugaaugcuaaugugcguguuauacuacuuagaaguuacaguccucuaauuuuuuaacuugccuucugauacuggcuuaaaauaaguuacaguuuaauuaaagguauauauugaucacacuuaccacaccuaugguaaaguagccuucuaaaagcuccagaucucuagggugccagcaaaacauccaaguacauaauacauguagaugagguagcaagcgaaugauuuguuguucagacuacaugaccaaauauaguucagaagauaucugucagugcuggggccucauggagagagggagagaucauccacuaggucagggacccauaacauucuuuagggggugauaugauguaguuuggggauucacaauccuuucucggugaggagaugcaaauuggccucauaauuaccaccauguauggaauagcaucauacaugaucuaguuguuguuuuuuaugguacaguguuuuuacaguacagauacauuuacccaccaaauauggugguuuggaaugauucuuugugaucuuccuugauuucaucagcaauuuuucccaacccauguuucaguuuucagucuuaauacuuagcauuaacuaaaauuauguucuugaacauggcuauauguugacccuuuccuuauguuuuuucagugucugccaugcucccugccuaagcuuccuguuguuugcucagcccuuuguguuccuuuugcagagacuccaauuucagcaugacucuuuugcccccaaaugcucucaaguaauagguuggcaauacguguucauggucuucuguuuaagggaagcuuguaaugugucauuccuuuuacugugucacaugguuuacugcagcauaucccuacaaaauuuauauugugcugugcuggagugacugguauguuggaguggauuuuuauuagcaauauauuuauccauauagugaucauaucugcuuuaauacuugacagugauaguaagucuaagauacugguguauuggauaguaagucuaagguacugguguauuggauaguaagucuaagaugcugguguguuggauaguaagucuaagguacugguguguuggauaguaagucuaagaugcugguguguaggauaguaagucuaagaugcugguguguuggauaguaagucuaauguacugguguauuggauaguaagucuaagaugcugguguguuggauaguaagucuaagguacugguguguuggauaguaagucuaaggcacugguguuuuggauaguaagucuaagaugcugguguguuggauaguaagucuaagaugcugguguguuggauaguaagucuaagaugcugguguguuggauaguaagucuaagaugcugguguguuggauaguaagucuaagaugcuuguguguuggauaguaagucuaagaugcugguguguuggauaguaagucuaauguacugguguguuggauaguaagucuaagguacugguguguuggauaguaagucuaagaugcugguguguuggauaguaagucuaagaugcugguguguuggauaguaagucuaagaugcugguguauuggauaguaagucuaagaugcugguguguuggauaguaagucuaagaugcugguguauugcauuggucaugggagguagaaauggcuccuuuacuaccuaccugugugaucgucaaauucauauuuucccaaggcuaauauuuucuucuuucuacuguaauuagcuuccucauucugcaaguuaacuaugauuauaaauacugaauaccuggcauguuuucucaaguaugaaaauaaaagcuuauacuuaauguguaaauuacaguugaacauagguccagacauaugguuauuaguguugcuuaaauuacugguuuuucuugucauugcuauugcaaguguucucaaagugacggcaaaucacuuccuuuccuguacuguguaaguaaaauaaauauauuuuaaaauguaugaauguguaauguagauauuacucuauuugaccuuuuauuuggagguuaacauauaaauaaauagcaacaacuaguauugagaaguccagaugcacugggcuugcuuaggugccucguggucuccauaaacauuuggucuaguguuucuggcuaaaagccagcagcaaauuauacuuuccaugcaacucuuagcucacucucuuccuucucagagcaugaucugcaaaaugcacucauaagacaucaaauuugaauugcaaauuuguaugcgaauauuauuuuacaaguagucgggaaagaaaccagaggggaacguuucccuaauuuguuagcaagcuguauacauaauuuguaacugaugcuugucuugaccaucuagucaucaguauucuguagguuauggaaauaccaauguuuucaaaucuuugcuuuguuuuuaucaagacuacuuuauuaaccuauguauuuuuuuuuuuaucacgcuuaaaagcuuguuuaauugucccaucacaagguaacaaauagucuuguuuuuuaaacaugggaaagcauuuuauauuguugaaacuggcauguuuuaaaauaaauauauaaccucaggagcuggcuuauaaauuauuauauuucuuucugcugcuuugaaauggugcuaggguagcugaugaugaagacaucagugugguaaauuaagauuguguguauuuaauuauguguguuuaguucagaaggaagcuagauuuuuuuccaccagcugggcaagguaaaagaaaugggaugugaaggaaaaaaaaggaaagaauauaggguuuuucaguucauugugagaggcugaggugcuuuuauuccuucugccuugcuaguugugauauugcuuauugauauuaggaaaacgaaacuccagacacuugagcaugaaaaauuacccaguguuuauggccuugaaaauauguugaugugucugaaacucucacacucgaaaguuaagccuugaaguuacaggccaauuucaagguuagacaaggaaugguuuuuacaggugcacuucauugaugaagaaacuuuuuguagagaagucauacuuaaggaguucauaauuuaagaaauuaaccauauaucucuucccugauagcuuuacuaggguuuucagggcuucucuugucuagugaaaugagaacaguaacugaaaugaacaguccaaaaagaagcuuuuaaaauuucaagcgacaguagaaauuggccaaaaguuuagauaguuuaguggauaauaaucacuauuagugacagaagaugaacuauggaauguagaugguuuaguucccuuuucuccaguuuuugcuggaaaacucucaggucuuccccaguccaauuuccucucuucauaugcuaauguaguuauuuugcuguguugcuguuucuccugucaucauauauuugaacaucauuugaagauuccuuuaaguauggagcagcauacuuuuggucgccaaggagauggcuucuuuuagaucuguguacuuucugauuuugcuaaguuaugauaguuuuuuccucacaggcccacacacucgugauaaauauauacaagugagucguacugucuguguugauaguuugggaauuauuuugagcagaguggcucccuauauuuaugauauaugggaauagucccuacugaggaagucuguguauccacuuacccgggguugcccuggauuaugguuguggaccuccauuggugaguucaugguuacuguuagaugcagguaaaaucuccucuagccacuagcacccacgaacaguaacauuuacugagcauuuaccaagugccaugcacugcaccaagcagucgaauuaucuuauaaaauguccacugagaucagugucagugagugguagauuuacauacacuaccagucaugcaaagaaaauauacuaucaaaguaaauuuuuugaaaaguuaaaaccugacucucacagaaauacaaaacgaaaugccaaagauguauuaacuuauuaaugaggaaaccaggcagaguuaaugcagguccagaguacugaaggaacugaucuuuaggcauuagaauaagauugcuagauuggagacaaaacuggugacguucugcaugcacuaaaaccacaguuuuuagaguuauccuuucugcuggacagaaaucuauaagcuaacguuguaguuucacacuaucugugcucuaacagcaaguaacaaagucaaaugcauuggcauucuucuagggaauuaaauaauccuugggugaagcugugaaacagugcucuagaguaauaugagaaggccacacagcucccuaaucuuuuucuuuuuucauguuuuggauaauuuuaauuaacaaucgcuuuuuaagauuauuauuuucuuuugagacgaaguuuugcuuuuguugcccaggcuggagugcaguggcgcaaucuuggcucacugcaaccuccgccuccuggguucaagcgauucuccugccucacccucccaaguagcugggauuacaggugcccgccaccacacccagcuaauuuuuuguauuuuuaguagagacaggguuucaccauguuggccaagcuggucucaaguuccugaccuucaggugauccacacaacucagucucccaaagugcugggauuacaggcgugagucaccgugccuggccaggcuuuuaaauauuuuauaauugaacuacauuuucuuaccucagcccaucuggggaagcaguuaaguaaggaauguacaugauuggacaaacuuaccccuuaauggugcuucuguuucuuguaguuuaaaguccuuggguagcuugucuuuuuuucagauaaaugcucaauucuuugcauuuuccccuccuuguccuuccauggcaaugggagcaagacugcagacugguccugauucucuucugccccaggugguugguuuaucuagucuugugccuggacuagccuuagcuuuuauucuugccaucucuccacucuggggagucuuagucucugcauuacccccacugggucacaggaaagcucaggauccacugcauaacauacgcauggggcuguaggggaccaggaggccacuucuggguuuucccuccuguuguguguggaucguaguuuugaaccaaaccagaagcuucucuguggagcuacgguucuaaauccaggcugcacauuugaauuaccugauggcggaguucaagaccagccugaccaacauggugaaaccccgucucuacugaaaauacaacaauuagccaggcguggugguacacaccuguaauuccagcuacuuaggaggcugaggcagaagaaucgcuugaacuugggagguggagguugcagugagcugagauugcaccacuguacuccagccugggugacagagugaaacuccaucucaaaaaaaaaaaaaaaaaaaaaaaaaaaaagaauuaccugauggcauuucaaaaacuugccaaugcuugaguuccugagcccagaccaaucuaagugucugggggugggggccccaggccguguaacguuccaaggccuuccuaggugguucuacccugcagcugugcucauggaagcaaggugagcuucucauuccguuuucagcccucauuuuaaaaauuaguguuuuaggaauuuagaaagcacauuuucucuugacaaagcuuggcugucaagaauuuugcuuguugacugaaaauauugauuuauaggugucauaauugaacacugagucuuucucuuuguauuccuguuuccauaaaccugaauaucccguaggcagauggaugccccuggccaaaacagagacagggucagguguaaggaaccacacaaaacccccccaaaucuaauuacuauacuucaagaauaguauucccaaaacuugguauuucuauguccaucuuagagaugugguaauaggcaaagugagguuuaguaugacuugcccaaggucaccuagcaagugaaagaaacgcaauuuaaacccagcuugucccccuccaacccaguuuggacauagcgguaaguucuucuggaguccuaacuuaacagauggaaugccaaacacauuuuuagaaaacauaaacuauuaaauagugauuacauucauggguuuuuacuacaaaagcuuuuuaaauuuguaaugaaacuguaaaaggaaaucuuuagcucauugaccuaauuauuauuccgaaaacuauauauauuagaaaauauuuucuaaguuuaaaacaacucuggacuuucacuaauguuuucugaucaauugauauucaugaaauucuaaaaugauuguuguuuuuuaaaauguuauuuuaggcugggcacuguggcucacgccuauaauccuugcacuuugggaggccgaggcaaguggaucauuugaugccaggggaucaagaccagccuggccaacauggugaaacccugucuuuacuaaaaauacaaaaaauuagccgguccugguggcgcacaacuguaaucccagcuacucgggaggcugagacaugagaacugcuugaaccuagggggcggagguugcaauagccgagauuccgucacugcacuccaacauggaugauagagcaagacugucucaaaaaaaaaaacaaaaaaaaagauuuuuuuauuauaucuugaggucauauauuuuccaaagauauaccacuacaguuuuauaaugauggucaauggagaaaauuucuccacuugaaauuuagaauucaaaagucugauuaucaaauauuugagaggcagcagaccuacguacucuuuaguuaauaaauauugagugucugguaugugccaugcccuauacuagguggauauacaaagaugaacaaaaacagugucucuguauuacauuuauauuggcaagucauuacuacauacaaauuucuaaaaauuuuuaaaaagaccuucagggagucuguagaaaacuagcacuaauuuucugagaguuugaguacagaacuaaugucagucuuguguuauacucaggaauuuucauugagugaaaacuugaggaaauaauuuguaugaugaauuuuaaagaaauugggacuucccuaagacaguggaaaauauuuguuuuuaagaggcauugaugggagcuguguggugauuugugauuugucagauuaaaaaaaaagugcuguguuuaccuauguaacaaaucugcacauccugcgcauguauccuggaacuuaaaaacaaaaauuuaaacaaaagugcuggcaaagcaagguuuuguuauuauccuuuauuaagcuuuuugugggauggagguuuuacuuuagaaucagaaaccucaagugucuuucucauauaaugacuucuuuuccucuggguagauaccgaguagugggauugcuggaugguaguucuacuuuaguucuuuaaggaaucuccacacuguuuuccauagugguuguacugguuuacauucccaccagcaguguagaaguguucccuuuucacagcauccaugccaacuucuauuuuuuuuaaauuuuuuugguuauggccauucuugcgggagaaaggugguauugcauugugauuuugauuuuuguuucccugaucauuagugagguugugcauuuuuucauauguuugcuggccauuuauaucuucuuuugagaauugucuauucguauccuuagcccacuuuuuggugagauuguuuuuuucuugcuaauuuguuugaguuucuuguagauucuggauauuaguccuuuguuggauguauagauugugaagauuuucucccauucuguggguugucuguuuacucugcugacuguuccuuuugccaugccaaaacucuuuaauuuaauuaagucccaucuauuuaucuuuguuuuuguugcauuugcuuuuggguucuuggucaugaagucuuugccuaagccagugucuagaaggguuuuuccaauuuuuuuuuuuguagcauuuuuauaguuucaggucuuagauuuaaguccuuaauccaucuugaguugauuuuuguauaaggugagaggugaggauccaguuauucuccugcauguggcuugcacucgcauguuuguaccagcagaguucacaauugcaaaaauauggaaccagcccaaaugcccaucagucaaugaguggauaaagaaauugugguauauauacaugauggaauauuacucagccauagaaaggaaugaauuaauggcauuugcagcaaccuggaugcaacuggagacuguuguucuaagugaaguaacugaggaauggaaaaccaaacauuguguguucucacucauaagugagagcuaagcuaugagggugcaaaggcauaagaauaauacaauggacuuuggggaccugggggacaggguggagggaggugagggauaaaagaccacaaauucgguucaguguauauugcucgggugaugggugcaucaaaaucucgcaaaucaccgcuaaagaacuuacucauguaaccaaauaccaccuguuccccaaaaaccuauggaaauaaaaaaaaaaaaggaaaggcaguuacuagucaauaucacuaguaaacaugaguuuuuaaaauccuaaauaaaauauuagcaaccugaauccagcaaauaauuuaaaagcaacaugaccagauuguguuuucuuccaauaauguaaggcugguuucacauuagaaaccuauuaauacaauuuaccauacucccuuaaggagaaaaaucauuugauuaucucaauacaaucagaaaaaguaaagaaaaauaaaagaauuagaggcugggcgcgguggcucaugccuguaaucccagcacuuugggaggcugaggugggcggaucacgaggucaggagaucgagaccaucuuggcuaacauggugaaaccccgucucuacuaaaaauacaaaaaauuagccgggugugguggcgggugccuguagucccagcuacucaggaggcugaggcaggagaauggcgugaacccaggaggcggagcuugcagugagccgagaucaagccacugcagucuggucugggcgaaagagugagacuccgucucaaaaaaaaaaaaaagaaaaagaaaagaauuagaaaccucagagaauggaaauuuugcucauguuucaugguauugagagaauucacguugcugaccugguaacccugaaguguuuaagugcugcagauggucaaaggaaagcugaaagauuucggagccugcugcuuucuuuguucugcguuugcaacacauuaccagaugcuagaugcagaaguacugcagcacuugccuguugggaaagcuuaaucuaacugcucaaguagcugauaugcagcaucugacagccugcuaugccguuuugcagcauacucaccggugcuuuugauauuggcucugaggaaguacuuuugguugcaagugacauggcauguaccucuccagcaagacuucguuucugagaaauucauguaguucuucuuucaugaguaauuuaccuuguuugauuuuucuacugguugauaugcuauuuuagucaaauauuaaugugcuacauuuaaaugcuugacuuccuuuuguuauuuugaaaucaguuauuagggugaaugguguaccugaagguuguguguaacucacaguugucaugggcugugaaagcuggcaagugcugcaguuuuuguuuaugacucgguugugucagugggagacagaaauucuaaaagauacugcaagcagauccuggucgauuucugugagugcuauaaguucugggagaaaugaucuugggcuuuagauguuaucgcuguggcaauuauauuucuucuggucucacagaagcaagugucauuaagagcuuuaaauauuugaaauuagaaccauaugaguuauuuugagaccucuaguuacuguaauuaaacauacacagguauauaugaaugaggacguuauuuaugcaugagcaagggaagcuuuuccauggcucugauuauuggcaggcagggguggugaggaaggaaagcaagauggacacaucugacacauuuaaagcccaguuuagccagaguaaggauuuugagguccuuucucuuuguucagauugcgagucgaugguaggacuuugggagggauguagcaaaggggauguaauaauggcaauagcucaugcucaugaaacacauagguuccagguaaaaugcuaagcucugugcauaugaucacucacuguuacacucuuggcaauguuauuaucucuggcuuaggaaaguagaugacaugcccaagauuacauuuguagaacuguggugugaacccaagccacccugaguccagaucccaaaagcuugaccacuguuuuauuuucuaugggggguuacaugcucccucaguaaguuuuagauuuuuaaggugccauuguugagcagaagaaccuuuagagcuccuuauuucuuuuguggcuuuuccugucucagggaaggugcaggcagaggaaguuaaauuccgaucacucugaaggaagaaguuugcagcagugguaggaugauauagaaaguauugacagugcugagaaucugggauuauuuauucuuguuuggagugagagacuggaucuucaguuuacuuuagauaauuaacaacugcaacaaaccagguugauuuauuacauuuucuaguuagauuuuguugacuguucaguuauucuagucaugaauaaauuuuuaucauuuuuccccauaacauauguugaagcagaagucucaucugcuagaagcaacauuuaaagugcuugcauaacaauauuguugauacagaagauuuuuuguauccaaacaaagaaguuaacuacugugcuucauuuaucuucaucugucugaaguaccaagaaaagagauguggaaaaauaaugauagguaagcaaaagaaaagaaaaauacaugcagcuuuuuuuuuuuggaacaaauaauuuuauuuuuuaaaauuauuauuaauuuuuuugagacagggucuugcccuguugccuaggcugcagcacagugacgccaccuuggcccacagcucacugcagccccgaccuccugggaucaagcgauccuuccaucucagccuuuugaguagcugggccuacaggugggcaacaccacccccagcuaauuuuuuugcuuuuuuuuuuuuuuuuuuuuuuuuuuuuuuuuuuuguagagaugagggucuugccauguugcccaggcuggucucaaacuccugggcucaagcaguccuccuggcuuggccucccaaagugcuaggauuacgggcaugaaccacugcaccugaccaggaaacaauuuuuagaccucuacauuauauuuguuuuuaugaucuucugucuuuccuacuaugccaugaucuauauaaguaaaguauacauauuuggaccuuuaaaacuggauucacauaguccccgucuugcagaacuauuuuucacaucauuuggucuuguagauauguuacaaaaacagaaaggaauuuaaugacauucuaccuccucucucuuuuuuccucuuuaauagguuucauuuccaauagcccagcaccagugugucauuguccucugauuuaggaguccuuuuucuguuugauuuugagcugacugguaguaugagcuguauugacauagcauucuguuuacuuaugucuuggaacuucuccuuuucuuuccauagucacguaugggugucugugcucaggaaucaaagccuuugccucuucuuucuuuuccuccacuguuuucucagugccuaagcauagguuaugcccauaguauguauuuaguagcuacauucuuucaauaauauuuucauuuguauguuuugcagauguuuuuagagugccuacuaugugccuuuacugagguauaugagguucugaggauacagagaugacaauaacguaauuuccugugcuuaagguguuugcuguuguuuagaggagaaacaucucuuuaaaggaaaaacauugcgguaugauaugaucaguauucucacagagcuuuacucacccaugauacaagcuugagcauaaaaucaccuaucucacagaguuacugaguaggguaaaugugauaguguguggaaagcaccuaacuguaguagucucuggcacauaguagguugccaaucaauggcagccauuauaauucauaaagcacagugaguucacaaagaaggaagagaacacauuguccugggccauuucaguaacgaaucucaagugaccuggcaccagugaggcaggcucuaccacgggcugaauggggaccccacuuccuucucaccugugugguguccaaugauaugcuagaauugaauucucagauguaucuuuucaaugacucauaaaugccuguaaguaccuggagggcaggugcugugauuagaaaaaucuuuauuucccggcagucuuugagaaaucuguaaaugucuauugagugcauuagguuuuagaauaaauucauaggcuauaggagauacuucuuuggaauauuagugugauuuuaauugcuagguuuuugcaaauaaaauagacaaaggucugaggaaggcauccuuccauuuggaauuugguacaacuagccaucuuugucccacguuuuguuuuugagguggcagccugaucaaauauagguugaacuauagaaugcaguuagcucuugaagcaucugauaaaugcagaaacagaaaagaugaggccagcaggggucaguuuaauaccaguuuaaguugcaagcacaguguuuuuuuaauucucuguaaaguggaaugauaauagaaacugacaugcacagucuaaauguaagcuuuaacauuucaagcuacaguaggagauugccaaaaauugagguagaugucuuuaacauucuuuuaaagagagaaauggagauuucacuguguugcacuggcuggacucgaacgccugggcucaagcaauccuccugccucagccucccaaguagcuacugugcccagcuucucuaagauuuuuaaguagaugauggagauuauuagugacagaagguaaacuauggaauguggauaguuuagcucucuuuucugucgcauggcagcauaggacuuucagccaaaccgauuuacuccacuaacuggcuuguacugacaagugcuagaaaaagccugacuauaucaugugcauuucuuugauguucguuacuugguagacuuuauaaaauaauacuuugugccuauuuuuuuccuagcugguuauaaagaaaaguuaguuuuaguuauagcuugcauaugaaaugucaauauuuccaaguuacaguuauaagaaacugagcauggaaugauuacuugaggacauuaaacuuuaaauaaaaucaccucaugcuacuauauauauuccuuuguuaucuucguggauaugaauggccuuuucuuugcaaccuaauguauggcauucacauuuauaagacuaggcucccaaauccuaagaacaucgugugugcuaaacucagaauucugcauacuaaucuuacuuacuacgaguaaguacucuuagcagauaaaauuguuuucuugaugccuuaguacacuuuccccccaagauacuauaauuguucaacuaaagauuuuuauauaauguagaaugauagacucuuagaccuggaagacgccuuaaggaucauaaagccuuguuuuauagagaaguugugugaugcgucacaggcagggcugucccuggcagagcaauucacacuucuuggacuguucuuccccaugguacuacacuaucgucuuuucucucccuacucuauucuucccuguucaauagucugcauauuugagcuuccugcuaaauauguuauagagguuaaauaacugccuuugucuugcaucccacuuccucuuuagcuguagaguagaaccccaugcacauaaccauuggucucaacaaucuuuuuuuuuguuuuuguuuuuguuuugagaaggagucuuacucugucgccaggcuggagugcaaugacaugaucuuggcucauugcaaccuccgccucccggguucaagugauucuccugccucagccucccaaguagcugggauuacaggcacgcgccaccaugcccagcuaauuuuuguguuuuuaguagagaugggguuucgccauguuggccaggcuggucuggaacuccugaccucaggugauccacccgccucagccucccagagugcugggauuacaggugugagccaccgcgcccggcuggucucaacaaucuuacauuguagcuuaaguggcucuuugggauuguugugucauguccacuggggccacuuagagccaaggggugugugucuccacagaagggaguaaggcccuggcuuuaaaggacaguagguacuguucuccagugcucuuagaacuguugugaagucugugagucacauguaguagcacuuuagggccuagaggaugcuggacuugagugguugcuccugucauggugucaggaaggaacacagggcagcaugacuuguuaaagaaguugcugcaugauccugacaacagucaggcagcucugccuagcgcuuguguucugaaaaugccgacuuuauuggguguauuguuuuuucuuuuuaaccauuuagguaucuucuccucuguuuauauuuuuuauuuuguauaaugaauuaucacauacuuuguggccuaaagcagcauauauuuuuuaaucguaugguuucugugggucagguguccacacacaccuggauccuccauguagggucucauaaagcucucgucaaggugucagcugggcuguguucucguauggaaauccggggaagaagccacuucccagcucgcuugggccacugaaagaauuuaucuccuugcaucaguaggacucagggcccuggcuucuugccggcucuuggcugaagucuacccacaguuccuggagaccacccacaguuccuucucagguagggcuuuccccacaugaccauguacuuuauuaagucagcaagaagagcuucuagugaagaucugauggcaagauggaguuuuaugaaauguaauuggcaggagugacauauaccuuugccauauucuguuagaagcaagucacagaucaugcccauacauaaggggcaaggcgaggggauuguacaaaggccugcacaccccaaggagguagcuaggugucuuaggggaggggccaacuuaaaguuugucuucucagcuuuuuuuuuuuucuuaaacagaggggagacggaaagggacaucgacauacaugagaguaacccaggagauuuguuccuggguuucacauucacagcacuugugggccuccaggccgaccugaggcauugaaaaucccaguuguugguuuggucugugcugagcuccuuacucaccuuuuaaaguuggcuguuugcaguuguacucccuuccucauuucuguuuucuuuguaccuuuuuauuuaaauaaacuuuaaguauauacuuuggguauuaacaaauauguaugccaugaauauaauauacgaugauuaucauggcaaugaagauacagaacuuuccgugaccccaaaaguugccauaugucccuuugguaucaauccuccuacacgucuggcugcagcaaccacugaucugcuuuguaucuauagaugacuuuugucuguuuugaauuuugaagaaauggaacuguacguuauagacuguggucugacucuuuucacuuagcauaaugauucugagguucauccaugucguuugugucaguaguuuguuccucuuuauuacugagcgguggucuguauugggauaacacaauuuguuuauccauucaccugcugaugaacaucuguguugucuccccugauuagguauugugaauaaagcugcugugaauauucauguaugagucuuuggguggacaugugguuuauuucccuuggauaaauaccaguagugagauugcugggucauauaagagcauuuuuguuguuguuguuggugguggugguggugguguuugcuuguuuuuacauguuaaaauaagauacagccaaacuauuuuccaaagugaugaugcauuccagucagcaguugcuccgcaccuucaccagcauuugauguagucucuuuuuaauuuuagccauuguaacagugugcaaggacguuauauugugguuuuaguuggcauuuccuugauaaaugauguugagcguuuuauauauaggcuuauuggucauuuguacaucuucuuuucugaaaccuugcacuuuuuuuuuuugaaacaagguugccuaagcugaaugcauuauuucaacuauuuacaaguucacaaaauaacaccuuuuuaauguauauuugcucacauauuaauguaguaaacauauuauuuaccaugugcuaaucacuuuacacauacuggcuuauauguacaucuccauauuagacauaugagauuaguacuuucauuacccccauuuugcagaugggaaacugagaccuagagacauuaaauaaccugccaguguuaauacggcuagugaaaaaacggaguuaguauucaaacaugggcaucagacuccacuagaaacauuaaauaaccugccaguguuaauacggcuagugaaaaaacggaguuaguauucaaacaugggcaucagacuccacuagaaacauuaaguaacuugccaguguuaauacggcuagugaaaaaacagaguuaguauucaaacaugggcaucagacuccacuacagacauuaaauaaccugccaguguuaauacggcuagugaaaaacagaguuaguauucaaacgugggcaucagacuccacuagaaacauuaaauaaccugccaguguuaauacggguagugaaaaaauggaguuaguguucaaacaugggcaucagacuccacuagaaacauuaaauaacuugccaguguuaauacggcuaguaaaaaacagaguuaguauucaaacaugggcaucagacuccacuacagacauuaaauaaccugccaguguuaauacagcuagugaaaaaacagaguuaguauucaaacaugggcaucagacuccacuagaaacauuaaauaaccugccaguguuaauacggguagugaaaaaauggaguuaguauucaaacaugggcaucagacuccacuagaggcauuaaauaacuugccaguguuaauacggcuagugaaaaaacagaguuaguauucaaacaugggcaucagacuccacuagaaacauuaaauaacuugccaguguuaauacgguuaguaaaaaacagaguuaguauucaaacaugggcaucagacuccacuacagacauuaaauaaccugccaguguuaauacgacuagugaaaaacagaguuaguauucaaacuugggcaucagacuccacuacagacauuaaauaaccugccaguguuaauacgacuagugaaaaacagaguuaguauucaaacaugggcaucagacuccacuacagacauuaaauaaccugccaguguuaauacgacuagugaaaaacagaguuaguauucaaacaugggcaucagacuccacuagaaacauuaaauaacuugccaguguuaauacggcuaguaaaaaacagaguuaguauucaaacaugggcaucagacuccacuagaggcauuaaauaacuugccaguguuaauacggcuagugaaaaaacagaguuaguauucaaacaugggcaucagacuccacuagagacauuaaauaacuugccaguguuaauacagcuaguaaaaaacagaguuaguauucaaacaugggcaucagacuccacuagaggcauuaaauaacuugccaguguuaauacggcuagugaaaaaacaguuaguauucaaacaugggcaucagacuccacuagaaacauuaaauaacuugccaguguuaacacggcuagugaaaaacagaguuaguauucaaacaugggcaucagacuccacuagagacauuaaauaaccugccaguguuaauacagcuaguaaaaaacggaguuaguauucaaacaugggcaucagacuccacuagaaacauuaaauaacuugccaguguuaauacagcuaguaaaaaacagaguuaguauucaaacuugggcaucagacuccauaucuuuguuguuggccaggagcaggcaaacuauaagccugggugccagaaugagccaugccguucuuguauguaucaugucuugucuauuguuacagcagcagagcugaguaguuucgguagagaugguuuggccugugaaggcugcccuuuacagaaaacaguugccugccccugcucuugcgcauuguauuuugucuucacuguuccugccuucuugucugguucuaaggaaugaaaggaggacaccagcucagauuuccuaaaaaugucuuuauauauaauuuuuaaaaauucucaaaaaaaaucugccuauaaaagucaaaaggaugaaaaugaauguagcaggaacaacugugaggugucccagcuacaguagucauugaguuuuuuugcauaaaaauacgauuguaaagauagauuccauaaaaugugauguucuuuguccugguacugaccccgguagaguguugccuauguuuuuggcuuaacauuuauagggcauuauuugaaaaacugaauucugauccaagcagagaugaggggaacaaggcugagaccuuaauuacuggcucucucuugucagagaaaggugcuuuuugucauauucccaugggauuugauugaccuucggacggccugugucuguuaggaggcauuucuauuucucagguuugagggcuagucaguaaaauuuggaugaauuuggacuggauagagggacucaaccugaauugugaaaauccugaguuacagaauuuuuaaaaguucuauguuguaguuauauauaauaauuuagcuauuuuaaagcacaaaacaaauacgugcacuuggagaauggaguccacagcauucagcaacaguggccugaagcagagccccagauaaaacacuggguugaaugucagugugcugacaucaguguuuuuuauuauaugacuguguucuuucuauaaaaaucaggcauugugagaagcccagaugugaagcuuggaacaauaaaaccaaaggaagaauacaucagagguuuguaaaacuuagauaauauggaaguaauuaaccauuagacucacgauauguucucuaacaguaaccuugaaacuccauguuuugugucuaaugacuucuaggacacauaaagacaaaaggaaagaauaauaugcuuucagagcaugaagaacuugcuuuagagucccugugucuuuugacucgaauacacaggauuauuauaucaugcaguuaugaaucugaggaaaguaugacaugaucgauaggucuaauucuaaaauaucugauaaagaaguuaauaccaaaauuagugaguuuccuaacuuuaaagugaaauaacuagauaaagaagaacuaaaugcaaagcuagcagaaggaaggaaauaauaaagauuagaacaguguuaacugaaauagagaauaggaaagcaauaggagagauuaguggccgggcgcagugguucacgccuguaaucccagcacuuaaggaggccgguggaccacgaggccaggaguucgagaccagccuggccaacauggugaaacccugucucuacuaaaaauacaaaaauuagcagggugugauagugggcaccaguaauuccagcuacucaggaggcugaggcaggagaaucgcuugaaccugggaggcagagguugcagugagccgagaucgugccacugcacucccaccugggcgacaagaccaacacucugucuuuaaaaaaaaaaaaaaaaaaaaaaaaagauuagugaaaccaaaagcugcguucuugaaaagauuaacaaaauugucaaacuuguagauagauggacuaagaaaaaagaagauuccaauugcuaaaauaaaaaaugacaauggggacauuacugggccgggcgugguggcucaugccuguaaucccagcacuuugggaggccgaggugggugggucacuugaggucaggaguuucagaucagucuggccaacauggugaaaccccgucuuuaccaaaaauacaaaaauuagcugggcacgguggcgggcaccuguaaucccagcugcucaggaggccgaggcaggagaaucacuugaacccgggaggcggaggcuguagugagccgagguugugccucugcacuccagccugggaaacagagcaagacucugucccccccccaaaaaaaagaaaaaaaaaaaaaaaaagaaaacagggacauuauuaugaaucauacagaaugaaaaaggauuauaggagggcauuaggaagaguuguaugacaacaaauugaauacccuagaugaaagggacaaacuucuggaaauauaaaaaacugugaaagacaaaaauuaugaaaaucugaauggaccuauaccuaguuaggagauugaaucaguaaucaauaaucucucaacagagaaaagcugacuuggagggcuucacaggugaauucuaccaaacauuuauagagaagcugauacuaaucuuucucaaacuuuuccaaaguauugaagaggaagaaauacuuccuaaugcuuuuauuaugaggccaacauuacccuguuaccaaagccagacaaagauauuaugagaaaagaaaacuacaaaccaguaucccuuaugaacacugauguaaaaauuuucaacagaauacuagcaaaccaaauuuagcagcauauuaaaaggauuauacaccaugaccaaauggcauuuauucccagacugcaagaaugguucaaaaugugaaaaucaaucaguguaauauaucauauaaacagauuguagggggaaaaaaaccccacgugaucaucugaaucgaagcagaaaaaucauuuugacaaaauucaauacccuuucaugacaaaaaucacugaacacauaaggaauaaaaagaaacuacuucaacauaguaaaagccauauaugaaaaacccauagcuaacaucuuacuggugaaagaccaaaagcuuuuccuuuaagauugaggaugagauaaggaugccugcuuuucaccacuucuauucaacauacuacugaaguucuagcuagaccauuuaggcaagaaaaagaaauaaaaggcacacaaauuggaaaggaagagguaaaauuaucucuguucauagaugauaugaccuuguagauagaaaauccuaaagaucccacaaaaaacuaucaaugcuaauaacugaauuaaacaaaguauuggggcacaacgugaauacacaaaaauccguugcauuuuuauacacaaacaaacagugaacaaucugaaaaggaaauuacaaaaacaauuccauccaaaagaauaaaauacuuaggaauuaacaaggagguuaaaaacuuaacaaugaaaagcagaaaaacauugcugaaagaaauuaaaggcaacauaaauaaguggaaacauaucccauguuugugaacuggaagauuuaauauuguuaagaugucauuaccuacccaaaggccucuacagauucaaugcguucccuaucaaaaucgcaaugauguuuuuuugcagaaaaggaaaaaaaaaucuaaaauuuauauggaaucuugagggacuccaaauagcuaaaguuaucuugaaaaauaacauagcuggaugacucaaugugcugauuucaaaauuugcuaagaagcuacugugaccaaaacaguguguuacuggcauaaagacagacauauagaccaauggaaucaacgggaaaguccagaaguaaaaccucaccuauauggucaaaugauuuucgaugggggugccaagacccuucaauggagaaagcacagucaauucaacaaauggugccaggacaacuggguauccauaugcaaaagaaugaaguuggaccuuuaucuaaguuuguauacaaaaaucaacucaaaauggaucaaagaccuaaauguaagaccccaaacuauaaaacuccuagaaaacauagggcagaagcuucaugacauuggauuugucagugguaucuugggaaugacaccaaaggaacaggcagcuaaagaaaaaaaauaaacaaauuguucuuuaugaaaauuuaaaaaauuuggugcaucaaaagacaguaucaacaguuaaaagguaacccagaguaugggagaagauauuugcaaaccuuauaucugauaauggaucaauaucaaaauauauaauuaagaacucaacaauagaaaagcaacaugauuuuaaaaugggcaaaggacuuaaguagacauuuuuccaaagaagauacgccaauaagcacaugaaaagaugcuuagcaucacuaaucaugacggaaaugcaaaucaaaacuacagugagauaccacuucacacaaauuaggaugacugcuauuuaaaaaaccccagaaaauaaguguuggggaggauguggggaaauuggaagccuugugcacugcguggacguguaaaacuguauagccacuguggcaaacaguauggcggcaacucaaaaauuuaaaaauagaauuacuguaugauccagcaauuccauuuauguguauguacccaaaagaauugaaagcaggaucucaaagagauguuuguaugccaguguucauagcagcacuauucacaaugacuaaaauguagaagcaacccucaugucauuuaucugaaaacaaaaugugguacauacauacauaucauaaaaugucauucagcauuaaaaaggagggaaaugaagacacaugcuacaacaugguugaaccuugaggacauuaugcuaagugaaauaagccagccacauuaaagacaaauacuauaugacuccacuuuuaugagauacuuagaggagucaaaaucuuagagccagaaaguagaauggugauugccagaggcuagaaagaaggagggaacuggaguuacuguuuaaugaauuuagaguuucaguucugcaagaugaaaagaguuacagagauggaugguggugauggugcacaacauuaugaauggauuuaguaacacuaaaguguauacuuaacuaugguuaagauaguaaauuuuuuaugcauauuuuauugcaauaaaaaaugaaaacaguuucaaucuaggaggauuuuggaugcaucuaugccuugagaaaugaaugguuugauguaaaugcaugguagcaagaauaaauaauuauguuaauucauauaauauguuauauauaguuuuaaagaaaauucuaucacugucuuccuauggguagggcuauaauguccaguucuuucagggauuaagaggguagggucugaaguuaauccuuguuugucguaauguuauuaauuuauucaaccaagacuuaauugagaaugaccuagcaaaagagacaaucuguucaaauuaaccaacuugaguaccauuucaauuugaaaacucugucucugguguuggaggucauucuucaggaaccaacaugguucuugggaagguaaaccucauguacaaagucacucaggaauaauacuugaccgcuggguguggugguacacgcccggaaucccagcacuuugggaggcugaggcaggaauaucacuugaguccaagaguuugagaccagccugggcaacguaggaagacagcuucucuacaaaaaagauuuuuuuuaaaaugagccaggcaagauggcaugugccuguagucccggcugcuuacggcugaggugggaggauugcuugggcucgggagguugagguugcggugagcugugauugcaccacugcacuguagccugggcaacagaacaagagccugccucaaaaaacaaaacaaaacaaaacaacaaaaacaaaaaaaaaaaagaaaaaaaaagaaacagaaagaaaacaauaauauuugacagaauaaauuccagggucauacuggaauaugggggaagaguaugaaaguaugaauuggacagauaaggauucuaaucgugguucuaucaccaccagcuaaucuucugacccuccauuuccuaacgucaaaaaugagaacauaauaucagugucauaauguuaagaagauuauauucauucuuauaaagugauaacuuagaagccguucaauucaguauuuauugaguuacuaacacaggcucuugcuguguuguuagucgaucuacuaacuaaagugugagaucuggaaagggugguaucagccaguuucagagaaaacaaaggaaacugggaggcuucauguaguugggccuuaacccugggccuugaagcauacauuuuagaugguauggugggauuacagugggauuacuggcauuuagugggauggaaaagggagagauuuuauuuauuaauuagauucaguuacgugcuuauuauucuuuacugauucuaauuuaguaaugggaaccuguaacuuuuuacucuucagcuacuuuaggguuaauuggguuaacggugaugaaguuuggaucauuuuauuaacagugauaguguugcaggaccccaagggagggcucuuggaucuggcgcgagaaagaauucagggcgaguccauggugcacagugaaagcaaguuuauuaagaaaguaaaggaauaaaagaacggcuacuccauagacagagcagcccuaggggcugcugguugcccauuucuuucuuuucuuuucuuuucuuuccucuucucuuuucuuucuuuuuuugauggugucucguucugucacucaggcuggugugcaguggcgagaucuuggcugacugcaaccuccgccucccagguucaagcuauuccccugccucagccucccggguagcugggacuacaggugugugccaccaugcccggcuaaugucuuuuuuuuguguauuuuaguagagacggggucaccauauuggucaggauggucuggaucuccugaccuugugaucugccugccuuggccucccaaagugcuggguuuacaggcgugagccacugcgccuggccgguuauuuccuaaugauaugcuaaacaagggguggauuauucaugccuccccuuuuuagaucauauaggguaacuuccugauguugccauggcauuuguaaacugucauggggcuggugggaguguagcagugaggacgaccagaggucacucucauggacaucuugcuuuuggucugauuuguccggcuucuuuacaaccuguuuuaucagcaaggucuuuaugaccuuuaucuugugccgaccucccaucucaugcugugacuuagaaugcguuaauugucugggaaugcagcccaguaggccucagcuucauuuuacccagcuccuguucaagauggaguuguucugguucacacgccucugacaauacaauucccaauugauaagugauaccuuggaaucagugugaauuauuuuuacacuacugcacaccugggaauggugaaugugugaggccuguccucucucaggcucauaggaaaagacagaaaugaucuugcuucuuuagggauugacagaacaaagacaaaggacccuagacuuugggaauagaaaucuguugaaaugagcuggaauugguaaaauaauugauuuuguuuaugaauugauaaaagccuacuuucaauucaucaaauauuguugagcaugcaacaguaugcucccguaccuaaggugcagucucugccuuagaguuguaauccaggaaggggcugcaagagagacucagaagauguggucugacaauauauaagcacaaugucugacccuuaaagaaugacaggauuucaacaggcagacaggagaggaggaggaauucuaagcaaaggcuuucacauguaaacggugaauucuuagauaagaucuguuuucuauauaccaggaacaguuugcuggcauuugaggacgaggaguaaguucaaaugaaaacuuuaaaauguuuccccaaaguguucauaugaaauuuuaaggaugugccuauggacugggaauaaucaaauaacauaaaauaaacauaaauaacauaaaccauaaaauaauaccauuuuuuuucuacuuuuaaaauugggcccagaauauagcuugcaguguuuucuuaauugauaaaacuucaguucaucaccuucaauuaauauguuaaugcaugaccauuugcuuuguauauaucuaggcuauauuuauaauuguggucugucuucuuuggccaaguauguauguauuccguuaucucuuagcuccuuuguauucaggcuaugcacauuuauuauaauauugcucuauuccaucuuuaauuaggcaagcaaauauucuaauaaaaaguuucaaagugaauuuugcauuauccaguacuagauacauauucuguaacuuuggggcaagauauuugccaggcuuauaaaacuagauauaacuauccauaaauaaaauugccucaauaagauuuaauggaagagaauuaagaagcuguggaaaaugaauaagaaaaggaaaaaaauauuauuuucgcaguuuacuuuuuuuuuuacuugggaucauauucuuuucugagguuuuacucgaaaaaguauuuucucugucauuacuuucuuucucucucuaucuuucucuucucucucucucuuucucucuuucuuucugucuuucuuucggcuggagugcacuggugcaaucucggcucacugcaaccuccaccucccgggucccaguuaagcaauucuccugccucagccucccuagcagcugggauuacaggugugcaccaccaugcccagcugauuuuuguauuucucauuacuguuucagagacuauucagagaguauucaguguuauaguauuuuccuuaaauaagauuaucacuuagggauuuggaaucacguuaauaaaauuauucaacauacuuuuacugaguaacuacucuguaccagguaccguuggaacauauaaagaugaauaagacuucacuaucggcauaccaaaacauucuauacucaauauauuaauacucuaauaauaauaaugugaacaaaauacuuuaggaauacagaggaaggaacuguuaauucugucacgcaguuuggacauuagaguugguccugguaggaugaauauaaaguugcccgauuaaaaaaagaugggauggauggacagggcaugacauucccaauagaguucuuucccuguuuuuuacaaaaaaagaaagccaaacuuccuaggaaucauaaccuuugauacauuguaaacaaaauguuuaguagaugacuaugaaggauggacucaaauggaagagugguuaaaggggauuugugggguucccuuuuaaaaucagguguucagcaaacaagaacuaaaaagauuagugggaucuugaacaaaugauugcgagcucaaaauucuaaggaaggaacucaguugcaccugcuuuuuuguaauagcaaauacaaggaccuucaguguuaaaaacauucaugagagauuagcuaacacagaacagaagauucucaaacccaauagcuugaggagaaaauccaucuucucauuaacuggaagauugucaauauaaggagaugggaguaauucucaguuacuuucauauaauccuacuuuaaaaagcaagcacugcgggaguauuuucuguugauccguugguucaaaaagaugcucucacaggagaaggcucauacaggcuggaugaugagcucauuauuaagacaugugauggucacuggaucccacaauauuucugacauguuuauuccucuugcugauuuucugacuuuuuauuguuguuuuguuuauacugagagcugcugacaugugaauaucccaauagcuaucaucccugaaagaugugcuuuuuaagaaugaagacugcaguuuuucuggagucagccucuugucucuuucuccuggcucacacuucacaaaaugagaauuuuuucuuaagacaaacaaacaacaacaacaaaaaaaacgaagcagaacuggauauaguggcucaugccuauaauccuagcacuuugagaggccaaggagggagguuugcuugaggucaggaguucaagacaagcauggacaagaaagugagacccugucuauuacaaaaaaaaaaaauacaaaaauuagcuggguauguuggcauacucccacauccuagcuacuugggaggcugaggugggaucacuugagcccagguguuugagguuacagugagcuaugcucacacccugguacuccagccuggucaacagagaaagacccugucucgaaaaauaauaaagauacacugaccagaagcuucagucugauccauugucaauaaagaacagugcaagagcaauuaauauuuuacaaaaucaaaaaagaaaagcuagcaggauuauuucauuagcaugcuucucuucauaugcaccuuugauuuaaaaaucacucuccuguaguuuuuuauuucuucacaauuaucaguuggaaacuaaauuuguucaucucguaauaagacugauucuguaugcaucauagaauugcaaacauuaaguaacaaaguccauguaaaguguuuagaacauagcacuuaguaaauagugguuauuauuguugucacuauccccacugucuuucuuuguagauauuuacuuucaccuuuucuucuauagcagagccacuaacagguaauagagaaguaacuaguuagaucuuaggaauuuaagaagcacuucaagauguggacagaaaaggauuugguucagauugcauacucuuaggcuauggagaugguaccugcaauucccauagaauguguauaaagcacuguauugcauuagaggccaugggauuacaaaagcuauucuuuguaagacaucuuagaauguuguugaugugugagaauaaaaucauauugaaaaaauauagaaaaguuaccgucuuucaucaguucuaagaugcagggucucaccaucuugcccaggcuggucgugaacuucugggcugaagccauccuccuaccuuggcuucccaaaaugcugggauuauagguaugagccauugcacccagcuaauuguuuuuguuuuaaucaauuaccauauuuuuagcacugcuguggcuuaugcuuuguuccuuuuuacuacuacuugcuuugaaugaugcuuaaaauggacccuuaggaagaugacuguauugaauuauuauauucagaacaauugauauacuaauuuaaaaagaauauacagucccaagugauagaauaaacaagaguuacugcuuaguauacaauaaauuuuguauucauuugauuucccucagaagucuguauucgaaaucugaguuuccuucuauuuauauguagguuacaaaguuuuuaaaaaggcaacaaaaaaaaaaacauuuauuucugcucuucuuaggcaauauggccuuuuggcuagaacucagaaauuaaaagcuugauuuguugguuguguaggcaucuuauaucuaaggaauuauuuuggcuuaauuuggggauaaaauauuaauuacaccuaauaagcagaaauguaauuauuuaagacaguuacugucuuacacauuuuucacuuaagauaugaagaagugguuaacguaauuucuucuucugggacuuaaaagaaauguucaaauuaaccacuauuuagguuugaucaugccuuuggaaggaauugguauuauccuuugaaaaugaaaaggcauaauuuguugaagguacauagaauuguacaaaaagaaaucaguaauuuucccauuuuuacuauuaaguuauaucauaagcagcuauuuugaaugacaguaugaaaaaguauguuuguguuuuaaggaggcuguuuuugaauuaggaaagauaaauacgcugguaugaagaucagcucauucaggagcaggcauuuuccugcauacuaaggagcuuuaaagguuagacaguaaaaagaaggugaucauuauguagucugcuccaccucaugccuaccagaaaauuuauuucccagccucccuaacuuuucuacuucaauauacagcuaacuguuaaugagcccuaacucugaccuggguaugugcccaggucacauacauccugucauuuaguccucaccauaaucucugagugcacaguagaugcuguuagaauuaucuguauuuuauaguacagaaacagccucagaaaagugaaauaacuucccucaaaauaagguagcuaguaaauggcagagcuaacauucaaccuuauccaugucugacuacaaaguaauccauccauuacuuaccuuuuuucaugguaagcuuuugcuuuuuggucaacacuaugcauugugccuugaguacauguaccaacauuggaagaccauucccaugugauauuuguaauagaauuagguauucaaaucacgcauucuugagacaauuaaagaauguaggauuuauuuacauacaaaguugagagaaugugcaucaugcugugucaggcuuccuuuccaugauucuguuaguuuucagugcagguauuugccaccugacuuggguuuccuagaugucuauaaucaaugaaauauuuucucuuuugaaaaacuauuuuuaaaauacauguuuuaacaguguugaauuacaagauguuuuaagauaauauaaaccuggacccaaauuucuauguaaauguuuauuuuauagagacaaguaaauuaaccaaauaauucagugaaucuucauugagaaccuaauaugaccuagguacugugcuaggugucagagaccggcuauaugguuuaguagaaagagaaaugguagacgcugugccaagcauagugccuggaacaagcagaaaguccauaagaaauauauguuaacugaaaggaagaacaaaauggaaacugugucugucugagucacccaaauuaguaaugucugugaguuuauuuccucaucugaaaugaaggguaauaaaaccuaccucagaaggauuguugucaagauuaaacgaguuaagauaugggaauauguccagaacuguguuugguacauauuagauguuuaauaauuguuagucauagugcgaaaaauaaguaacacauuauucccauucucaagcaaugucaagauuuaaaaucggauucuuauccaccauaucguuagacuucaguugccuuguucuucuauuugcuuuauucugccugagcuucacuaacaauccacagggcuuuuggacucuacaaagaaaacacacacacaaaaauaucauacacucuucuauaucuacucacaucugcacucaaauuuaauucuguucugugaaaaagaaaaucggcacaaaguuauugcuuaauacugucaaauacuuuuuaaaauuaguugcccucuguaacaauaggagagcauggaagaauaaacaagcagcagaaugaugucagagaaacuuuggccacagaaggagaucaguagguauuggaauuugaacagcuuauuuuucacuuacuucuauacacaauauggaucuuacagauuuauuguaacuuuuuucuccgauuuaagaauugccagaaauaaagcugagugacaagaaaaggauguguguacaugagacagagggcgcuguuuaugcccaucuguacagaaugucauucguuuuaaauaugauuuuccucuuuuuccucacagaaagagaaaaugguauauuucuccuucuaugcaacagagaacugauuuuuuuuuuaaauucuuauuacuguuuuuuuuugaaguauaauagaaacaaagcaguguuuuucuuuguuaaggucaguucauguuuuaguaaugugucuugagcuuucuguauuuucugagcuaaccauuuaaaaaauuuugacuucuacaccaauuauuuuaugugugauuguuuaaauucuaugggucuuguugaugaccuuccuauauuuauugucauugaaaacauucaauauguaaauauaauaaacgauuauaucuuuaagaaaauaaaaguuuucuaaaauuaaaugugaauuaucauuaaagcauaaaaugcugugacuauaagguaacauuaaaaaaaaaaaacaaagagagcugggugcgguggcucaugcuuguaaucccagcacuuugggaggcugaggaggguggauccugaggucaggagaucgagaccauccuggcuaacacggugaaacccagcucuacuaaaaauacaaaaaauuagccaggcgugguggcgggcgccuguagucccagcuacuugggaggcugaggccggagaauggugugaacccaggaggcggagcuugcagugagcugagauggugccacugcacuccagccugggugacagagugagacgccgucucaaauaaacaacaacaacaacaacaacaacaacaaaacccagaaagagaugacuuccagccagaaggcgagacucugugggaaaagccuuccuucuaaggggaggguuugggcugcuauuuuucuuacuuuccuugagagcagcuucaggacuguacuugggucacucuacaagcuguuuccuuuauuuuuucucucucaacaaagauuuaccuguccauuuauaaagugcagauuguuucucuaagauggcagauaagaggcuuguagcaugccucagccacuuggaaauggcuagauagugcaugaagauaaacuguaugagcuuuuuuucaagaaggaaaauggggcugggcgcaguggcucacgccugguaaucuagcacuuugggaggcugaggcggguggaucacgaggucaagagaucgagaccauccuggccaacauggugaaaccccaucucuacuaaaaauagaaaaauuagcucuguaggcccagcuacucaggaggcugaggcaggagaaucgcuugaacuugggaggcagagguugcagugagccaaggucgggccauugcacuccagccuggugauagaacaagacucugucucaaaaaagaaacaaacaaacaaaaaacaacaacaacaacaacaacaaaaggaaaaugggaauccacuggaaucgugagggacacccagauccuggugagcagaacacuggcaaacaaccucugcgacagugucugguggauaaaaaagauccugguguagggaggcccuuucugcuuuacaccuaggcagaucuccaggcauuuggagcaccugcuuaucugguucagcagccugagccacgcaacucuuccugugggacagugggacccucucugcucuaagcccaggcaggucugcaggcauuuggagcacaagcuuacuugggucaguagcccgagcugcuccauccuucccgugcagagauccucauauagggggacucucucugcuccaugcccagacagaucuccagguauucagaacaccugcuugccugguucagcaguucgagucacccuaccccuuuuaugcagagaucuugguucagggggagcccacuauacuacacaccuaggcagagcucuucuggauuuggaguuuagggcaucccccauuccuguguagagaaguugaugcugaagagguuucccauuccugugcagagaacuugauacugaggagcuccaugccuaggcauaccucugggugcuugguagccacccauuggauucucugucagugcuggugcuugugccuguaucaggggaccuuuagguggaccugaccagucuggccccaugcccuuggggcugagcagggagcucagaccacuaugcauucuauguaucagcccauugucugaggcaacagagaacuucugccaguaaacaaggaucaaguauccagcuacauuggcugcaacuggcucuuaccuauaagcaucaucuacuggcauguagauugaacugcacagccugauacaaaaccuaccagaagaacugguagaaacaaaaccaaaggcagagcaaagauagaagcaaaacaaauagaucuuacccaaaauaaucuguagucauacccauaggaagcaggggaaagggaaagagaaggaaaaaaaacccaguaacauuauagaggaagaaaagagaaagaaacauccuaccuacaugaaaauaauuacaaaaauuagaagugcuagcaucuucagcugagaaagaaucagcacaagauuacuggcaccauuaaaaaucugaauguaguaacaccaccaaaggauugcacaagcuuuccagaaaugguuccuaaccaaaauggaaacucagauaugacagauaaguaauucaaagcaugaauugcaaggaagcucaaugagauccaagacaagacugaaaaucagcacaaagaagcuucuaaagcuauccagggaaugaaggaagagauaaauaucuuaaaaagaaaucaaccaguucuggaauugaaaaacucacuuaagaaauuuaaaaauacaauucaaaguuuuauuaaugguuuggaccaaguagaagaaagaauuucagaacuugaagaucagucuuuugaauuaacccagucagacaaaaaggaagaaaaaauaauuuaauaaaauaaacagucuuugagaaauaugggauuauguaaagugaccaaaacuacaaauuauuggcauuacugagagagaaggaaaaaaauaagcaaccuggaaaacaaauuugaggaauuaaagaaaauuucccuaagcuugcuagagagguagacauccaguuacaagaaauccugagaacaccugugagauacuauacaaaaugaacaucacuaagucauauagucaccaaacuguucaaggucggugcuaaagaaaaauaucuuaaaggcagcuagagaaaaaggucagauuuuguacaacaggagcccuaucaggccaacagcagacuuaucagcagaaacuuuacaagcaaagugaguugggggggcuauuuucagcauuuuuaaagaaaagaaauugcaaccaagaguuucauguccugucaaaugaagcuucauaaaugaagaagaaauaaaauuuuuuuccagacaagcaagcacuaagggaauuuguuaccacuagaccagccucacaagaguuccuuaaagguguucuguauuagugugcucuugcauugcuguaaagaaauacgugaggccaggcaugguggcucacuccuguaaucccagcacuuugggaggccgaggugggcggaucacgaggucaggaguuugagaccagccugaccaacaugguaaaaccccaucucuacuaaaaauacaaaaauuagccaggcgugguggugcacaccuguaaucccagcuacucgggaggcugaggcaggagaauugcuugaacccaggaggcagagguugcagugagccaagaucgcaccacugcacucuagccugggugacaaagugagacucugucucgaaaaaagaaaagaaauaccugagacuggguaauuuauaagaaaaguucaauugacuuaugguucugcaagcuauacaggaagcauggcagcaucuacuuuuggagaggccucaaggaacuuuuacucaugccaguagguaaaggaggggcagccgucuuacaaggcagaagcaggagagggaaggguggugugacaccucccucccacccagucccacuuccaacacuggagauuacaauuuaacaugagaguuuuuggggacacagauccaaaccauaucaaguucuaaauauggaaacagcugcugccacaaaagcaccuuaagcacauagcccacagacccuauaaagcaaccgcauaauagaaacuacaaagccaccagcuaacaauuucaugauagggucaaaaccucaaaugugaauauuaaccuugauuguaaauggucuaaacagucuacuuaaagggcacagaguagcaaguuugauaaaacaacaagacccagucaucugcugucuucaagugacccaucucacagguaacaacaccuacaggcucaaaguaaugaauaacaaaaaagagcagggcuugcuauucuuacaucagauaaaacaaacuuuaaaccaacaacaguaaaaaaggacaaagaaaggcauuacauaaugauagaggauucaauucaacaagaggauuuaauuguccuaaauauauauguacccaauauuggaguagccacauugauaaaacaagaccuaggaaaagacuuagacaaccacacaauaauaguggggaaauucaacaccccacugucacuauuagaucacugaggcagaaaacgaacaaagaaauucuggacuuaaaguaaacacuugaccaauuggacuuaauaggcaucuacagaacacuucacucaucaaccacagaacauacauucuucucaucugcaccuggaacauacuccaggauugaccacauguucagccauaaagcaaguuucaauaaauuugaaaaaaucuaaaucauagcaaccauauucuaagaccacaguggaauaaaaauagaaaucaguaccuuaaaggacucaaaaccacaguuacauggaaauuauacaacuugcuccugaaugacuuuuguguaaacaaugaaauuaaggcagaaauaaaaaaaauuuaaauaaaugaaaacagaggcacagguaccaaaaccucugggaugcagcaaaaguaguguuaagaggaaauuuuauagugcuaaauaccuaccgcaggaaguuagaaagaucccaauuuaaugauuuaauacuacaccuaaaggaacuagaaaaacaagaacaaacauuucaaagcuagcagaaaaagagaaauaacuaaaauaagagcagagcugaaugaaauugagacccagaaauuaauauaaucaacaaaacuaaaaauugguuauuugaaaggauacacaagauugauagaccauuagcuagauuaacaaaaaagaaguucaaauaagcacaauuagaagugacaaaagugacauuacaaccgaucccacagaaacacaaaagauccucagagacuauuaugaacaccucuaugcacacaaacuagaaaaucuagaggaaauggaugaauuccuggaaacacacugugaugguuaauacuaagugugaacuugauuggauugaaggauacaaagcauuaauccugggugugucugugaggguguugccaaaagagauuaacauuugagucagugggcuggggaaggcagauccacccuuaucuggugggcaccaucuaaucagcucucagggaauauaaaacaggcagaaaaucaugaaaaagggagacaggccuagccucccagcccacaucuuucucccaugcuggaugcuuccugcccucgaccaucagacuccaaauucuucaauuuuggaacuugaacuggcucuccuugcuccucagcuugcagccuauugugggaccuuguaaucauguaaguuaauacuuaacaaacucccguuuauaucuauguaucuaucuauguaucuauguauguauguauguguguguguaucuaucuaucuaucuaucuaucuaucuaucuaucuaucuaucuaucuaucuaucuaucuuauuaguuaugucccucuaagagaacccugacuaauacacacacaaucucuuaagauugagucaggaagaaauugaaacccugaagagaacaguauugaguucugacauugaaucaguaauuuaaaaccuaccaacuagaaaaaaaaaaaaaaaaugccccagacaaauggauucgcugccagauucugccagauguauuguacaaauaggagcugcuaccaauuuugaaacuauaccaagccaguguuaccuccauaccaaaaccuggugaagacacaauaacaaaaaagaaaaugacaagccaauaucccucaugaguauaaacccaaaaaucuacaacaacaugcuaguaaaccaaauaaaacagcacaucaaaaacuuuauuaccaugaucaaguaggcuugauuccugggaugaaaguugauucaauauaugcaaaucaaaacgugugauucaccacauaaacaguauuaaaaauaaagaccauaugaucauccccaauggaugcagagaaagcuuuucacaaaaccccaaauccccucaugauaaaaacccucaagaaaccaggcauugaaggaaaauaauaauaauaauaauuauuauuauaauaagauccaucaaauaauaagauccaucaaaauaauaagauccaucuaugacaaacccauagccaacauuauccugaauggacaaaaacugggagcauucucccugagaacuggaacaagacaaggaagcccacucuuaccacuccuauucaacauaguccuggaagugcuagcuggagcagucagucaagugaaaaaaagaaaaggcauccaauuaggaaaagaagaagugaaacuauuucucuuugcaagugauaugauuauauaccuguaaagucccaaagacuccaccaaaaggcuccugaaacugaucaaugacuucaguaaaguuucagaugcaaaauaagugugcagaaaucaguaacguuuuuauacaccaauaacguucaaacugagagccaaauaaugaauccagucucauuugcaguagagauacacaugcacaacaccuaggaauacaucuaaccaaggaaguaaaacauuuuuacaaggauuagaaaacacugcugaaagaaaucagaaaugacacaaacaaguggaaagacauuccaugcucauggauuggaagaaucaauaucacuaaaauggccauucugcccauagcagucuacagauucaacacuauuccuaugaaacuaccagugucauuuuucacagaauuggaaguaugcuaaaauuaacauagaaccaaaaaagaguccaaguagccaaagcaauccuaagcaaaaagcccaaagccagaggcaucacauuaccugacuucaaacuauacuauaaggguacaauaaccaaaacagcaugguccugguacaaaaacagacacauagaccaguggaacagaguggagaaccccaaaauaaagccauacaccuacagccaucugaucuuugauaaaguagacaaaaauaagcaaugaggaaaggacucccugucaauaaauggugcuggggcaacuugccagccauaggcagaagaauggaacuggacccuuaccuuucaucuuauauaaaaauuaacucaagauggggaaaagauuuaaguuuaagaucugaaacuauaagaagcuaggaaacaccauucuggacauagacuuuggcaaauaauuuauggcuaaguccuuaaaagcaguugcaacaaaaguaaaaauugacuggugggaccuaauuaaaccaaagaacuucugcacaucaaaagaaacuaucaacagaguguacagucuacagaaugagagaaaauguuggcaaacuacacaucugacaaaguuuuuuuaauagaaugccuauuauuaagaaguaaaaaacaacagauuuuggugaggcagcagagaaaaagagaaaagggaguacuuauguggaugggaauauaaaccuaguucagccacuguggaacgccauuggagguuucucaaggagcuuaaagcagaacuaccauucgauccagcagucccauuaauggauacauauccaaaagagaacaaauaauucuaccaaaaagacauauaguugcauguucaucgcugugugcagaaaucaauagcguuucuaugcaccaauaacguucaagcugagagccaaauaaugaauccagucucauuugcaguagauauacacaccuacaacaccuaggaauacauccaaccaaggaaguaaaacauuuuuacaagaacuagaaaacacugcugaaagaaaucagaaaugacgcaaacaaguagaaagacauuccaugcucauggauuggaagaaucauugcugcacuauucacaauagcagagaugugguaucauccuaggugccuagcaacaguagacuggaugaagaaaaugugguacauauacaccacagaauacaauguggccuuaagaaagaacaaaaucauguccuuugcagcaaccuggaugcagcuggaggucauuauucuaagugaauuaauacgggaacaaaaaaccaauaccgcauguucucacuuagaagugggagcuaaacauuggguacucauggacauaaagauggcaacagcagaaacugaggacugcucgagguuggagggagggagcaaggguugaaaaccuaacugguggaaacuguguucacuaccugggugaugggcucauuuguaccccaaaccucagcaucauguaauauacccugguaacaaaccugcgcauguacccccuugguucuaaaauuaaaguucaaaacacaacaaucccagaaaaauuuauuaaauucaaacuaucaguuucaggcacauauuuucauccuuuuuagaaguacuuuugagcugaaauugaaaugucaaauaacauaucauuugaaauacauguuugguugaguauugccaucacaugguauuaaauauuaaacauuauuuuaugcuguuagcgggucacaaguuucaguguguaaugaagaaaauauuaucuguuugaugacuucugugcucugugauagaacuguguguauuuauuuaccauaguaacaggcuuuguucuguuagugaauacuuaaaugugauuauuaaguguuaugugaauauaacuauuucagacauagucuauaacugcuauacacaaauucuauagguuuugggaaauaauaauaaugaaaagaugccucugccucauauauaacagucccuacaguaaucaggacagacgucuuuagaaccaggugguuuguacccagugauaaguuaauauguaauaaagucuugcuauaagugaaucugagaaaaaagcuacuuuuaauaaauacauggauuuuuuuuuaaacagaaaccuuuaacagaauaaauuuauaauauuuuagagucagugcaguuauacauauguuucuucauacugcuuacugucuaugugaccuugggcaaauucacucaucuccgugugcuuuaguguuuuuaucugucaaaugguuauaauaacaguuucuaucugguacgguaccuguaguuguaccuggcacuuagcaaacacuguguuaucuuuuauuaucauuguguauacgccauucagaguacgugggcacaguguuugaggcaccuacuaaagccgggcacaguguccgaggcaccuacuaaagccgggcgcaguguccgcggcaccuacuaaagccgggcacaguguccgaggcaccuacuaaagccgggcacaguguccgcggcaccuacuaaagccgggcacaguguccgaggcaccuacuaaagccgggcacaguguccgaggcaccuacuaaagccgggcacaguguccgcggcaccuacuaaagccgggcacaguguccgaggcaccuacuaaagccgggcacaguguccgaggcaccuacuaaagccgggcacaguguccgcggcaccuacuaaagccgggcacaguguccgaggcaccuacuaaagccgggcacaguguccgaggcaccuacuaaagccgggcacaguguccgaggcacguacuaaagccgggcacaguguccgaggcaccuacuaaagccgggcacaguguccgcggcaccuacuaaagccgggcacaguguccgcggcaccuacuaaagccgggcacaguguccgcggcaccuacuaaagccgggcacaguguccgaggcaccuacuaaagccgggcacaguguccgcggcaccuacuaaagccgggcacaguguccgaggcaccuacuaaagccgggcacaguguccgcggcaccuacuaaagccgggcacaguguccgcggcaccuacuaaagccgggcacaguguccgcggcaccuacuaaagccgggcacaguguccgcggcaccuacuaaagccgggcgcaguguccgcggcaccuacuaaagccgggcacaguguccgaggcaccuacuaaagccgggcacaguguccgaggcaccuacuaaagccgggcacagugucugaggcaccuacuaaagcuguaggcuggagguucuugcacuugagauaagccccgauuacaaaauaacacucuguggaagguguuuuauauuugcagcuuaccugugaauauuccaaguaaagucacugcuauuugaagccaacccagcugcuuuccuuuaucagaaaagaauguuccccugugaagccuuuuuauacuguccuaacaacccaaauccaggaacacaaccccugcucccaacucaaauggacuuuuucacccagucaaaucaauguugguucugucuguccauuuucuuuacauuaggaaaugacauguagcccaaaggacaaauguuuuaggggauggauaccccauucuuguugaugugcuuguuucacauuacaugccuguaucaaaacaucuuauauagcccauaaauauauacaccuacuauguacccacaaaaauuacagaaaaaauagcaucugaaacaaauugccaaacuuaugcauaggauugagugaaguaaauuaauuuugagucucaaaauguugcugguguauuuaauuuuuaaaagagcuuaagauagugggcuuucagguuuacauuuuaguuuauugcuuucuuaaagcaguuaacuaucauuaaaagaugguugcacuuuaaaaguugauucgggagaguaguauuuauuguccaaaguuucauauucaucuuuaaaagauguacgucaaaguaauuuuuuucuuguuuuguuugauagaguucuaaauacaugaauauagcuuuaagagauggaccuuaaauugcaauuuaauuucagacucaauagacacacgauacucugcuaccauuuuggcaguguuauaagccuauugauuauuucugauauuaucagugagcagcuuuuguaguggucaaggugcuauauaaauauaaugauuucuuacugacuuucuguaaacuuacguguuuggacuggugaagauuuauuucuagaaauaaaauauucucauaugaagugugaacauuguauuuuuacaccuaguuuaugugaaaaauaucuguauuguguauuauaguuuugcagucacugaaaauaguguacugaauucagcuguuuucuucagguagcuauuccaugauaacugaguuugucaagcaacaauugaagauuugaauguuggacuaugaaaaugagguuucagcagucacagucaucacagggugagaauagauuagauaguguugccagguuuuagaagacagaguauuagaaccuaguaucaguaaggaggaacacaggaauauagagaagaccauuuuugaguuuuagauuuuauagaauuuuuagacaguuuugcagguauauaucaagagagggggagggaaaggaaugcguuugaauuuauucugcaggugccugcaguuauuaaugugcucuauaauugugucaugccagaaggugacuuaauuugaaaguaagcuaacauggaacagacuugacuaccugggggagcugcucuuagaagaaaagagauaaaguuuaauauaaacaguacaaaaucaccuauccaguggggaaauaacuuuugaguuuggagaacauuguaucuaaggaacaguugccaaagcagauauuacagugaaaggugagaucaauagacuuaacgugaccugaucuuauuaguugauaagaaaaaguuuuggaaguacauaaauacaaacacacauuuuuuaagggugaaacagaaauuauauuuuucauguuacuuuagguaaaacuguuuuguugggcuguacuacuaugaugaucaaauauaaccuuaauugaaaauuuuuauagagcuuauuuuuucagaaauauuuuaucccaguacauuuaggaaauuacaaaaaaaaauacaaaaaaaacaaaaaacuaggauccauacugggugcauuuuugugaauuaaaaccugaaauaauuguuuaauaguuuccauauuuguguuguauuuucuguguuuuguguggaguaucaauaaucaggccagguacgguggcucaugccuguaaucccagcacuuugggaggcugaggugggcggaucacuuaaggucaggaguucaagaccagccuggccaacauggugaaacccugucucuacuaaaaauacaaaaauuagccaggugugguggcaggcgccuguacucccagcuacuuggaaggcugaggcgggagaaucacuuaaaccugggaggcaaugagccagagaucgcaccacuuugcuccagccugggugacagagugagacugugucucaaaaacaaaugaagaaacaaaaagcaaugaucauacuauaaaaaaaucaaauacuaaaaaaaaaucccaguaaucaccuauuuuaaaaugcacuuuguaguuuucgcaucuuguucuugaucuuauuugacccucagagaaauacugugaauuagguaaaagaagucagagagcggcugggcacgguggcucaugccuguaaucccagcacuuugggaggcugaggcgcgcgggucacgaggucaggagauugagaccauccuggcuaacacgaugaaaccccaucucuaguaaaaauacaaaaaaaaaaaaaaaaaaaaauuagccgggcaugguggcgggcgccuguggucccagcuacucgggaggcugaggcaggacaauggcgugaacccgggagacagagcuugcagugagccaagauugcaccacugcacuccagccugggcgacagagcgagacuccaucucaaaaaaaaaaaaaaaaaaaaaaaggaaagucagagagcuuuugcauaacuggcccagagggugugguagauggagcuacacucagacuuuggagccugacuaauaacacaauuagagcaugagcaagaggaaggccaggggcagcuuugacaugggaagagagcuacuuacauacugaccgguaauugauaaugggaacaaacgaccugcccaaauuacuuuccaaaaagucucuguugggagacauuucaaguuuagaaaugaacaauuuugagaugaucugggcagauuugaaaucuugugaaaucccuucaaaauccgaaaaugagugugugagagcccagcguguguuuugugaagacuucucuugugugucuuguauugcuuagagggcaugauuugaugacauggucagaacauucugggcagaaucguuacaucaucaguucuugucauauuggcuccaaccuuauuuucuuacgguugcuuuucaguuuuaugaaacaauuuccuccaaacaccuuaucaguggcucaguauccgaaccuuuuacuccaaauacaguuucaaaagagauaugcucucugccuguuaacuauuucaguugagacccaaccuuacaucaauagaaugaaucucugcaacgguugguuucagcaagguggugagagggauuuugauggugagggacagcgaagcaggaaaggguauguucucaucacucaugaaaacuuacuucucagauagcguuugcucauaaccgcucgcuaauccaggcaguacuuauccagguucucuugcuaccuggauuuuuuaaggauaaaagucuaccaaaauuuuucaaagcaaauucuguaaucuacuagaagaauuuauuuuuuugaaggcaauaggugacucuuagcuagaaaauaaaaaguguuaacugucguuucuauuuacuuugggaagcauuuugccaaacaaaaaggccucuuuuaggugugggaaaugagugaugaguagcugacucaggagccgcagcuagccucucuuauauauagucuauguucagagugcggaaaaaagagaagaaacugcuuugugacaguuucccacgcacaagagauauuaaugaaauaaaauguuuuuaacucguguguauauauauauauaugagucccauguuaaaaaauauauauauauauauauauagagagagagagagagagagaguuauccuucucuuucuuaaaccacagugcuagaggcaaaaucuguccugguagucuguugaaugugugguugccuagacacacguuauaaauaauuauuuaauuaauuuuuaaaaauggaacuugagauuuuagcauuuugcuuauaacacauaaaauuugagaucugggaccucagaauuuucuucuguacuugcacacaugcuuucaaaugucauuaccuacuugaguccagcaucuggcaauucguuauacugagcagcuaauuuuucauugugguuccucugggucucagugcagagucauacaacacagcugacuacagaguagcgaccuggauucagaucagcugccaaauuaaguuuacaauucuguaacauucaggucuaauaagggaguuauauacaaaagagcauuuagucuuaguugauuuaguaguuugauguguaucuucguauuuuaacauauaacuaacgaagaaauaugcugaauauuauuuucuuuuaaaaaacauuuuaauuaucugaauaaucgaauucaucccuaugugagacuguaauuauauuaaacaguguaauauauguguuacauauauauauaguauauauguauaaaauauauauaguguaaauguuagagucaggcaaauuggguuuugauuucugcagaaauacuguuauuugggcaucuucuauguggcucaguuuccacauagguaaaaugaaaauucuaaaaauaacuucauagggccauuuuagaaauuaaauaaagucauaaauauacuauuaaugcauauuauaaaguguccaguaggugguauucuuauugcauuugauguaauuuauuuaugaauuugaagcuucaagcuuccuugaccguaacaaaugcauacauaacccagaauaugaacaauucacucuucaaaaguuuuacucacuugaaauaauauacuccacuuaugauaaugacuucauuuuagaaaucauauuacuugggauugguacccuuucuauuacaacaggagcccuagcuacucaaauagacuuacuuuccaguagaaaaauauauuuuuacaauccacauagaaucucauuugaacaacuagagcaauguccagaguccucacuucuuacuuaaaauaaaacuacagauacaguaagaucaaggaucauaccguaagaacaaaggcaaaaguuagguaguaaaggggaagagaagaacguuuuauuaauuuuuuuaacuaaagaaagccaccauaauugaaugucaacuuuagcugugacuuuucuggcagcuagaauaaaaguaagaucguugucugauagaacugaaugucucaguuuauuagaacaacaaaauacuguaaucuuucucaaaaccuacauggaacaaacuggaacaaguauuucaugaaaaccaaaugaaaaauaaguaaauaaaugauuucaucaccacugucaccaaaaacaaaugaauuuuuuggauaggaaaacauggcuaaguugguaauugacugagacauuggccugguguguuaucugugguuguauuuuauuaaacuuauauuuacagaaauggaaaaaaacuaacuuuucauacaguuugguguauucauagcaaaauaugaauagaaaucaccucuggaaucuugaugaacaaggccuuuagugguucauugguguagaaugaauaucaauuuagagaaauaggucuauaagucaggaagugaugcagaaaugucauaaggcuuauucauaaucacaacauuuuucagauauuuuccacguuaaaucugaaauuuuaauuucuuagauaaaaaucuguuauuuuugauuuuuuuuuacuuuuguuuugauuuguaaaauuucuauuucauuucucucuuuaaggguugagauuuuccuaagugugagaugucugccucuuucuuaauaaaagaggaucuacauguuucaaaaauacuuuuauucccaguauuucuguuuuuuguuuguuuguuuuuggagacagagucucguucugucacccaggcuagaguacaguggcacgaucuuggcugacugcagccucugcuucccagguucaagagauucucgugccucagccuccugaauagcugggauuacaggcaugugccaccacacuuagcuaauguuuguguuuuuacuagagacagggucuugccauguuguccaggcuggucugcaacuccugggcucaagugauccgcucgccucagccaccaugucuggccuguugccaguuuuuauucuuauuuuuaaacuucaucuuggaaauaaaacuaaaaaaaaaaaaaaaaaaaaaggcaguagcugcugaauucuuuuaggaacucuauggaguucagguucuuggucuauuuagccguaguggaauuuaugaaaaucuaaaacauuaaugaugccuaagaggcaggcugccucacugagaugaaugcuuugccuggccugauagcagaauuaaagaaaauugaaacuucagcguuuugaagaucacugggguaucauuugguauguauucagaauaguucaugaauaauguuuagauggaguccauauaaacccaauucauaguagaguggaaaaauuuuuauauacagaaaacugcuguagccagauaguaaaagaagauauauuuaacuguuuauaguaggcaacagaaggcaguguggaagaguccaaugaaaacaguguuaggagugcuucuugucccuuuuuacacaacuagaaaauauaaagcaaaaguaauuuuuauaacauaugccaaggaucuacucauaugguacauguuuuauaucugccauaacagacugacauagcaucuuucacugucaaauugaguuagcugugguacauaucauggaugguuucaaagcuauuuugccauuaauaaggcauuuacaaauacuauaauaagugcuuauaguauauacugccgguccuuucagauugcugcuuugcaugcaucaaauccuauuuauaaagugguauuauccaaagugaauagggaaaaugaucuagaaagucaggauuuuuuuuuuccacacucacaaguagaauccuucucucuagugaauugagucagcauuucagaauggaaaagucugaugugcaaauagcuagccccaagauaccuauaaaauggggucacucaaaaaggugaaaaguacaaugaauuuacauuuaaguguccuuggccucuuuuaggugugggaaaugagugaugaguagcugacucaggaacuauagcuaaccucuuuuauauauagucuauguuuagaguauaguaaaaagagaagaaacugcuuugugacaguuucccauguacaagagauauuaaugaaauaaaauguuuuuuuaacucauauauauauaugagucccauguuaaaauauauauauacacauauauguacauauauacguguauauauauguauauacacauauaugucucccaaguagcugggacuauagacauuugccaccaugcccaacaaagauugguuggcuuuuauucauuuuuuaaaaauaaggaaaaaauccccaccuuuuacaaaacguguagaauguuauuucuuucuaaucuuaacucucaaucucuuguguucuuaguccaucaaguaagaauucuuucuacaccaaacuuucaaaguaagauucaaaauaaucuugaaauaguuaaaacucuuuccaagaauuagaaugauuucauaacaaaacauuugauauaugggccaacaaauagaauagauuuagccaaagacugauuuuugaaaggaaaguucaggaaaccucccagaauauucauauauauaauguacaguauaacugauuaauggauaauuugggaaauuagaaacuuggggguuaagaucugugaagaccaacgucuuucuaauaggauuuccagaggcaggugauaguuaagauagagggguggaaauagucaaugaaaugauaaaaacauuauucacaaagcugaaaaaagccuuauaauucuucagauagaaagggcucacuauguguugaaucacaugauuuaaaaaagucaaaaacucaauuauuccuaguaaaauuuuagaacuccauagaaaauauauauauaccaacauauuccccuagagggaaaaaauaagugacaaaacaugcaggaacuggacuaaaaucacauuucucauaugcagcauuuaauucuagaagaucacggaacaguacuuucaaaguucugaaagauaaauaacuuugaauaagugcgauguggugcugagaagaauguauauucuguugauuuggggugcagaguucuguagaugucuauuagguccacuuggugcagagcugaguucaaguccuggauauguuuguuaacuuucugucucauugaucugucuaauguugacaguggggcguuaaugucucccauuauuauugugugggagucuaagucucuuuguaggucucuaaggacuuacuuuauuaaucugggugcuucuguauugggugcauauauauauuuaggauaguuagcucuucuuguugaacugaucccuuuaccauuauguaauggccuucuuugucucuuuugaucuuuguugcuuuaaagucuguuuuaucagagacuaggauugcaaccccugcuuuuuuuuuguuuuccauuugcuugguagaucuuccuccauaucuuuauuuugagccuauguaugucucucuguacaugagauaggucuccuaaauacagcacacugaugggucuugacucuuuauccaauuugccagucugugucuuuuaauuggagcauuuagcccauuuacauuuaagguuaauauuguuaugugugaauuugauccugucauuaugauguuagcugguuauuuugcucauuaguugaugcaguuucuuccuagcaucgauggucucaguaaagcacuccucagcaaauauaaaagaacauaaauuauaacaaacugucucucagaccauagugcaaucaaauuagaacucaggauuaagaaacucacucaaaaccgcucaacuacauggaaacugaacaaccuguuccugaaugacuacuggguacauaacgaaaugaaggcagaaauaaagauguucuuugaaacugaugagaacgaagacacaacaugccagaaucucugggacacauuuaaagcaguguguagagggaaauuuagagcauuaagugcccacaagagaaagcaggaaagaucuaaaauugacacccuaacaucacaauuaaaagaacuagagaagcaagagcaaacacauucaaaagcuagcagaaggcaagaaauaacuaagaucagagaagaacugaaggaaauagagacacaaaaaaaacccuucaaaaaucaaugaauccaggagccgguuuuuuggaaagaucaacaaaauugauagaccgcuagcaagacuaaugaagaauagagagaagaaucaaauagaugcaauaaaaaaugauaaaggggguaucaccacugaccccacagaaaugcaaacuaccaucagagaauacuauaaacaccucuaugcaaauaaacuagaaaaucuagaaaaaauggauaaauuccucgacagauacacucucccaagacuaaaccaggaagaaguugaaucucugaauagaccaauaacaggcucugaaauugaggcaauaauuaauagcuuaccaaccaaaaaaguucaggaccagauggauucacagcugaauucuaccagagguacaaagaggagcuguuaccauuccuucugaaacuauuccaaucaauagaaaaagagggaauccucccuaacucauuuuaugaggccaucaucauccugauaccaaagccuggcagagacacaacaaaaaaaagauaauuuuagaccaauauccaugaugaauauugaugcagaaauccucaauaaaauacuggcaaaccgaauccagcagcacaucaaaaagcuuauccacuacgaucaaguuggcuucaucccugggaugcaaggcugguucaacauacgcaaaucaauaaacauaauccaucauauaaacagaaccaaaggcaaaagccauaugauuaucucaauagaugcagaaaaggccuucgacaaaauucaucagcccuucaugcuaaaaauucucaauaaacuaggcauugaugugacguaucucuaaauaauaagaacuguuuaugacaaacccacagccaguaucauacugaaugggcaaaaacuggaagcauucccuuugaaaacuggcacaagacagggaugcccucucucaccacuccuguucaacauaguguuggaaauucuggccagggcaaucaggcaggagaaagaaagaaaggguauucaguuaggaaaagaggaagucaaauugucccuguuagcagaugacaugaguguauauuuagaaaaccccauugucucaguccaaaaucuccuuaagcucauaagcaacuucagcaaagucucaggauacaaaaucgaugugcaaaaaucacaagcauucuuauacuccaauaacagacaaacagagagccaaaucaugagugaucucccauucaaaauugcuucaaagagaauaaaauaccuaggaauccaacuuacaaggaaugugaaggaccuguucaaggcgaaccacaaaccacugcucaaugaaauaaaagaggacacaaacaaguggaagaacauuccaugcucauggauaggaagaaucaauaucaugaaaauggccauacagcccaagguaauuuguagauucaaugcuauugccaucaagcuaccaaugacuuucuucacagaauuggaaaaaacuacuuuaaaguucauauggaaccaaaaaagagcccuuauugccaagacaauccuaagccaaaagaacaaagcuggaggcaucaugcuaccugacuucaaacuauacuacaaggcuacaguaaccaaaacagcaugguccugguaccaaaacagagauauagaucaauggaacagaacagagcccucagaaagaauaccacacaucuacaaccaucugaucuuugacacaccugacaaaaacaagaaaugggggaaagauucccuauuuaauaaauguugcuggcaaaagugacuagccacauguagaaagcuaaaacuggauccuuuccuuacaccuuauacaaaaauuaauucaagauggauuaaagacuuaaauguuagaccuaaaaccacaaaaacccuagaagaaaaccuaggcaauaccauucaggaccuagggaggggcaaggacuucaugacuaaaacagcaaaagcaauggaaacaaaagccaaaguagacaaauggguucgaauuaaacuaaagagcuucugcauagcaaaagaaccuacuaucagagugaacaggcaaccuacagaaugggagaaaauuuuuacaaucuacucaucugacaaagggcugauauccagaaacuauaaagaacuuaaacaaauuuacaaaaaaaaaucaaacaaccucaucaaaaaguuggcaaaggauaugaacagacgcuucucaaaagaagacauuuaugcagccaacagacacauaaaaagugcucaucaucacuggccaucagagaaaugcaaaucaaaaccacaaugagauaccaucucacaccaguuagaauggcgaucauuaaaaagucaggaaacaacaggugcuggagaagauguggagaaauacgaacacuuuuacacuguuggugggacuguaaacuaguucaaccauuguggaagacagugugacuauuccucaaggaucuagaacuagaaauacuauuugacccagccaucccauuacuggguauauacccaaaggaguauaaaucaugcugcuauaaagacacaugcacacguauguuuauugcggcaguauucacaauagcaaagacuuggaaucaacccaaguguccauagacuggauuaagaaaauguggcacauauacgccauggaauacuaugcagccauaaaaaaugaugaguucauguccuuuguagggacauggaugaagcuggaaaccaucauucuuagcaaacuaccgcaaggacagaaaaucaaacaccacauguucucacucauaggugggaauugaacaaugagaacacuuggacacaggguggggaacaucacacaccagggccugucaugggguggggguagaggggagggauagcauuaggacauauaccuaauguaaaugaugaguuaaugggugcagcacaccaacauggcacauguauacauauguaacaaaccugcacguugugcacauguaccuuagaacuuaaaguauaauuuaaaaaaucauaacugcuuaaaacucacuguaguacacacuguccugcuggaauauugcagcugccucccguugcuuucguggugggcucaagugucgugacuauccaccgaaaacguugugugacgcucaucaggcaucucuacuugcacaguucgucucuccaguaaauugcacugaaguaaaaaguaauuucccucaaaaaaaaaaaaaaaaaccaaacaaagaaaauaacuuugaaccaaaaaucucauguagccaaaacuauuuguuaaguaagaaggcagugauagaaagauacucaaauaugcauggauauaagcuauuuuuuaucuaauuaucuaggcuucuuauaugaaauaauauauguaaggaguuucugcaaugaaaugguagaagaauccaagaaagaagauaaucugagauguaagaaagaauugcagguaaaguaaagaaaagcaaaaaaacgaaaaugaaaucugcuugacucuugggauauuuuguuucaaacaggagaaguugaauggcauaagauugcauuuccuccccuguggagcuguuccacaauacuuaguucuacagugaguaauagauauauaauuauaauauugugaaugcugccuguugacuaucugucuccaaaaaucaacugagaaagcacagaggacugggaucuauuuauggaauagaauuuaaugaauuaaaaauaaucacugacaguguaaaauaaugcuguaacaaaagucaagaaguaaauauaggaaugcaucguugaaaccuggccaggugugguggcacacuccuguaaucacagcacuuucggaagcucaggcgggcagauugcuugagcucaggaguucgagugcagccuggguaacacaaugauacccaucucaagaacaucaacaaaaaacaacuacucaggaggcugaggugugaggauugcuugagcccgggagguugaggcugcagugagccgagaucgugccacugcacuucauccuggucaacagagccagaccuugucuuaaaaaaagagaaagaaaccccagugguaucuaugagaaaaaugaaaaaacagaagauacucuuuagaaaauuuuaucacccaagauagaguguauuagggaaaggaaaauuuucaauacuuaaaaaaaugcauguauuacuuuccuaguuuuaagaaaagcuuaaacauuuaaaggguaauuuaaucaaugggggauuguuaaauuauauuuuuuucuaauaaugcagcagguaaaacaacugcaggagauuucuuuguguacugaaaucaaguuuuaagugaauacaguaaacuaagucacaguacgauacggauggcauggucuaauucaguguaaaaugcuuuuauguuuguauauauucauguggcaaaaagucuagaaggcuauucucacuucagcuuuuuaaaguucugugcauacuagagguuuacagggacuuuuaaaaugucauucaaaaguuacaauaauaaagauauuuugaaaaaugaguuuguuuaaagcccagaaacggggagggagugacuuacugagauuaaccaggaagcugguggcagaauuaggacuaaaauccagucugaagagauguuacaaagcccugggaaguuuuagcuuucccccuugaauuuccagcagcccuccuaagcuaccucuaguaauaacaguaauagaacaacaaccauaaguauguguuaaauuuaaugugaagugugaguaaaaauaucuuuaggagaaaaaagucuguguuccucauaucuugguuggaggcgauggucaggaaaggcuuaauaaagggaagguaucaguugagaaaagccuugagcagcaggcauaguuuuuuugauagacugagaugggaauggagcugcgaccaguuauaucggggaguaugagggaacacacacagagaaccugucugccaaaugaaguccuuucugcgccuacucauguuucuaugacaagaauuaauucacauagaauugacaaguggggggaugcuauugaguuaauguggucgucucuuugguuuauuaagugguuuuucuugauguauuaaugguuuucuucaucaagugguagcagcuaaacccaaagugcaguaaacgccagcacagcccagcaagguggaggaauggagaaacagugagcccgagaccucuugucucucgcuugguuuggccauaguauucccagucuuugugcauuuucagaauuuagauaccuuucuuacagccuucuuucaagcuacuuuaaccuuuaaauguaugguuggcugggcaugguggcucacaccuguagucccagcacuuugggaggcugagguggguagaucacuuuagccccagaguuugagacaagccugggcaacauagggagaugccgccucugcagaaaaauaaaaaaacuuugggaggccgagguggguggaucacgaggucaggagaucgagaccauccuggcuaacacagugaaacccugucucuacuaaaaauacaaaaaauuaaccaggcgugguggcaggccucuguagucccagcugcucaggaggcugaggcaggagaauggcgugaacccaggaggcagagcuugcagugagccgagaucgcaccacugcacuccagccugggcgacagagugagacuccaucucaaaaaauaaauaaauuaauuaauuaaauaaaaaaaguuagccagguguggugggaugugucuauaaucccagcuacugggaggcugaggcgggaggauugccugagcccaggagguugaggcugcagugagcuauuauugcgccacggcaugccagccucggcaacauugugagacccugucauucauuucauucauucauuuauccauaaauaaauaauuaaauguauacuuauuuaucauaauauuucuuuauuaagaauuaaaugucuuuuaaaaaucacgcuaguuuuaaaaguugggauucuuacuuuuuagggauuugguuauaauacuguauagaguuugaguguucugccuuaugagcccucaaguuauaauauuuuauauaccacauuuuucaggaauguauauauccaauuauaauaagucuuuacucuguagaguagugcuuucugugaugauggaaauguuuuauaucuuguuucuaguauuguagucauuagccauauguggcuguuuaaguucauuaaauuaaauaaaaaauucaguuucucaguugcacuagccauauuucaagugcccaguagccacucaguggcucaugauuuccauauuggacagcacagcuguagagagagcuuagagcuuguagggucagugaaccccuugaaaagaccccaagggcucuuuccccagcccuccccuuccuagaggagaggcuaggaauuugcucuagaagaaaaauucaaauagagguucuagcauaauguggggcaugcggaaugcugcggaggggaaggucuguuuugaguugguacuacugugagucugauacugccugugagcuggagguggcucaccauacaugucuuuuugucugucuaccuaccugucuaucuagacauccugcagagccugacuguugcccagcugagacccacaacuguguuuauuuuuauaguuagguauuccuaaccagauuauaaguaauuugagagucggguuguauuuuauaauucugcauucuccacaaugaauaacacuuuugcaacauauucaggaaggacguaauuaucuggcuagaagcugauguguuauuuauauuccaguagaaauugagacuaauucuucaauuuuggggcacuggaaugacuaaauauagggagguuaggugagaaacuaauguaggauuuaugacacuuuccaguuacaguggggaaagcgguauuaacuccugucuuuucuucuaugauuguauaucuucugccucaaccuuauacuuagaggcaggucuauuagugaaauguuugacuuuuaguuuuuacuaaguuaguagcucaaaggaccuccuaguuuugauacuaggagcauaggaaccuaaugcaaaguaaaacgugauuccauguuguaagauuugauuuaacgccacauuccacuuuucaguaaucugugcauuuucacaccuacuccugcuuucucuuuuugaacugaagcaaucucauggguaaugaccugauuuuccuucuucaguacagguuuuagucucucuauguugcuuuugaauugguuuaaagagauacauuuaaauauaauauauaauucuaguuccaaauuguguagucaaagagguuucuugucuaagcuguaacugauuuguauauauuauuuuuaaauuaacauuuacagugcaccaugguuuguuaugcuagguguuuagccuuucuugcaaguuaaaugcaauauucuauuauaugaaauauuuuaagauacuaaaauguaaacuacauaguggcauggauaggccaauagccaucacagugugaauugaaggagugcuucuccccuauacgguauauauucaucacagugugaauugaaggagugcuucuccucuauacgguguauauucaucacagugugaacugaaggagugcuucucuguacaguauauagucaucaugguguuaacggaaggaguacuucucugcaugguauauguucaucacagugugaauggaagaagugcuucuccucugugugguauauguucaucacaguaugaacugaaggagugcuucuccuccaugugguacauguucaucacagugugaguggaaggagcacuucuccucugguguauguucaucacagugugaauugaggagugcuucuccucugugugguauauguucaucacagugugaauugaaggagcgcuucuccucugugugguauauguucaucacagugugaauugaggagugcuucuccucugugugguauauauucaucacaguguggauugaaggagugcuucuccucugugugguauauguucaucacagugugaauugaaggagugcuucuccucugugugguauauguucaucacaguguggauugaaggagugcuucuccucugugugguauauguucaucacagugugaauugaaggagugcuucuccucugugugguauauguucaucacagugugaauugaaggagcguuucuccucugcgugguauauguucaucacagugugaauugaggagugcuucuccucugugugguauauguucaucacuguguggauugaaggagugcuucuccucugugugguauauguucaucacagugugaauugaaggagcguuucuccucugcgugguauauguucaucacagugugaauugaggagugcuucuccucugugugguauauguucaucacagugugaauugaaggagugcuucuccucugugugguauauguucaucacagugugaauugaggagugcuucuccucugugugguauauguucaucacagugugaauugaggagugcuucuccucugugugguauauguucaucacuguguggauugaaggagugcuucuccucugugugguauauguucaucacagugugaauugaggagugcuucuccucugugugguauauguucaucacaguguggauugaaggagugcuucuccucugugugguauauguucaucacagugugaauuggggagugcuucuccucugugugguauauguucaucacagugugaauuggggagcgcuucuccucugugugguauauguucaucacagugugaauugaggagcgcuucuccucugugugguauauauucaucacaguguggauugaaggagugcuucuccucugugugguauauguucaucacagugugaauugaaggagugcuucuccucugugugguauauguucaucacagugugaauugaaggagcguuucuccucuguguggaauauguucaucacaguguggauugaaggagugcuucuccucugugugguauauguucaucacagugugaauugaaggagugcuucuccccugugugguauauguucaucacagugugaauugaaggagcgcuucuccucugcgugguauauguucaucacagugugaauugaggagugcuucuccucugugugguauauguucaucacagugugaauugaggagugcuucuccucugugugguauauguucaucacagugugaauugaggagcgcuucuccccugugugguauauguucaucacagugugaauugaaggagcgcuucuucucugugugguauauauucaucacaguguggauugaaggagugcuucuccucuguguggaauauguucaucacugugugaauugaaggagugcuucuccucugugugguauauguucaucacaguguggauugaaggagugcuucuccucuguguggaauauguucaucacugugugaauugaaggagugcuucuccucugugugguauauguucaucacagugugaauugaggagcgcuucuccucugugugguauauguucaucacaguguggauugaaggagugcuucuccucucuguggaauauguucaucacugugugaauugaaggagugcuucuccucucugugguauaugguauauguucuuuccucugugugguauauguucuuuaaagggagcagccacuguuucccaccucauugaaauucacacugcauccagcacuacuggaaaaguaaugaaaaugcugggacuacagggcuuuauuuuacuguugagaauucuccgugguuacaguauuauguagugccuaauucuccuggugucgccuucguuuuaaauagugauuuuuauuuucaguccagugauccauuucauucauuaacccccuaaccacugaguaagcuucaugucacaaaagagcuuccauuggauuuauuacaaauauaaauauucuaauuauucccgaaucucaauguauguauucucauuugcauuaaaaacuauggcuuuuaaguuagacucggaaaggaucaaagugcugcaauaagagaauaaaugcugcgcuucuccuggacuguggucucaaguguuauaacuguugccauagcaaaauuaggcuaaauuuccuaaaaucuguucagugcucccaaggaaaaacucaacuggagcauaagaauuuucaucucacuuuuuccccuuuuguuugauuuccucuccuuaacauaaaauaaacauugguuguacccuuccuuuugaaaaauugauugcugugagaaguugacuuauauuggaucuugcauguaaugugugcagauuuguacccaaagcaguaauuaucauucaugccaugccuuuuuguaucaaguccuguuucugaugaacuggagccccauaugaguuaaagcaguuuugaaauguaagagauacuaucucuaggauauuaugaaauguuucgugauguuauuuugauauuucccuugcaguuuaaagaaaguaacuucuuuuuucugugugucaauuggaauguguguguacauuauagcaaugaccagaaaacaauuuuuaauauguaguuuauaguuacuauguagaaacuuuucugaauacuguaaaaaauuauuggugcauaaaauuuguuauauuacaugcuuuuauguauuauacucuuccauauaguggggauauauauuuacuuauuuuauuaaauagaucuauugcugaugcugauaucuacugcccagugacuacagaagcuccuuucuggacaacccguuuauuacacucuccauguauccacagcuauaucagaaaagcaggaaaccagagaaaauauaccuauuugaaaguggcaugucagcugggaugagagagaagaguaagaaugauggauaguuuuagagaauaagacugcuuucaggaaugaaugaagacaagcauccgagcacguccaaugccaugcuuagcaauaacccacacaacucacuggccaaaaguacacuaagucuguaaucggaaaaauucucuggaauaaaauagagacucauauggaaguauucaggugaaaauauacaucauaugauaaauaguucugucaaaguuaggaaacugaguaacugagagagauacuacugugagagaaauugauuugcugugauuugcuguacauauguaucagaacugcacuaugaaauaugguaaccaguagccacauuugacuacuuaaguaauuaaaaucaaauuaaaaauuaagucuuucucuugcacuaaacacauuucaacugcucaacagccacguguggccaguggcuaccauauuaaauggugcugauagaaaagauuguaucauugcagaaaguucuauaggacaguucugcucugggagaauuucuucucaaucaagagaggcacaaagauuaugauacuauucuuugacaaaaauaaguccaacaagcuaguucugacugugugcgacuguaguccuaguuacuuggaggcuuaggcaggaggauagcuugagcccaggaguucaggucuagccugugugguaccuuggacugauuauuggaucucuccagaguuggcaaugcacaagauaggacagcauucuagccuaacuccugguucucucuucccuuucccauuuuccuuacguugucauuuccuauguacuucuuuuaaaauuuauuuucgcuuauuuucuugaauguguuuaugcaaacuaaaucuuucuggugagcgauugcagauuaaagggaaauggccuauucuuucucuuucugccuuuguuucuuuacaugugaaaaaaagauugaugucauuuguuugagaauuaaugaauugaucacuuggagcaauuguaaacauguggagcauuauauacagaauagcauguaguucagaagaaaaccaggucauggcuuuaggaaaagucaugguuccuaaaaguucggugaauuaccagauuagaaaaucuucacacauucauuagaguagcauuuaaauacugugauauuaaacguugucauguguuuggauaaugugaaguuugugccucacuuuugggguccaccugcuuaacacuuggaaaaaucuugaaggcccagauuuuuagagcugaagguagauauaagucuguuuuagguuuaauguuuuaggaacacauuaaaauacuucuaguaucuugccauuuucugaauaccucaaaacgcuugaaaggcacgugcuaugauuugaauguuugucccuccaaaaugcguguugaaauuuaauugccacuauaucaguauuaacagguggaaacuuuaagaagugaugaggcuaugagaguuccacccucaugggugggauuggugucaauauaaaaggugaauucggcccccucuugcuguaucucgccccuugccuucugucacgagaugacgcagucagagguccuuugcuggauauuagcaccuucccagccuccagaacugugaacuguuuauccuaaauuacccagucugagguauuucauuauaacugcgaaaacagacuaugguagugcauaauuuaacuuugcaucaucucuauaagauggauaaagggcaauuguaaacuuuauccuucuauaaagagaguugcaaaauuuaaauuucaauaggauuaaguaaauuauuggcauuauuuuguucaauggcagguagacugaaacaauguaacaccuucuaucacaaacuuauucaauagguuauuacuaauuauuugauuuaaauagacacuaaucccuuuuuuuuaaaauuaguaagauaaauggauuucaaagaauuauugcaggaugauaagaugaggaacaaaaaccaaauguagaauuucucaagagaacgguaauguagaauuuuugaaggugagcaaagaaaauuuauuggauaauauucuaacauuauuuuuauaaugaauuuaauuuuaaaauaaaugaagaacuaauugaacauuuagaguaauagucauccuuagugaaugugaaacaaauaguguagcuuuauuuguggaaauuguuacagccccauuagguugcuauucauggucuaaaugaaguuaauuguagcuucgaaauuuguaugaaaauguaaaaaaaguuggcucaaaaauuccacuuuaucuauuuauucauuuuuaguuuugucaucccaaagauguuuugauuuuugucucaaagaucaugggaacuucuuaaagcaauggaaguaucuaaaaauaauauacauacuaaaaaaaagaaggcuucuuuuagaaaaaacauuauauuuagaugauggagguuuaauuuuuuucauaaagugauggugcugcuggaaacaccuuguuuucucugagaaacuuauacagaaaggaauagcaguagaauaaagauuuugaacuucuuaaccaaaggaaccuagauugucacuucagccaccauaaaauguaucuauuaauagauacuaaaaaguuauggcuguuuaggguuuuaugcugcugucagcuugaccuauaggcaauggaccaggaaagagaucaggucaagugccaucaacuguugcuaaaaauggcaacaaaguagaguggaaaucagaaccagauacuugauuuucuuaugccucaaaauguuggagccucggguaggaguaccacacaguccauuacucuaugaacuuuguguugucuuaaaaaggacacaaucccaagaguccuguaagauaacuuuuaaugauaaguaaacauggaagccaguugaauugcccugcuuuagggccuucugaaguaaacauugaaauaaggaaaugugaggccgggcgcaguggcucacgucugcaaucccaguacuuugggaggcugaggcagguggaucacucaaggucaggaguuucagaccagccuggccaacauggugaaaacccaucucuacuaaaaauacaaaaauuagccggucaugguagcaugcgccuguaaucccaacuacucgggagacugaggcaggagaauugccugaacccgggaggcggagguugcagucaguggagaucugccacugcacucuguaguuuggaguuugggugauggagugagacuuugucuccaaaaaaaaaaaaaaaaaaaaaaggaauaaaaauaaggaaaugugguguuagguaaauauaaauaacauagcauaugaugccaaaucuauuuuaugaaaauauuuaucacagauuuuuagagaucggugagaccuuaggaaauuauuugaauacuuauguguaaacuaauauuauuuucauuuuaugcauaaagguagaguggcuggagagguuaagugaucucuucaaguucaaacuguuaauaagauggcuaaaaggacccaguucuccagccuggaaucuuuaggacggaguuucauccaccacucaaaguugucuucuucuuccuucuuccuucuucuucuuucuucucuucuuuuuuuuugagauggagucucacucugucacccaggcuggagugcaguugugcaaucucagcucacugcaaccuccgccucccacguucaagugauucuccugccucagccuccugaguaguugggacuucaggcgcccgccaccacacccgguuaauuuuuuguauuuuuaauagagacaggguuucaccauguuagccaggauggucucgaucucuugaccucuugauucaccugccuuggccucccaaagugcugggauuacaggcgugagccgccgcacccggccaaaguugucuucuuuaauccuccugagggcgccccagugcaugagcugaaauuaaagcauaaacgggcagaacacaaagccagcacuucccaaaacagaaacuuaguuuucuaguagaagaaaaaguggaaaguacaucuaaccauguacugugauguguucucaugaaauuauugccccacuucaccucagggucuaccauuuuacuacaaaguauaugggacguuggacuugguuaauauucuucaugaucuaagacuguuugaaauguugagguuuagaauuuaauaugucaaaaaucacaagcauuuauuaaagauuaauuaucaauauuaaaauuagggagaauaaauaaccucaucuaauaaucucauaaugcuaaauaaauucaagaguagauuuugaaaccaaggaagaugaacuagaugauuuauaaggucuucuugagcuuuaaaguucauuaaugaagauuauuaaacacuuuugguuuuaauaucuuucauagaaaauauauuuaauucuguugccuucuuggaguacuugcauaucuccacuuuauucagagguuaguaugagauucuuauagcagaguuucucuuuauuccaaauguaaauuuaaaaaucaaaauaacaaagcuguaaaaagacuagaaaugguucuguuucccaguuccacucuaacccauauuugaaggaaaguggacgcaucaaaugugugugaucuuuauguguaaacacuaacacaaaugguggcagacgcugcagugacucgagugaagaaguuuuagucaguuaauggguuauauaaucagcaucaaaaaaucaauucuaggcaaacuauaccacuaacugaauguuuuauuuucuguaauuuauaauuauucuagcacagccauugaugaaaauauaucuuaggucucauguagauuaaauaaaucuguaguacauggccucaucuuuaacuugucuuuauguaaauuuaaaagaaugauauuuaacucaugcaaagugugcuuaguggaaaagaaaguccucugacauguuaauggaaugcugugaaaugcauuuauaauacauuuagaaauucgguaucaguaugaagcaacuaacaggggcuuucacaggucauuuaguuccucuucuucuucugucagcauaguguccaaaacauuuauggagguaaaaaugcuacacuuugaguucggguuuauagagcagguguguggaaguuuauuuuaggcaagaagaaacuucaaagaacagauugggagacagugugaaaaaaagcaaguaaacauauuauggaaaccgaucuugucaaaggugacuagaucauacauuggccuucauuauuggaaauaauuuggaaauuggauucauaaugaaguuuccaccauuuccaguuagaagagcaucuuacaucuuuuguauuguguucuuugagauacaucuagccuugcaaucuuguaauauuuaccgaaugcuacuauuuugcacacauuuuuaaaaaugaagaauauaguuguuacgaaucccuccgcaaaaccucugauuagauuuggcagaaaaauauggagagauugaacaaaagagauacuaggucugagauguauguauguuguagauccguaugguuuauucaggaacuucagcagaaugacucgaagaggaaaacaaagaaggagaugauuacagaugcuccagagacacugucuuuccguaacuucuguugucaccuguguuaagugugugcuggugcgggcucgcucuccugugcucuagcucucucacacacuugugcacaacuucugaaaagacugcuauguaguuauugucucuuccuucuccccuguuccucaccuuccauucucuuuucagcccauucuaaugggacuuucuuuucugacacuucauuacaguuguucuaauaagguuaccaaagaccuuuagucuugccaaaucuggugucuuuucuguuuuuuuuuuuuuuuuuuuuuuuuuuuuuuuuuuuugacuuuucagcagucuuccacauaacugaccccuaucuuggcuccuaguacucaacacucuucuuguuuuucccucuguuuagccauuucuuuucaacaucuuuugacggcuguugaugcucuguuuaaccuuuaaauacuggaauuaugaaaggcugaguccugagcuuucuucuccuuucuuucucguuaaauaaacccucuccuuaaaggauucuaauuuauuucuaugacuuuaaauacccucuuugaugccaauauacuaaaaaaaaaauuguaucuccagccuugauugcuauacugagcucccguucguauguccagccaucuacugguuucauccucacuuggauauuugaaaagcaucucaaacucaacauagccagagcagaacucuugauuccucggcucccucugccaccuuccuuuuucugcuucuguuuuucccaccucaauaauuacccccagucaagugcucaguacaaaaaucuagucauuacucuuaauuuuuuuucugucacuuacccccaucaccacugaauucauuagcaaguccuauuaacauuuucuuuaaaauaugucuaaagucuguuuccccugcuuucuuugccaccaguauagucuaacguaacaucauaucuugccugagcaaucauaguagucuuccuucuguccuuccuccuccuccuuccuuuccugcuccucuauauucuuucucaguggcgcccacaaugaccuuuuaaaauaugaauuagguaaucccugcaccuucccuuaaaaccuuccaucgacuuccauuacaccuagaauacagugugaaucccuuaugcuauuucaguacuaauauaucugccccuggguuuccucucugauguauugcuauacuuuggauacauccccuugaccacaccucagccacacuggcuuucuuucugucccuuuaaccuaccaaguucauuaucaaacagagcccuugcaguugcuaauuccugugcuuguacugcuucggucuucagggcacaguucaaaugccacaccccaccccagaaagguccucucugaccacucagucuaaaggagcuucccauuacaucuacuguaucauauucuccuuggaggauuuagcauuaucugaaguauuuuuguucacuuacuuguuuaucuguucaucgucucugagcuuuaugaggacagaguccuuuugccagucuuguucucucugguaggcaguguaugaaaaaagauaaaacagaacccccaaagaaaccuguguguagaaugaaagauucucagaagaaugcuuguaaauagaagaaucuaaauccucuuacagaugagaagucuugaaaaugaaaagaauccuucaguucuuuuuaguuuauaaacgaagcugauuuugaaaauaagccaaauugaaugcuaugaugugauuaaguucauccaaaugaaauuauagaauuuagcaauuccagcauauuguaauuacugaaguauuccguauuguaaaggaccauuuaguguacacaauuccagucagcugugcuugucagguaagggaagaguuaaugaagaaggaggaaaacagagaagggguaguaguccuacaaagugacucuaagguuaggucaaaucuuugugucccuucaauaccaauaguauagguauagguaccuucagcaccuauaguauagucguagguccauaagaaaagcaaggaguauuagguguccuuucuggugacacugacuccauuuucaguauauacauaagaugacaaaaugagcaaauacuuuguaaagugcuauaugccucccuaaagcaagagguccaggaacaagaaacuagaauuauggagauuggaaggugucugaauuuuacaggagacucaggcugccucuaucuuuuccaguucaguaguuacucccagucaggugcucaggaccaaaaucaaggcaucgcucuugauuaauucuuucugucauccccuaccaccauccccuucaucagcaaguccuguuagcauucugagaacaccuuccaucucuggcaacacugcugucuucuuggcucacugaaucaguugugaguggucauacaucuguggccccacggcuuccuuaugaccacuuuucuccucacccuggguacaggagacucucuuuccugaggagaccucuguuccccucccugucuugaaucaaaggaguugggcagauggguaaaagcucuuugcuggaaccuucaggaaggaaucuacaaauuacugaucucagaaacaggaaaugugugacaaugaaugucaagggcuaucuuuaugcuauaggaaauaaacuauuuaacuucaucuaucuucaugcuauagggaauaaacuaacuucauuggaaagauuuucauguauuagaugugaaauuacaauauuagagcacauacgauuuagcaucaaauguaccgugauuauuacuguaggacaacucugccccuucuaaaccgcauggugacccacucauuauauucuguauauuucuucaggagacaaugagaggccacugaaguaugauuguagaacauugaguucuuugcauccuucaguuuauauuaauguuuuaggucuaaacuuuucuuuuucccuaaauugaaaucaccuuugacuccuuugugaaaagaguaaugauaaaaguuuugacuucuucuuaucaaggaggauuucauaaauuaaggaaggauauauucaugaagaaucuacucuaugacaggagcucuugcugauaacuuuuauauauuuuauauaauucucaggaggaccuugugaguuaggucucacugugcuugcguguucaaaugaggcaauggaggcugugagaaauuaaguuacuuguuuaaguuuacacagcuaaugaggcacagaucggcucaaauccuguucuuauuucugaguucaguccauuuucuguaauauggaucucucugugcuuuguuccuugucgauaauaaaguccguaauaauaccuguaauaucuauuucuuagagcuaugauaaucagaugaaugugaacacaauaccuauacaaauuuccaguucuauuaugauuauuaguagcauucauuuaaccacauuaccaaaguguucuuuuaauucacuggcacuuuauacaggauuucugaauacaacaguggauauuuuaucuguuagacuccuuguaguuauguuuggguugcucugagaaugaguuuuacacccuuccaauuguuggcaaauagucauacugaagaaaaacugcccaucuguucagaugcuagccaaaacaucacaaacagucaaaauagcagauucaacccuaugugaauugugaugagacaauauaacaggauauaagucauacugucauggggucuuuggggugucacuuuucuggccggaaacaugugacugguggugcccuugccugaguuuugcuuggaccugcugggcuuguuccacccacucgcccuggcaggcugcgcucagcucaugcuaccagccuggaucccgugcuucaaagggagucuggagucaggcauggaguggugaggggugugugucagcaaacgugggguccgcccacugugcggucagacacaccagcugcugcuauggugugggcagcuccaggugcuggcgugagcaccagcucucugugaggcuguggcuggaccggguucacugcaagcggcuuucccgucuggcaccggggaauguggugacaucccggaaacuuggagaugccaggaaccacagggccccaaagaagggcucacagcccuggcucagggagcucccaggucugggcuacccgaaggguugcagcuccuuucuccuucucuuugcccacaacguggcgagcaaggggcauguuuuagcccuguuuguguuacaguagcucuuuuagccucaccauucgguggguccugaguucuuguccugugaccaggaagaaugagguaugcaauguggagggugagcaggaugaagaggagcuuuacugagcaauagaacaacucagagaaaacccacagugggcagguccucuccguagccaggaugucccaaugagcguucagcuccuuagcagagagacuugcuccccucugcugguaggucaucccaacgaguguucaguucucagcagagaggguagcuucucuguuuggcuaguuguuccguugucuccagcucuuggcagagaggaggcccuagaguaagagacuguucucugcaggcaggucgucccaucaucugcagcucuaggcagagaggguagcuccucucugcagcuggucgucccaucaucugucuguucucucagcagagaggaggccccagaguggguugcuccccucugcagcugguaguaccaucucugcagcucucagucuagagaggagacccuggaguggguagcuccucucugcagcugguugucccagucugcucagcucugacugagccuggggcauuuacaggccucagaggggaggaaguuugcacugauugguccauagguggccaugggugggccggaaaaggcaccacaaguuuccacuccaugccccggaacuggcagcccagcccccagccuucaggcccuuccuggcuugacaauggggccucacuggugaccaggccccauccgcccaggaaccugccugccuccugcugcuguucauggugcccggacucagcccugacuuugcucccaggucggagugggcaucgauagcagagagaagccaggcagcugaagcaggcauuucugagacugugagugcagucaggggccuuccugggccccccaaagugcagggaugucuggauccacagcugugguuuggucagcugcagcugugcccaggcagguggggcucccaccugcuucguggagcaggagucccaggucugcagccaugguuugggaggcugcaggugccugggucugcagcugcaugguggguuggggagagcauggcggguggggcggguggggucuucucccugcucuguggagugugcaggcccggccauuccuccucacugcagcuggugugaugguagcagugggucgucuggaauggccacuaccaucaauauccuagucaacagauguggaaggagguaguguccauuugggacaauuuaagauuuucaucaucuaaauuuaaggcugggcuuagaggaacguaaaugccaaaaaauugcguuuagauaucauuauauuugaaaucaaaugaacagcaauaaugaagcaguauauuucccugacacccucgugggacuugcaacagggguguucuguuuacucaccugcagcucucagcuccucacaggagggagugcaugagucaacaaggugggagguggaguacauggucgcuggagucagccagccacuacggcaccagcagugaaccccacucagucggaucugcugcguuccaccccucaugaaaggaggcaugcaggugugugagugcaggagccugggugaguguuuuuugguugcuggcaggagccaacucugugcuugccugcagcugcaucugggggcugggagugccugugaccacgaaagccccagagggaguguuacagugaccuuuuagcucugcucucugcagacggcuuaugcguuaacagcucaaugggcccucugccuuuucgcaugaggcagcugccuucugcuaacgagggcaaagggucagugugacaaccuuuuugucuucacacucauggcuccagaaucuugucuggcaucugggagaaaugaagucacacgaaugaauugaaggaugauaaaugcagggaguuuuauugccaauggaaguggcucucaguggcaaggugagcugaaaaggggauggggcaggaagguaaucuuccugugaaaugcggucaucucuggccagauucuucuccagaguuaccccgucaggcugucccucugaagucaagcugcuucucuccgacauccagcugcagucuuugauguccagcugcuucucuucucucugcuggcuggaucugggguuuuuauaggcacaggguggggugggauagggccacaggugguuuuggaaaaggcagcauucaagcagggaaacagggauguaaguucuacuuugggccaugguuugaggcuugaaggugggguuuuguuggggaccaccauuuucugccuagaauuucucugcccccugucccuaucaauaguuggaggggaaaaucaggaguuuuaguuaaauuaagcccaaccuauauaaaagagaggcuugacaacucccaggcauacagauaaagcuauuggugcucugugaaauggagaucuacaucccuggaaaggggacagaauugacaacguuggucauuuccuuaccacaguauccuguauuuuccagaagcaugugauugucuugcuaugauauuccugaauguuacugguuuccucuuuuucuaaagcauguuuguugugugcagaacuaguauagcuucaggcuuuuggcuaagauacccgugaguauuauugcuuuuuuguuuuguuaaauaauuuuuauugaacacacacaaaauaccuuaaauauaagguacaaauaacaguaaacaaacaacuugcauagcagucagccagucuuaagaaauacaguguugccacuacuuuuuuuuuuuuuugagacggagucucgcucugucacccaggcuggagugcaguggcgccaucucgguuuacugcaagcuccgucuccuggguucaggccauucuccugccucagccuccagaguagcugggacuacagccgcccgccacccccuggcuaauuuuuuguauuuuuaguagagacgggguuucaccguguuagccaggauggucucgaucuccugaccucgugauccgccugccucggccucccaaagugcugggauuacaggcgugagccaccgcgcccggccuguugccacuacuuuuaaagcugcacaacugcuucucucucuuaucucccucuccaccccacgaaauaaucacuaucuugaaucuuauguuccuuucacuggcuuuuuuuuuaacagguuuucuuguauguauugaaaucaguuuuuuauguguuauaauuugguauguuuuuaacuuuacucaugucagaguguacguauucuugucuacuuucuuuuuuugaccuaguauucugagauuuauucgugauggucauguaacugcaacucauucaguuuuaucgcuguauuguuuucuaugaauguaccauaguuuauuuauuuucuguuuuuaacuguuacacauaucauugccaugaacauucauguauuuaucuuccauugaacauguacaggaguuuuucuuggauauauaacuuguaauggaauuguugggccaugaguaugcuuauugcaacuucacuagauaaugucaaauuguuucugaaaguugacuucauucguacugaaccaucuucaccagcauuugacauugugggauuuaaaaacuguugccaauuuuuacauuagcacuuuaauuacaauuauauuuaucauuucuagaugguauuuuuuuuccuagcuagacauuaaaaaauuuucuuuauccuuccucauauuuucaaucucuuauuccuuuaaacaucuuaaacauauuuacuuuaaauucugauaauaccaaauuagaaacucuuugugaguugauucagcaauauaauacuucugcugagucuuguucacugaucuuuguuucuuuguuuucuuugugagaauuuuuaguuuauuuauauuuugagacagggucuuggucuauuacccaggcuggagugcaguuguacaaucucggcucagugcaaccucugccucccgggcucgagcgauccucccaucccagccuuccaaguagcugggaccauaggcacacaucaccacgcccaguuaauuuuucguagagacagggucucccuacguuacccuggcuugugauuuuguuuuuuaagcuguaaguucacacucuuuagaaauucuuugaggccuggauugaagguguauucacccugagugaauuugccuuuuguuuugauggauaacuaaggcauuaacaaccuuggauccugcucagguuaauuucugggcuugagguuucuucucccacaaagauaauauaaauuuaggcuacaagcuugguuagaugccaacuucugcuuaugagucuagaaaaaaauuaucccccucuguccaguauuuagggucuagauugagaacuucuuugcucucccuuguguggaauagauuuuuuguaauuuacagugauucuaacucacagcauauaguccuuggaaaauccuaggucuguucaggaguuugguuuuagacuuuccagucuggaugaggcccacacacagccuccagugcuuugugcccacgucuccgucaaggggaaaguucaggauccucagguuagcuaaauguuucuagugagaaagcuagcuucagaguuuacuuacuggccugguaucuuuacuugacuguaauacucuaaggauauuucuuucuuaucacuuaaaucaugaauuuuauuuuaauguucucuuuuuaaauacaacuucuuuuaugccuuuauuuuucuucauuuuuuauuauauuuucaauaaugcagaaaaggugaaggaauacaaccagaaauuuagcaccuagauucaucaauuguuagcauucuaaaaacaaagacguucucuuuuauaacaaugccauagcacgucuuagacaauuaguaacaauucucuaauauuuucuguaauaccuaauccauaucagauuuucccacuuguuccuagguaucuuuuuugcauauuuuuccccaaaugaggguacaaacaauguacugaugcauuuagaagauauuugucagugcgucuaucuggguuguuggggucaccauauuguccaauauggagauguauuuuauuguuuggcauuuuccugaagucugcuuaugaguuuuuuuuuuuuuuugaaauggagucuuacucuacugcccaggcaggagugccauggcgcuaucucggcucacugcaaccucugccucccggguucaagcgauucuccugccucagccuccugaguagcugggauugcaggugugcaccaucacgcuuggcuaauuuuguauuuuuaguagagacgggguuucaccauguuggccaggcuggucuugaacugcugaccucaugaccugccccuguuggccucccaaagugcugggauuacaagugugagccaccgugcccggccuugaguuuguuuuucacauuaguccagagugcuccaucuuucgcucucuauucgguuuccuugugaguuauugacuguuagaguauacaauagaaaaaauauuuuuaugucccuuuuaaggaauuauaccuuucaaguggaagauacacacugacuuuccuccaaauaguuacacauuuuagauuuuugucgugucaguggacucaucucaggcaggauuacaccccagggcuuccuuuaaaaaaggaaagugacauuggcuuuacguaacagaagcaguuuggacauuucuuuggacaguugaguuccgcuggccccuuucuguggcaugcugcugcucagcccagcugcaugaagacaggacagagaacgauggccacugagagugauccaaaguacucugugggagaaggcagauggauaaauauuuuuucuuaaaugcaaagcuaacuuaauguuacugcccauuacugguaacuuucuuuagggcuuaagacuugaagaauuuaauguugccugacaaaguuuuaagauggcucagcauuaaaaaaaaauggugucuuugaacaguaaugagcgccaaguaagaaauaugggugugcugacucuuuuugaugaucucaaaguuauuuauuuaacuacaugcaugaagccccagcguguguguguuuuucuuugucacugacuucacagcagcucaguaggauuuuaaauauguauauuuuauauuuuccugcaccugccccaugacaauauacauagaccaugcaaacaaagauguauuuagugaagagauugcgaaacuguuuuauuacuguccggaucuccauuggaagugaagcugcuguuucacauccucuuuaggcauaucuagccgccagcaacugugcagauuagaaucaugagcuucucuuccacaugcguguggccauuguggugaugaccgaugaaucaucgcauuucaacuggaaugaacaaaaauagaaagcucagcagcagcauuuuuuagagagguaaaaaucugcauaaauaaagaaaauuaaguguuuccaugaauuuuaccuacuagaaaguggaaaaauguauuugauaauagagcauauauauaaguuuuauaguacugcuaacauaaacaugaguggauaauuuuggggcucagcaaguuuagcugcaaaauggcuuugcuauucuccauuccucuuuguuuuaaugaucauuccuccauauucagaagauucuguuucuugauuuuuaggacuguuccuaaauauuccgguagcugucuuuggaagacugaaaaaauauuuucucuuguccuuauagaaaaugcuggauagggcagaaccuucucucuuccugaaagaggccacugaucuaaauugguuucucucuuagccuuacuucuuggaggcauacuuauuauguauuuacuuacuuuggcaugcuauuuuaaaaauuccuugguuuuuauuuuaaacaauuccuucauauauuucacuuaaauaaaugagcugauacuaugagcuucaacauauugguuucaaaacucaucucuuugucuuuuuuccuuuguuuuaccucauauacaguuaauugacaguucuguucauuuuuccuuugagauaucuugccaugcuugguuuaccauuccagcacagaguacacaacucauagcuggauugcuaugacauuugucuccucuuugguuaucuugcauucuuuuaccaaauaaagcuuucacaaauguauuaucucccuaccauuuugugaccugggaugugaaaucuaaucucugacuggauuucuagacuccucucuugucuuuuucaaccuuaucauccacaacuugccauuguaaagaccaaguuccaguguuccauuagaucaauaccaccauuucuguaaacaaacagaugcaaacauuaagaaccacagucuggcuaauucuggaacaguaccuaaaauauuaaaccaugaccaucuuuugccuguugguguuagaagggagcuuuugguguuacgagagagucaccaaagaggacagguuauggaagcuagcucugcagagcucuugauagcaggaguucacagagauuauaaacuaggaaauucaaggugcuucagaaagguucuucuugaaggaagagaaagaacuguguucaaugagagaaagcagcagaaaagcacacuaaguucguucuuuauaggcaaguuuaaaacugggauuuacucaauggccgauggccauuacagaugcuaagauauucucagggaccaugagaagaucaucaugcugaagugagaauggagccagggaggggagcaucagagugggacugguuuugaccuuugaacagggccacuguccuggcguggaagugcaguagacagggcagguugggugaacaaaccagguagcugaguguuccccugcccuuguucuagcaaacuugggugugcagggccugagaauguucuguugacuucugcugcucuguuuugcucauguuauuccuuugcaaugggugccuuucuccuauccauuuucucaaagaucauaugugcuauaaugguggaaacacggacuuaggagauaaccugacucaaaacucacuggaguuuugucuucuugcggaugagcuggacccuagccaauguacuucaccauuccaaaucuucaguuuccuccuuugauaaugcagguauuaacauacaugcugcuguguaagcauuggaaagucuggcccuugguguuuggguuuagaaaagugcuuuugucagcauccauagucacagguaacugacaaaaagagcaugugauauccuguguaucugugucgacaucauaugagauugaggaagguugaaagaauacuaauuucccuugacagaauucuuuuaauuuuauucauuucucugcauccuucacucuuuaguuuaucugaugguagaggguuagcaguuguagacagugucaucaccugcccuggaugauacuagagcuccuuuuguagacagacuauauauucugacaccagagaaaugcuguaccugaaggccccauaucuucuggaaggacacugaagggagagcaaguuacugaaauccauuucucauaacccaagaacguccugucuacauuuguaugccuugugcuugguacauauuuguuguuuagauuaacuuaaauuuuaugcuuucauuacagcuauucucuguggaaaauauuaaccaaauuuauuagaucuuuauggaaaugaaaaacugcuggucuaaaaaugcuugggaaacuuaagaguacuaucauucaacuuggcaguacuugauaccagugaggguugaaguucuaaguugaaauaaaacagaucgguuaauaggaagucaaaugagacugauagauuuuauuuguugggacauuuuucggugaccaaauaugcaguagacagucaauacaaaaaaccuagaaacgcauagaaaaaauaaagagaggaaaauaaaaaucaccaaaaaucauuagcauuuucauuuguuccacuauuuuaucuaugcauuuauguauuggcugcuuuuauguuuuuccuguuaacauuauaggaauuauuuccuuucauaaaauauucuugaauacccuaaugguacucauuuaucauauaauuauuaccauuaugcauuuaaucauucuucuaauauugaacauuuuaguauuuauuauuuuaaauguagcagaaauaaauaucuuuuguuggcaucuuuauuuccuugaaauaauugacuagauauacaauuacugugucagcauuuuaaauuugcauauuuaaaaguuuuguugcauauugcuaacuaucuuugaaaaaguugauuuaguuuaccagcccugugucuuuucuggcacaugaugcauuuuuaugucgcuacauccuuaccaguauugaguguuuuaaaaaaauaaaagcuuuugauuccgauuuacucauuuugucuguuguagauauaauccaccuuaaguggaauauuuguuguuacuaaauacuugagugauuaucugagguaauauguauucuucuguauuuauuuaugugacuuuuuuuuuuuuuaccacaaucuuguacagggauuacauuuuacucaucuuuaugcuacccauagaauuuuuacacaguagauauucaauaaacaugaaaaauaaauaucacacaauauccaccuuguuggauuccaccacuuacuaacauaucugcacguauauacuucaagcaaguaucaaguuucuuuauuggaagaugucauguaaaguucccaagucucauuuuugguuuuauaugaagaaucuauucauugguaggacauauugauaaaaauuacuaccucuucccccuuuuauuugucucccucuuguguacuuucucugccuuuuuccuaagguaaauauugguauugucuauaugcuuucaucacagguacaauuaauuuaguagaaacauugcccaucugaaagaauuauauauugugguaucaguggagagauguuuauuuuuuuuuaacauuuuguuguuauugguuaauaagaacaugaccaagacaagagcuuuaacagagaugugagauguguauucaaccagucucugaaaaucauuugcuuuuuguguuuuauggcaguaccuuguggaucugcauuuagaaugauaauucaugcuaacgacuuucauaucccaugagguagcagaaaucaaugcuaaaauggcagaaugaaacgguauagcaaauaaagucaaugagcugucaaagaauuuuucuucaucaaacaaaucccaaagcacugguguuauacugaccuucccucacuccucuuuccuggauucuuagaccaauuugguucaugauuuuuuuuuccuauaauagaaaaauuaacaaacauguuuggucagugaaacagaagguauuugaaaaugauaccuuggagcagugucucaaucuucaggaaaauggugaagaggaaauacagcauugauugcuguugcuaagcaacggcuuucacagcagacgcgccugggacagugguggugucugccagcacaccaugcggggccgaaagcagugcagcacucauguuucugcgaaaucagaauugaagcccugcauuuccuccuuccucucgacuuucucugaucaauaccugagaaguuaagaucguacggucaaauauauagacugugagaaauuuggagcaccuuggggauuuuuggagagcugcgaauggauuuguagagccaauucuguuuuuuuuguuuuuguuuuuuuuuuuuuaguuucgcccuuguugcccaggcuggagugcaguggcacaaugucggcucacugcaaccuccgcuucccggguucaagugauucuccugccucagccuccugaguagcugagauuacaggugcccgcaaccacgcccagcuaauuuuugcauuuuuaguagagacgggguuucgccauguuggugaggcuggucuugaacuccugaccucaggugaaccacccaccucggccucccaaagugcuguagagccaauucuaaaggaaucagaauuccuauuuuauaucagaaguacuguuaguuuucuccuucaugcauuuauccauccagucaugccuauguucucacauauuuagggaauauucaaggcacccuguuacacuuaagagcuuggcaucucuuacguugcugacaugugcacuaugcgugugaugguaggcaccauugcugcagggugguguaauggagagcauccucuuaggacugugacucucaaacuuuagggcacauuggaauauccugggcagaucauuaaaagcuuucucagccccacacuuggugaggucuguuaccuauuuccagaccucuggaauauguccuguuaccugaggucuggaaaguaacuuaggaauaugcauuuuaaacaggcucucuaggugauucugauauugguaguagaagagccauucuugagaaauacugaagucgaagaauuagugaagauuugacagaguuaccagauaagaugucauuugucaguuguaauucaugaacggggaggcuacuaacuguaguuuuaccuguucagucuguucccucccagguugccucuccuguguuuccaucuuggacuugcucuugauucacuagagucagacuaauuugaguucuuuccagaaacuggaaugugauuauuccuuaguggggagggguagccccccaucacugcuugggacucaugcaagagcaagaaaugcaaguauacaaaaguacccaagucuugaucucaguguucugcaguacaaaccacuaagacggaaauuucaaacugccuuucacugaaaacaaaaagcaaaagaacaaggaaacaucuaaaucaaccaguuaccuuuuuuuuuuuuuaccccaaugcugauaauauuucaguggucugucaguuaugaaucugaccaguccuuuaauaaaaucuucuaugcuuauaaagcuuaagugauuuuugcuuauacagucuucuaauagauaacucuuuuuuucccccucuuguuauauauacccugaaucccaguuuuggucuuaaugcagaccauguuuaagaucuuggccuuaugccauuuuguaguacagauaaauaauuaaugguuuuuauuaguuuguauaauucauuaaccauucaucuaucaagcugaaugacuuauagauggcuuuuacauuucaaauuguucagaaguuauuaaggucuguaauuuaucaucacagccauuucugaccucguucuuggucccucacuggaaugauguucauugaauguguaugacacaauaugaagaaaauuaaguugcacuaaagacauuaccaauaugaguagggaggcuuaaaauguuggcaguaaucaauagugggacuuaauuuguauauucugugauggagacauuuuuauuacauuuauauuuuuaaaauugauuccauuuuuaaauuaguugcccucauuucagacuauacucaacagcgaaauaauauauuuucugaaucuaaaucaucauauauuauuugaccuuuagcugaauccaguaguaaagaucaaaaugaauuaugcuugaguggaaagagguuuuaauguugcuuuacacuugguuuucccccauuccacaugcuguuuaauauuauugauucagcuugaaugaucaugagcccaaaaacuacuuuaguugguuuuggcuaaugcauucuuggaugcuauggaagugccuguaacaccugaaugguucugcguaaauagucacgcauuuuuauaccguccacgagaggacaugcaacgugauugccuaugagcagcagagaacaguuuucuagacguauguuuuucccuugguacaaacauguagcuuccguuagcccuaauaggagcugcguguuugcaucuaagaauucaguauuuagaauaugacaagcagugaguauuugaggaguuauuacugaaccuuucaaauaaguugaaaggcagacaugauuuugaguacuggggaaguguauuaaucccuuagaagugaacuauucagaauauuuaacucuauuaucaugaaguguuagugaguagggaacuauccacaugucuagauuccuuucagcuuaauagugucuccauacauuuuacagucauaucagcuccucguaaugcacuucaccacgugaagugaaugaaauagccucagucuuguucacaaugacugggccuuucaaacucuccuuauuuaauuugcuggcauuaugauggcucuugcaggaccucuguugcagaaucaaaaugugcaugcagagagacagcugugcuuugauuuagccuaugagauaauaacuaucauucuaaaauugucuuacaucauauagacacaaauuucaaaucucaccuauuuucccagcucucucuucagauaugacuuugcuagaaugaggcauauucuuccuugucacucuucauuuuuaaaaaaauuuugagaauguagauuuacuucuacucuggcaguuugcacaucuugguuaacuagaccaauuaaugcaaaagaauaacccccaaauuuacugcuccccagguuauuguccagucccugucucuuauuaaugugauuccugugaaaacuugagauugaagaauauagugaaaaaguaccaucuaccccaaaagcaaaucuaaaaugagaaaacuuucuuaagcaaauucuccccuaccaggcacaugugauuuauuuuucuuccuuccacuuagaauugaaaaaacaugauucauaucccaucguuguuauaauuuuguagacuucagagcuuuucuuuuuucuuuucuguuuuaguuaaguuguacguuucuuuguauguccuuuugucuuuuacuguuuguaaguguccuugauagauauuaccauaauggcccuuuccuuuagcuuauacuccuauguuaugauuuguuuuccacaucaccuuuauuuaguaacucccaguccauugaccuuuuucacuccuuaugcuguauuuagauggaaauaagaugacacguaccaguuccaucuuggagcgcuaagagaucuucaggcucacaaacuaagauuaaccuacuaacaugggccacugauaacgaugaaaacguggaaggagaggcaguguaaguaaaagagaaaccugcauccagacaauaaguaaugaggaucugauggugauaaagaugaauuuaaaagacaggaguaaacauaugaaugaccuacacacaagaauucagauuuucugauguuuuaugugugguacagccuauucauagagaauaggugugucaaauaacacauauuuaauuuuuauauccaauauccaguaucuuuauagaagugacuacucauuauuauguucauuuuagguaaucugaaguccuaaaaccugccuuauacguuuggcauagaauuguguucccugguaaugcccacuaaugaaauguuuagggaacucaacuguguuccuucagaagcuucugagucugccaucacuuucggugaaucagugcuucugaaaagugaauucaauaauuaauacgaguuauuuuucugugaauuuagcuuuuuacaguuguuaaaucagcugagcuguuauacaguuuauaaaacuauauuaaaauuuaauaugauuacucuaaaguggcuaagguuuuaaaguuuucccaacuuuuucagagcuuuauuaaagcauuaaauauaaagugcucucuuagccacaguaugacuaguuauuuauugguuagaaugacaaaucuacuugucugagaagaugcugaguuagaaguucuguucagacaguccccaaauugccuuuaugcagcacaguggauaaaaaucugaaaacagaauugguuauugauuuuuguuuugcauugguagcaagagaagaauaauacuguaacuuuuuuuucaagcauacaaguucuguacauaauuuuucucugucauuuuuguguggcuuuugguaccacuagaacauuccauaugacccuaacucuauuucuuauauuucugugagauucuuugagucuaaauaccucuuuauuacaaguuucuuuacccaugggauuccuguugcuuuuacuuaagagauagcccagaacuccucuuacauucuuuucagaaguguucauguugguuuaugguagaauagauuucaauguagguuucccuuccuuccuuccuuccccauuuugauguuuaguuauaugucaucuggauuaauuuguuuuucuuuuuuuaaauuuauuuuaggcuuaaguuguaucuagauuuuuauaaaauacauuuuaagacuacucuuuuuucccuaguauuuccacaucuaauugaaguuguccuaaaaacaguggaggaauauuauuuuauucaauauuuucuauagaaagcccgauccuugccacacaugcagcaucagggaaagccucagcugagacguggaaauugaagacagcaugauggguaauucaucacaccagugaauuuaguauuuguucacccuuuuauaggcuuuaauauugugauccccacuuuacauaugaggaagugaagauuuagaaaaguuuaguaacuugccuuaagaguguagcagaacugggaaguuugcucuuguuguuguugucuuuguuguuuuuugagguggcaucucucucugucacccaggcuggagugcaguggcacgaucucagcucaaugcaaccucgccuccuggguucaagcgauucuccugccucagcuucccgaguagcugggacuacaggcgcucgccaccaugcccagcuaauuuuuguauuuuuaguagagacgggguuucaccauauuggccagacuggucucaaacuccugaccucacgaucugucugccuuggccucccaaagugcugggauuccaggcgugagccaccacgcugggccggaacugggaacuuuuaaucuaguccugucuaauuccuguuaugccuggauugaacaaaagcagagauguaugagagugaacacugucccucauauugugcuuuuccuguggcgaguuguggcuagacugcgcaugacuguacuggauauuucaugggaaaggacuccaggagggagaccaugcccacauuuauagugaaagaaaagaggguuuggagcacuucauuggaacacuggaagcuuccuggucaagaaaauaacuuuguuagaaagagaugacaccuaaguauuuucuugagcuaauuugugauagcugaacuguaucuccuuguaaggaccacccuagguuucugucuucuuacgucuaaauuccaugccuccuuuuaaguacaaaacuucuuuuauugucaucuucauagacuccacccuucuggaguaauuuugacaguucauaagugaagugacagaugagaagaggcuaaauucaguguaguucggaguggguucaaaggaacccccuccgcagagcagcacacugguaucucaggaauuaagucuggcucucaggcuaacagauguaaaagauaguucuggccugauguauuucuccugcaaaugaaguuauguuagaauaguuuaaaaauuaaaagccaggagauucugagucaaggccugaagaguuugcuuaugagugaaauuaaugaaugaacauuaaucaccuauuuugacaauucauagaauuuuuuucuuaccuucugaugauugacuguguucuaaaauguuaagcaugcagauaaauggaccuuuuggguaaaugacagaaugauaucagcauuugucucuuuggaagcucaauugugccauuugaaggaaaaguggggauuuuaagcugucgugccauguaagaguauauaugugacaugaugguccagaaucuugcuaaaccagugaagcaaauagguaaauuaaguggugagcuuugacaaagguaagauucuuugauuuaucauuccuccauuucauuggguuguucuaaagaaagaguuaagccaauuuauuuaguaaucauuuacugagcccacauucuaugcuggacacagugcucagcacuggaaauauagagacacaggaucugcuuucaaggagcucacacuugagaagggaagcauggcagguaagauaugggggcuucagcauuagcuguuuaaguggggucugggaaaaggaauugguacaaagaagccuguuuucauuaaugugaggaugagugacaggucaggaaauggggaaaguaaauuuaagagauuauagggaaaaaauaggggaaaaauagauuauaaaccuauuuuauuuggcccacuuacaguuuuuggggggaguuucuguuuuuauuaucagcauauaaaacuugggaaauuacauauaaauauauuucuggguucucuuacaaaacacaguagauacccugggcucuguuuucacaccugacugaaguuagcuggcaauggauagugaucuccaccuuuagcaggcacugguacucucuuguucuccauccgguccacuuaggauucuccuggcuccucuauauuugaguuugagacuucuaguuuaggguauuuucacaucuuggcagugaugggaagcagcuagauaggacagggggaagaucuggacuaggaguggguuguuggugcauuaaauaugaaaaagauuugaggauguuauugacugagguagaagagccaggagcaagugagaaacccaggagaaggagaguguguucugggcugaacuguguccccgcaaauucauauguugauguucuaaccaccgguacuucagaaugugaccauauuuggagagaaggucuuugaagaggugauuuaacaugaggccuuuaggguugacccuaguccaguaugacugguguccuuguaggaagaggaagagacaccaacagcacaugugcgcagagggacugccgugucaggaggcagcaagacaguggcuccuccagccagagagggcucggaggaaaccaaaccuauagauacuuucaucuugaacuuccagacuccagaacugugagaaucaguugcuguuguuucagccaccagucuguaguauucuguuauggcagcucuagcgaacaaccauggggaggugcuggcguccagaagcgggagagaauugauggagcagagauugugucugaugguggcugaacaaauccccaauaucuugcacacaucuggauuaaagcucuguggauauuuauugaauuaauuucacugaaggaccagugagagggaaacaaagcccuggggucagagggauuugcuguggaccagggaaggaaacuggagaaaguucuuaagucuccagccuuuauuuucuuuuucuuuuucuuuucuuuuauuuuuugagacggagucuugcucuggagugcaguggugcgaucucagcucagugcaaccucacccucccagguugaagugauucuccugucucagccuccugaguagcugggauuauaggcgcccaccaccacgaccagcuaaauuuuguauuuuuaguagagacggguuuucccauauuggccaggcuggucucgaacuccugaccucaagugauccacuaucuuggccucccaaagugcugggauuaaagcgugagccaccucacccagccuccagacuuuauuuucugggcgaagagguggaggagugauuggguuggauuuguuacugugguaucaccauauucucucacuagccauggaggcuuuaggcuuaugcauaagcagguaucauaauguauugaauggaaaaggauuuggaguauauuuuguuagcuagcgugauaccaggaaguccuuguugucaagaacuguuguuuucaaggaggaauugcauuucugagacugugcguggauuuaauacgucacauuucgaugauuugagggagauggugauggguuggggaacugaggaaagggagaagucucuggaaaagccucugaggaaagggggaaggaguugacucgguuccagcugaauucuugcaggcagagucaaggcccagccugggguuugcaguagcaggaguccucugacuugguuggaaaaagaacuugggcuaagagauuggaaagcuucauaggccaaugauagggcggucagauaugaaaaauguaaagguggucauguagaaaugagaaaggaucaaauguguucaaauuuauuuaugagaaaaauggauuuuuaaggcaguguuucaggaacuacaguacuaaauaaaaggacugauauguauaugucacuguuuuuuuaaauuaaaaauauuucaaaucauaaaaguacauuauagaaaauaucguuaaguaaaaguauuaaauaaaaaucacccauuagcucaccaucuagaaauaauaauuauuauuuugcaguacauauuuccaguuuuucuauguauguaucaguauaaaucauuuaaaaauggcuuuuuuuuguuuuuuuuuuuuaaauugagacagagucucuguugcccaggcuggagugcaauggcaugaucucagcucacugcaaccuccaccucccgggugcaagcgauucuccugccucagccuccugaguagcugggauuauaggcaugagccaccacgcccagcuaauuuuuauacuuuuaguagagacaggguuucuccaaguugcccaggcuggucucaaacuccugacuucaagugauccacuugccucggccucccaaaguguugggauuacuggcgugagccaccgcgccuggccugaaaauaguuuuuaauaaacccaguggaccuguaggugauugaugugaaccggaucauuaugcuuccgugacauuucuugguuugaagugugguaaguuagagcaacugagauuuucauaaacacuucauuucuggguuucaucugaacauugucauccucauuuugcugauacuuccuccuuucccaaggucagcaggccgugacagcugguacugccauguuuuugauggccuaauuaaauauuucauauaaaaugcauauuaccaucugcuuagguuacagauauagugacccaaauaauaaacaaaauagcaugcgugugcuuaagcugauccagagagaugaacacccauuuucugcaugguagaaaagugcugggcuugcgcugguuuaaaaaaugcuccugcuuuaacccccuauuaauaagguugacugccauuagggauuagcaauuuuuguggauguguccauauucucaucugguaucucuuauuacugcuaccauauauaaggacugauagacuuacuuagaggggaaucuugagcuuguagggaugagcagauuauuaauuugucuguaagaauuguacuugucacguugguaucaccauuuucugucaauagccauggaaacuuagguuuauauaaaagcaaauaacauauuuugauugaaugaaaaagauuugcugaauauguugugagaaaaccuuguuaauaugggggcaagaaauccucguugucaagaaacauuguuuucaaagaugacuugcauuucugagacuucauggauuuaauguuucacaugaugcuuugauaagaaacuuuuuuuuugguugggagguagaagagguuagaaagaccuagguuugauaucaugacuuuagcuaaguaacuuaaauuuggugaacuucauuuucggcucuagaaagaugggguugauaauacccacgucaaaagguuguuuggagaaucaaaucauauauaugaaaagcaaaaugccuacuguaguuccuggggaauuguuaguuguucccaucccgugcaucuucucuauuacagugggcgucuguguacauucuugcucagugucuacgcuguucuccucuaucuucucuauuauagugacgucuguguacauucuaccucagcgucuacgcuguucuccucuaucuucucuauuacagugggugucuguguacauucuuucucagcgucuacacuauucucuaucuucucuauuacagugggcgucuguguacauucuugcucagcaucuacgcuguucuccaucuucucuaucacagugggcgucuguuuacauucuugcucagcgucugcgcuguucuccauccucuguaucacaguggacguuuguguacauucuugcucagcgucuacgcuguucuccucuaucuucucuauuacagugggcgucuguguacauucucgcucagcgucuacacuguucucuacucuauuacagugggcaucuguguacauucuugcucagcgucuacacuguucuccucugucuucucuaucacaguggacaucuguguacauacuugcucagcgucuacacuguucucuaucuucucuauuacaguggacgucuguguacauucuaccucagcgucuaugcuguucuccucuacucuaucacaguggguguuuguguacauucuugcucagagucuacacuguucucuucuaucuucucuauuacagugggcgucuguguacauucuaccucagcgucuacgcuguucuccucuaucuucucuauuacaguggacaucuguguacauucuugcucagagucuacacuguucucuaucuucucuauuacagugggcgucuguguacauucuuguucagcaucuacgcuguucuccaucuucucuguuacaguggcugucuguguacauucucgcucagcaucuaugcuguucucuucuaggaauagcaucuccguguuuacuuuguuuaacuuccaccuuggauaaagccuuggugucauugucaaucaagaucuccugguaagcauccaccccaccaagccagcgaaucaggugugcucuucugaauuuuguacgugacaagauauuggaaaugugucaaacguuguccugaagggagggaguauccaguaauuucuguuuagagcccuguaacugcucuaagcccucacaguaaauacuuuuuucaaaacaaaacaaaacuuaaaauagccugguuggcuguauaccaaaguucccuguuuggugcacugaauuggaaauaauuccacaagcagaugcauucauuuguuuaauccaagaauuauuaagugauuuccuuauucuuuauauauccagugugaggugcugagugcauucauagaagagaaauaucagguucccugucccuggggugugcucagcucagugacuucacagagggcacgugaucuuagaguaguagcagacguggagcauagccugaggcacaaucccagacugaauuuuguauuagguauagugacaguuaaucuaacucuaaaaacaucaguuauggacauaaggaugggaacaguagguacugggacuacuagagggggaagaggggaugggggcaagggcugaaaaacuacccauuggguacuaggcucacccccugggugauggagucauuucuaccccaagccucagcgccacacuacauacccauguaucgagccuguggauguacccccgaaucuaaaauagaaguugaaauuauaagcaaaaauuuacauuaaaaaacccuuuaaugcccauuaguuacuuauaaucuguuuaaagaauagccaguugcucucagccuuuucauuuguuucauuaauugcaucuguuuauuuacucagucuggucaagaaaaauacccuuaaucguuuauauuaaaaaguaggugccacuauaaaauucuaagcuuuugcugaaaaucgugaccuuugauuguucauacugguaauuuauuucucauuuuuauguugcaauuacaacauucaaagcaguagacuaagaucuaaugauuuagaagcaccagaggcauugcugggccaggaugacaagccuuuaaugacucucuuaggcaguaaaaaagccacugcaauugcuguaugaauauucauuuaagaagcauucauugguuguaaaucuuuuaacauguagacuuuaaaaaagaugaauaacauacuauguaccccggucauucuuauugaaugugucuucagauauuuuuuaucaaauucauuuuacugcucuuuuugcuuaugaaaauaaaauaguauuucauuaguugagcucauuugaauauuagaaauaaacagaguucauaucaugugaaauugcugacagcucuuaaaaucaguccugcacuuugcccagaggcauuauucacauugcugguuacaucuguucuugggaaagagaaccugccuugacugugaauggggguccaguuugccccagguuuagucccugugauacucagcaaauguugccugguucuuuacuaaauauggcuacccugugaugagaagcuuugggcugauugggccuuauuugucuucuuuucucuuacugggaaagcaaagacugcugaacauaacugaugucagaaugggcccguguuagcuauauacuguguacaggucaagcacauaacuauuaauaguaaaaaucaacuuagacaggggaacgggauucagauccagcaguuuuauccuagcccacacucuuaaccacaauuacaauggcaaacaaauaaauauuuuuaauuguaugcaguaugauuuaguauuggaaagacuguuuaaauuuuuuaaauagacuuuaaauuuuagaaaguguagauauacagcaaaauugugaauaguacagaguguuccccuauauauucuguacccaguuuucccuauugacaccuuauauuaguauggugcauuauuacaauuaaugaaccaauauugauauacugguacuaacuaaaguccauacuuuauucagauucccuuggauuuuacccagugucuguaccaguaugccacacaggauaccacguuauuuuugguccuuguguugcuuuaggcuucucuugguacaguuuuucauacuuucuuuguuuuugaugauccuugacaguuuggaggaauauuauuggucagguauuuuguagaacguaccuuacguggaaagaagguaauaccugucugaauuuuuuuucaugauuagaguggaguuacggauuuuggggaggaagaccacagagauaaagugccguuuucauuacauccuaccuggaauaugcucuauugacuugacuuguugauuuugaccuugaucaccuagcugaggucgcguuugucagccuucgccacugcagagcuccuccuuuucccuuccacacuguccucgucacagggacgucacuaggcaccacccagaccuaaggagaggggagccacguuccaccuccuugaaggaggaguauuuaauauguaaauuauuuggaauuccucugaacaggagauuugucuuuuauuuauaucaguauguauucguacacaauuuauuuuauaucucuaguuauaauccaauacuacuuuauguucuugcccaaaauauucuaacuuuuggccgcagggaacuuuuucaguugauuucuguguccguuugacauauccucaucauugcagaguuguuuuuuuuuuucuuuagcaccuccucacuuucuggcacuacaagaugcuucaggcuuauuuuuuauguuuccugcucauauccuagaagcagccauuucuucaaugugcccuguuuucuuuuauuggagaauaguuuuagaaauuggagaauuuagaaauuggagaauaguuuuagaaaacaagauugggcacuauuuauguuuauugcuaaugaguuuucuuugcuucuaggcccuaugaaaguuuuaacuuuuaaauuuuuuaagcugcuugagcugcuauacuaagcaacuauuucuguaaauguugguggccaaaaguguuaaauaaauaguuuaaaauuuguuuuucauuggggaaagaauguuguauuguaguuacaguugagaauugccaaaaauaaaauuuaaaaagaacaauacuuagaagaacauuucuaaaaacauuucuuagaauuguauaauugucucagucaacuugcuuuuauuauuuuucaagauaauuuuuaaugauuuuauacaaagcagugauucccuggguaaugauugugaagauuuugccuuuugugcuucucuuuuacaguggauuuuucauuuauuuaacuuggauuagaauuagaaaugcaaauacgucagcaauugaauuuaccccuuggaaucuugcuuuuugcuggacauuuacuaucugaauuacacaaaggaaaaaagacaaggagcagugucuguacccaggaguuauugucuaguaguuaauaacaagcacuguacaagcauugaucagucaaaacaggaaauuuagaaacaaccaggagaccauaucagauguauucugggcaaauaucaccccugcccaggccuaaagaacugccaaaaaucuuuaaaauauuggcuuauaaauaaugugaaguagaaaaaaaauuuaaacaugacaucucagugauauuucugcaaagggagguuuuuuuuuaaauaaagaagugacaguaaaauugauuuucacuagcuuuaaagacaguaucauccucuguaucguaagauauuacucugagaaacaccccuucauucuuucaggugaaaggcagccuauuaucacaggcagccaaccacugcaacagcugguauugacaaaggcucugaccccuuuugguuaaaaaugaagcaaaaaucugaguguucguagggcuuccuaaccuccgguugagcuauauguaagaacccuucacccauuauaauaauccagguaugcgauguuguauuacagugaccugcagggucaugacuuagugagaggcauucuuugucaacacagggaaaguuaacacagaagguaaaauuuagaagaaaggugaaugguuauaauauucuuucagugcgugugugugugugugugugcgcgcgugcacgcacauuuguguguauauauuuguauauuccuucagcaacaugucauauggucuaggaaucccugggcgauuucugguuuuggagaauaggaugugaauguaccucugaaacugacagaaugauguauuaccuuguaggucacuggaguagaguccagaugugcuuaagcauuuaugaaaaguuaccuauugucacagaggccccguaccacaugaguccugugagacuuuaaaggaaaucuaaccaaaauugaacucuauuucagguauagcauuuucugugguuugauaaugacauuauaccuauuaaaauaauuuuuugcccucauuauuaaaaccauuaguuuauuuagugacuucacagucacaaguuuuuuauauuuccugggcaagcaaaaccucaguagcauaaacuuaguuuugucacugccccggggaucccacuucauaugggccaauaaauuuccaggcaacuacaaguauuaugucauaugugcaaaaaugugaugucuuuuuugauccaaaccuuugccagacauucaagagagguuaggauguaguaaguguuuguaaaagacuggagcucucaguaggccaaguauagcguagaaacuggcaguggugaaaaccuggcugcagguacaagagaacacacguauauggauuguaguuacagcuuuagugugagcgaauuaaucuucauuguacgagggacccaauguaauucuucagacguuuuuguggaaaaucuucgugaaggagacuuagaucauuguugugccguagaauuucucugauaauggaaauguucucucuuuguugugcaauauggcaaucaguagccguuuucauguaucaaacacuugaaaugcguugaaugugacugaggaauugaauuucaaauuuaauuuuaaugauguuuuaaauuuaaauagcuacaugugguuagugacuaccuuuuggauagcacagcucuagauggcuagguuuggcaugucuacucgugagauaaugucugugaaaaacuguggcaugcagccgggugcaguggcugacgccuguaaucccagcacuuucggaggccuaagcaggcggaacacgaggucgggaguucgagaccagccuggccgauauagugaaacccugucucuacuaaagauacaaaaauuagccgggcaugauggcacaugcccguagucccagcuacucgggaggcugaggcaggagaaccgcuugaacccaggaggugggagguuguggugagcugagaucgcacuacugcacuccagccugggugacugggcgagccuccaugucaaaaaaaaaaaaacaaaaaaaccccacaagaacuguaguauaugaaguguucaaaaaaauguuuacuuuuccccuuaggaaguguguagacccccuugauacuuuuuuaaaacaacaacccacagguuaauaaaucuuuuguuuuaacuuucccaguauagugccauugcucauguaccucuuaaauuucaugaugguaugaggaaccuuuagagcugcaguuauagagaaguacauaaaaacagcguaccucucuuaauugugcgccacccccaaaugaaagagaacauaaugaccaauuuguauccauuuuguuccccagcacuggcuugcgugaacaugauuuagaaugcuuugcugcuuuugccauuuugguguacguuugaauaaaagggaaagcuugaaaggggacacaaagguaagaaagaaaagaaggccuagaauuaaagagggagaaaaagaagcgugaguacccggagagcugcgaggacgauagcagccgucugcggcucggaagaacugauuguagaucuacaggaagugugcuguugugcugcuggcggaggccgucccugaggaaguaggagaagaccacuagggcugugucuaagguaacuguaaggccucuccauccuuucugcugauuaugacuagcagcuaauuuggaucugauuuauacuguggggaagaagcuuggagagaaacguggggugccagugugaugggggugggucagugaauggcggcuugcugucucuguagaucaggccacaaggccacugcuggggcugccucuuuugucguagggacuuagucuagaguuuuauugaaggguacguaaaagaucauacaaauaaacauauucugaagaauacauucaucaguacagucuaauuuaaaucuccagauaguugguaauuuugcuuuuuauggacaagucuuuucaucgaacuauuucuauuucuaugugaucuuguuguauuuuaaauguuaauuuauucuuccaaucucuucuuccuuacuuucaucccagaauuuuuucagaucuguauguuucuaccaauguggcucucagguugucccuaauuugucagaggcuguaguaccauauuuucuuaacugguaguaaacaagauaugacgauaaaugggaccuaaggauacuucuaaugaggaauacuuuugucuucacauguuuuauuggguuuaacuagaauguagaaugaaaaacaauaugacuucucuguuuucuuagcauauuuuguucuuaauuuggcuguacuuauuagaacuccuccaagauuuccuauaaucauuacauuaaaagccuucauuaucaauugaaaugcaucuuuuguaacuacauuucuuuuuuuuuuuugacuuuaccuuuuaccuuuuuaaaagcaaugaaugcauuacucuugccaagaaaauguaaagaucccaggaggacuuacuguucuccuuuuucccuagagagagcuaaucucaaguucacucuuuuuuuauuaauaguuggauugagauacauuuagucucauauuuacucuuuaaagaauauguaaucauuacaaucauuacuaauuuuauuucuuuucccuuaacccuuuuaaaguuauaaggaaauaauacugcauuuuaacauugauagguaccguaauuuuggauuuuauuuuauuguagcauuuacauuaacugcgaaucuuggcuuuaaaaaagccacacauagguuaggcacaguggcucacgccuguaauuccagcacuuugggaggcugagguaggaggaucgcuucggcccaggaguucgacaccagccugggcaacacagcaagacuucaucacuacaaaagaaaaauuaaaaaugagccagguuauuuuggagcuuuaacauuuaacaacugcccugcuggguuccaaaguugcaggaguucuguagccccuuucuuuuugccaauuucuucaauuaaaccucuuuucuuauaaauuaaaaaaguaaauaaguaaauaaaauaaaaaauagcugagcaugauggcacaugccugugguuccagcugcuugggaggcugaggaaggaggaucgcuugagcucagguauucaaggcuacagugagcuauaauaauaccacugcacuccagccugggugacagagugacaccuuguuucaacaacagcaacaaaaacaacaacaaaagccacacauagccucuucuguauccaacuuuuaagugaaaguucuuaagaucuucaauguaugauucuuaauuuuuuccguaauaacaacacuccaguguuuucagauguuucagauuguaucuguuuuugugcagugguucucaaacuucaaggugcaucagaauaaccgauugcugaaguuucucauuuauuaggacugggugggacucaacugcauuugaacaaguuccugacuuacugaugcuguugguccguggccauacuucaggaaugacuguguuaucauauuugauucuucgagaauccagugagaucuugggcagauacagauagggaaaaugaagcuugaagacauuugugaucuuuuuccagcgacacaucaugaauuaaugguugaacagguaccagaacccaugaagaccuuucugguuuucuccugcucauggcaagaguucaguucccaaaagacaucucucugauuucaaauauguuugaucuuuuugucuuauucuuuuaagagcuauucauguguuuggauacacaccccuaauauucacauuuauuuauaauauaugcuuaaaauuuucuugucuuucaguuacaugacuaauuuuugugccuagagauguucuaaaaaugcagugucuuucugaagaaacaaaaccuuacauaacuugucaaggccacccaagguuaaucaugaggaaaaacguugaauuuuuuuacccaccagccuagucuucuggcauuuuuucacucuagcuugcggugaugguucuaggcaggaccauuauuuguggguccaccaaacgaggaaugauccaaaacaaagaaucucaaaaccacaucaccagacccucgcagaagggcccuguacugauuucaaggauacuuuuauauuuugcugcuuccauggagaacugauaguuggucuuuaauugguaccaaaacauugaaacuccugcguguaaggcagugacauacagaaugcaccgugaggugcguuuucuccgucuuccccucaguuucucucugaacuaccuuaggguauucaguauguggagcauguggacuagugucuugaacccggugucagccauccaucaggauuuaccuguugaauauugcaugguaagcuuugcuaguauagugaggaagugcuguaugcuuuucugauacuggcuuuucuaguuccuaccucucauuuucucuugcuuuccuucuucuguucuacuuugauguuggggccccugaaauaccuuaauccaaaauagaagucgggagggaaaaaaugauagcuggagaacaaggugaaaaucuugaccucgacuaucuucuauuauuuaguauaguguuggcuuuuugugugugaguuggggagggggacaaagaaaaucaugauuuuuaaaaaauuuagucuaauugaguaguaauuuaaaucagugagcuuuagcgacuccccuacuucccaugcuuccuuuuuuuuuuuuuuuuuuuuuuuugagacagagucuuacucugucaccuagguuggagugcaauggcacgaucuuggcccacugcaaccucugccucccggguucaagcgauucuccugccucagccucccgaguagcugggacuacaggugccugccaccacgccuggcuaauuuuuguauucuuaguagagacgggguuucaccauauuggccagacuggucucgaacuccugaccuugugauccacccuccuuggccucccagaguguugggauuacaggcgugagccaccgcgcccggccucccaugcuuucuaaugcugaaauaaaacucuuaaguauacgcuacggucuguguguggugcuuuauacgcaccauuuuacuuaauccuuuguuaagcaguauuauuuugaggaaacagauugagagcgauuauguaacauggccaaggucugacacuuaguaagugauaaacuugggucuuaaauacuagucuuuuggacuugggcauuuaaggacgacuagccuguauuaccuuuccuuugagauccuuccucagauaggaggugaauuuaauaaucuggauuucuugaaauaaauuagacuccacaaaaacaaauccugccuuuaaaacugaucuccauauuuccccuuguuuguuacggugccaguucuuuaaacauuugcuugaaaagagaaauguacauguugcuuuuagagacacgugucuccuaagcacauacaaaugacaguauuuugccguugcugugccugggaguuuuuauuuuaguuauuugggcuuuaaaagcagcauaugauggaguuucaauaugucuuaaaaccacggagugcuaccaugauacguacauaaauaaaccguagggggucucuuucuuuauuuugcccauggagaugucugauagcuuucagaaaaaaggcagccacccuaagugacuaaugucacccauuuguagggaaauaguugagaauuucucccagaguauauccauuaaaaaucacuucuuuagccucuccugugucuuuaaaaccuuuucaucuuuccuauuuugucuuauaugucccuucuuguuauaggaguauguauuuuaauaacaaauuuaauacaguauucagucuuagaaccaguuaauguuagcuguauagcaaaaacaaacauauauucauccagucagucaugcuccaauauggaauaacuguuaccgacacuugcguuguucccuugcuuccugaguagcuuugagaaauaucauuccugugagucucagcuuccuuaugucuaaaaagcugaugauagcaucucuuuagauauuuguaagaguuggaugaaauagugugcauuguagaagaaagcgccucuguguaguggggugggagggaggacauggcaacaagguaccuuucucuuuaagaaguuagaaguuugccuucuggaaaacaguuauaaaaucaaaacccaauggcuaguucgugcuucagcagcacauauacuaaaaaauuagaaugagacagagaagauuaguauggcuccuguacaagggugacaugcaaauuugugaaacacuucauauuuuuaacauaaacacacacaauggcuaaugaaacauacagaccuuuuuuuuuuuuuuugagacagggucuugcucugucacgcaggcuggagugcaguggugcgaucuuggcucauugcagcuuuugcccugcaggcuccagugauccuccucacuagccucccgaguagcugggaccacaaaugugcaccaccaugccuggcucuuuuuuguguuuuuaguagcgauagggucucaccauguugcccaggcugaucucaaacuccugaguucaagcaauccacccacuuuggccccccaaaguguugggauuacaggcaugagccaccacgccuggccccagaccucuuaaagaagcauauuauggguaggccuauaaucgaguucuuaacauagauauuaaaaaaaaaaaugucaaccacaaauguuaguaacuugugccacuuuuaaaaagcaaacuuguucagaguuucuguuugggaugacaaaaaucuuuuggaaauaguggucaugguuacacaacauuuugaauuuaaugccauugaaguguacacuuaaaaugguuaaagugaaaauuuuauguuauauaaaaauauuuuuaaaaaagucagugaagugaaucuuugcagggcuccauuaggcauugucuaggccagagaaagcuagaacuggggccauacugcacagcuccuggggcaaggagauccucuuuucagaguccaaucuggacucugaucgcuccuguucgcugcuguauuucuagcucuaggccaggacgugcuggaugaaugaacagucuguuugcuucaugguuugugcaacucauugcucuugcuguagugccagacacgacaacauucugauaguaguuugacuuccuaugcagggagaaaacaugaaggucagaggcugaguguccaguccuuucacccauuaguuuuuuuauuguaaauuaauaaaucgauauuuauuauacauucuuaaaaaucccaaaacaaguucgagcuuuacaacuugacaccaagaggucuacuagauacuuuuuaucaagacggcccucagugcacgugaggaaugugagccaccaagaccauugauacgacaaugaagagaacuguucuuagggggacuucuuguaauauuuccgucaacaagugcucacaugaaacuaaugcuucaaaauggguuucuuguacuuugcauugucauuaucuccaaggaauggguuccauuauugugggguuguuugcuuguuuguuuaauucauaguuuucuauucaaacaaugacuuguuaaucauguuuguuucaaaaaagaugaauaaaaauuuacuggucucuuuagggcugcagucuugcuuagaaaugaacggaaucuagaaauauuuuaauuaagaaauuuaaaaguuucaaagcuuguaguuuuaagaugugcuuguuuuuucacaguggagcuauugaaaaaucccucagcagcuugcuuuaccacuguguuuucugcaaugauccucuugagcauuuuaaaagaaaaaaaauugugccaaauuaguuuuaaacauuauuccuugcuuucuguucucuucaugucuaugucuuguguuucuuugccugaacacaggacauaagaaccuuauuguuuucucagagugcuuuuggguccuuauuugauaucuuuuccacucuucauuccuauuuguuucuccuuucuuuucuuuucuuuuuuuuuuuuuugagacagagucucacucuguugccuaggcuggagugcaguggcacgaucucugcucaaugcaggcucugccuccggguucacaccauucuccugccucagccucccgaguagcugggaauauaggcgugcgccaccgcaccaaagugcugggauuacaggcaugagccaccuuguuucuccuuucuuaaacgcagaucuuuugacuggagcuguggaacuggggucagaguugagcuccaucagcacaucaccucguuaucuagcacaucacaccuacuuuguauguuuguguagcagaccauuucuucuuucguguuuccucauuuuacauuucaucucuucagucacagcgaaaaguuguuccgugagaccucuugcauaaugacucuaaggggcuucagagacauucuccugcgagguaacugugccugugauguggggagagugugagacugggaagcagaagaccggaaugugauacagccuuucccacgacuuggcugaggaacugcuguugugaaccuuuugcccuggugggauuauuguaaguauucagagggaucauuuugagagaagugcuguggacauugacagugccagacucucacaggucaaguuuucauugucucuuaguuuuggggcugauaugaaaugaacuugggucuuuuucugagggcuuucagaaaguuagcaauuaaacaagaauucuaaauucuguuuuuugaauucacccaccgugcuguucucugguuucagaguacuugugcaugguaagggacugugaggaaagacuuugaaaugauuaaaaaaaaaagagcauguuuugucuacucaaccaucaggucagcucugccuuucacugucuuugagcuguacuagaauugugugugcugcagaaaauagacaguaaagcgccugguucuuguccauaaaaugcaguuguguuuggagaaugcaauagauuauuuuccuaugcauauugacuaguuuugcacauuuuacaucuugcuggcauuucugaugcuuauguauuugugucuucuuugaauucuuuuaaaaaucagacuuagcaucuuacucauuuucuagugaguuaaaucuuuuauauguguuuuauuaauuuugagaaucauuauuuugcuuuacagaaaauuauuucuuaacaauacaguaaaaaaccacaauucugggaauuaagggaacuauuuauguuacuuugagcaagguacugagcucugguuuuccucauuuaaaaaaaauggugagauuugaccgagacaaaccucuagucugugauucuaugauuuuaugauucuguuauucuacaauuuaauauucuguaagcccaagguccacuguccuaaguuuguuaauauuuaggugaauuggcauagaaucaaggaacuaaaguauguuauguauguaaaaauuguguaaguucuuuuuggcauuuuuagcauacgugugcacauaaauuaccauuguacaagauacuuugguguuuguaauucuugaaaaggaauuaccagccaggcacgguggcucaugccuguaaucccagcacuuugggaggccgaggcgggugaucacgaaaucaggagaucgagaccauccuggcuaacauggugaaaccccaugucuacuaaacauacaaaaaauuagccgggcgugguggcgggcgccuguaguuucagcuacucgugaggcugaggcaggagaauggcuugaacccgggaggcggagcuugcagugagccgagaucgcgccacugcacuccacacuccagccugggcgacagagcaaaacuccgucucaaaaaaaaaaaaaaaaaaaaaaagaaucacuaacauggcaaaacccugucucuacuaaaaguacaaaaauuagccgggcguguuggcgggcaccugcagucccagcuacucaggagaaugaggcaggagaaucgcuugaacccgggaggcggagguugcaguagccgagaucgcgccacugcacuccagccugggggauagagcaagacucugccuccaaaaaaaaggaauuauauuacuugaauugcuauugacaguuuucaguagugaguaaaggaagggugagcauucuccaggcagcuuuuuagauaagaagaaaaauuuauuugccuuuaaaaauucuuggcauauaacaccauuagugcuuauagaaaaugauggcuguuauugaagucugugacuuuuuaaaaccauuauuaaguucaaaaagcauuucuaaaacaucuagccuuacagagcauugcauuaggaaauguaagaaacaaauugaaacuuuuauuccugcuguuuggguagucacuauuaagcaucaaugugguagguaugucugagccaccucaggguacuguaacaaaacuccacagacuggguggcuuaaaaaacagaaauuuauaauuccucacaguucucaacacuagaagccuaagacaagguucuggcccacuagguuucuggugaggucucucuuccuggcuugcagauggugccuccuugcuaaguccucacauggcccuuccucaugcaagcacacagggaggaagggagcaggucaaugagcucucuggucucuaccugugaggacacuaauccuauugugucagguccccaccuguaugaccucauuuaaccuuaauuacugucugagaagccccuucuccaaauagaaucagaggguuagggcugcaacguaagaauuuugggaggacacaaacauuuaguccauaaucugugauauuguuagaagcaagaagucacacaucugagguacagauugaggauggcaagaaguagucuccccagaggaggccuggucauuguugaagacagccaagaguuggugaguuugaugccaaucugggugcuucuauaauuagaagauacuaauuauacugacccauuccuauuuaucuguucuaauuuuucagugguuacaagguuuucccaauaggaaaaaagggcaauauacuugcuuuucuuucuuuuuggauuuuaagccugagaccucuuugggucaugauauauauauuuagauucuuucagcauguguaacaauaucccagaaaggacuaguguuuuauauucuuuuaacuccugguuuuucuaccuacugccuuuacugcuuuggugcucaugggaauacugccacuuagggaaaaauacaaccugaucuuuuguggaucuuggaguggcuuacuugguuuaaaauaaucugggacguggauagguggaguuauuucaagcccuucggcuuuacuuccaugccuaaugucuuuucucaucauuuauuaaagcgcuuugacuuugauauguauccuguuaccaccuuguaaauccuuuuaguaauaccuuucuaugaugaagguguaaacacugcuguuucuaccgcauuuacuucucccuccgugucauuuuuauaggacuuuaaaccugcuaauguuccagguuauuaauuuaaaacagccagccaaauaguagaagcuucuuucucaucuguaauguccugaccucauuuuaccuguuuccuuuucaaauucaguuuggaaaucucaauuuucauaaucuuuugagcuacuacuucacuucccugauauuugcaauuuagcagccuuauuauuuucaagacuuuauaucaggaccacacaugaaauaauuacuuuuuuuuuuuggugcuggacauacuccccuagcuagucaggauuuuuauuuaucuuucuuuaucuuguaggaaauggaauucuuauuugcauuuucccugauuucucaccuugcuucuucuuaaccuuguucugacaguauuuaagugauguagcuuggacauuguuugcuuuuuuaucucuuaugccaaccuucuuguauuuagcuacaugcuuagagcugcccaauuaaauggcauccaguaaacuguauuaggguuugugcuugaaaaugcuuugaagacgcaguugauguuuucuuuguaguuucucguuauuccucaaguuuguaaguuagucuaauugaaaaguauugucuggaaaacugccucguuuacaugcagauuucauugauugcccugggcuuguacagacuucgcaauacuuuuguugauggaguuucucuuaugugaaacacuuuagcuaccuguccuugguucuggacucuagcuuuccaaaagcaacauggagaauuuaaaggggccuuagauaaaagccaaaaauagacuuagaagauaaaguuaaagggguuacaauuauuuaaucugcuaaaaauaaggguguggagaaauuuagcaaugugcuaacugugucuucucuauguuaaguaugcucauuuguacuuaggggcucaguuagugucuucucagccgggucuggaaaaccugguauugugauuuugcuucaguaucaucauuaggaaggauuuagguuugagcaauggaagugauguugaacauaggaaugagugucuggggaggagaggcauuguggaaauggccuccugagucuuacuuccuggauaagauggauuauggguaaaggugucuuccagauacaggauucuaaucugauugcugucaucaguuuuauuuuucuaauugugacucaaagugcuuuauaugguggaagaacaacaaagugcaccuaacuguuucagaaauggaucucuuggauaaggcuggugaacagguccagguagacuguugugugggguacuggaaagaguacuguacugggagucauauaucuaggugaggacccagcuuugcaugaaaguggcuaccugacccugagccugugacguuaucacuucagucuccaguuguccuuuuuacugugugggagauugguuagaauaauucuuagguccccuuuggaucaguucuaugugugacagugggagugaggucauaacuaucagggaggaagaggugauagagaagucgagagaugggaagauuaaguggagugaaggcugagguaauaggagaaaggggaaggaagggagauggcgaggagggguuuucaguggggaacugauaagaguguuuguggccaccagggauggaguuuuacaaguuuuaaaaguugaucucuuucucucucucuuuaaugugcuggauuucaguuacgaugagaacaacaguggugagguuuuacuuggucucucuuuuuaaaaauuagauuaauuuggcagaauuuaagacuguuaacucaauuuucucuuucuguuccuuauauaaguagguuaaaauagugcucuuucuuugaagauuucaaauaauucuuuuuauuauuacaaaugcccccugugaaauaagcaaagguaauuaucucuacgugaucauuggggaaauguagguacaauguaauuaaacaauuuauuugggaauuuaguaugcuaguguuagaauucauuuuucaaaucucucuaccuggcuucucugcuuuaaguugugucuauguaucuggaggauauguuagcccacuggugcuuggcacacggguuguagaaguacuaauauaucucagagauggacauccuucauccucuugaacgcaucuuaaggacuagaucccaaaggggaccccuaugugucuguuucauaauucaguaacugaauuuauuucuuauaaauaaaaccauacaaguuaagaaaaaucacauaccuaugggguauucugacauuuccuguguuuuuguguagaggagaucuuugguugcaugaagugugaaucaugaaaugauagaauuuauaguauuuucuuugaauuuccugaguccucuagaugucagacaggaugucagauguacugccauuacugaauagucucagcuguggggaguggcagggaugucagcugacagccugaaaugcuuugcauuaguuuuguaaguacacagauuccuuacaucacagcugaguauaaugucaaggaugccuccuacuuccacuagagcugagacuaguguaucuguuugaagguuggauggaggaagaguacaggaaaaccuuuguccuucagugcaaucauuuguauuagaaauuuguaaaauauacucuaggcgagacauugauuugccuugcucucuugagacacugcuuugcauggccauuucucucaguggaaugaaaccucuguucacaagagcacuuguuuccacaucccagaggcgcaugguuccuaccacuucucaaggaugggaaugcauguggagagaugaaugauaguaauuuucauaguuaaaugaucacuuuaucuguaggaaacaaauagaaccccuaugauggacauauuagaguagaguauguuccucccugauauuuuguugcuuuuaaagcacgucacaucucuuuauggcuccuuacgccucuuucucuguuucugucaguucuggggaguguuucuaaagggaggaaucucuugcuggaaacuagguauagugauuacccauucucuucugcccuccugaguuguuuuuuuuuuuuuuuuuuuuuuuuuuuuuuuuuuuuuugagacagagucuugcucuguugcccaggcuuggagugugguggugcgaucucagcucacugcaagcacugccucccagguucaagcuguucuccugcguuagccucucaaguagcugggacuacaggcauccaccaccacucccagcuaacuuuuuuuguauuuuuaguagagauggaguuucaccauguuaaccaggauggucuugaucuccugacuucaugauccaccugccucggccuccuaaagugcugggauuacaggcaugaaccaccacacccggccuaacccuccugaguuuuaaaaucagguggcaaacauuugcaucagucuccaaaaucaaaucuucaugaccuugaguggaagguauaagauagaauagguaguuuauauauauacuuauauauauauaaguaguuuauauauauacuuauauauauaaguaguuuauauauauacuuauauauauauaaguaguuuauauauacacauauauauagagagagauuauguuuucuaauauacauauauguauauauauuuucuaauauauguguauauauauuuuucuacuauauguagauauauauuuucuaauauaucuauauuagauauauuagauaugggaucuugcuauauugcccaggguggucuugaacucuguggcucaagugauccuccugccuugaccucccaaagugcugggguuauuggcaugagccaccacaccuggucucauguuuccuuuuaacugaguacuuaauucacaccuuuuccucuuuuggcugcuacucugauaacaaguagguccccaccuuugaagaacauugcaucugaccagacugagagccagggugaacaugggccccagaccagagcuuuuggaauaacaaggaacagcaaaaaccaaucuuccccuucacuuagaaagagacuguggauggaggguccaaaucuccgcuaucaacacauagaaagccuggagcucaaugccaacauggaaaccaaaauuuaucaggaaugaaauguaguaucccuucauauacucaagguuaagauggguuuugagaaauauauaucugaccaucuggcuucuucuaggagaaguggccucacuccagcacuuuuaaaagauguuuuucuugcuauuacauuucccaaagggggauuaaaucuacuaaaagggaucuagugaauccgaauaaaucagcugucucauaagaaacauuccuggaugaugauuucugguugcugagauuauucagcacauuauuucagaguggcaaaauugagggcaaucugagaaaauagaauucagugguggcaauauuugcugacagauuuauauguaggacacacauacaacccccauuuuuucagucuguaugucaagagaucaggaccccucaucaccaaaauaaauuauuuugugcauuacagugaagaggacaacagagggaaagacgcuuucuuggagggcaauugaaaggccuuuugcgaagguccauaucacucugaaguggaaggacuggagcccagugccauguggcuuucguuagcuugacugcuccucuucuuugggugcagugaccucacuggaagcuguuucuuccacuuguucugcuggcuacuucuccuccuccuccucuuccucuuccuguugggguuagagguuugaguauuucuguauacauucuugcauggccuugaacuuguuuauauaaucugagcccuugaauccuccauccuacaauggaagcaggaaaaguuugacuuaaacuguucccuacaggggccucuggccauuccccuaaggccuggguaguuucaguuaauguguucauuuggcaguaucaauccgugcuccucauagggaucgcugcagucaucagccaccugcucugcauugauuggagucuaauggguuuuuuuuuuuggucacaaauaugauucagucuuucccuucuggcuagcguagaacauggcuacaggcuggcacuuagaccucacagaagaagcaguggcagcucaguuuaauuaaagacaaagaaauuucuguugauugaaacucgcucacuuuggggaccuucaaauuaagaaaaaaggucugcuugcugaggaggccguaaugagagagauggagugggugugccuguuuuuaugcuguagccaugcaugcacuuguccauucauucauuugcuuguuucaguaaauauugaucgagcagguaugauguggcaagcgugaaaauacuuccacaaagcaaguaacucgaguggagccucucccacuucagugguguuuuuggcuuauacucugucuacggcauuucucaacuguauguaaaugacucccggucuaggagauuuaaaaugguguugugugguauuguuccuugguucauucaaguucagucuuuaaucuuuucagaguagcuccaaccaucuuuuggggcuuuaccuuccucuugaaucaucaaauucuugaaggugaugggugccaccugcuugauuccagaaggaccgucucugaucccuggcauuguucauucaggugacuggcaauugaacauccaucccagauuuacaguugcgauccuaugggaaagcucccuccuccugccauuucaccuuuggaacuguugcuacacucuggaagauuuuccaguaacuacaucuaauuagaagggugaauaaauuaccaaagcaaguuaaauuaccuugugugucauaacaauaauuaacauucaaauaggaaaccacugccauuuuuauaaacaucacuaaauggaggcagcacccuuuuugaaagcaggaaccaagagaguagcaccucccuaagccugcuguaaggauggccugggggaguugcuaggcgaaauguugagaacauccgucugguugagauugaugucauuggagaaauucuuuaauugcucuacuuaauaucugaauccuucgaaguagcaacuuuucuauguacuaaucauuauccacucuguccucauagcucuauguguuuugcuuaugucuuccaucuuucgagaaggaauggaaauugaucuggucacaagacauuuuuggacuaggcuuuacuuagaaagcaggucacagccuuuuuagaccccaccuuucaacaguuccacuccuuccuugcucauuuaauauaccuaccuuuguucuuuuuugcuguucuucuuaaacauuuucuguccugaaaauguuuauucuucuccaugaugcuacuucgguguggucucuugauuuuauguuugugcuuuuuugcuuuucuauagagugggauuaucaauugcuuuuauuuauucaguaggcugccaugucuagaauuuauuuagacaauugaagggguaacuuggugcaacucuggcuuaaauaauaaugaguuguuaaagguuuuuguuuuguccuccuuuuaaacuuauaaacucuuaaaugauguuuggauuguaagugauggcauguaauuuaagaagacagcauugaaguuguaaauuugcucauaauugagagauugucccuaacauacuccuacauguuucuacugaagagaacaguauauuagcagaguguaguaagguuuaaaucaccugauuucuuaauauuaugaauagguggcucuuguguuuugaaaagauuuaaccaagccauaaauaaaaucauagaucuuuauacccucaggccaaauauaaaucacagugguuccuguaauauccaaacagcaggccuaaaaacaauuuaaaguuucuuuuccuuuuccuuuguguuucaccaauuuggguuaaagucuauaguuuggggauucagacauuauguuuguauguuauacgugcauucuuuuaguucaagaguggcuagccucaugagccgucuaaggggaagagccaauauuaccagugccauuaacaaacggccaguauaggcuggugugguggcucacaucuguaaucccaacacuuugggaggccgaggugagcagguugcuugagcucaggaguuucagaccagccuggacaacauggcaaaacccugucucugcaaaaaauacaguaauuugccaggcauguuggcacgcaccugugggcccagcuacucaggaggcugugguaggagaguugccugagcccgggaggucaaggcugcagugagcugugaucuugcgccacugcauuccagucugggccacagcaagaccuugucucaaaacaaacaaaagccuauauaagcauuaaucucauugcuucgaauauguuuucguguugcugagggucagaccauguaaguguuuuccaauguuuuaaagagucaaauguuacuuuuuuguuacgguaucaauucaguucaaaauaauguuuuguuuuuuaauguuuaucucuuucugccaagggcucugaagagcuaaauauaguccuucuuaagagccggacaguggugaauggauguaggaauggccuggauccacugguacuuauggguguaguugaggaaggcuaauuuugucagcugaccugauuuugggacuccacaguuuguuucugagacuaaguagcagauaaaaaagaauuauuauuuugugguuacuggugaggggguuuggguugaggccuggaggacucaauggaaaggagaguacuggaacgaaauaaaaaauuaucuuagugauuuuguguaacauuagcuuagaguaaaacacuugguuuccauuaucuuucugcuuuugaauaaauaucucuucuaaaaggaccauggaagaugugguaacuugagucaguacaaauugcuuuucauagagaauguauuuaagaaaggaaacuccuucaaguaaauuauguauuuugaaaaaaguuuuuauucugugucugcacaguauaauauacuuggaauucauggcuacuuuacacauguuucauuuacaauguauuugaaagcccuccuuaaugaauaaugauaauuaggugauugacauauucucccacuugacaaucacacaugccaguaaauuacccucuauuuuccuggagugucggcaauaaauguuuaaaacuuuccccuagcaaaugucauucagcaaaauccuaacagauuagaagauacucuguuuccccaaauugagugaaugaccacccugugaauggcccugucuuccucgauaguucacagacuacuuccagaucugugauggaaaguauaguucaaacuuaagaaguuagauuugaauauuuaaaguguuuuaauccucaggugguagagggauuuucaagucuggaguacuucuguacuguaaagguuaugcauaggaaaaaauaaccuuuuuguuuaauaagcagacaguuauuacuccagaucucaaagaacaaagcauuuauuuuaccugaauuguaaaccucucccaguggugcuuuuuguuuuaucuccuaucaguuggauaauacuaaguuuauuauaauaagguauguaaaaaucaucuugaagccugacucuaauuuuuggugcaauauaaagggauauuuaccauguuacaaaauacgaugacacaauauuuucuacucaaauacgauuuuguaaauaaaugaauguuugucuguaucaccagugcguuuucuacauagggcacaggcgcaguuacuccuugagcuauacuuaguuuuucccccaauaauuucugaacuuugagguguauuguauaaaugauaaaauguguauauuuaaggauauaauuugaugauauuugaguauagauaaaugcauauucauguaacccacacucucauuaauaccuaaaagauuuucaugaccuuagaaaguauuguaauauuuuagauauuucuaaaagcagcagagauucaucgacuggugaucagagcaaacguuauuucaguuuaucaggugcuuaccagaugaaagugugaagaagaaaggcagauauauuauaacuaauaauuaguaauuguugagacuccacucuccuggaauagauccacuguuaagaaacaaauguagucaugcagcgguguguaccuguaauuccagcauuuugggaggccaaggcgggagggucaccugaacucaggaguuugagaccagccuggccaacauagugaaaccccaucucuacuaaaaauacaaaaauuagucaggcgugguggcaugugccuguagucccagcuacucaagaggcugagguaggagaauuucuugagccugggaggcagaggcugcagugggcuuuaauugugccacugcacuccaaccugggcgacagggccagaccuggucuuaaaaacaaacaacaaacaagaaaaccaaacaaauguugucauggcagcauaaugauguuuugguuaaggauggacuguguauacaaugcuggucccauaauauuauaauagagcggggaacuuucuaccaccugucauaacuccacagacaacacauuacucguguuuguggugaaccugguauuaaaaacccuacgguacugccaguucuaucaaaguguagcacauguaauucugugccauauauaauacuugauagugauaagaaaugacuguguugcucguuuauauauuuacuauauuauacuuuuauccuuagagcacacuccuucuacuuauuaaaaaaaauaaaguuggccagaugcaguggcucaugccuguagucccagcccuuugggagccugagguagaaggauugcuugacauaaggaguuugagaccaaucugaguagcauaaugagacccugugucugcaaaaauaaaaauaaaaaauagucagguguggugacacgcaccuguaguccuggguacucaggaggccgaggugggaggauagcuugagcccaggaguuugagguuuaugugagcuaugaucccgcuacugcacuucagccagggcaggaaagcaagacccugucucagaaaaaaaaagcauuaaaaaauuaacuguaaacagccucagguaguuccuuuaggagguauuccagagaaggcauuguuaucauaagagcugacagcuccaugccuuuauugacccugaauacuuuccagugagaucugauauggagguggaagacagugcuauucaugaccccgacccuguguaggcauagacuaauguguguguuugugucgucguuuuuaacaaaaaguuuaaaaaguaaaaaaaauuuaaaaauaguucaaagcuuauagaauaagguuauaaaaaaggaaauguuuucauacagcugaacaauguguuaguguuuuaagguaaguauuauuacaagagucaaaagguuaaaaaaaguuuauaaaguaaaaaguuacaguaagcuaagcuuaauuuauuacugaagaaagaaaaagauuuuuaauaaauguaguguagccuaaguguacagcguugauaaagucuagaguagaauacagugaguguucuaggccuguguagccuaaguguguaguguugauaaagucuacaguagaguacagugaguguucuaggccgguguagccuaaguguguaguguugaugaagucuacaguagaguacagugaguguucuaggccuguguagccuaagcguacaguguggauagucugcaguagagaacagugaguguucuaggccuguguagccuaaguguguaguguugauaaagucuacaguagaguacagugaguguucuaggccuguguagccuaagugugcgguguugauaaagucuacaguagaguacagugaguguucuaggccuguguagccuaagcguacaguguugauaaagucuacaguagaguacagugaguguucuaggccuguguagcauaaguguguaguguugauaaagucuacaguacaguacagugaguguucuaggccuguguagccuaaguguguaguguugauaaagucuacaguagaguacagugaguguucuaggccuguguagccuaaguguacaguguugauaaagucuacaguagaguacagugaguguucuaggccuguguagccuaagcguacaguguggauagucugcaguagagaacagugaguguucuaggccuguguagccuaaguguguaguguugauaaagucuacaguagaguacagugaguguucuaggccuguguagccuaaguguguaguguugauaaagucuacaguagaguacagugaguguucuaggccuguguagccuaagugugcaguguugauaaagucuacaguagagaacagugaguguucuaggccuguguagccuaagcauacaguguggauagucugcaguagagaacagugaguguucuaggccuguguagccuaaguguguaguguugauaaagucuacaguacagugaguguucuaggccuguguagccuaagugugcaguguugauaaagucuacaguagaguacagugaguguucuaggccuguguagccuaagcguacaguguggauagucugcaguagagaacagugaguguucuaggccuguguagccuaagugugugguguugauaaagucuacaguagagaacagugaguguucuaggccuguguagccuaagcgugcaguguggauagucuacaguagaguacagugaguguucuaggccuucacauucaccugccacucgcucauucacggagagcaacuuguaguccugcaagcuccauucauggucagugcucuacauagguauaccauuuuuaucuuucauaacuuucuuuuccuucaugagauaaagucauagucugucacccaggauggaaugcagugaugugaucuuggcucacuguagccucgaacuccugggcucaagcaauucucuugccucagccugcugaguagcuaugauuacagauguuugccaacaugcuggguuaauuuuuuaaguuuuucuagaguugaggucuugcuauguugcccagucuggucucaaacucccggccucaagcaauucccccaccuuggccucccaaagcauuggaaucauaggcaugagccaccaugcccaaccuuauacuguauuuuuauuguaccucuucuauguuuagauaaguguagauacauaaauaccuaccauuguauuacaacugccuauaguauucaguacaagaacauacuguacagguuuguagccuaggagcaauaggcaauaucauguagcccagguguguaguagacugucucaucuagguuugcguuagugugucuaugauguugacacaaggacaaaaucaccuaacaaugaauuucuuggcaggugucucuguuaagaagacaugacuccaguacucucagguguaagcucuuuuccagugaugacaccggcacucccuacccccaucccucuggaaaaagaaugaucuaaaauguuaugauuuaaagcaaaaggauaugcaaaggugaaucagagaaauucaaagaaaggagggauuauauuaaugucauauaaaaauaauuuaagauaaaaaacaauugauaggauaaacuugauaucuuuuauaaaagaaauauaccuuuuuuucaguuaucuuugaaacguuuaccaaaaucaauucuugauuguacacagacagcauugguucuaccucacccaaugcgugggagcacagaaacucuauuagaccaaaguagaaaucaaaaccacuuagaaaacuagaauagagaaccauaacauguacugaaagaaacaaaguauacucagaaauugauaaucugaaaguaguaauuuguagacuaugaaaccauagaaaauaaucuucugguuuaaaaaaaauuagaggguuguuugaaaaauaacaugaauuuugcauauaaaaaaacugaaagguuuugcaaaauacaguauuuagcggucacaaacagugcaggaaaauaagaagucuacgagcuuuaagaaauguagaagauuacuuggaaagacauaguauguuuguagaugauaagacugagcauuauaacgugucagucuuucucgacuacguuucuugaaagcaguuuuccagguaauuuuuuaguguucauuuggaagaaugaaagguaaauagugaaaugccauuugacaaaaaugaacaagaaauguuaaugcccaaaucuuagggagaguuuaagacaggcagucuuguauuacuaccguuuuuguguaaauugauuuauauuuugagacaagcaaauuuagaaauauuuaucgagucaaaaauuacucauaguagaauuccuaaguaggccaauaaaaaaagaaaaauuaaaauuaagaaaaaauuauucauagcaauccuuguuuggugaaagcaguaauuauacuuuuuuuuaauagcaaaaaaaaaaaaaaguaaugagugugggagugguuaaaugaauuauaaauaaauguaaagggaagcuacaugcaaccaugaggcauauuuaguaauauggaaacuaaccaugcugcaguauuaguuggauuauauuucauacauaauauauaucacacuauucugauauuuuuaauugagcauauuucuaggagggggagaaaaucauuguguuaaauucuucauuuuagguuaaugaaaaauauauuauuuaauuauuguuuuugauagugaggaaauaacacccaaauuauuuuuucuuaaguuguacuaugucacauucucuuuuuuccuuauucuguguuuucuguauuuucuauaaugaucaaaaaccaagaacgaugcagacucagaauuaaacuguaacacauucuaguuuuguuaucaaaacuugaaaaucaaaaauauuuccauaaucugugaaaaaugaguuuauagguacauuuuagacugaagauuucuugcuguaucuuuuuuuuuuuuuuggcagagucuugcucuguugccuaggcuggagugcaguggcacaaucuuggcucucugcaaccuucaccuccuggguucaagcgauucuccugccucagcuucucggguagcugggguuauaggcuugugccacaaugcccugcuaauuuuuguaguuuuaguagacaugggguuucaccguguuggccaggcuggucucaaacuccugaccuaaggugauccgccugccuuggccgaaugcugggauuacaggcccgagccaccgcacccggccuugcuguaucuuuagagcuggaacucaaacuugagacucccagugcuauccauuguuauucugccuggaaguaucuuuuuucaccugugaucugggacaagcaagagcauuugucccaagaagagcaaacaggacuucuguuugcuacuccaggaacauuauuuuguuucuuagauaguccagcuuuuuaagcuuugcccuuuucacauauauuguuagagguuuuuuuuuuuuuuuuuuuuuuugaaagaaagucuuuugcccuguaacugacuuugaccaauuuuccuucucuauauuuguuaaauuaacuuuggcguuuuucaucuuggcuuacuaauuucugacuaccucuuccauccuaucuauucguugcaguguggaagauaaacgugagcuuacccgugacuccugggccuuggcaucugucuuuugcagacugccuggauugcuauccaauguauuagucugucaagguuuaaauuugguguaggugggagggauguagggacggacacacaagcuuuuagaaaagccaggcucucuaaggaauucaagugaagcagagacuucuuuucauauuaaagcaauguaaaaugacagaaagaauuauagguauaaaauuguguauuacaaaugggaaauuuaauuggaccagaguacauagcaggugauauugaacccccuacccugaaagagccuuuguuuuucaaguaugggauagaacuggaacacaggggccuuuguacauggacacuguauaggcaucauuuguuuuacuaaacacuccuuucuaaagacggcaaaagcauauuggcagcaagguagacuugucagaacaauauacaugacuuuuagacccaagcagguggacugcuugacaugauuccuccgggugcaacgaauuuuugugugugggcagaaaggaaugagucuuaauacuucucagcaauauacugugguuuauuuuccucucacaaagaaaaagaaucauuucaaagaaauaacaauuauaaaguacagcagcuuguaaacguucuccauucuuuuuaauucccaggaaugugugauggggcaggagauuuggucccuguggagugucuguauagccaaagguucuucacagauuuugguucugccuccuuugcaaaaguagaagaaugccuuuccuauguuguuaaaaagauauuuaaaaauuaauauuuugcacagugcuuuucauuauggggccauuuuugucuuaacauggaggcaaaaaaccugugacuuccucccugaaguuccuucuacccuuacauggcugaaucugggagagguucgugcauuuuucccauccuuauggaaguacacaaguaauuacaugaacgugcuaccugugcauacuuuuauuggcuuuugaaacauuuuauagcuuuucuaugugucacaugccaugauauguauauuacauugauuauuuaauauuuacuacauauccacgagguuuacucuuaagauauuuuggcucagagagauaauuuugucaaggucucauagugacuaaguugcaggacagacccaagcagucugguuucauagcacagcuuccuaaccaccgcacuguuuugcguuuugucuguuuaaaggaguaugcauagagaagaauauuggaguaccuugcuuaaaaaugaccaaaggacagauaacccuaaauauaaaagagcaaaggaguugaauagaccuuucuccaaagaagauauacaaauggccgacaagcacgugaaaagaugcuccucaucaucaguuauuaaggaaaugcaaaucaaaaccacaaugaggcugggcgugguggcucacgccuguaaucccagcacuuugggaggccaaggugggaagaucaccugaggucaggaguuugagaccagccuggccaacguggagaaacccugucucuccuaaaaauacaaaaauuagccaggccugguggggugugccuauaaucccagcuacucgggaggucgaggcaggagaaucgcuugaacccgggaggcagagguugccgugagcugagaucaugccacugcacuccagccugggccacagagcgagacuccgucuucaaaaaaaaaaaaaaagaaaaaaaaaccguaaugaggugccacuucacauuuacuauuaaauguaauagaaugaaauguaguaggauggccgugaucaguaaaauggaaaauaguaaggaugugaagaaacuggaacccuguacauugcugauaggaauguacagugugguagccacuguggaauccacuuccuuaaaaaguugauguaugacccaggaauuccacugccauauacacacacaaaagaauggaaaacugauacuuaauuucacauacauauauuauaaauaguauuaguauuuacaauagugaaaagguagcaacagccaaaaugcucguuguuaguugaaugaauacaccaauugugaucuauccauacaaucgaguaucauucagccaucaaaugaaugaaguacccauacaugcuccagcacgggugaacccggaauacauuaugcuuaaugaagggagccagacacaagacgccacaugcucugugauuccguuuguaugaaauguucaaaguagaugaauccauagagacggagugcagauugauggucgcuagggcuugugggaaggggcacccgagagcagcugccuucaguggguaucgaguuuuccucuguagugauacaaauguuuuggagcuggauagguugguggucguuuaucauugugaaugcacucaauguuacugaauuguucuuaaaauaguuaauuuuauguuucaccucaagaaaaaacaauaaugacuaaguuaucccgcggccccuagcucucagguauuacagucaguugcagcuuuuauggagcacauauuugcauguuauugggccaauagcaaguuaaacaaacacugugauaggcaaacauuaucuugagcacuuuacauguguggacaagcacaaugacugacgugguucccagacuccagccgagacuccaggaaccaacagccuuuaagaauuaacaggggaacagacaaaauaugaaggcuguauguugauuuagcagacacucagcaaauaaagggcuuacauuuuggugacgccaacagcuaaaaugcuuuuucacacagugaguaggguguuaccagacuuacaugugugcucaggcagcaugaucuuauccuccuccuaaucaggguagguuucagucaugcaugcuggagcaaaugauuccggugagagaaucugaaagaacccuauacaaacauguaccuuuuuuucuuuaggacugugaagggaacguggcaguguguggccuggugcagccugugcccagaggguuuuucacguucaguauagaccuuugauguucucagguuauuuuccaaguugcccagaagcaugacacauacacugcacuaaauccuugaggaguugcaagaaaacagauagugcuuuucuucuucuuuuuuuuuuaaaaaagggaggggaaccuaguccacagugcagcaaagcaguuugucugguguagguaaugggggugugggucaccgaggaugacccuuguugaccuacauuccugaucucucccauucagaugugcacauguagauccauuuacuucuagacagcccucuuagguuacugaaauuauugauucagcauugucugcauugccagggccuccucucacccuaauguagagugggaaguggacauuuuuacuuaaaaaugugugaauuuuucuuacccaaauauuacuuuauugucucauuguaaaaauuucauauaucuauauaacagauauauauaucuguaaguaacuuuaauaaucagacaagccaccuucuccacuccccgaccuuuauucacuuuuaccauuugcaucuaagcucaccuuaaaaaccugugacugguacaugguggccucuucagcugcacacaaucuugccugggaguuuuccuggccugaggcuauaagguggaagauuguuucgacgacuuuuaacccuucaccucuccucaccccugaaagcaucagcaaaccucccucuuucugucccgaaauccccaaaggcaaggaugucuuuuccuguuuucuagagcucacucuuuuauuauuugauggaccucacucuacuaguuaucuagucucaauuauuuucaccuuuuuuagccuuuaaaugugccugucuuccucuuaggaaggaagaaagcgagggaggggaaaaaaagaaguaaugccuuugcuccaccucuuccucuacuuaucuuugaaucaucucuccuuucacaauuacaacugaaauuauuuacauuuuuagucuucacuuucuuacuucuugucaccuccgcuguagucuggcguucagguccuuaacucaauugaaacugcuguaguugcgaugagcagcaaucuccauguugcucaauccuccggauacucuaacuucauguguccuguggaccgcucccuuucgggaacgcuuuucccugggcuucggugacaccauacucuccuaguuuucuuccugcacuacugucuucccagucggugggguucuuucgccaccuuguuuguucucugcacacugucuguggguuaccuuacugauuccuguagcuucauucaccgucucuguguggcugacucccaaaguuagcuuguguuuuaguuaccuuuguauacuuccagcagccaacaugggaccuguugcacaacaguagccuauguuaaguaaaugaacggacugauaaauagauguuuuccaugauugauacucuucccaaaaucuuucauuauuaccauuugucacccaucacaagaacauaaacuccaugagagcagagacguuaucagucuuguucaggacugugugccuggcacguggcacacguauccaguaugagcaaaaaacaaguggcucacccaaaaugauccuggcaccaggaaguuucucuuugggccuggcuuccuugguuacucacaugcccccguccauguguuguaggaagaggaaagauguaagcauuaaggauuuggcucacuggggcugguccuggugguuuggaaauagcagaucucuaaggcauuccaucaccucaugagagaagucuuauuuauuuauuuauuuaucuauuuauuuauuuauuucuugagacggagucucgcucugucgcccaggcuggagugcaguggcaugaucgcagcucacugcaaccuccgccucccggguucaagugauucuccugccucagccuccugaguagcugggacaggcacccgccaccacgcccagcuaauuuuuuuguauuuuuaguagagacaggguuucaccauauuggccagucuggucuggaacuccugaccucaggcaaucugccugccuuggccucccaagaagccuuauuuuuauauagcucguuuucucucaccugggaucccaggucaaccccuuuucaaguugggagaaaccagcuaaacauuuuguguuuuaauuuaaauuuuguggucugaguugacucuugcuaggguggggguagaggaggaaacccagcagagaacuugaacuaagucaaaauggcaccuucccuccugaauauuccuuuuauuaagaugucugcagaucuccgagcauuaggucuuccauucuuggagauucugacuuuccucugucauuauuucucugcggaagguucuaacauuuggccaguugugauuucucugagcccuuugcaacacugcagggagcacacucaguuguaugcaguggggcugauagcauccaggucucagaagcacuuuccuuccauaucauugccgauuuccuguuucuuuuuuaauugcacuuguuccuuuuauaaagugacaguagcuaaauuuauuucucaagaugcuuacaugcucuuuuaaagaguaucuaaauuaauaaacauugaguacagaaaccuaaucugaauuuguguuuuuauugagagcacucucauuaaacacaggcuggaaaaaaaaagaaucaaccagacccugaugccucuugcaaaaucugaucuguuccaagucuagcagguagaguccugauugccuuuauuugcaaguucagaagaaugcagguaggugaagauuagaauggccucguagugaauauguauaagccuauaaaauuaaaguagaacuugguuaaagagcaauacaaucucuugcuauuucaugaaugcuuagcaguguuauaaagacgugaacauauugcuguguuucagugagcuacagccuuacccuuugauaugcuuaauuauuuucaaggucauuucuuuuuauaaaaucaaggcaagcuggaaaaugucaaacagccuacaaguauagaauaaacuauuuucauugucauuuuauagucauauauaguugugguuuugaguuucccaguuacaaccagucacugaguguaagagucacaauaaauucucuuaggaacaugguauccuuuaucucuucaaccauuaauguuccaaggauauuuucaaaugaaagaaugauaaaaauuaguugaugcguucugggaauaugcacauuuaaaauuucaaguuaacaauacagaugaaggugguuaaaugugcaagagcuagcuacaauaagagaaauguaguugaggcuacugcugaagggauuauguacuuagccucuaagccacuuaggauauauauuaaguugguugugcucuaccauuuuggcugaagauaauuuucccuuacauaaagcaaauauuuaguaacaagugagguaagucugaguuguucauuaugcagguuauaugguacgguugaaauccugaccauaccacuagucucuguaccucugaguaacccucacauuguauuguacuuaaagguuugaggugauucuuaaguaggcauuguaacugagaaauauaaguuucagauuuuugcugccaccagcuguuaggaagugcugguuauuuuguaaugaugccugaaaaccauggacuccucagcauugugaaauuuggauuuagggguaacacaaacaaaaauuccagauucuugaggagauaagaauuuuaaaugauucaagaacaugcacaccaauucuauuaguuuaaaaauaauuaauaugccuuacguggcaguagaguucagaucaguuggcugcaaucuucagaaauauuuauuuauauggugucaacuuagguugucucugagacacauuccaauugauacuucugccugccucugacagacuucuuuucccagaaacacccuccacauaugcuuauuccuguuagcuuaaccuaguucuagaauguucuuuuaggguaauugagguaagacucucuuuucacuuagccaacuuggaguuguuggcauuucaauuaguggucauugcgggauagcauuacuucacucauucucacuuuagauacauugcucccaccgacuuauguuguauaguaguccuucucugauagauucaccaagaaacuacuguugcuuagccggccagguacacguccacacgcuuugaccucacuuacugaacccacagcucugccacgcuguccucuucuguuccugaaacucuccaagcuugcacccaggcuguuaucuuuguaauauuuuuuuuacccucuugcaaccaacacacaugcacuauugccuggcaaacuccuacuucuaggaguuuuuggcuugaagccugcuauuggcuuaacuagagaagagucauaugaaggucuggagagaggccagauaagucagagcugugcauucaaagaaaaaucaggacuugggaagacauguuccugccugucauuugaaauauacugucauuggccagaccuguauuugauucucuuuuuacauuuuagaagaacaauacuuuuaagccauacauuugauaagaaugaucaaaccaccacuuuguugcagguuuacugcuaggcucuguggguacaucuauucgcggagaaagaaaaguaaauuaauaauuacaauagagcaugauauaccaagguggaggcauagacgggggcuggggaacaugaaggagaccaucgaaaucaaagguggaggccagagaaggcuuccuggagaaacgaggccugaauugcuuucugaagaacugguaaaagauaaucugaugaaaacggguucagccuggaagagaggaugccugaaauggagggaacagccuguguaaagauggaaacaaucuaacagcuuagcacacagagaaaacuguaagucacucaguccucagugaguuugaagugcacgcugaaagcuguagggccccggagaagaagccucuugggaaaauaggccuuuacaaccacagcaaagacagucugucaugcuuggcggcaugcaggugagcugugccaggugugccaggcaggcugcauguucauuuguagaggacucugcaaaugaggcgcaggguggagcgggguggugcugccagugaacaaagagaaugaggcuuaccuagagcaaucgcuggaacaccugucuugucugauggcaucgucucgcuugucugauggcguugucucacagucccagccugcauguugguaauguucagggcgagaggaguaagcaaacagccccagcuucugucugcugcugcucuggagaauaucagaguugcucugccaggucccacagguucuuuuacauucaccaucucuauuuaaucuucccagauuugaaaauaaugguuuauccuggaugugaucugaaaguauuuccccaaugcuuacccacaggagucacccacagaauccucacucacugcugucccccaugugagagcuugcuauagcucugugucaggaauuugggaacaguguugcugguaauguggaaaucaugagagacgucaugugggguuagacagcagccaccuucauagcucccugccuuucucacuucuccuagaccucuugauucucugauuccucgggaaacucaauuaccuuuccuugauuaugcagagcaauuuaacucucaaacauccuucggcucugggcccaccuuugcacauucagaagcucauuaauguuucagcaccgaggaacuggcaggagcuuugacauuucaguguugucuuuucucccuccccagguaucucagagugagaaggagcaguauagagaucugcuuucccacuaauaugaauuuucaccccaaaccucagcaucagaugaagauagucauuuucaguuuuaauauuuuuuucuucuaugcauauuagguaggcaaagaaagacauagaguucucucuaucuagaacuuugaaauaaaugaaaauauuagaacaaauaaacacuuccuauaaaugugagugaauaggacaguagguaauaaccggaauggauuuggaagaauggauucugucagcucauacucagaggcauauuguuaaagcagggauaugaagacagcagcagaguacagggguuacaggcaugaauuuaggagucagaucaagcuggguuauaauugugucuccucucauuccuaaucugugaauuuagcugagucaacuuaaccuacugaguuuacuucauuauuuguaaaauaaagguaauaucaccagguaaaguggugcacuccuguaaucccagcuccucaggaggcugaggcaggaagaucucuugggccuaguaguugaagaccagccugggcagcauagcaagaccacaucugggaggugguguggagaaaaaaaaaaguacuccccccacuccaggaccuggcgagcccucaguaccgguggcucccauuucacucacagucuuccugggcugugcuuccgucguguucccugcacuccuacacccuggucuucuguuuuacaagcuggaccuauuaucccacaagggacuucgcacuugccauggcccugccuaggaugcuucagcagacauggcuuaucacaggccagugcccauucuugcuuucuuccugcuaacagaguuucaauuuuuuuuuuuuucggggcuacaaaaggcccauucaugccaguuaaaagcaagaaacuuccuuagcuuuacuguaucugugggacaguuuagagcagauguaagugaacacuuaugggcagggcuucuggggaagguacuauuugcggauaggaagggacugacuaggcuggcuagacacacccugcccuucagccuuccccauucuucaucacuggaaggcugaguuacugcucaguaguagagcagcccccggugagcuacacaccaggaggggcaaagaaaaagguauaaggagcuuggcucccuaauggcauugugggaauccagugagaaaagggacccuuucuguggguaaaucauuuuauuugguauucuguugaaagcagugaauuuaacuccggcuauuacacgugcuuuccccccagcacuuuagaaaaaccuuuuuuaaugguuggcgcucucauucuucaggacuccauugaaugugacugccucaaagaugccuuccuuggucauucccucuaaaguagcucuucuuccacacgcucgugguguauucuguuuuauugucgccacaucaugaacauuaucugaaaauaucuucucauuuauuuacuucucgguacugcauaucucacgcuggguagaauuaagcuccauuggaauaaggaccugguguaucuuguucauugcucuaucuguacugagaacuaugcugauguaaagcaggugcucaguaaauguuucuuaaaugcauacaaaacguguuaucuagauuaaagagcaacuuuuuacauuuaaucaguaguuugucaaggagaggaaaauuaagguggaauucaugguguuggagugauuauaucccuuuauauuuauauauucugguuugucuguauauuuauguguaaauauaauucacaucaauaaauugagcacguauuaugugcuaggaauucuaagcaccuucuaccuuuucauauuuuucaaucaauaguuuuauaaaaaagaguaaauauaaaaagguaugcuuuacucuacgggguaguucucaaaaaaacaaagccaauuuccucuuuuaaucauugcguauuuauuuauuuaucugaaaguguuucuucaaagugaaaguugaaauguguaguaaacuuucaaauagaacugcauuuugucucaguagaaaauucuccaucacauauaucucaaugacuuugugucaaaaccuacuauuuuaccugucaagaugaucuucuucccuuacugugcauuucagaggauggaaguacauagaaugaaauuuuagugucagauacaucaauuacaaaccaacggagcuguuucauuuugcaccaaugauggagaaagagagucaggggaagaaugagucuauuuuuaccuuaaaguagcagcauucaggauaagaugucuucacuuagaaaucagucauacccucgacuguggaucagugcaggcuuuaauaauucauucugaaaccugugcuuccccagcuagugcucccuggcucuuuacuuauuuaaaggucuguuuaccucucaguuugcaccugcaacuguccauucaaucugcugugcauaaccaguggggaauaagcccauuaauuagaauaauuuaagcaucucagcuuccugcaaucuucaaccuaguggggucucacuggcaacauacuucuuuaugaagcucaucucucaucugaaccacaggucuagauccuuaaugcagugaucagaagcuugcgauucuguggcacuugaaaauuuggaagccccauaauauauggucugguuugcagauucucaacgcaguuccacuagggauugacacacccaugcuagucucuuguguaauuaaccacaacaacagauuguagcagaauauaaaagaaggaagcugaccuaugggggggaaaaaagacaaagcuuauuguuguggcaaggagggacuucauucuuuuaggacaggcuauccaggugaccugauaauggauauagaggaauuccaguauugaauuaggccuuuugcaucugacaaaggacaggauuaaaaggaauaacuugggagggaaugucuguuggcaucuguuugcuugaugauccacccaugaugccugaccggaugagagccugucuuugggaagcucaugaguuuauaagaaacagaauugcugcuguuucuuaaacuaggcaguguucuggugaagaacgugggcucugggacaagagggccauuugcugguuguuuucucuugucgaguuaauuaucgcucugccucaguguucucaucuauaaacugugaguagccagaccucccugaaggacacuugcuggcaaggccaaaacacaagcuacaaacagaggccaagcaguggaggcagggggcgccccgaagggacaggugacaggcagugaugccaagggcagcucuuguccucgucccagacuucgcuacucauuggcuuuggugauguaagcgcuaaguaaaaagcuacugcuguuccaaacagaugugaggcgaagguuuaagcuuugcggucugcguaugaccuuuucaucuuugcccucguaccuccuagcaucccuuucuuugugaauggugccuacguuggauuguuuauccaaaccagacaccugagucauucuaggguccuuugugucacccaccuccaugauucagcaaaucacuaaauacgguuuguucgaccuuuuuaccugugauuuccuuuuuaguguagguaauuccucaucagccuucaaauucagcucaaauaugaccucuuaagggaaagcauucugugacucucccuuucguagucugauuaaggugcccguuuucuuugcuccccaaaacaccuuguagauauuuuaggaaacacagcauuucuugcaaauguuaauuuaguuuccuccacuagacucuuaagcuccugugggcagagacugaguccuauuugguuuuauaucccuaaugguuggcauagugccucacaaauaacaggcuuuuaauguuuauugaaggaaccaaagaaaguagguuucugugaguucaccuuggaucauaaccaugauauagaacuuauuuuuauggggaaaauauguucuuaccuucccaauaacucagaguuauaagcuuuagaguauuagcagaugucauucuaaaaguuccuuucuuuagaaucuaaauuauuuaaaaaacuuaauuuugugugcagguaaauugcuugucucugcccucaucaacaucccaggggcaggauuuaaaaaaaucuucacguuguuguuuuauuuuguuucacuuuuuucuugcccauuucugauacaaaaaugggacaaagagcuuucugauggaaaguuauuauuagcuccauuuacuagaaaugauucauaggcccaaggaagucuuuuugcauguaguaaacacauaguaaccaaauuagguaugugagccaaagguuaagagccaaagucaaacuuccagaccuuaacauuaauugaaaaaaaaaaauucuguccuucgaacucuguagcucaagauaaaugugauucuuagaggucgauauauuuuuuuuuuuuugaagacauagucucgcucugucacccaggcuggaguacaguggcacaaucuuggcucauugcaaccucagccucugagauucaagcgauucuccugccucagccucugaguagccaggacuacaggugcgugccaccacacuaggcuauuuuuuuuuauuuuuuauuuuuaguagagaugggauuuucccauauuggccaggcuggucucgaacuccugaccucaagugauccaccugccucggccucccaaagugccgggauuacaggcacgagccccuguaccuggcgagauguguaguucuuggugcuaacuaugagcaucuuuagggcaugaagcagaucuucacuucuguauugccagcauuuaguacaauaaguguuuggugaaagaugaaccaauaagugaaugauuguauuuccuuuucagcuuucaugagaaauuaugugaugaucagacuguuugguuugauaaccuuuuauuguaaagguaguuuuugauuauuauagagcagcacugguugaugggcuugaaauuuuauauuuuucuuuaaucagcauaucuacaaacaaucaguggaguauuccuuuuggguugccauuuugaaacaagaaacguauggaaauaagggacgaacauuaucugcuuucucuuggcuguguccugaaagaauuggaauuugcuguggagcaaaagcuaaagauuaagcaauauuuuuuucuuuuuaaaguaauaccaguauaauugcuggaauuauuaguaauaguauuacuauuauucauuauuaaauuucucauuuuauuucaaucucuccaucaggaaugacuuguguagaguaagggaguuugggagggaagaaagcuaauucauaaauucauuuuucuuguuuaauauacuguuuguuuugggccaggcacgguggcucaugccuguaaucccagcacuuugggaggccgaggcgggcagaucacaaggucaggagcucgagaccauccuggcuaacacggugaaacccugucucuacuaaaaauacaaaaaauuagccaggcguggugguaggcgccuguagucccagcuucuuaugaagcugaggcaggagaaucacaugaacccgggaggcggagcuuagagugagccaaaauugcaccagugcacuccagccugggcgacagagugagacuccaucucaaaaaaaaaacaaaaaacaaaaaacaaaacaaaaaaaaaacauuguuuguuuugaugguaacuucauguauuucauacauugucauuguaacacauuaacuaaguguggggaacaaugaacaauaaaccaagagcuguuucucuguugugauacuucuuguugccaaauuugugggcuuucauaguucaggaaaucuuccugcacaacugcuuugaaaauuacuaaauguuaauuacuauucuacuguuuuuaaaggaaagcagaaaacacugcaucugaaagucuauuaaaagaaacuaggagggcuauugguuucaauuucuaauagcuuuauaguguguccugggcauccuucugugccgugagcgggggucaaauucugaagacuuaagcccugaagcacuuugccgguauaaacagaucucucacuggggcagauuacuuaccuggagcuguauggagcaggaucagcuagaacauuacaccuuuuauaucuuacuuugccaaagguaucauucacuuaguaagagaaauguuaacuuuuuccauaguuaguagcgauagaagcagagcggauggcacaaugaagccaucggagccuuuaaggcccuuauuauuuccauugauucguucagugaauguaggcugcgugcaauaccacaugaguggauauagccaaagcuaugccagauugauugauggauugccuuuaguaaacuugcaguguaaugaggccacaguaauguagaagagggagugacucauguauggggcaguaagcagaaaggauuaaagucuucugcacuuugcauuuaagaggucauuagaacccacccaaagcaaggguagauuuagugccuaaugaugucacaguacauauuaugagagguuggaaauuuggggaaauggagaugauagcaaguauaaaggguuuuuuuucuagcaaccuggcuauuaagggauaaauaaaguguuguagcuagaggugaaugagguuaaaggugggauuguuuaaaauagaagacuuaggccaggagugguggcucacacuuguaaucccaggcuuugggaggccaaggcaggaggauugcuugaggcuaggaguuugagaccagcuugggaaacauauugauacccugucuguauuaaaaaacaaacaaaacaaaacaaaaaaguaauuagccaggcaugguggcgcagcuucuggggaggcuaaggcaagaggauuuguugaacccaggaguucaaggcuguagugagcuaugaucauaccacugcacuccagccugggugacagagugaaacccugaaaagcaaucggccaaucaaaauauaaauaaaauauauuucccucccucccucccccucucccucccucccucccuccuucccuaucuccagcaggguuuuaggcugaggggaagugaugagugggaaguaaaugagacugaagauaaggaaguccagguuaugacuguaggagacagagaggauguggaacacaggagaauggauggucuguguaggaggacuguuccucucaaaaguggggagaguuuaaaggagaaggauaaugcuguuuauggggguuggguaggaaguugguagcagggcuguggcuucuguuuucuuugugaauuuggaagcaagaucaucugagggagacgcacacacgcagaggcuuggugcuugaguagacaguuggaaauuugagagaacuucugcaccaugugauacgguucugggccccaugcagcuacaagagaaaauuggacaucagauauguugaggaaacacuccccagaauuuguugcaugauuuccuccaucaaagcuuagcagccuaguguuauaaaacauaaaaauugcuaacauuuauugagugcuuacuuugugccaggcaccuuacuguguaguaacacaguccucaaaacagugugaaauagcuccuaucauuaccuauuuuuaccauccccauuuugcagauguggcugagaaagguuaaaucugggugacaggaugagacucugucuuugaaaacaacaacaaaaauacguaauguuaauuccagguuaauuuauuucuauaaggacacacucacguaguguagccugaucagcaaaaugaaauuugcuuucauucaaaagccuuuauugaggaaguauaucuaaucgaaugaaauuguuugucugcucuuuagaaugaaauuacaugcaauuaaaugagaaaaaucuucacucagugcguaaaacauagcaaguguauggagaauauugguucccuugccuuccucugcacuugcucugagugagcagcuagacugagguggcauuaguuucaaggcacauaacucuugcuuuaccaacuuauaauugcucaggaugaaaauagcaacaacaugguacuuccaugcucggucuucacauagccaaugacaagcuccuccaagucaguucugaguguccuuguggcugaucuguggacuacacccuuguccccaggauguguuaacaaacacucucuucccuccacuucucuacaucgucaucccugcucuccagacgccaggugucccaggcugccuuuucucuccucuggaugugggcugccugccgggagccucucuuauuuugucacccaggcacuuucauguuuguuuucugcuccagcagccacugggcugaacccuucacuuccagggagcuuguuuuguuucacagacuccagaggaaguaguuccuccuugagcucccagaaacagcguucucagugaaguaguuuuucauuuauuguuguuuuggcccccacaucccacagugcugaccucugacucagggguuggaguuguccacuugaaauuuccuucuucuauuucuccauuuucuuuugaccaagucuguaagcauuugcuucuucccauuacuuucuccagaagaucucggcuccugccacaggaaggucacuggaaagcaggccuaguagaaugccagacaggccuacauacgccugaauccuugggaaugcacagcuaggcucugaaaauaccucuguaugguauugaaucuacuucugggguugaaacgggccuuaaagauacuuggguaguuaaagaaaauuauuugcucaucuaaucaagugauguuugaaucugucugcugguggagugaggacuguggaggaaggaucgacaaauauuuauugaguagaugcugaaugugacacuauaggcuagguccuuuucaaagaguuuuuuauuuuuucuuuguuccaguagucuuucaacauagguuuguuauccucauuucacagaugggaaaacugaaggucaaagaaauuaaaguuacuugguucauugcacuaaguagcagagccaggauuuuaaacaccuuggccaugaaccccauacuuuuuguaccauaucaaaaaaaaagggaguuagauucauuaucuaacaggaaguccaucuauccugcuuguagaaggacaaaaugauauugaaaguagggggcuguggggcuauuuuuuccccucaaggaauuuuuuuuuuuuuuuuugagacagagucuuacucuguuacccaggcuggagugcaguggcacggucuuggcucacugcaaccucuguccccugaauucaagcaauucuccugacucagccuucugaguagcugggauuacaggugcccgccaccgcgccuggcuaauuuuuggauuuuuaguagagacaggguuucaccaucuuggccaggcuggucuugaacuccugaccucgugauccacccgccucgaccucccaaagugcugggauuacaggcgugagccacugcgcccagccaaggaauauuuuaugaguaauaacuucucuagaguaucauuucaaccuggagccagccaucugaacaagccuuccuccaucucuuuuaggaugguaagcuggggcaugauguuuaagacuucuuggcucuuuggcagggcucuggaggggaagugaguaagccauugggaugucacugugguaauguggacaggguuuucugguuuugucuccuucccuguggccuuuuuccauguccccccaaccccuggacuuccacggcugggccagacauuucccuucuuagacaaauagacucgcuucauccccuccauagcugcagaggagaaauccuugguuugggucccaguuuuuccauauaggcuauucuugugcuuuaugcagacagaaacauuaguacaguauguacagaauuagcaguauaguaauaagucauuuuaaccaacagauguaaaaaaugcuucagcauaccuuuguaauacuaggccugauuacagaaugggaguggucuguauaagugagcugugguagaaaauacaacccuucagaauaaguuaaauguaauuaacuucacuuuaccagagucauuuuuguucccacaguuacccgaguacuaauuucuaaacuugaugugucaagaauguggcagaauggugucaacuuaauggccaagaaaugugaucuguuuugaaagagaauggaauauuauagucuauaguacacaagaauggaauauuauaguuuauaguauacuuucuuugaguaacauuucugugaacauugaaauugggaaagaagauucuguuauuuucuucugagacuuaagagaguaucacauuaaaguggcaaauuuguguuuaugccaaauguuacugugauguuuucuucuauagaaucaaucccuguaagguaaguuaaaaaaacagaauuucuuucucuauagcugcggaugcaaaagaacagagagauuaaauuaacuugcuuguacauauagaaguuaaugguuguuucagauaaagaauguguagaaucauaaauuucuuaggacauggguuaaauggcagacagaggaaucuuuggguuacauuguagacagaggggugaucuuugcauaugagcaaguuuugugucuuauagguggugcuuucaaggaugcuccuuagaaucgugaucucuauuuugaaagggaugaggauuugauguuaauuuaauauucugucuacuuggcauauuuugggguuuugucugauguagcagaaaaguuccuacccagaauaauuuuuaaaacaugguaacauuggauuagggcaguaacacacugcucaucucaauaaugcuuccggcuuuugaauucauuaaaauaauaaaagcuuuuuuuuaucugccucauuauuuuuaaugcaguuccaucauagagcagacuuaaucccuuuguuggugaagguaguuaaaauuuuccuuuugaaaggaaaaaaaauuaucacuucugcuaguuaaucugauaccuuucucuuuaggguauuuugaaacauauuaauaaagacaaaacuaaaacuaaaauugaggaucagucacagcagagugagaaacauggcauggcauugugguagauggaguagaggcccagugauggggacaggaauccuaaauucuaagucgagcccugcucuucauuagcuaggugucucagacaagcagucacucaacauuucugcaucucaguuucuucguagagaaaagaaggguuuugauauagaucuccaugguucuuuuuagugcuaauuuuuaaucauuuaauugaaaugcaaaaagagguauuuuaaaaaucaggccuugcauauuuuucaucucuacugaccccacauccuccuccagcuacugucacauuucuagaauuuucuuucgagaaaugauucucaaaugaggcgucuacuccuugucucuaacugcauugccaaacauaguuuucugacaucagcugcauuuguccugggacccacccugaguuguaggguuuuccugccacucaccugagaacuccaggcugagccuucaagugcacuaagcuaauuaagugcugcaguaacucugcccugguguccucugauggcacaguugcaacagaugcauugucuucuugcuuauuaacaaguaaagggcugaucccuggaaaauguuggggaggggguuaggauggcaguugugcuuuucguuccagaagucacuuagucaucuuuucuuggagauggccuguauaccuugccuagcacaguguuuguugaacagcaggcauguaugccuaagagauuuuucuccaucuuuucuuccucccuccauuuuccuccauucuuugccuccaaaucauaguguuaugugaucuucggggugucgcuuuucuggccggaaaccucuguggcugguggcaccuuugcccguuuuuguccuguguccaggaagaaugagguacucagagaaguggaaggugaagaagaugaagaggagcuuuauugagugucagaacagcucagaggaagcccacuguggguaguuccucucuguaggcaggucaucuaguggaguguugagcucucagcagagaggaggcccuggagaugguggcuccucuucacaagcaggccguucagacaucucugcaggucucugaagcucucagcagagggcagcuccucucuguagcugguucgcccauugucuccacgugcccugcucuggcugagccugaggcuuuuauggaccucagaggggaggaaguuccugccgauuggcccaugguccuccaugugcacccagacgaggcaccacaaguccccacuccggucccggacuggcauccuggcccccagccuucaggcccucccuggucugaaggaggggccuuacggggacugccgccuuccacccaggaaucucucugccuccugcugccccgggcucggccccaaccccggucggagaucagagcaggcaucuggagaggagaggggcugggaagcgggagcagacacccccgagccugcagggaugaaguggggggcgggucuucccgggcccuccagggugcaggcugcagagaugccaggucugcaccugcggaguucacgcuccaccaacucaguaaagguggggcucccucuugucccuggcuccugccugcucgauugagcgcgaagcccaggucugcagccgcagcagggaggcugcagcucuacccuggagggcagauccugucugcucccggcccccaccaagagcacagggaagcuccgaucuccagcaucaguuugggcagcuguagccccacccaggaaggcggggcgccugccugcuccauagagcaggaagccuggucugcagccacgauuuggguggcugcaguggcacccacggagccccugccccaacccagaaugggugaggcucccaccgccuccauggagugugcagcccuagccggccucccuguugcagcagcagcugccaucaauagauggaauuacaaccaccgagcacguccugauucacgugacuuucaacauguuauaaaggcauacucuucaugggggcuguuuucuagcuucuuugucucacaucaaaugagggcugcuccccuggcuggaccuauggcuccugacaugacuccccggagguguggccuuucuccagcaauaaauaucgaagcugcugccguuccugaaggcgagccuuuccuuggacugggaaauuaagagggcaagaucgccucccuuccccuaggguuugccggggcagcguuguuuacagugaaaaaugugccaugcagccucaguuuuaaccugaccagcgaacauauggacucggauggaagcaaaaugguguauuguaaauacuccgggugcuuccgccaccaacgcaagaagcgagggggaaucuaauuauucucgaacagauuguccucugccgaacacugucacgccugccugccgauuaacaagaaaacggccugucucuaacuccaaaagccacacacaaccgucugcaggccccugugucaguuugcugcagugauuggacgacaccaucaaccuucaccaagggaggaacaguuuggagaguucuugaaauuuucagcugcugcuuucuuucuucucuucugccauccuuccccuuccuccucucagaauuggugcuguugugccaauucuaggugaauuggaguauguggcucuggcuagcauggguguguaggccccauuauuagauuccugggcaguuugccuccuuucuagucucugcuucccagacugguucuccacacuccgcuucacuucuaguuuauucugucuuccucaaaacucacccccaggacggucuucuguuagucuuuuaugccuuacccugcaccgggucugcauacccuccauucugagaaagccaauuguguuuacugucuccucuuuaacugcugaaggaaggauggguguuggcacuuggcggagaaggagguuuguuuggacagaggucucuuucccaaacccuugucguuaacucacaugugcagguacguguucuacugaggucaggccauaagcauuuucuucuuuuugguccauuuacaguucuguaguuugauucuuugauauacaaauguccuggguugcuggaaaucccuagaaauuuuaguuuuaagaaaaggucauaagcuguuuuaguaccuggauucuucuaaaaaguucauguuuauucacuucccuguucuuccugcauggugcaccuuuaggcugguguauuuuccuuaucggagaacauggcaugcuuucuugucuugcccuuuaucuauuucucccagauagguaagcucccugagggcagggauacccucuaccuucuugcgauuauauccucaacaauuggcacuucgaucagccugugaauacucaauaacuguauauuagaaaauaaugacugagccugcuuuaagagugcuuuaaaagcauuaggguugaauaugaguuuugaagucagacagaccuggaauaaaauuccuuccucuacuccuuaauaucgguaagacucuuugaccuuucuaagucucacuuccucauuuguaucagauucgaucuuggauugucacuaauucaauaauagcuacuaacauauauugaccacuuaguuugugccaggcauuaugcuuagcagucuacauggaugguuucauuuaaccuucgugaugucugugagaugaaugcuguuuuuuuaauuagcugcuuuucucaggucggaaagucaauuuaagaggcuuacgcuacuuacugaauguuacacagcuagaaagugggcugaguucacacucggucaccugauugccaagccugugcucuuaagaucucagguucauugaaggcagcaacauuuggugaguauauagcaguuaaucaauaaucaaaacaaguaaaauguaagaacagcacuuuaaaacuugucuuuaauccagugaagcucagaugccuauauugccuuuuaauugucuaagcacuugcacaaaauuaucuaauaugaucccaacaauucaguauuauuagucaaauuuaauauguaauaauugggagaauaaaagcuauuuauugagcuauucgcugcugacacuacauacauuauaacuaauauuccugacagccuuuugaguuagauguuauaccgcuuucauuuugcaaauaagaaccagaagcucagagaaguuucugaacuugaucaaggucacauuguagcucagauuaaaauuugcaucugagccaggcauguguagucucaguaacucaggaggcuaaagcagaaggaucccaugagcccaggaggucaaggcuauaguuuacuaugauugagugugugaauagccacuguacuccagccugagcaacacagugagaccuugucuaaagaaagaagaaagacaaauucagauuuucaagccuguguucuuuccacuauacaaaacuauuaggaugcuuucgugaggcgguggggaaguugacuuucuggaaguuuuuugcuauccagauccgggaaacccgauucgugcuuccugaauuagcucuguuauauacauugcagaguaaauucugugucccuagucuucugugaagugggaacauggugccuguguccaaguguuuuaucucuuuccauuaaagucagcaguuuuccaaaggucuuguuuaugaagguuauuaguuaugcaaaaugggccuuuauggauaguucuaugaaaugauuccaauuaaaaagaaguggguagauugccaguuggugucagcuaauuaaauuaugauaugcuccugucauuaacaaggacucugacuggaggaaaaauaaaaagauaaaagcaaguuucugaaauuuguugacagggaggguauauuacuuugcccauucucauauaauuagaagaauaaaacaggagcuucccauuuuguauuugaaauagggaaaucuguuauuacuuucuucuaggguauaauuaaucaaguucagcugcaguauuuuagauguuauggugaaauggaguuuuauuaaaaacuguaguuuaauaauaauggaucaguuguacugacauuauugcaaacauaaaaaugagcuucgaauaccaaaaacacauucaauaaauuuaauugagaaggggcuguguuagaauuuuuaggcugguuccacgucaguguuugccaugaguaagagaagacauugguacccaggcuugcccugaagagugccagggacauggcgguagcagcaucccgaucuuuaguaguccucuggcggguguauccgucagcucuugucagcucgacagggaggcuguccguccaggugaggagagccuugccgggcugcaguaaguagcuuauaaguacagucagggaauggagaagaaaaucuccagcuuuuccuccagcuaaaguuaucaaucuuuacagguacuucuggaagcuguugguuagccaugcugcuguugugugaggaaacgagugccuggcuggaaagcacaaggcuuugggaaaguuacuuuuucugcauuaaaucaaauguucaauaucuugauccugugcccuucugugaggugauguaguggagcauucuucuagacauauagguaaaugguguugaccuaacagaugggaggauccagaagcauagaggcugggaucccaaagcaugaauaagcagaaucuagaauuuagaccuuacuaauuugacauuuaugaugauucauauagugcugcuuugauugauugauugauugauuugagauagggucucgcucuguugcccaggcugaaaugcagugacacaaucauggaucacugcagccuugaccucgugggcucaagugauccucccaccucagccucccaaguagcugggaccguagccacaugccucuauagccggcugauuuuuuguauuuuuaguggagaugggauuuugccacauugccccgguuggucuugaacaagcuauccaccugccuuggccucccacagugcugggauuacaggugugagcaccaugccuguccugcuuugacuuuuuuucuuucaaaauguguuauggagagaacugacuuagaauccuauuguauacccaagacugcaaggacacuguuuaaacuuacaaagaaaggcaccuguuuugaagccuuugggaagacguauuucuugcaguaaugcaugauucacuaagagucccuauccuuuaagcaggucccaagacccucuacacuguuagucuaauuggaggaugcauguuuguguguguguguguguguguguguguguguguguguguauuaaauauacaacuguauuuccauuaaaaaagauaauguaauccagguuagcuuuuuugccuguuaauucacauuagugagauuuuguuguccauugugguggcaauuauuucuuaccauuccaugugggucuuacacaauuaagagaggcugguugcacagccagacuugcacagaacuuucuacccucguguuuaucuccaugaagaagcugccaaagguuggaacuaagaucaccaagcccuucuuacuugucuucacacuaaacaugcuucaugauguucuggccaauuuguguuuguagguguccagaaaagagcaauauacuuacgagaacucucuacugaaaguacagcagugccccccuuaucugagguuucauuuucugugcuuuuaguuaccuuuggucaacuacagucuaaaaauauuacauggaaaauuccagaaauaaacaguucauagguuuacagucgugcacuguucugagaagcaugauggaaucccguaucccccgggacaugaaucauucuuucaucaagcguauccaugcguauacacgaccuacccauuagucaccuagcagucacccucaguuaucagauggaguauugcagucucacagugcuuguguucaaguaacccuuauuugacuuaauaaugcucccaaagugcaagacuagcgcugucaauuuggauaugccaaaaagaagcuguaaagugcuuccuucagugaaaaggugaaaguucccgacuuaauaaggaaagaaaaaaaaaauacgcugagguugcuaagaucuacaggaagaaagaaucuauccaugagacugugaauaguauauuauuauaauuguuuuauuaguaauuauuuuuguuaaucucugugccuaauuuauaaauuaagcuuuaucauagguauguauguauaagaaaaagcauagaguauagaggguacaguacuaucugugguuucaggcacccacugagggucuugaaauguauccccuaaggguaagggggacuacugaaucgagaagagagguauccuucuggugcuaaagaaagaaaaaagaaugugguauacugagguucaaggccggugaugccugauucuuagugacugcuaucuucugagcaaguucuuuuugcuuaaagguaauuucuuaaaugugagaguaaggaagaggaaaacuuugaaaaagagaaugaacccaaacauaauuugacuucuuuauaggaaacuuaacuuuguuucaaaauaagucuuucauugcuuccagcucgacucugcuuccacugaacauagaacucaaucaccaggguuuaaacagcaacuagugcuguauuccaggagauguguuuacuaaauggaaucuugaauguuuuuacauugcuuuaugaauucuggacuguuuaauaaauuuaaaugaagauuuuuuuuaaauguguuuacguuggcauguuagucauuuacugcagaauuuugaguacauucaggggggcugugguucuguaaaggacuuaccacaguuucuagcacacuguacauguuuaauagacauuaugcugcuguugcuuuuguuggcuaccauaacugugaaggagagaauugaggacaguaaaaugaaaguaaguaaucauaggaaugcaccaucugucaaggugugcuuaagacauuaaaauuccuuugaauauccguacaaaugauaaaauuugagaaauaauuguuugucuuuguuuuaccauuaggcuuuuugguagcuguauccugucgcccuguucaacauuugcucauaucguguggaauucaaauccugcuagaucuuuugcagaguuuccaguucuguuguguguauacagugacagcugaguucaguauggguuguuagagagaguugauuuccaagccagauacuuuuggguucaagugacugcucccuuauguauuagcuccaugugacccuaagacauuuaguguccuaugaaccuuucugagaauuguucugaguuuuccugacagagucaccagcuucaagaaaaacauagcaguugaacggauaggucaccugaaugaagccugcccacuuggguagccccugacaauaccucuacugucauaaguuauauaagauaguaaguauugauccuaaagaugguccugaauugccaaggaagauagacuccacucugcuaagccagugaccgugaugugcauuugaaacgcauuuccuuccagcugggcuugguggcucaguucugugaucccagcaacucaggaggcggagaggggaggauggcuuaaggccaggaguucaagagcagccugggcaacauagugagacuccaucucuaacggggcaugauggcaugugcuuauagucccuacuacuugggaggcugaggcaggaggaucacuuuaacacaagaguuugaggcugcaguaagcugugauugugccacuguaccccagccugggugacagauugagaccccuaucucuaaaaaauaauaaauaaauaaauagcauuuccuuccaaaugggcgggauaaaaagguuugaugcuuuaaaguauaaacuuuaauaggaaaauaauccaccacggagcaguuccuucaaugaagaugguggacacuuccguucucuguugcacagcugcaguaacugcuagcgguacuaauacuacuggugcuaguacuaauacuaaagcuaacauuuguugaccuuauauuguugcuagaaaguguaagucuuucauuuuuucuuagucccaaagaauacguguacaagaugaauaccacuaauaauuuuccagaggaggaaauaggcuuagagaaaagugucugggccaaaauaaugcacauccaaagcgguggagcuggaauuugaagcgaaagguccugauccccagaacccaucauccuuuuaccuguuuuaccaagcauuucagcagaaaccuggcacuuguaccucauugaccauuacuggcaagucuucucauuuguauauaugugcauucuucaugauccuuuugaaagagaucuugguuuagauaauauucuuauguaacuaaagaaugauuuguccauucuuauguuuugucuucgaucaaccaauacaugaugaaaagaauaucuugaugaaagggagaacugugucauugcagagugaaauaugggugauucauaucuuaaugaaagggagagcugugucauuguagagugaaacacaggugauucauaucuuugugcggacuauccauggcauauuuaaaagcuuagaucagcugcucuuuccuuuccagcaggauucuuugcugucuucucagagugugaugaaauauucaauucuuuuaacauuagcuugaacaaaacaaaauuggagaaauagccugucauuaaggccuucuauaacccaccauuguuaaccaucuuggauuuucuguguaauauuagcacauaucaacaauuuuuaauuuaaaauucuacauguguaacuauaaaaucagaauuuuucauuuuuguuaaagaaauguguuucaaacucagcuucuugaaugcuuauggcaugcaguuuguuuugcugugaauugacaaagggaauuacuagaaaaagagaaaaagagugcagaguuugcuaaauuccuuuccuggaaaauagggaauugauaguugagaaaugaaaguguguuauaaagcucuuauaacacccacuggaaaauaaucauuaaauauuagacaauaugauuggauuaggaauguuuuagguagaaugaagucaaccaaguucuguuuuucuguguggucuugagaaaaucuauguauugaaauacucauguuagccucccauuuucauuagauauauuuuauaaacauuuuuugguccauugagaaagacccuuuauaacagaagguuaaaagguuaauuuuaggucuuuggucuaugaacaauuaaaauuucccaggaagcuuaaucagacauuaauguaacacucaaucaguccccugaaccugcugugaguuucgccauuacuccuuauugauuagacuguauucuuuuugcugcuaaugaauuauuuauggaggauuccuugagaguauucaggcauugugaaggaagaagauaaaaaccccuuccucuguauagcucaggccagggguuugguggcugcugugacugauugugaaggcucuguccccugggucccuguugucuuaacuguccugcagcuuuacaaagucuugaguuacugagagaagauacaaaagggauuagauuaugucuagcaaacuugacagaccugagcauuuagaaaauauuuuccacaugauuuguuuauagagagcgguacaaagaaauuuagguacugugcaaaguauuuaaacuuuuuuuaaaaauaaauuuuuggcugggcgcggugacucaugccuguaaucccagcacuuugggaggccgaggcgggcggaucacgaggucaggagaucgagaccauccuggcuaacacggugaaaccccgucucuacuaaaaauacaaaaaauuagccgggcgugguggcgggagccugcagucccagcuacucgggaggcugaggcaggagaauggugugaaccugggaggcggagcuugcagugagcugagaucgcgccacugcacuccagccugggcgacagagcgagacuccgucucagaaaaaaaauaaauaaauaaauaaauuuuuaaaauaguuuauaggaagagaugaacugaccaaaaugcagucagguuuuuuguuuuuuguuuucaguucgggcuuuauuuuguuuuaaauccuagaagcuuaguauuaugaaaacaacuguuuuaaugcaaauaucuuucauaaguagugagcgaauauauacgaagagggugucuuguucucacagugcagcacucggggcggagugaggaugggacagaggaggacugugcacagccucggugcuauguguaaauuuagucccuuggcccuaugcacagaaugaggaaaaugaguaagacauacauacuauauuuuuauucagcuggauuuaauuaucuuaaggaauaucuuuuuaucauuaaagguauuuuacauuuuuaacagaaauaagaaaaaaaauuauguguuuguguguguaaugggggaugacauacaaagccuaaaugaaauuuguucuaaaauucaggguaauaaucucugagaggaauuuggagauuuccuuuuuuuuuaaaugugugcucccaaauaccaaagagccauuccaaaacucaguaguagaauuauauacaaaauguaauggaaauaccuucuuagaugacuuuaaaauggaaaaagaaaucggcuuauccuauaacccgcuacuuccgcccagggacuugcagagaaacaccugugcguucucagaacuuguuucacucuguaggguggagggaaaaaucgaucaugaucuaaggcugugguugcugaauuggguuauuaguugugcaccaucuacuuuuaccgucuuuugaucuggccacuauauuuagguuguuaugguauccaguggggagaaaaacaacuuaaacuuuugcaauugggaaaccaagugauacuuuaaaaaacuuaaugaaccuugaaaauugcuacucaccgugugagaguaaaaaugucgcaucagguggguagcaaagaaaauugucuugauacuuccugcauucugacaauauuucuuuggcagauaaucauguaucuuuuacugagagucugcuuugugcagauacccuuauauuguccuuguaugcacuuuggggagauacauaaaggagaaauuaauauuaagauuaaaacaugugaaucccauggacucaggugaggagaaauggcgaguaaccacuaauagguccagaguuuccuuauggagugaugaaauauucuggaauuacauaguggugaugaguguacaguuuugcaaauauaugagaaacaacugaauuguauacuuuagaagcaugaauauuacagcacgugacuuauauaacaauuaaaaaaacccaaauccaaaauucuaguauaugcaugaucagaaaaacaacaacccaauugcuuagcucguaguccuuggaccuguuguaagacuucuguuucuuauccucugccuacuguucccugaaugaucuuccacagugacugauuuaauagaguuaaaaacuuuccgugaacucucauugcuuuuaguuaggucugugcauacaguugggcagacugugcucugcagaagucuaagaaaugucuuucucauucugcuuuuuuggaugaauucagacucauuacaugacauuuaggacugucugcaucuuaguuccagccuaccauucagcaacuucauucauuuauaugcccacucauucacuuauucauucauuuuauuuguauguucauugguuccuauguugguucauucauucauuuacucacucauugauucauuuaacuguauuccuuaucuugccuacugguuguuauguucucccugcccagucugcagagcccaugcuguacauugucucagccuuuuucccaccuucuuccuccaacucccagauauauucucaaggcccugcuucuauccugcauuuuuuugcaccuuucuuuugccauuacagaguuguacuuuuuuucuuuaagugcccaguacauaacaaaagaagguucuaucucagauggggcagcauuauucacaacugucuccgggcuccuccaugaggugucuaaggugucuaccuuucuuucaacuuuaaaaucugaacaugauggaccuaugcuuuuggaauuggggguggguagccaacuaaaaaauggagagccacucuuuaccuggauagcuaauuuuuauguuauuguaggauaauaaccacaaaucaaggcacagcuaccuauuagagcuggccugaaagcuuuaaauucugcagaauguguuauaugugccauuaacuccaaucuguuggugcuaauuugaaauggugguuugggaacaugugcaguuccugguguacuugaagauuucaggacaugaaugacaaacaguaccaauaacucucugaucuaacagugagaaguuaucagcaggcacugccagauuugagaauauucaucuuuucucacauuguuuucuuucuuauuuugcauaagugaauaaaggaugauuuuggaaagccuuacacuugauauacauuauacaauccuagaggccuuuaaaaaacaggacagaaaacuuacuugaaugcuugaaagguaauggaccagauuagaguuugaacuagaugacucuuagcaguuccuucuacuuggaugaugucauaugcuucucuuuuauuuaaaaugucauuuugguuuguauauuaaaacaauuuuagcuguauauuucuacucuguucauauauaauauguauacauuaugcauauauaauauguauacauuguauacauacacguaugugugugugugugugucugagacaauugccagacucauuuuaauuaugaagcuuuaaggugauugauauugggaucacuuuugccucugcaucuuaagcaaauuuauguucuuugccuaaugacuucuauauuugccagcauggacuuaucuugagaugacucaggaauguuacuggaagugauaguuguuuggaauaauuugacgcaugucccuaagauggcuuacuuuugccccucugucauuuuagaacauacuuaagcugugcacacugggauagcuuccagaagcuuaaauuuuaggauuuaauuaggucauacaauauuaauuaauaaaaaacuuuuugaauugcuuuguguucgcagguacugugucugaugcuccacauagaaggaugaaugggaccaaagguccuacucuaaaccauucacagaggaguagugagaccuauuagaaaggauuugaaacaaaagcuuucagguagaugacugaaucacuguagcucuucagcauauuguaacagaaaaagagccaguuuuugaauuuuuaugagcauguuauaguuuuaaauaaugugauuuuccugaacuguaauauugauguaauucuaagucagagaagcuguuuugcauuuccagcucuuccugccuacuucagcacuaaccaagguaccaaacagcagccucuucagcauauaugcuaaguuuuuuuuuuuuuuuuagcuugacugggaacauuuucuuggggauguaauuuuaguuuggugugauaugcaaacaagcacacuuuaaaaauagauauuauuuagcauugaaguggaaauuaaaaaugagucauuaaaagcggcaggggggggaagaaaauguggucaaucaauuucaguugcauauagguguagaugcaaauggaaagcugcaugguuauuuaacccucuaaaagucagagggucuuaugucuccuguucagagaugcugcuuauauuuaaauaauaugauggacauuugggaauagacuagugguucuuaacuucuuuugauucacagauucuuuugagaaacuguggaaagcuaagcacauguauguacagauauaaaauuugcauauuauuucaauggauucauggauucugaagcauauucugcuaggggcauauaaauaguauguguuaauuuaugugaugaaaaucauggguauauaauuuaaauuuaguguauaaaauuuauaaauuaucuagauuacuuaugaaucauauacaugaucuagcugaauugaauacauaaguguuuauuauaaggcauuuaauaaacauauauaaaaugccuuauauagaaagcugcauuuuaaauuauguugaaguggagcuuagguuggaauagacuuugggaguacuauuuauaaaagagaauauuuccaaguaaggcuauuccuccugaaaugucagucauaggccacuucuagaagaaaaggugggaaaauaaaaacauuuucuuaauguaauacagcaggugacaaagugagcugacaugcuuaugaagcuagguguaggcgaugugauauauaaaggaaaauuaaaaugucaucuuaucugaagguucacuagucauuuccccgggcugucuuuagccugugcauggaaauagguucuucugguccagauacaaugcacuuuuaauuaguugaccauaacaagaauacauuucuuuugaagugcuuuuagcuuaaagauggaagugguuuaauauggaguucuaaaaugaaauguuaggguauaauuuuaauuauauaaauaguagcuacaacagugucauuugcuggcucagcuguggcuauuauaaaauagugaaauguuuucaagcuuuuuuuugacaguaguugaguucauugagcgugugugcauucagcucgcuugcacauguguucucccucuuucuccuucuucuuauaaaauaauauaaaagcuggcauuuccuuaagaagauguuucuccugaugcacuuuaauaaagccacaccccugcuuccguuaguaucagccaaucgugaugacauauaucaagaagauaguugcuggugagguaagcagugcaacaggccccuuuggcccuucuuuuccuguacauucuuaacuaaggaaaacuauauuaaaaacugaaggaacaaugagauacuaucauuagauaauaaguuuaacaacacucaggucuuuagaaguauuuauuuauuuacuuuuucagguuuuucauugaguaaaguguggagauuuguuaugggaaacauucucauccuuucccaacuuggugggaauuggaccaauagauguuuucaguaacuucacgagccugggaguggaaucuuaugauguucugcuuuucccucagucaugccguggguucauuuaaaugacaagcuuugggaaaguuauucaaucaaauguucaguuguucaaacuugaguuuugagaguucuuuauauauucuagauacuauacuagauacuauucaguucuuuuggaugcauacccauaaaugggauugcuggauaauaugguaauuauuuuuauguuuuuuuaagaaaugccauacuguuuuuuguaguuuuuauuauagcaccuuucauauuuccaccagcaguacccaaggguuucaguuucucugcauccuugccgccauuucuucuuuucuguuuauuugauaguagccauccuagugaaugugaaguggcaaccucauuauggcuucaauaugcauuucccuaaugacuaaugauggugaacaucauuucaugugauuguuggcaauuuguaauucuucuuuggagaaauaucuguuugaguccuuuccccauuuuaaaaauuggguuuuuccuuuuuuguuguugaguuuuggaguuauccauauauucuggauauuauacccugaccagauaaaugauuugcaaguauuuucucccauucuauggauugcuuuuucacaauguugauuguguucuuugauacauagcaguuuuaauuuugauguagcccacuuuuucuacuuuuacuuuuguugccuguguuuuguaucauaccugaguaaucauugcucaagccaaugccaugaagacuuccuuuauguuucuccugagaguuuuauaguuuuaggucuuuuguuuaggugcuuuaauuuuuguauaugguguaacguaagcauccaacuucauucuuuugcauguagauaaacaguuuuaacaagagcauuugucaaaaagacuguccuuuccuccauugaauggucuuagcacucuuguuaaagauuauuugaccauauaguuuucuaauccauguacauggauuguuuuuuucauaacccaauuaauuuuuuaaaaacauaaauucagaaccuggaauuuaaucuggaugaauguaaucuuguuuguuuaggcccgucuuccaaucugaugaguuucuuguaaagcuuuuuuaaauauauaaauuuaauauauacacuacuucucccaauuuuuugucaucucuaaauuugguaagcaugccuuuuaugaucucagccaagucgccgaugggcauguuuaguagaauugucccaauuccaggacuuaauaacagcccauuagagauagugcuaaaaauugaauuucaacauucauuuuucagucuauacuguuuggguguguugcaaacauaacugauaucauuccccugugcuucuucauugugcucagaaggacaucaagaauuucucauuuaaacauuauagucuuuuucugaccuucagccuuauaaccauauaaaaaagggaaaauauuuaguuucauauaaaguauuuuaaugaaaauguucugucuuuaauuggucauugucuucauauguguucaucauuguuuaauaaccaguucuagacuucuccggaaauuuaugucagacuuuaucauugcauaaaucauaaaauugugguucaaacucaccuuuuuaaagaaacaauuuguguagucaggaggggaauauuucaauagacaaaagacaaucaguaagaguuauagccgaaauuuauguucugucucucaaugugccccgcacaguguugggaauguauaauacaucucagaucauuuuggguugacuaugaaguaacggaaauguauauucuuuccuuguuauuaucaugguagagcaggcauggucagccuuaugaauaagaaccuaagguucuucuaagugaaagugcaggcacucaaaguccugucuuugacucaacauuucacccuuauuccuucuuacugauugacugauuggauguuuacaugauucauucauucuuucauuuagcaaacauuuccugagccaccaccauguacacaguguuuuguuauaauaaucuggaauuaaacacgacaagaccuuugaucucacacaauagagggaaauagggcaauggaggcaacccccuauaauacuaaucaugauaagauaaaauguauguguguugggaaugcaaaggaagacauaaguaauuaugacugugagaacuggaaaugucuucaugggaaaaguagaacaugugcugauuuuaaauuucagcagcagccaaguggagggaaugaggaagccacacaaggaagguuccugagcccauggaaaggacuuuaucugcuucuaguccuuggagcauagaguguguguaguguacaggacuaggaguguuaagacgagguuugauugugggguugcuucagugcucuaguaugaaguuuggacguuauucucuauuaaguaaagagcuguuuaaaguuuccaaguaggagaaugaaaugauuaugacgauuuagaacgauaauucuuguucauggcaugaaauauagauuagagagucaagacuggaaggaaggagcccaacucucaagccagugcaauaguucaggcaggagaaaggaaauacaaaauuggucucuuacaaaaaggucagaacugucuggagugcaaugaguggcauguaacuacugcuuuuaauccaaacagcauuuucuuuuugugauuagggagacauuaaaauucuuuguuauauaacgagaauaaaaauuggauuuuugaaaacaaaaaugcccuguuuuuacuuaagguuucuagcuucuuuuugaaugauaaauauagguuguaauuuucuuucacugaugcaguuuuuaauuuuaaaaggguagucacucuauaagaaucagcauguuuuagcauaaauggucuuccugugagagacagucaaucugagcuaccuguauuuuaauuuaaauauuuugguuuuugggagacauaaaauggauucagggcuuauaaaugggagcucaaguguuuauaacacugaaaauauggaggccugggaacuucaugaaaaguuggacaacccuaaaugaucuuagugauaauuuugucuacauauuaaacguuaaaacuuucauccuaaauuguagccucucaaggugaagaguucccuccauuuaugaugggaugaauucuaugaugauagaaaaauugaacauauaaguuuuucuccugaugacuugcuguggucaccugccucuggggaaccuguuuucugaggauauucuuuccaauauuguacuugcaacucauucugaaauuauggaauuaguauuguuaguuuccucuucucucugccuuuaaacagaaguagacauagcuacaguuauauauuugacuuggcagaauuuucaguuuucaaaaugccugcuaugaagggcaugguaaggaaguauuuuuugcugugggaucaugauuguuucuaugcacaaauuuagugaguacacucuuugcuugacuagcuaacaagugcuaugggcuuauauccauuuuucagucuuuaaaaaaaaagagaaagaaauguguucagaacuuucucaacucgauggggaaauuauucauguuacgugaacagacgaguccucuccauggcagccucuuucauguaaccucuagugaguuuuuacuuuccuuauguguacaagcucuuuauucagguuugauuaaauggcaaaacaauagcuguggacugucuugguucccuuugggcuacuuugaauagugaacaugcagcagaagaugccaggagucaaaggaaauggcgcugaaugucgaaaggucagucccucaaagauaguuucaccaaaugagaaaauagaaacucucacaaaaaagcugaggucaaccaugcuuuacucuauucuuaauuucuacuuuuuuuuuuuuuacuguauuugaugaauaaauuuccuuuuaccucauguaauguuuagguguaaaucuuucauuguuguaaagguguuaagucaacaauuaccuauuaaagcuuucaugaccccaaaauugaacuauucagaaauacaagugcauuaagacauuauuuuuaaaggcuuaauuuuuuuuagagcaguuuuaguuucauagcaaaauugagagauuuugaagacacaaagauuccccaucuguccccugccugcaccuugucuuccaucuugcauauuuuuugaaggaucgcaaugaacaagaaugggaucaacaguggggagggccacacaccuguaauccuagcacguuuggaggccgaggugcgcagaucgcuggagcccuggaguucgagacuagcuugaguaacauggcaaaaccccgaaaaauacaaaaaaauuagcagggugugguggugugugcuuguaguuccagcuacuugggaggcugaggugggaggaucaccugagcuggggaaaguugaggcugcagugagcugugaucgcaccacugcacuccagccugggcaacagagugagaccccaucucaaagcaaaacaaaacaaaaccaaaaaagcacacaacacacacacacgcacaauggagcugacuaauccagauacuccuuucacccccuaaagggagaaaaagaguaucugagcucuacugaguuucuguuguggcgaguauggaacuuugaagucagacugccugggcuugagggccagccccacugcucacuggcuguaccauguagaacagcuguuguacucucucuaaaucccaguuuguucaucuaugaacugaggauucauaauauuuaccuugcaggcuuuuauaauaaaaauuaaauaagauuucuauguaaagcacuuaucaaugugccuggcccauagaaagcacucaguaaaugguaugugcuauuguucauucuuuccacaaauacauacugguuaacuuacccuguuccagacacuuuucagcaugcuggacuguauagugaacaguuccuccccucauagaaauauauucuagagguaggaggcaacuauaaccauaauaaaugagcaaauuacuuuguaugcuagaaacugguaagagcuaugaaauaaaacugaacaucguaauagagauggggaggaggagugcaggaauuggggcaacuugcaguuuuacauagaaagucacauuaggccucguggagaagacaacauuucaacagugacuuggagguauuugauuguuauuguuacuaccaaguaggauuuuguucuaccaaacagggcuuugcuuuacgccuacauuucuacccuuacugcauuuuguaaaaguugaugauaauaauaaaugcauacuuaauacuaauaauuaaaauaguaauacuggaaauuauaaucuauguuuacacucauuuuagcuauauaaucuccucuccuuuucguauuuuucuuuucuuuucuuuucuuuucuuuuugagacagagucuugcucugucucccaggcuagagcacaggggcgugaucguggcucacugcaaccuccgccucccagguucaagugauucuccugccucagcuuccugaguagcugggauuacaggcacgcgcuaucaugccuggcuaauuuuuguauuuuuaguagagaugggguuucguuauguuggcuaggcugcucuugaacuccugaccucaggugauccacccgccucagccccgcaaagugcugagauuacaggcgugauucaccgcacccagccuccuuuucauauuucacucauuuccacugcagugaguuuagggauuagaccaguaaggaaauuaguucuuuuugcuuacagacaacagaaauagaagaaaacaaacuagaaauuagcuccuuaaaaacaaaauacuaaaacaaaauacagaauucuucuacaggauuucucaacuaucuuuugucuacuuuauccaacuuuccaaugcaguaucaucacacuaaaaugcuaguauuucugaaaauacuugggcucaucuuuguugaaguuauugacaaaaaaguucucaccuuuucugugaaugagaaauauugagguguuuaugcagucuaugguuuggugcugcaguugacucagguuggcaugggaacuggugccuugugaccgcuuacaauaaccaagcauccucaaagaacaggaaaagcugcccuuucagaguucuauauggcauuaaucuguauuucucucuucuaaucaugagcaaaugauauuuuccuuuacagagcuagcaucaccuuuugguacuuuugcacuuuaccuuccuguguagauacauuggaauccgcucucuacgguuucucugugcauccaaagcagugguuacuaacccuauuagauucagugcugcaucuuuguaauguguuuuggaauauccccuucauuucugaaaugaaauguauuaauaauauaacugccucuacacauaaauuuaaguauuaaaauaguguuacaauuuuaauauaaagaaaagagaaagauagcuuucagugcauuuuauuauguaaaugcuuacuuguugacuauuccuggagauaaaaugaugucaucagauguuuggaccuacuugcaaugaauauauuuggauuaaagaggaguaaaacaacauucaacugaguauuggcaaaagcuuuucuuucuauuugaagcuuugaaauaaggaguaaauaaguauacacauaaacauacauagaauccuauaaauguaacaucuguguauguagauugaugccugguuauuguguuggugauugaaaugccaugaauugucgacaugauuuuucacaaugaugaacaacucuugguacaauugcaaacaaaacaaaguauaauuccucuucaauuuacauuuaaggauguugcauuccuugauaauucagugacuacuaaacagugcaagaaacacuugugucuguaaguaaaauacaguuaggcucuauauucaaagaaguaacaggauuuucucaccuaccggcaagucugguggaacaucugaaagacuuggaggauacuggguaauuauuuguuaucuaaggcuguccugucuagcaggccuggcuacagucuaccacaugccauugugacaauugaaaauacugaaaauggucccuaguacccccagugagaaccacugaucuaaagcuccuuugcagugcucaugcccagauggggauccuguccaagcugcagugcuguguugcuccaugauuuagcuuggcacggcacugcgcuguguguaaguaaugcuucuuagugcucuggaauuauucugcuugaagcacuuuccagauggcuggcugauagcuucuggggauacugaaaugcuguuccgaugguuucuaacccucuagucucuuccuuccaauacaucuuauagauuccucaaaguuuguuguguauaaaauggauacaguggauagguaguugccacuccuuuuuacuacuacucgaauuacaaauuauguuuucuugguggugauguuucauugauggacugauugcuugauuggcuguuuuccucucugucguuaucuaagguucauagccauauugcccauauuugucuguuauucaggaucccucucaccacuucugaucgucaucacaucccucuuguuuuugccauugccauucuuucuuuuauuccucuuagcuuuaccaaagggucuuuuauuauauguuaccacuccaucgaaguaugucuuuccuucgagcucauaaaucgugguccucagcugaacuuuaaaaacuguucuauacucaguagauuacuuuuaaaauauuaaauagcuaaaaauuuuaaauuuuauuuguuuauuccucuuuaguuuaucuauaucaaagugaagagguaucugaaagaccugguuucuagaaaucucaaguuucuuugucauagaaacuugucauacauaguaugguuaccccauuuaccacauagguacagugggauuuugucugaggaauuugaauguggcauaacaggcaauaaagagccagugcauauucuucagauaaaauuaacaugaugaaaguuauauucugaugacuuaaauaguauucauuaugcagggguuugugaaggguaugggaugcagauucaacuucaauauaugaaguacuaaggaagacuauucacaguguuaaauaugcugccaucaacaucuuuaccaauguaguaaaguuccguaaucauugagacaucauaacuccauaagggaaauuccagauguguguguguguguguguuuuuuuuuuuuuuuuugagacggagucucgcucugucgcccaggcuggagugcaguggcgcgaucucggcucacugcaagcuccgccucucggguucacaccauucuccugccucagccuucccaguagcugggacuacaggcgcccgccaccacgcccggcuaauuuuuuuuuguauuuuuaguagagaugggguuucaccguggucucaaucuccugaccucaugauccgcccagauuuuguuuuaaguagaaaagaucacucuauuacagugucauggguggccuggggugaggccuguccaggccucuguguaugaucaucagauacauucucaaccaagauauauucuagcugaagccaucacaccugguuauuuucugucuuaaauuaugcugcuugugucccucuccggccuuaugucaucugccuuuuauuguagucacucuuuuacucauucaucuaucucauuagguuggaaaacugagggacagucuuaggcauuuuuuugcacuuacauugacuagcucaguguuuugcaccuaauaggugauggguacauguuaggaaguuggcucuauucaaaccucgccuucuuuguggacagcaucuuuggauuuuaugcaauuuaauuaccuucaaagacuuagugauuugguugauaaaaccuuaaaaaaaacucguacagcuguagucuuuauugcuggaaguaacuuuucuuucuuucuuucuuucuuuuuuuauucauucauucauucauuuggaacuuuuuaaauagucacuuuggccaacuccacauuuuacagacugggaaacaaacuagagagguuaagugacuugccuuaaauccacagccaauuagugacaauacugagacuagaacacaggcuaaagguacuuuuuaaagagaguguuuaucacuuauuaaaacaguugcuuuugcaauaauagugauaggauaauucaucauuaauucaacacuuauugacuuuguuauacacaaaauaugguuuaagcauuggcagugagguaaauacgaagacaacaucuuuuguggaaaggaucuuaaauggagagauuuuaaaauaaagaaaaugugguauauucguagauauagauauagugacaaggaugacagacaugacuuguaagaggcguugauaggaagaaaggcugauggcagcagaugcaggacuagucccaucuuugggugcuaggguugccauuucguuaacgguuccuauguaaaauugugcauuucucaggggaaaaaaaacacaagaaaaauggacaguaugcaucccuuuguaauguuuuaauuaggcauuuuggacuuagcauacugccuuauguaaaacaauacaagcauguaauacaauuuuaauagcuucaauuuuauuagggacaaaaauaaaaagauggaacccaaggacugccaccauuaggaaagucagugcagaaugauuuguguguguguguguguguguguguguguguguguguguguguguguguuuugagauggagucucacucugucucccaggcuggagauuguaguggcgugaucuuggcucacugcaaccucugccucccggguucaagcuauucuccugccucagcugcccgaguagcugggacuacaggugcccaccaccaugcccagcuaauuuuuguacuuuuaguagagaugggguuucaccauuguuggucaggauggucucgaucucuuggccucaugaucugcccaccucggccucccaaagugcugggaugacaggcgugagccaccaugcagggccaaugcagaaugauguaggcuguugcaucagauggcucuuccguuuagauuaucaccugcuugcaccuugaaguucucuuuaauuuuggauugcuuugaacauauucagcucauuuuuugaaagguguucuggcacuuccaaaugucagauaucugugauuuugaacuuuguaauuguuauucaauuuucagugagagaacaggguaaaagaggauaguacauuguaaaggacagucuguuaucuccucuuaauuuuucucuuuagcucuauaagguauuauagagaguguuucacggaaaucaaaguaaaaucaaaaaacucaaaguauguuuucccuugacagaaacuuccuaugaagaaguucugugauccauagauuuaaaauuggccucuuuugggagccauuugauuggccugaaguuaaucauggcuacgcccuucauuguguuuuucagugcagaugugaaauuagucccggagagcaggggcauguuuguuugguguccuugguuaggacaucagcugaguucggccuggucaccauacacaaugucaucuuacauuugguuacugggcaauccagaguucaaugaaaguguccagcuaagaguuaaaugaaacguguccuuuagucaaauaugugauuuggucuuuaauuaguuggugcauuuuugaaaauuacuuggcaacuagggauauuucauuagcauguaaugggauuaauauuuagugaaucauuuuugaaauacaugacagauguucggagccuugguaauuugccauaugguagcaaguaguaguuuucagaauucuuaguucugucauauacgaauacaccuucauaagggugugugacucuguguuugagaaacagcacucucuuuguugcuuaggcuggagugcaguggugcgaccuuggcucuuggcacacugcagccucaaacaccugggcucaggugauccuccugcccccgccuccugaguagcugggacuacaagugugcaucaccauugcuggcuaauuuuuuaaauuuuuuuguagagaugggaucuugccauguugcucaggcuagucucaaacuccuggccucaagagauucuccugccucugccucccaaagugcugggauuacaggcaugagcuaccuuuccuggcccugcauucuuuauaagugugucuacuuaucuccaaagaauauuggagauucuuuuuuuuuuuaauuagucuuuucuuccuguucauucugcaagggauauuuauauuugaaauuuuggagaaugagaguuuuuccuuuaaaauugaacuauuuuugaauaccacuccagaggauguagguguuguauuaacugaaguuucauucugaacauggaaaguuuaauuaucuugugauauuuuauuugauuagaacucuguaguaaucgcuuugcuauauugugaugcucuugucacagaugauaugcccgguuucugucauuaacgcugcacucuuuucccuauaaugacaucacugauuacucauuuuagaaccaguuuccagcauauguucuuccuacuuccugcaacagucauuuuguaguuacuggccuggaggguaagucuuuauccuuccauuagacggguucaguaugagcugcuauuaauuuuaggacaugaaagagagauaaucaacacugcuauuucucugggaauacacugaaaauuaaauauguagacuaaaaacuacacuguaucuuaagucaacuucuguucauuuuaacagacauuuagaugaauuuuggacucuuucauuuuuaaaagauuacaguuauaaugaacaauaauuaggaaagcuuuuuuuuuuuuuuuuuuuuugcaaaauggaaggaauuucaaaauucauaguaauggugaaaagcaaagaaaaagaaauaacccuaaacacaaaacaaaacaagaaacaugagagaggaccgaccaucaguuagccaugaucugacucagucugcaagacagggaauaacuuccaaaugguucuuuguugcuacacauuuacuggguggcuuaaaaaaaauacucauagagcaagagaaauuauguauuaggauaauguccuaguaaaauauuacuuuuguuuugucuuuauaucacaaaauauuuaaaguuuaguacauauuaggggcuagagauugcagacacaacaugauguucugucuuaaaagcuguauucauguuuucuaauauucuuagacuguauccuucucaaagcaagaaauguguuuuauucguuuuuguauccccacuguagcaacguggaaugaacaugagauuaaagaaagccauccuucauguagucauuuuugucaacacugagaaaauacugauugagcaggugguguaagccaggcacagugcuuagagguggggguaccagcuugugugauacgugcucccugcccuucuggaucucacagccuagcagggaagacagauguguacauaacuaaccccaaauacauucagagugucuggaaacacacaggagggaugguuggguuggagaugauuucacagaauaaaucacauucaaguuuggcuggccugugacccauaauuuauaaaucaaaauauuggccaucuagccaaugucauuaugagccacgcauuaugccaagugcugaagauacagaacuggacacaacauacucccugaacucaagagcccauugauuuguagaagacauauacagauguuuaggaauccaacaaguagaaacugugaaugggaugcuguggaaggaggagaaagacugaagaggagagccucaguagggccggagaagagaggcccagcaaaaacuauacgggaagcgacccuugaguuuaggaagggggacuaggaauuuaguaggucaguagaggguggauuaaggucugguuucaggcagugaaaccccucaucuaugaaaauuuggagcaugauaagugaugggguuccggacaugcuaccccaaaauauggcauuagaacaaacagcagaagcaagaaggucgcucuuaucuucuacucauccuuaucuccugaagcaaguuauaaauccuucauuccagaggcauacucucuauaccuggagaagagaccauccuuauccucaaaggcagagagauaccaagaagaaugugaacaaacaggcguugcuaaguuuuccccaauuuauuaccauuagaucauauucccauuguccaaucacacuuccccauaacucucuggucuucgucagaccuaagcauaaaaauagaccaauuucccugcuucuuugggucuucauuucugaaggcuccugggucacuuaaaaccuacauuaaaauaaauuuauaugcuuuucucuugucaaucugucuuuuguuauagggaucucagccacgaacugauggguaagaaaagaaacauuuuccucuccuacauagagacauagagaauagaauucuuaagaaaaauaguguaugucguacauggcaggagaugaaacuggcgaggcagcagggcuuagaacuucugguaggugauagagaguuguucaagagugaguguuuuaggccaggugugguggcuuaugccuguaauggcagcacuuugggaggcagagguggauggaccaccugaggucaggaguucgagaucagccuggccaacauggugaaaucccgucucuacuaacaauauaaaaauuagccaggcaugguggcauaugccuguagucucagcuacucaggaggcugaggcaggagaaucacuugaacccuggagguggagguugcagugagcagagaucaugccccuacacuccagccuggucaguaaagugagauuccaucucaaaaaaaaaaaaaaaaagaaagaacaaaaagagugaguguuuuaguuacagcuuggacuuagcugcaagacagagacccaacuacaguggcagaaagauacaacaguuuauacucucaaauaggagaagucuuggcugggugugauggcucaugccuguaaucccagcacuuuaggaggccaagguggaaggauagcuugaggccaggaguuugagaccaacuuccaaaaauaaaaaaaaaauuuagccaagcauguuggcaugcguuuguagucuuagcuacuuggaaagcugaggcgagaggauggcuuuagcccuggauuuugaggcugcagugagcuaugauugugcuacugcucucuagccugggcaacagagugagaccuugucucuaaaaaaauaauaaaauuaaaaauaaaaauaaaugacgucuagagggaaguauuccaagucuagagaagcaucuuuagaagguccucagaugucaaucuuucuuuugguugugcugcaccugacuuucauccuuaagguccugcacgguucaagguggcugcuggagcuccagccauuaccccugcauugagaaagaaaggcagaagagccaaaaaaaaaaaaaaagcacgugccucauaccuuuuaaguuuaaguucuggugaaguuucauacaacacuucucuuuagcacacauuuuaaaaaaaaauugggagucucaaggaagaagggagaauggguauuucagacuagcuggcauuuuucaucaccuggaggugucucaucagauguugauuuacaaagauuucccuggcagaggauggaggauuuguuggaaaggguaugaaaccagcagaaacgaacacgccacaguuugugcguuuaauguuucccaucgcugacauucuugaguaagcgucagugaugguucuagcuugaggcauuuggaucauuggggugcaggugcaccauauugcacauaauaccugcacaugcaacuuccugaugggauuuaauggaggcuucuagggugucucuaagggucuucggugcauuugaggugaggaauggaguugaguucugucuuccgugauuucaguauuuggugcacuuucugcuuggaaaaaucucaccugcuuuaaaaauauuucccacucuuugaauaaccuuaaagguaucauuuaugauguuuucugcuuugacuuuuuuggccugacauuugaguucuggaaaaauaaacuaaaagucagcuacuguuuuuaccuuaaauuuauccuuuaguguguauuuaaaauaauuauuugugaaauuuuuuagcacuucagguuuauauaccucguugcagagaauuuugcucaguauauauucugagcauuuucggaaucacuauuguuuguguagucccuuaccuuuaaaaguucauuaucagcauuacacaguuauuggucuuugccuccuaggaccuauacuguuuguacuaugugugaugaucgugauauuguaacuauuaucucuuaaguuccuagcagaaagaaauucugucacagaaagaauauguaauuugaccaaugcaaagaaauaauguuauucuacuguuuuucggaaaugaaagaaccaaguuuuuaaaguaguuauguuuuuacuauaaaagauucuuggguugauaggcacagcaaaccaccauggcacacguuuaccuacguaacaaaccugcacauccugcacauguacccuggaacuugaaauaaaaaagguucuugaaguuucuggcugccugcaugacauaguggguuucuaaguugaagggagagagagagagugcgcaagagcgagcacuggggucaggagugggagggaaaccuuaccuugucauuacugaguuuguauaaccagacaccuggaucagauuucagaaagcacgugaaauaauuucaauuguaauaugaaaaugcuuuuaaaaaaugagauaaucagucauccuggauuuguuuauucugcgaaaccuggcuucgagagguauuuuuggcaucuggguugccugccuacuguguuuuguugaagcagaagggggcagcagagaaaccaacuagaaagcccacaucuguguugguuccuucuaacggaaggugcugugcaauguaaauacacuacaaggaaaugaaaguggaaaguccuaucuuuuauuuauuaaauucuaaaaaugauugcaaaacauuuucagauaacaugauucggauuucuacuuguccauuuauacagauacugcgaaguggauauauuuguguguuuuguucuaagaucugacaagcaaguguagaguggauuauuuguaauucaguacagcuuucaguggggcuuguuuuccaguagacauucuauguguuuauagaaaagcagaugcucuaguggguuuuugcaguucauucuaauauuuauaauuuauccacuggaguaagaguuuuuaaggaaaaccauuucauuucuuguuaaaauucaggggaguuaaugccuuuugacugaauuuugguuuuggagucaguuagcagucuaauuuuuuuguuuuauuuuuaaaguauugccugugaaaauuuucccguuuguugaaaggaacaagguuuaagcugacugauugguuucaugcccuuaaccuuugaaaaugugguaauuaauuaaagcaauacuauuuuucuguaaaugauggccaagucauguugaugggccuggcuaacuaguuauaugugcuauguaugaaagcuguucuauuucucauuaauauucuauauuucuuuuccugugauucaggacaguaagauagcauagcugagggcuucucacugaaaaccuaucagguguuuugauguauucuauguuuaagauaauggacaagguuuagugguuaacaggaaacuagugccucuuuucacugacuuacaaguuaaaagaaggagucauugaguuauaugguaucuuccucugcaggagagccagugaagauacagcugcaguucuguuccaaauccauuauguguguuuuauauuuugauaaauuuaaucuguugacuuguuucagccccauuucauaagauaagcugugaaagaaaccuccucaaugugauuuacaaagugagaagugaaguguuagcuguacucuacugguuaggauuuauagcaugguacaguauuuagcagaauguguguguguguguguguguguguguguguguguguguguguguguccaucucagggugcuugagguauaggauuacaguuaauucuuuuuuucuuuuuuucuuuuuuagacagaguuucgcccuugucgcccaggcuggagcgcagugguaugaucucggcucacugcaaccucugccucccagguucaagcaauucuuguaccucagccucccaaguagcuugggauuacaggcaugugccaccacgcccagcuaauuuuuguauuuuuaguagagaugggguuucaccauguuggccaggcugaucucgaacuccugaccucaggugaucugcccgccuuggccuccggaagugcugggauuacaggugugagccacuacgcccagccaugauuacaauuaauucuuauugaaaguacucaguggcucaucuauuaucucuuuccagugcuagucaucucauucucucucuguaugguaguuguuauuugaugagcacuaguuguauaaaaguaauaugucugauuucuucaagaaauguuuuucuuuucugucaucagugaccucaucuaugacacuggggacaacuguccagugaaaaugcacugccguccagugaaaccaugcugcuuuuucccugcacguguauuuguccucuugaagcugcgacuuuugacugaaugccagauguuguuauuuuaucuuuuuggguacuagcuauuuuuguaucccucaaauuauucuugagcuuuuuuucccccuguaacacagugaaguuauuuggaaacaguuuuauuuaguguguguaggggaaggggucuugcuuuuaaucuuucuuaggugggaccagagcaguauuuaguguagggcaagucacugaggcaaggcucuuugggucuucuauucaauaccccuugaaccuugagguuuucuacucugguugaugggagcaggcaguauucguggucuuauuugagcaccugcuacuguuaccucuaacucuuucagcugguccugucccagcuucaggcaguauguucaugugcaugggcugauuaguacuccguggaauauuuaaggcugaccuucugcagauuuguugauuucucucccuguacacuucuuuccucucugguauucuguccuguaaacucuagccuuuuuuggucucccuauacucucaacuuugucaccuuaacucagggccuccuucaggcuccgccuggcuucuacuuguugugagcgugacuggcuaaggcuggcuucacgggaaguaaauaauuuacugaaacaggugcgaguuaaaaccaaguuuaggccgggugcggaggcucacgccuguaauccuaguacuuugggaggccgaggugggcagaucacgaggucaagagaucgagaccagccuggccaacauggugaaaccccgucucuacuaaaaauacaaaaaugagccgggcgugguggcgggcgccuguaaucccaagcuccucgggaaacggaggcacaagauuugcuugaaccugguaggcagagguugcagugagccgagaucacaccacagcacuccagccuggcgacagagugaaacuucaucucgaaacaacaacaacaaaaacgagaacaaguuuauuagcgggaagcaauggccggcacagcagagaagaggcugucugccaagaggcaggggcugaaaggaaguuuucuagggccaugcuggagggguuaugugcagagaggauugugcugcugggguauaugcagagcaagguauuugggaacaggauguuguacaagcagguuguuugugauuagcugucucucagaacaauuguucucccccaucgggggcuggccucuuccuuguuggugcuaacuuaccuugucaggacuccacaccaccuaccuucauuguggucuggaagcuuucuuaauaaauuggggcaguccuuuuguuuauuucccagucucucagugauugcugccuuuguucaguaucaugaaaaaccacuggauguugguguuacacauggaugggaagguaaauccaauuuccaugauuacauccuggcuggacacggaaaugucucucuauaaauucuuaaaacuguccccugucagagcccaucugaaauuagugcuuuucucuccuccugauaaugggguucuauuagugcugaaaaucuaaguuguaggcuucacuaugaaaaacugcacagccuccccaagaaauaucaucaccagucugccugguggucuucucuuucuuucgcggauuccuaaauagguuuacagggagugcugagaggaucgucacacuuaggccuacugagggugacucggcacagaaugggaagucugcagaagaguagagugagguggucauuucucagcagauauguuuauuguuacccacacucuuuuucuaaaagauucgaggaguaugagauauuuauguauuuauuucugaagucugccuguguuccagucaugaccauucagaugcugagauacaggauaagcaggaagcagauguuucuguccacaggaaccucccugucugugggagaaacaaaugcuguguaaauagaaagugauaauacgacgugauaaacuacggcuuucccauucaaggacuuuagaagauacucucuuuuccuccuuguaccauuuuaacaaaagcagcacagcacuauaccgaugccuuuuuauacuuugcguuacuuggugaaaaugaaguucucuauuuuaucugucagcaaacaucuaagagcaaaaauuauuugaaaccuuuguucuuaccaagacuaacuuuaucuucauguggcacauuuuaguaauuuaccuaguuuguagccaucuaacuagaauuugcugauuguuuauguauuucuucagauugcugauagauuuuauucuaauaagcgaaaagcaauucuaagccuugauccuuaaaagguauauuucccuuggcagcaauucuaguggaaacaauggguagucucuuuuuauuaaauuuuauuuauuuauuuauuuauuuauuuauuuauuuauuuauuuauuuuuugagacagagucuuacucuguugcccaggcuggagggcaguggcgugaucucggcucacugcaagcuccgccuccuggguucaagcgauucuccugccucagccuccugaguaucugagauuacaggcucauaccaccacaccuggcuaacuuuuuuguauuuuuaguagaguugggguuucaccauguuggccaggcuggucucgaacuccuggccucaugauccgccugccacagccucccaaagugcugggauuacaggcgugagccacugugccccgccuaaauuuauucuauuuguaugaaauaacucuaaaaauuuggucuucauuaguguuuuuacuuauacuucaagaugcugaauuauuucuguguaaauauauuggcauuucuguucuauaagacagcauuaaaugaaauaguuucguuucuuuuccaaguauauuuuuaaaaguacauuaguguagccuauuuuuuauuuuuuugcuuugucuuuugauagugaaacaaaauacuacuauucuaagcuuggguuuucaaaauacacauuauucacgguguaaauucugcaguagccuuguauuguagcauaugaaggaggaaaaauuggauccauuuagcucugaucccuuuuuuguuagcaauuuauguguauaaccaacagauuucuccuuaagaaaaccucauuauuaagcuaacuuagggaaauuuaguaaagaaaugauuuggaggaaagcaaauaaaguaauccaaauauacaauaauuauaccaaaauuuuaacaucgauuuauaagaauaucuuaccacuuuuaaauuucuuccaaaauugacagauacugauuuuuuucauuaacugucaguggaaauccuaugggagacagcucaaauuuugacagcuucaagaaaauggauggcuucuccuucugugugguaauugaucuuaccuuuugaagaauuagcucauaaguauagauuuggagagaguuacaauaugcaauacagccuuccucuuuugaaaauaagucagucauucugugaacugaagacuucagcaugaagaagguugcucugaagggcagaguauauaauauuauuugguugcgacuuuugcuagcuugguggcucuugagaaaucuuuagugaacuugccaguuucauguuuguaggggguaugcaucuauccaggauaaucaucccccauugaaaaacuaaccuuuucaagguuaaguauaaugugaaacaaauaauauugcuccagaaugaauuucugugcaguuuguaugaauuaacagcuggcuaauaagaagcucuugaagucuaucauaagcaaggucuuguauuagccauagacugagcagaccuauugcugccucuaccguuuaccucacauggugaaguagucugggaaaaagcagugucacuguuccacuccagauagcugucauuaugguauuacauaaacuagcagacugcugugggacgcaaaggggaugugcaccguuuugguuauuugaggggacuuuggcaugcccuuguaggagcccagaaggaaggaucauacaguuuagucuuaagcugugcaaaaacaugaccacaugaaugaaaccagucuuccugaggccagagggcuuauaaagaggaaagauacacaccuugaguagacuucuuuuugagcaaggauauccagaaguagaguguuaaggcaaagcaaaagauucuuuagacugcacucaagucugucuuuauaggcauuucuugcuuguguagcauggaaaggaccacugcuugcucaguguggcuuuuuuuucugcuaugcuggaccauguaaguagccauugagauaauuuauuccugagucaaaauaagagggcauuaaauuuaguagaacugaaguuggcacuggcuagacugauuacuaugaugggaucccuuggagagcaucacuggugaaagcaccuggauucuauuuagaaaaacuuaaguauguaaguugccuucuuugggggaugaaacuuauaaugaacuauuguagaggguaugaaagcccacggcauguuucuaucauauacuauauauauauaugcuauacuaagauguuaugcaugggucaggguccuugguaaggcucaccugucauuucuuauguaguuuauauuuguuucucuuugcgcaaggauuuggugaguuaucuuauggacaaugaaaggagaaauguccuaaugcagaguucgcuccuaaguuuaaaugagaaauaucuaaaauccuaaaccaugaacaugguucaugguuuagaacccuuaaaauggaauuacaguacuuuuaaauugguagguguaaggaacauggcugcacugcagccaggcaggaugggcugagguaaacaucccgggugacucagcaagucuguagcgcaggcgcgcaacuccauguguaauauaaacagcuauguagccauaacaugggagggccaucacuuggcucuuugccacuguugucuuuaaaagguauaauugcccuggugacacugugcaggcgugcuugcacccaaagaaagagagagagcaccagaucugucugucuugcagcggggagccaggacacagcucagcuugcuugcgcucagagggaaagaguuaagcuguugaccccaaagggagagagagccagcagagaucugugcuugggaguggcuggaacaagcagccgagacacacaguguaagagagcugcugaauaaaauuguauuucaccuacccguagcccccugaguguucuuucagcugucugccauucaucuacccacucccuuccggccucagcaugggcuggaaccugacccuggaccuaacaauggggaucuuagggacuuaagagaucaucuaaaugaacucuuuacagaugaagagacugaauccccaaugguuaaaugacuugucuaaguccacacaucuaguuagacgcugagccaagacagaaccugauuucugguuucuagaugugcaccccuuacucaguggcauguacuguaauucacaguuuccauucacuuguugccaaggucugccacuuccgagaguuucacaguuuugguguaaguguacauugccaaaugagaaauagcuuggaaauauaacugaagagacauuaucuguugugacugcagcugaagcaccaacuuuuaaccaguauuagcacugcuuauuucagcuccuauccuuaucucaaauaauucugccuuccuauaacacaugauggggaccccugggagccgccaaaaaggacacuuacucugaggucuugcccaggucucugcuucuuccuccuuguucccagauggcaaacggacauccucauaguaagacugggcugcuuuccaccugcgcagccccaugguaagcaccugcagcuccagagggaauuuauuuuaguaaaacaaacaaaccuggagaccaggagaucaauuaucaguaguuugguaauaauugaaaacuaggucagaggcuucuauuccuuuuuccaugagagcuggauaugugagguuguucuugaugaaagcugaauuuuuaaaugcagguuaauggcuuucuuggaagccagcaagcaauuaagguuuucucauccaugcagaaauuacagcugcagggggcaauuuuuaaaaauuccuuuggauucuuagaacauacuauauuuauuuauuuucccuuaaauucugaccuuaagcuuaaaaauaaguuuguuaauacuaacguuguuuucccuugagcuagcuuugaaccucaaaugaauugcaaacugcgaagugacugcuguagggcuacucuucaguaagcugguccaguuauaugguaaugaauccauuuauaaaaaaaauuguaugugagcuguuuccaaggcuauuauaguauuucuuuaucagacuauacauaauuuuacguuuguaacaugguacaguuccaacugaauaggcaguaauuuucuuuauuagaguugcauuuuagagugguucauucaucagauuuuuaucaaauauauucuucgugucauucauugugauagguucuggaauaugauuaagaaauggucccugaacuccaggggcucacagucuaggaagaaaaaagacaaauaaaauuauaccaauauaaugaaugcaguuccauggcauaugaagaguguuauagaaacacagagcaaagauguaacccuaccuagugucaaagaagacuacacagaagauggugcauuagaaggaagagaaagaauuggcugcaccaacaggaggaggggaaaggaccuucugagaaagagaagagugugugcaaagcaguggaggccucagggaggaugguggucugcuaauacugaguuuagugugguugucuuugucuuacguugcuugcagggaauaaagcuaguauuugcuuugcuagcuggacugagcugggcuauacuaaguugucugaccuuuaucccguacacaacaggaacuacaggagguuuucaagaaagggagugaagucagauucauaguugagaaaaacauucuaguaacuaaguggugaauagaaugaagaaugggagcacugauuggaaagcauuuauaauagacgguggagggcaaguuuuaggaagcaggcagugauugugaugucagaaucaauuuguaugauauuuaaauaguccacccggaacucaguaaagcaaagauuguugaagagggugagcuugagagacuggauggauguugauaacauuaauugugugagggugugaucucuuugcugagauuuuaaguacgguaauuuucugaugugauaccuguauucauagcguaaccugugacccuauuuggauagcccuuaugccucuguauuaugauugucagucacuucccugaacuauaaacuucuugaggucagagauaaguuuuagugguucuuguuccacagccucugacacagggcuuaguuauguaauaggugcuugguagauuuuggauguuuagacguggaugcaucagccaucuacuuaagaauuccucuuucgaauucuuccuuugcacaagaagaccuuuguuucuuaacccaaagaagacgagcucuguaaguccguuauaauuuucauuuuauggccaaguuucucuggacuuucauuuuccagaaacuaccuaucuuagauuuugcucuuuccuuagugacaacucaguaaaguuccuauuguucagagauuacaugaugaaguagauauauacauguguguuuuuucuucuuuaaguuuggcuauuugaaccuguggcucugugguguaaacaguaauuccuuuccagauuuauuuauuuggaaguuuuugggucuuuaaaaauuacuccuguguuucuggucuugaguuaaauccacuuauaauugcccuagggguucccauggcaucagcacagcuggaggucuggugggcuuuuguaaauggcauuuggaagagugauucauuugccaaagcauuagcaaucuuuuguauuguuuccaugugguuuuugucuaaagagacaagugcugggauuuuauuuauuuaauaaacuuuguuugaaugagcuaauuuccccacuguccagaauuacuaagggaagaccugagcauuuauuucaaggacuuauucuauccauuccuugcuucaguggggagcagucacuucuguagccaccaacuaccugauagucuagucuuuucugugauuaaauuauaaaaauaaucucuuugugaacuugucugcuuuugguauaaggucgcauauuuaaagagcaaucugugaugagauauguuggcuucauuuucuguuuguuuucuaaagaaaggaaaaauagauacauuuccauuucaaaauucuuuuuuuuuuucuuuuuuugcgauggaaucuugcucugucacccaggcuggagugcaguggcgcaaucucggcucacugcaagcuccgccucccagguucacaccauucuccugccucaaccucccgaguagcugggacuacaggcgccugccaccacgccuggcuaauuuuuuguauuuuuaguagagacgggguuucaccguggucucgaucuccugaccuugugauccgcccgccucagccucccaaagugcugggauuacaggcgugagccaccgugcccggccuucaaaauucuuuuuaagagccuauuauaugcccaacucuuguauuacuuucucuuuuuucacguucacaccaacccuacuugagagcuguuuuucuccucacuuugcuguugagaacaguguuucggagaguuuaaggaaucuauacaagucccuuaguaguucauaucagagguuguuuuacacccagguuuucugucauaagacagaagcuuugaaacugccuccauuguccccauggcuccacauaggccagagggcuuccagaugcugauaacauugaugaagagggaaggucagagacuagaccucaguuggaagcuguggcaguugugcugugaaaacccaccagagggaagagacguuucaauucuucuuucauaaccacggaaauccuaagugacuuguggcaccucgguauauuaggacuucucauuucagaaaguuaauggucuucucuccucucugucagugugauguauguaaccacugauuagcugacucauuuguucaguuggcagauacagaggcgaucaguuuacucgccuugcuguuuaaaaaucaugauaauuuugcacucccuuugagaaauggguaaguucagaaaucaguuuugggacuaucuuuauuuaacuaaggcauaagugacugcaccuucagcaaauuuaauuccuggcuucagacugcaguaaucuuaaaugagacauuuuguuguaugcuuauaaccucagggauuuuaucugcugccgucguggucuuuugaggaggauucuccuguugcaaaggaugucuacaauguaaugaauggcaagaaguaucaggaguauuuugagugcuuaaacccauccgagguuuauuaauuuuccggauauggguuaacaugguuccaugaauaggcacaaggccuagagaguaggauuaggaagguuuccagggauucugaacucaugucaagcaaaacuggcaugcugggcagcuaagucaacugaauagggaaaagacuuugaaagugcuuuaucucacugcauaauguuugucaauuucauucaauuaauuuacagcugcagggcucaugaggcugaaauuaaaguuuuguaaaguuucgauaaggaggcagccaaacaaguuugauuagcaguggauguuuuggaaaugaguuggcagccaugcaaaaauagaggguuugaauuucaggaggcacguuggcauggcagugcccauuugauuaaccguggaaagcccauuacuuuccaccuggcauuucgggcauuucuuuucucugugugucuucucugagguaaccucuaacauuggaauaaacaucuuuuuaguuaagucucaucagcccauuguucuuagucuguuuuauuagcaauaaauccguugucuguguuauucuuucuacagccauacaacaugcucuuuagucuuucuuuccaaauuguagacauuucaguaagguguuucucccucugcagguuggggcagcacagggccuuucacuuggaguucaggaguugaguuguaugaguuguggcugaagggucacagacaagggggcacagcaccuuuucacauaauauuuagcaggcuagagucuguacaauaacauugaucauuguucauuuuuagugcuuuuuuuuuggugaaauaaaacaugacccuaauccucaacaggaaaauuucauccuccuaaacgggauuuggugcugacaaagauucuuugcuuuucuaaacuuuagucagguuccugaacucuguccccaccagggcccaucugugcauuuuagcaaggacccugcuaagucaauuuagccagaaccccaguccuucauaucugaucagucucagugucugaucggcuuccucaucccccaucgggugaugugucaucaucuuggccugucuuuggcaagaauccuguuaggaugguguggccagaauguccucuuaccugugauuuugccucuuaauaauuuuucauucaccgacugccacccuccucuuuggcuauaaauucccacuugccgaugcuguguuuggauucagccuggggucuugacugagaucucuuucccccuguugcuguaguccugauaaaaaauauuuucauugcucugcucuccagcucugcuuuuccuuugacaguagccuauuuaaaaaaugauauaggagcaggagggggaacgcaaggguuggggaaggacauagaggugguuucaacuguaucuauaauuuuuuuuuuaucauggggaggaaaggucucaagcgaauauggaagguaaacaugaggaaauugguucugguacacuggaguuucuuauuuuacucccuuugcuuuuuaaacugucucgcgaaaggcuuguguuauuuuuccccccauuuccagucugucccagacgaauaucguccuauugcaacaugaccagccugcagcucuugccccaugugucacuuuuauacacaaguucgacaagacccgaaccagccaguaccuucucccaggagacgagcccacucagccugcauuuugauggaucagccgugucacauugcuguagaaauuucuaaauacuuauucuuuuuauuuuguuucuuauuucacaguggauccacaacagucucuggugaacagcaugcucugaguagcaccguucuagucuuuguauaccagggauguuucacaguaaauguuuaaaucauuuuggacauauuuauguuuucaaaguauuuuauguuaacucauuuacccaguucugcauauucgcucuuacaagugggugauucuuuuauuccacaaauuuaucuccaucuuggagcuuuguuaggugcuccugaaaauucagugguaagacuuguucuugccuuaucucagccagugaauauucaaagauguguaauucauagacuuuucuuucaaaggagcucccauuuuagaguggagcuagaacuaauaguuuguguuccauaccaggcguauaagauaaaugcuacagaaacccugaaaagagucaugauuuguaauugggcagguugaaagguuuuauagaagaauggcccaucugaacaagguuuucuucaaggaugaguagggaguuuucagggugacagagggauaaagucaaaggaaaaaagcaugagcacaaaugaggagagauggcacacagcaccugcugagaagugaucagcagauggguggguucuagaaugcacccagggaggugagguuagaaagguagaaugaagcaagacaguauaaggcuuugauuuucacacuaauaauuuugagcuuuuucuuauucacaugagaagauuuuaaggcaugaucaguuuugguuagagcccaggcgcauaaagaguggguuaugaaagggagagacuagaaggggagagauuaguuaagagguugucaaaacagucuaaauaagagaugauaacgaccucaacuauagcaguggcucugggaauuuagaggagggaauaaaucugagggcugucucagaggugaaagugaaugagugggguuugggaagagauggggggccaggugaggagcacgagcuuuuuuuuuuuucuuuuuacauggacaaacugaaucacagggagggacauguuuuccuguggaugaagauacagauaauuuuugcauccaagaggagagagaagcaucacucucgauagccuuaauauucuguucucaaaauaaucaacauuauuucaggaaugagaguauaagaaauaaaauuaaggacagugggaaaauauaaauuugucuuggggaaugugauggggccuucuguauuauaacagcuagaaucuugacugacaguuuucugauauagaccuuuaguucucauguuugaacucccuauauucauuuguucauucuucaauauuuauugacagcuuaccuuguaagaaucauuguauuaugaguuguggauagaaauacaagacauaaauccugcccucagguagcucacguuuuaaaguggaggacaggcacuuaaauacagcagugugguuggaguggauaggcucacaggagccguagcaaaauuagcaaaucuugcugagaauguggggccaugaaugucagugaaggagaauaguuuuuguuuuuuguuuugauagagacaggguccccuucuguuacccaggcuggggugcacuuguaugaucauagcucacugcugcuuuaaacacuuggguuuaauaccaccucagccuccggaguagguaggauuauuauuauuauuauuuuuuuuuuuuuugagagccaaggucucacuuuguuggccaggccagucuccaacucauggccucaagcaauccuccugccucagccucccaaagcacugggauuacaggugugagccaccaugccuggccuagaauacuguuaggagaugagaacgugcuagccggugaaaacaagagagacauuccaagaagggacuguaggguuuagaggaagagauggcuggggccagauucucagaggcuggguucuauauggcaugugagaauuugugguugagugagaaagagaggaacagcgauuaaaggguuuacccuuuaauggagaaguaagcaaccaaauggaguuucagugggauugugcuggccauuauggagaaggggaucugagauguagagaagaagggagacaccugagagacggugcagugguucaggugagaaauauuuggaaucugaacuagagcagcaauauuggggacagacuaaagaguuaauaaauagaaaguaaaauugguaggacaucgagguggauucaagucagaaaguaggagagaggcaaggaguucgaggugacacagguucaagcuugagcuacguacauaguggaagcauugcuaagagccugugcgugcugggaagaaggaugaugaguucagcuccagaaaccauaugaggugccuggagaucuuuagcaggcaguuauguacucagaugcaaaggucuguggagaaauuaaagccggauagaacuuugggaaucaucagcauuuaggaauagauuguuaaaauggauaauggagguauuuacguaggccgaacaaagagaauuucaaacaccugcauccuguuuaauucuucaguuuaaauuuaccaacaaacauaaaagguaggagauugggcugcuuucagggcauugagcucaaaagacagaaagaggcaauuuaugugucacuuaauguuuaucuuacgcuugccuaccgggaagagugaaaagauguuaaagaaaaagagggaaucuuuucauuccuugaacuguuguguugaauaaauuuuaaagaaaaagaagcaaaaugaaauaacuugagaacaagaaccuaaccgcauaugaacauaauuuacaugccauaaaauaccauuuucaauguacaauuaaaugauuuuuauaaaauuuacauaagccauauuuuuuaaaguauuaaaagacaguuaugagcuaagcuuuuaaguacagugaugauugagagugugauaaaaauacugcagguagcauuuaauuagggaaauuccugccaguugaaagauguggauggggauuggcagagauugaaggaacagccauuuugugccagacacucugcuggaagaggagcagauaaacgggcgagucugggagcauuuuaagcagcauuuaaaggauaauaagguccugucuucacuaagccauugacaugaaugugauacuuuuauauuuguuucuguuuucugacuuuagcccuaggaaaauaaagggucauacuagcauugcaguuauuuucucacauaaaaaauuauauuuggcugcuucuaauuggaaguaucuauuuuaagcucaacuaacccuaacaucucagguaacuguggacagaacuucacauauuauaagcgucuuacucuguaaaaaaaaaaaaaaaaaaaaaaaaaaaaacaaaaaaccccuaaaaauacauauuacuagugauguauucauuuaaacaagcuaugacgauuuaucuaguuucuggaagauacugaaacuugaucauuucuuugcugcagugaccuacagcauaaguuaaaugguaguuuuaguugauuaugcuuuauuuuauuuuguuuuuuaagucaaagccuguuuuucuccaugauaauauccuccucaugguaagacugcauggacaagaaguugcauagagaauagaguguucgugggaucuuucuauaacuuguaagcaaaggaggcuuuggguuugcuguggaucguccucuggagagucgcauucauuuucucagaggagcucugucccaggaugcucaggaauauaaaaaauaaaagugcaaaaggaaagaggacguggcagagccgaccuuuuccaacucugagggugaauaucuucugucuugggaggauggugacaagcuuggacuuggaaccagaacccuggucucuugagccauguuuguccaguccugagcgucagcaagcagucagggaggagggaaagcaaggguugcaggcagaucuguggaaaaagugagcuuugguaugaguugacauaggcauugccuguuggugugguaauugcccaguggagacguccacaggccuuggagugacuccugaguggggccaucugacucgucaugcugccaggcagcggcaggucacaguugacauguuuucccauuucuucacuaccuaccuggcuuuuccacaaaaaugaacucccuuuuaaucaucauuucugcagucuauuuagagaguaugaaaagcuuauacuaaucuaaaauaaacuuuuuuuuguuuuaaugcguugaagucuugcucugucaccaggcuagagugcaauggcgcaaccauagcucaccacggccuugaacuccugggcucaagggauccucuuaccucagccuccaaaguagcugggacuaccagcaugagccaucaugccugucuucccaaucuauguauuagugccaguaaaacaauuaagaagagugaauauauuagauaaauauauccuagcacauuccgaagaugaauagaauuuauuaugauuuuaaaucgcccacuccaguuuuuccuuuggcacggagaacugaaagcugcauaucagugcugggcuguccauaaauacuuacuagucauuguacuguuaacaguuauuuaaugauuuaaucagaaaagacuggcuuuggauuucugaugagguaaugagaauuggcauuuaaccaguuaauuggaauuggaaagagcuauuaaaaggccaugagaaggucuuucaugaaacccuugaauaugcuucagucugaagaucuuauuaaauuaugccaaggguguuuuuuuucccuuucacuuuaaaucacccguuaggaucaucucaucagcuuccugaauguugcugcagaugaaauuauuauugacaucauaauguuggaauuuuaauuuuuucucuccaguugucagugaauccaguguucaacaaucacuaguuuuucuuagccccauugggaccaaacccaaacuagucuuaaauuuuauuugcaccuuuuuggguuugaagcuugauuguucgggauauuggugacagugcuaggacucagugucagucauuguuccauugccuauugaggacauaguucuacuucuuuuggacagacagccuugcuuuauucaagcgucccauggaaaucaguuuguugccacagagaagcagauggguagauagaauggucaaauuuugcugucccuucacuaauaacuuagagaacuguuuauucacagccggccaugaaacaaaguaaauguuuguuucaaaauacguaucaaauugaauauuauucugaagaaacaacuugcccgauaggcccgacacaaacuggcuauuaccauuuauuuucaacuuaucagucugauacaaccaaagagauuaaaucugauaguugaaaacuauuguaggucucuagcauuauuuaaagauggagacugguuagaagagguuggcuggaaaagggugggagaaaagcaaaauaggaaauguuuuguuccuuuuaugaccaaaaauucuacuauucccagagauagccuagaaguaguuuggcaaaugacauuuuaguuauuuuuggagcugcuuuucaauauuuuaacauguguuuauguguaagccugaaaggauuacaaaugugugugugugaguguauauacauguacauauaacuacacauaucuuucuuuauauaauaauuauguuuuugaaaaguugaguauaauaaaauacuuacaaucuaaauaccauuuuaauaggacaagggaagcugacuuucuaaauacaaugucacauucuaagugaugaacauaauuuuguuaauguaaaauuuagaacaguauagauaaagugugucacucagccucaaaaaaguucuaagauuuugucaucuucauacauuuauuuuguaaaugaaauaaaauauuccagggaaauuugaaaaaagauuuuuuaaaaauuaaauaauagcuccuuguuuauuggcuuuaaauauuuaaacauucaaauuguagccuuuuucuaaaugcacaaaauacaaaauauuuucuccuaaaguccaugaauggugccuuuuggccucucugaacccucuucacacagcaggauuucgaacgugugcuggacaccaggaaacucaugucauucccgcagggcuuuggauuuaggacuuucuuagauugacagggaccgaauauuugaaauaaacuauugacaugcaagaggcagauuaaugugaagguuaguaguuuuggagcuaauuccaucaucuuucuuguucuugauuugcaugugugcauugaauuauguugucuuuuugggugcggguauagauauaguuuuacccaauugaucauuaacuuuuuugagggcaucuauuuguaucuuguuuaucuugauggaaauaaaauauaaaaaucaguuuagugguaauuuuuaaauaauuagacacaggaaggaagaacaggguugcaacaaaaacacuacgacaaaacuaaggaugguggaaaagcaagaagguaaauuuaauguagacgggugucuguaaaauauaauugaaacuaaacuucugacaccacauaauuuuaaucacagaaauauacuugggaaggaaauaaauucucaaagaaaaccaacuagauuuaagauugucacuaaggaaggcugaugcaggugccacacaaagugauuuaggucuagggccccggacacuccucuacaucauauugauaugauagguagcagguagauauccaagucugaguuggucacgaagcagaagguauugugugacuucucaggcagugguacagcccucucggugaaaguacugguuggaaacuggggugggauuguggggguuggaaauuaaagguuggaacaaaggaaugagagguuuuggacaggucuaucugagaacucuggaguacuacagagcuuuugcuuuuccagcuaacucugaccaagccaauauaguucguauacgcauauuggcaaccacuggugaccuuuauuacauggaaaacauuuuggccugggaaagauggguaggcucucucuccuggaaccuugucugagcuggaaccaucucggcauccugcugcuugccacauacuucugacuuugcuaucccuucagacgguugaauucacccagagugaggcauagaacagggaaucagcauaguuuguaacccccucccuauuuauuguuuucuuaaugugugccaagcacugaccuccucaggcuuggugcaaguuaaggaaacaauaaauguaaagggaauggauugcugugaagucuguuccuggggagaaaacaugagaucagaaugacguuucuuugucugaacaacuauauuuuucacguguuuugugcauuuuccaaauauuuaagaauccaagaaauacuuuguaaugaaagaauuuuuaaugacccuaugcagaaacuguaaauugcaugucuauguugugaguuucuuacuggauuauagauuacuggauuauguaggagaaaauggaaugagcaccuacaaaucaacaacuuggauaaauaauaucuagaaacuagcagggacucaucauuucauugucuuugguaagauggacagaucauuuggugguuguugcacaugucuuuucccauaaacuguacuuguugucacguaacuggaauuagaguuacaaugauaaccauuuguuacaaugauaaacauuuguuacaaucauaaccauuugcaagaaccgugaauccuuuuauucaacaaaaguuaguucugguaucuuuuucauauacauugccugaggcucagaauugcaauguauucuaguuaggucuuuguguuuaggcucccaaguacccguauuaaucagaacaucuaaaaagcauucccauaaguacaauggacugagauugccaggugucugauguagugcaaagauuauugcuguuuaaaagauuuugaccucagagcuucauucuucccaucgucauaauuuucugagcgcugaggcauugcagaucuugucuuucuguuuauucagcuauacuuuuugccagcaaagaggccugaacaaguagguaaugagacugucuacacagagguucugcgagcccacagcugcccacuggcaagacccguuuaggauuaauauuucagaucaucuauucugcuugcucugagauugaugcgcaagacacaaagcaaccucuagacacuucagcuaagaauagguauuaagcgugaaugcauuugcauauuugguggcaaccuauucuacauucuuccuuaacauuuuuuucuuguuuauuaaacagaggaugcuuuugcuuaccucucaacugcagaaaagguacuguuugauauauaucgguuuuauuuacucuguucucacagaauugcacgugugcuguucaugggggaaauauuuuauguaauuuccaauaaauauugaagaaaauacuauaaucauggcuugauagaaggugucuuuguauggauauuucaagggaguuuuaguaauggcccugcucuaugaaaaauaggaguugaaguugauguucaggccauuucuccuuuauuuacuguucuuguauuuuuuugacacagggucuugccuguugcuuaggcugggguguaaugacauaaucacggaucccugcagccucaagcuccugagcucaggcgaugcuccugccuuggcuuccugaguagcugggacuguggcacgugccgccaugcuaggcuuaguuuugaguuuuuguacagacagagucucacuguguugcucgggcugcuuuucuccuuugaaagaaagcagcuggguuuaaggccugguuauggcuugauugauuugacugguguuuuugaugucagccugcccuuuccuugugucuuuuacugguuaacucccacagaugcaucagucccaagcucagauguccagguuuugugcagucuucuuugaauccuuuagacaugauuugucuuccuaaucugugcucccaaagaagcuugucugcaccuuaucguugcauauuacauuugcgugcugacuccucugcuguguuguuugccccugugugcacucacuucugcccuuggagugccuagcacauuaucuggcauacaguauaaguucgauaaguuauuuguuaaauuaaugauugaguagcuaugaagagauacgaaauggccaugggcuccuuccccuuucuccuggacagucuuaacuccuguuucgaauuguuuugcuuccugugaaggaaagaaguaugaaguuguauuugugcuagccacccgcaagcccaugguguggggagagacagacaaacacauuccagugcugggcaucauugaugcgaugauaugugcacggggcuuuggaagcccagaagaggagccugcaguucagcugaggggaccagagaaggcuguuugaagaagauggugcccgagcagaagaggaucaagacgucacugggaggggcagagggucuaauagagauaccaaugcggggcuugccguaaacacucagggccacagaagaggaaaguccgccauggagggagggaauggcaaggaggcaaacuggagagaggcuccgagauacgcucagcagauuuagaugcagguuagauaugaaaagugggaacugugauguguguuagguuuguuaugauacugauuucugguauuucuggagggacauuagccgugaagaaaugaaguauggcucaugugauaugucacuuuaaaauccugagggacagccaggagugauccugugcguuuugcuauagaaaaagcaguggcucuggaccuuuguguaucugccugggcauugaacggcaauucuuugaccuuguuacaacccagagggcuuuaaaagucuggaaaguuauggacuguugguggcgaggcgggggacaugcucucuggaagaucagucugagagagccccaaguauccagauacacuaagucauaaugauacaaaacuuaaauccuguagucuuucacagcaggcggaagugcaaggacugggcuuaugguucaguccucucuucuaaguuuaagaaaguuacuuaaccuaucagagcccuccuaggguaguauacugcuggguagacugcuguguuucccacacggaguugguguguggauuaaaggacgcaguguauggaaaguccccggcacaggaccuggcacaugagguaccuuucccugucuuuguuaguuucaguguaacauuaucaccagcccucaugguaguguuuuuuccuuugauuagaaauaacaugaauaucacaaacacugcaucaucuugguggucucccgcaggcagcugcccccaugacagcggcuggaguaguccuuguagugagaauacagcuguguuccuaggacauguucggccccaccucccuuauggccaaguggguuuuugguaguuagacacagcucugccccuguccgcauaggggauauaugcaggauagugaaacacacgcuacaccgacuucuaguaaaccaggaauuuguaugggcugugugguucuguuucuaaaaaaguauuuggcggguaagaaggggacugccaaugaaugggauuguuuuuauauauuaaauguauccaaauaugcacagaacccuuuguuaccauuuuaaaauuuuaucuucugcuaauagaauuucuauuggaauuaaaaaaaaauaaacugaaaaauuauuacucugagguuuuguuaucaaguuuuaggaacuuaaaucauuuucaauuuauuaguuuuauugauacauaauaauuguacguaauaauuauauuuuuguacccauuaaguaagcucucuucaucccccacuacuguucgcagccgcugauaaccaccccucuacucucuaccucaaauuguuuuagcucccacaugugagugagaacauaacauauuugccuuucugugccuggauuauuucacuuaacauaauguccuccaggcuuauccauguugcugcaaaugacaggacuuuauucuuuuuuauggcugaguaauauuccaccacacauauaugcauuauauuuucuuuaugcauuuaucuguugaugggcacagguugguuacguaucuugacuguugugaauagugcugugauaaacaugagagugcagguaucucuuugaggcacugaguuccuuucuuuuggauacauacccaccugugagauugcugggucacgugguaguucuaguuuuaguuuuucacugaacauucauaauguuuucuuuugcauaacagcucaacuaauuuacauucucaccaacaggauaugagaguucccccuucucuacauccuugcaagcaucuguucuuuuucgucuuuuuuaaaauggccauuuuaacuggggugagaugauaucucauuaugguuuugauuugcauuucauaaugauuaaugauguugagaauuuuuucauauauguguugggcauuugucuucugaaaaaugucuauucaguuuauucaguuaauuugcccauuuuuuguuuuuuuuuuccugcuuuuggugguuuuuuugcuauugaguugaguuccuuauauagucucauuauuaaucacuugucagauggagaguuugcaaauaucuucucccauucugucucuuuacucuguugauuguuuuguuugcuaugcaaaagcuuuuuagcuugauauaaucucauuugucuauuuuugguuuuguuaccugugcuuuuguggucuucucaaaagacaucuuugccgggccaauacccugaagcauuucuccaauguuuucuucuaguagcuucauagcuuuggguuguacauuuguccuugauccauuuugauuggauuuuuguauguggugagagguggggucuacuugcauucuucuauauauggauauccaguuuucucagcaccguuuauugaugaggguguccuuaccccaauguauguucuuggugccuuugucaaaaauggguugaccguaaaugugcagauuuguuuuuggauucucuguucuauuccacuggccuauuugccaguuuuuaugagaagcgugacauuuuuuaauguacaggaugguuuuccaagaauggaaauagguuuauuucuaguucuccugugguuuccucuuuucugaugggucuuggguaauuucgaacagcaauuuaaauuugcacugugcauguaagaauuuugaaaucauuucagcauuuuuuccucacuucuuuggaaaaaauaagcacuuaaaaugacccucagccugaaaaaguaagauuaugccuuauaauuaaucagauuuuaucaaaagugaaguauaauaccacauacauggccuuuagucuaaauugacuuuuuucuuaaaguaagauuugaauggauaacagaaucuuauauaauauuuauuaguaaaagcuacauauacuuuuuaaaaaaaaauuguguuaaaugacuagaggacauauccagauuucugugucuaugauuauuaacaguuuuguuggugaucagcagugauaaugugguuaagacaccuauuuucuugucuguuuugaauucaugcccaauagaaaggcuauagguauuauuaaacguuuauauaaaaaaccuuugaguuuaaaguugaaaguagcauuggaaacacaaaguugauauuccugaugcagaguuagcaccaugcuaaucacucauaccugucggcacuauauuuagcucauugagcucacauauuuccaagaacuacuaggauuucaagugaagcuucagucauacacagacauugucuaaaccacgcaaguauguguuuaaaagaacugccugucagugugcagugguaaugccagagcacaaaucaauagcauauucuccuugaccacuggagaacaccacagccaaauuuaaagcacauuuucccuggaugaguccagaaccgacuucaguucuuuuuuuuuuuuuuuugugcugagguuuaauaggcagaagaauaaagaaaaccagcucucucucuauagagaggggucuuccgaguggaaaagacaggagguauggugggugcagacaggaaaggaggaaacuacauaggaaaguuggaauccuguugcccacaacccauccagcgguggaggcuggggucaguccaggaggguuuggguaauacugggcgguagccccagccagaaauccucaguugcuccagaaccucuuccagcuucaagcgauggcuaaguccuucaugaaaggaagcuuguucacacguggccaacaugcccagcaacccaugggugcugggagauucuccauguuuuccccaguacgccuggcaucccagucuuugaacagcagccgugcuaaccgcguuucuaacuggcugacggaugccuguuacugauuugauaugguucuaacauuuaggccgagagccuugaaaugaaagggcagaguuggaguccguuccucugcucaccauuucggugacugcuguaccuugguuuccccgacgagguucccaguaugaaguggcuacguugucugggguacguaccugggcuucgucauuucgcgucagcaaaauuuaggacaugaacacacaagaggaguuuagaagcggaguuaagaggcaaaagaaaagagaaagagccgggugugguagcucaugccuguaaucccagcgcuuugggaggcggagggcggguguauccugaggucaggaguucgagaccagccugaccaacauagcaaaaccccaucucuacuaaaaauacaaaaauuagccagaugugguggggcacgcccaugaucccagcuacucaggaggcugaggcaggagaaccacuugaaccugggagauggggguugcagcagacagagauccagccacugcauuccauccugggugauagagcuagacuccaucuaaaaaaaaaaaaaagagagagagaaagaaaaacagcucucucucuuucucuauagagagaggagucuuccaaguggagaagacccaauuucaguucuugguggagaucaggauuuuguucaaacagaagaugguguucucucuguuucuuccaugcccauuuaaugaccaacguucagcugucacugaagggcuaaaagagagaagcucuuauaugugauuauuuugacuuaauuuuucuggaacugguuucuuucucuguuaggacauacugggugcuuaugcaaggauuauguauguuggacaguuuggccauucauauauaccuuuguagaauuuuucuguaucuuuucuuuuguacucuaguauuuuaauauauuuugucauuuugcaauuuaagccugggucugagacaguuucaccuuauucuuaauaaugcuagauaauuccauauccacuaauagaaagaaagggaauuugugauggugacugcuuugguaccaagaggacagagggagaaaaagaacagagaaaaacugacuggauucuucuagugccagccaguggaaaauggaaagaaaauuucuccauacccacauuucccccaaaucucccuuguaaaaacaccccucccccagaaaaaaaaaaaaaaagcaaacuaccaauuucagacauagguuuuaaaugcagcaucaugaaaacugagcaauuuggagggcgagaaaacaugugaguggcuggcauuugggguaggaacagccgguaaaggucuaaaaguuuugucuacucaucuccuguucauaccaucaugagauaaaggggcaguuuucuacccgagacuuuugguugaguaguugaaaacuuguuuucauggugugcaaaagaaauauaacaugaaaaucuggaucaagugaaauagaaauauuuuuagaaaccaaaaucuucaacaagcuucugugaagguuugugaagauucauauguuccuuucucacggucuuaaaggagcaacugaagugauuucaggaaucuaagcuauucuggcucgaaauagggauggguuggauaugcaccuuucccaaaauaauucacugcaucuaaaauuuauaauuaaaauaguucuuaggaaauauaauaacaugaagugcuacucauggacauggaaaauguaacucaugccuaauguuuugguuauaggagaaagaauguuccagggaaaugucaucuuuauguauugaauuuucuaaaaguagggucgaguggcugggcuuaguggcucacacauguaaucccagcgcuuugggaggcugaggcgggaggauuacuugagcccaggaguuugagaccagccugggcaacauggugagaccccaucucuacaaaaaaguacaaaaauuagcugggcaugguggugcaugccuguggucccagguacuugggagguugagguaggaggaucucuugaacccaggaggccacagugagccguguuuacgccacugcacuccagccugagugacagugcaguacccugucucaaaaaauaaaagaucaucucaaauaaauauaaggucaaguaauuaccuacacaauaaucaaugaauucaaagccucugaaacuaaaaauguagcuaaaacuuuucuggauauaaaauauauauguguguguauguacacauaaauuucauaaagauaaaaacauuugccaucuuccuauacaaauuauaagcugucugaaauuauuagaaggggauguaauauaggaaguguauugugacaaagcuaauuuuucaaacuuuuggggauauuguacugaaaacaaaaauaagcacuaaucaauguccucagacuuaccucuaggauaaaauaaaauuuuaguuggacuacuucauggaauuucccucauuacucuuaacuuuuuuuuuucuuugagacggagucucgcccugucgcccaggcuggagugcaguggcaugaucucggcucacugcaagcuccgccuccuggguucacgccauucuccugccucagccucccgaguagcugggacuacaggcgccugucaccacgcccggcuaauuuuuuuguauuuuuaguagagacgggguuucaccguguuagccaggauggucucgaucuccugaccucaugauccgcccgccucagccucccaaagugcugggauuacaggcgugauuacucuuaacuuuuaagccgggagaaaugggaaauugagaacuccugaauagagagagagagaaagaaagagaaagaaggagagagggagagagagagagaaagagagagagaguguguguguguccuuguuuugaugcgcuuuuaccuggguuaccuuuccgugacaguucugagcuuugucacauggguguuuccugcucauaagugcauggcgcucgcuguagauagggacagucuacacuggagguuucagaaguuaaaccaauucaugagucaaaggggcucacagaggacgaagagcaucucauuuauucuaaacaagugauugcucuuuuuuuuccuuauuagugagauguauguuuuuucaauaaaagcuuaguuagaaagucauugugcaacuagauaaaaauaauaauuuucuauguuuacauauaaagauuugcuugcuaugauguaguugguuagaguugggaggcgguuugguuaacaguuggaguacugaggacggguuucaguccgcguaagucuucauguagaaucuagagggggccuugucaguggugcuuuaucuaaagccguaaugacagcaguguuggaauucugcuuugcaaauuguguuuguuuuacuuguugaaaguuaaaaucaagacacagaaucagugcagucaugccguuauugcacguagaguugcuauguugguaggcuaaaguguuuuggacagaacacauuauuuguuuagaaaaaaguuucauagauaccacggaaaacaacuaacugaacuuguuuuuccuuguagcuuuuuuugugugagccucugagauuuuuuuuccuugccuuugcuuuccgacuauuugaacaggaaaagaacaacuaauggucuggaggagaaaucaaggacacuuuuuaaaauuuacucauucagcagauauugacuaacugaugaguaccaaaugugcuagaacccaggguucuagagaugauuaaggaagucaacggucuuggcuucauggaacuuaugucuaguagggaagaaagauguuggucuagugauaaaaaguagcaagagaugcuuauucccucuauaauaagaauaacaggaaggaucuagaaauaggcucauggguuuguagcuauaagggcaagaauuugaaaacucuucuggccaaaagcucuacuuauucugaaucauggggggagcuuucaucugcaaggaacugccagauagaggagcuuugguggcacauacacaccauggaauacuaugcagccauaaaaaugaaugagaucaugcccuuugcauggacauggauggagcuggaagccauuauccucagcaaacuaacgcagagacagaaaaccaaacaccgcauguucucacucauaagugggagcugaacggugaaaacacauggacacagggaggggaacaacacacacugggccugucggaagggcgaggggagggagagcaucaggaaaaauugcuaauguguguugggcuuaauaccuaggugauggauugauagguacagcaaaccaccauggcacacauuuaccuacauaacaaaccugcaggucccgcacauguaucccagaacuuaaaauaaaaauaaaaauuaaaaaaauuaaaaaaaaagaaaauuuggcauuuuaggugucauaugguagcaacuagauauugauuucccuucucucucucugaggcuuuuuuguuguuguugucauuugcuuguuuagugacuugauuaaacuauuuuacugaaaucuaaaaauaaaaauaaaaagcaucaaguacuuaguaauaaaucuaauaagugaaguguagaaaaaaaaaaaaagaaaauauauccguagccucuaguagauaggagcaaaugaaaacugaaggucuucucaccugcaagcacagucccaggcaguguguuguaauaaaagcaagucucagacugacucaugcacagauacaaacauuuauuaggcaggcgcaaaaacugucacaccaguuguucuauaaauuuaucacagaaagauucacuugaagcaggugaaacagugcguuagcuucggaauucagcuaaccuaguagcaguucgcugacaaaaauccauacaggguccauccuaguauuaagccuagggggccuuuaagaaagguaugcuguggugggguguccauauaauuugugguccaaagcagaaugcuuugagaaccaaagagggcauucuuaauaauuauguugggauaagaaauguaaacugggacuguaacaggcaaauugcaaccuaugguaauucuagucauucggcaugcuagauucuuguacauuguucaagcaaaggcaaaaggaaauaaacuaauuauucuuuuucuacuguuuuuagccauccacauaucuuaaacaccccuuguuucaccaaggaaaaauauuuuuaucuauaaugcaaauuaucaaauccuuuaagguugaucagaaacaaagauauuugaaaauguuuuguagcaaaggggaggaaaaguaucuuuccugcuacuuauuuuggguagcugggacccccucuaauaaaauuuauuuuauuagaaauuuauucaaguuuuaugugacaugggagacuucauaaggaaaugaagacccgaagaagcaguuaaacgugagcuuguuucauaguagguuugaugaagaguggagagucuuagagaaaugugauaggacaaagcgggggaugagcugaauguuauaaacuggaggaugcuuaguaagaccuauuuguucaggucucuaugucacugcauguuuggagauaaggaugccccuuucuucuggguauagggagggcaccucacacauuaggguccuuugaccugcuucggggaaggucauaaaacguaggaaagauuuuauaaccuuuuucaggggagaaggggagggggaaggucuguuuucucaaauccuucagcuuaaaauaucuaauaugccaaaguaccauauuuugggguaggaugucuuggaccccaucaguagcuaccucuggcauuguggcagauggucaccaugugucagaugauaaacauccaccucuggauuaauuccucauuaggguacuucagauguuaacuaauaccauuagggugugaguggaaacuaacccagauacacauaaaucacacuggaaauacuucuauauugaaguguuuaaaauuuacuauagauaguguaacacuuucuuugcuggagauaaaauuuauguuguuaaaagagaaaaugcaauauucuuuaggauguacagcuuuaaagcugcauuaggaguaaaacacaggagguacaugcagcauuuagugaucauuucugcucuuuucuguagucuucuagguacucuaaucacaaaauguuaaugcgcaucuuuagggguaaaauaaugugcucuaaagaauaugguagucacugauaauuuguaauuauuuacuagauuuuuuguuacuaaauaauucaaugguaugacuauaguaucaguaaucagccugcugaagaaugaauaaugcaaucaauuuacauucuuuuguugccauugauagaccaguaacagcuuaccuuuccuauauucuguaggcaucuaagaagaaaauauaccaaaacuuuaagauaucaaaauauauuuuucagagguaaaacaaugacccucguaaauacauaguaagugcgugucauaaauuuauuugccugaugaaugagggaaucaacauaauggugaugcugauucccagaaaauuccacagauaaauuauauauaggcacugauagaaugcuagaauaagauuguaagaucaguaaauugggcugggugcaguggccuguaacccuagcaguuugagaggcugagacaagaggaucacuugaacccaggaguugaagaccagccugggcaacaugucaaaacuccaucucuacaaaaaauacaaaaaauagcugggcaugauggugcaugccuguagucccagcuacuugggaggcugagguggaaggaucguuugagcccagaauguugagacugcagugggcugugaucaugccacugcacuguagccucagccugggugacagagugagcucuugucuccagaaaagaaaaaagaaaaaaaaaaaaaaaaaggaauugucaguugguuaaugucuuacagggcaauaaaacuguugucuuuggggcuaucuuucuaucacacaaaaaucauuuacauccuuuuggacaaaaaucugcaaguuaauauguuacuuagcaguccuuaugcugauagauaauaaguaguaagccaaacaauacuacaguauuaaaaaaaaauccuugggugggccuguuuagacugugguccaauauuuaaaagaauauaaagguaaccuuuugacauauuuucaaauuuuucauaauuuuuacuaauaaagucuuucauuucguuugguuucgguuuauaaugaguuauaugauucuugagcaaauacaaauugugaccuuuauguguguauuguguggguuuuuuguuuguuuggaccagaaucccccuuacuugggacucaguaagggaaagggcucauaguuuugacuuaccugaauuguaggugagauuagcuguguuauuguuuaggaacuuuuauucugugugaagggaacuguagucacccaacuggcucuuccugucugcugcacagacaaaacugaagggguggccugccccuccacacuugugggcguuucuuguuggguggaacgagagacuugagaaaagaaagauacacagagacaaaguauagagaaggaaaagugggcgcaggggacccgcgccggcaccagccucugaguucccucaguauuuaucgaucauuaucgggcauuucugggagagcgggauguggcaggacaauaggguaauaguggggagagggucugcaggaaaacaugugaacaaaugucucugcaucauaaacaaguuagagaaaaaagugcugugcuuuugaugugcauauacauaaacaucucaaugccuuaaagagcaguauugcugcccgcaugucccaccuccagcccuaaggcgguuuuccccugucucaguagauggaauauacaaucggguuuuacacggagacauuccauugcccagggacgagcaggagacagaugccuuccucuuaucucaacugcaaagaggcauuccuuccucuuuuacuaauccuccucagcacagacccuuuacgggugucgggcugggggacggucaggucuuucccuucccaggaggccauauuucagacugucacauggggagaaaccuuggacaauaccuggcuuucguaggcagaggucccugcagccuuccgcaguguuugugccccuggguacuugagauuagggaguggugaugacucuuaaggagcaugcugccuucaagcaucuguuuaacaaagcacaucuugcaccgcccuuaauccauuuaacccugaguugacacagcacauguuucagggagcacaggguuggggguaaggucacagauuaacagcaucccaaggcagaagaauuuuucuuaguacagaacaaaauggagucucuuaugucuacuucucucuacauagacacaguaacagucugaucucucuuucuuuuccccacacaaaaccauuucgccaagcccacgauauugcaguaaagaaagaguuuaauuaaugcagagcuagccaaguggaaagacuggaguuauuacucaaaccagucucaccaagaacucagaagcugggguuuuuauggacaguuuggcgggcaaggggcuagggaaugugugcugcugauugguuguggauaaaaucauaggaggguaggaaacgguccugcuaugcugaguaugccucugggcgggggccaugggaccaacugagucauaagucacagguccaggggggugaguugguugccagcaugcuaacgucugaaaaacguuucgaaagaccaaucuuagguacuacaauaguaauguuaucuguaggagcaauugaggaagucacaaaucuugugaccucuggccacaugacuccugagcaguaagggauuauagaaacuacgccuacauuuuaacaaauugcaggccccucccauaacccuaaucuuauggccuuucauuaguuuuacaaaagcggcucuggucccugagcaaagagggguuuaguuuuagggagggacuaugaccauccuuccugucucccaugguuagcuuggccugugccuaggaaugagcaagggcagccagccugugagacuagaagcaagauaaaguuagucacgccagauuccucucaccgucaugaucuuggcaaacgugguuucagaacuccucaaauauccaggagcucgauuuggccuuuaggcuaacuugaaagaaauaaauacuucuauuuuaaauucuuucuuuaaaaaaguuuuuuuguagagaugaggucuuggaguguuaauccaggccucaagcaaucauucucccuuggcaucccaaagugccaggauuacagguaugagcuacauugcucagguuauuuuaaauuuuuucuagcaggaggagagauguauucaauccugagcugguacacuaguaauuaaaaaaaauagaagcuaggggcugggugcaguggcucaugccuguaaucccagcacuuucagaggccaaggcaggcaggucacuugagggcaggaguuugagaccagccuggccaacauggcgaaacuuugucucuacuaaaaaugcaacaaauuagccaggugacauggugcaggccuguagugucagcugcucaggaggcugaggcaugagaauugcuugagcuugggaggcagggguuguggugagcaaagaucacaccacugcacuccaguaugggugacagagugagacucugucucaaaaaaaagaaaaaaagaaaaacuagaaacaaacaacaacaaaaagucuuccguuucuauauuugagcagucucacaguuuguaaacacaagcacagagucuccuuuugaagcuucuauuuagauaccacagagugaaaacaggaugccugcuuaaacacagagaagucuuucagcucuuagguuuuagguuuugacuuagggauuuagauuuugacuuuagauuuugaagguaaccacacucuucccagagcgaaucaauggacgcuauguaaaucuuuccuuccucaacgcuaaggucauaggaguuaaauuugucucacauuuuccuuucaguggguugcauuguuugauaguuuaugauaaucaaacaaagugguaacuuaucuguauuggugauggacuucuuucagaagggcuuugcuuuugauuacacacacuaauuauccuuaugaaaauauacaugcauuccauaaacgagcuguuuuguuauccaagccuugauucuuucguccauucuuagcuacuguugacuaccuaguguuguuaaccauuguuguagauauuggggagacagcaguuaacaacacagauaaaaaauuucugccuuuauagaguucgcauucuagaggggggagauagauaauacacuaagauaaaucaaauauuaagcuuuucuguguauuuuauaucaaaaagguauacugaacuuggacacuaagguguaguaaggauuuccuccuuuguaugguaaaagaagaguccuugguaaucuuucuuuuuacaauaauaauaguucuuuuuucuccuagagucucccguuuucuuaaagaacuuuacccacacaagcaagguugcccuaggacagugguucccaaccuuucuggcaccaggaaccaguuucguggaagacaguuuuucauggauggggcggugaggaggggauggaugguuuuaggaugaaacuguuccaccucagaucaucaggcauuaguuagagucucauaaggagcacacaaccuagaucccucacaugcccaguucacaauaggguucacgcccucaugagaaucgaaugcugccacuuuucugagcuccaguggucaugccugcucacccuccaugagaauccagugcugccacugcucugagcuccgguggucaugccugcucacccgccacucgccuccugccgugugacccaguuccuaacaggccauggaccaguaccaguccgcagcccuggggaccccugcccuaggagacugacuuacgaguucaugaagaaaguaaaaaauaaauuuagggauccuaaauaaaggauauauauaggauaaauaaagucgaguuuugguguagagcccugauguuccaaauugucccaaaggguugaaaaauuaaagccuucucuucuucacacagauugaaauuuuccuuacuuaaucuuaucugccguuagguuaccucuccaauucuuuuuucaauuauuugggcauuaaacugcucuaucgugaguuauuagagaucacuuucuauggcugacaaaugucauuuaaaauuaauaccaacauuuaugauuucugugugaaauguuuauucuuucaugagauagguuucauauccuuguucucuuguuaacauccccuacuuuguuuuuaguugugggguuuuuguuuuauuuuguuuuugcauuggagaccacaguuugcaauaaggcuaugcacuaagccucauugauuuccucuaagcucuuguuuauugagcacuucauaugugccuugaauucugugagugacagacagucgggggaugaugauauacaaggcgcaguuuuuguuucccaugagugugaacuaugcggaaacuuacacgaguuuuacuuacccauguacaacaauuagagaaaaauaaaaaauacagugcagucuaguugggaaguuuggaugggaaacaaguuagacuuuaaauuuaucauauuucuaauucacaccaccaaguaauaaauacaucaaucuucauuaugugaugggaaaaaaguagagucagaguucuuuucaaaauuccuuaaauuguucagaaguacaaacaauauuuuacuuuuuugcuagaagccagaaaaauccuuacaaucauucagacauucuuuuaacguguauguccuauuucagacuuuaucagcuucauugggaugaaggauucccagugaagcuguacauaugaugugaaucugcucugugccaucuaguuccaaaaugcgugguguacucuggcacaccuaagacaaaagaagccuauuggccagaaugaucacauuggcugcucugccuauggagaagccauuuauuccuuuacuuucuuaauaaaguugcuuucacuuuacucuaaaaaaaaaaaaagaaugaugagagaagguuuuguagacaucuuauuuguuuacugucuaucuucugcuaaacuauaaccuccauaaaaaugagacauucuucugucugaugauguaucucugguaccuggaaccaugguagauacuuggugcucaguaaauaauuguuuaaugacuguuuagaggaaaccuauagaucaucguugacuuuucccucucccuuaucuuuacauucagucagucaauacaucugguuaguucugcuuccuguucucuuuuagcuagguguuuuucuucagccacacugccagucccuuaauugaggccaccauuauaugggucgcugaaucaaccucuuaauggcuucugugcuugcaguuguggaaguacccuuccuucagucacuucuacagaaagugaauugaacuauucuucuucgacucuccauugccuccuaauaaagucuaaacuucuugaccuugaaagauggauggacuucacauccucgcaggaggagauggucuagauaggcagaagacggcugaagaagcagaaguggaacaagaaggccggucauuucaaaguuacuuuuucauagaagauuaaaacagaagaagccuuccuuaucacggugccuaaaaguggccugguuggggauuagacuauuaucucucuccuacuuucucagguuaaacaaguugguuucaguuuggaacuuuagucucaauaacuccauguuggcuucgugucucggggccuaguguaggagcuuaguccaaaucaaugaccucccauaaauucuauuuaaugcuuuuucuccuuaagucuucuaagagugaaacugggauaacaauagcccaauaaggaguguuuggggcaggggagaaauuuuugaaugcuucagauaaaaguugucugacauuuuacaguaagagcacuuauauuauuucaaauuuuaaaaaguguauguguguaucuguguguauaucuucugcuuguuuuaugaaaggcacuuuaaaagaggcugccaacauguacuuuacugaaugucaacaauaauauauuuuuauuugagcuaauuuugaaagucuaaagaaaggaagacagauuuuguuuuuauuugacaaacgauuguuuucuuuuuaaaaaugagaaugucauucauaaaacacaauuccuucccuuaaagaguugauaaaauagcagaggugucagauacauaaacaggcaacuugaauccugugggaugagaacugucauuacagagaggaagaaucaggacauuaugggcacauagaguaguggcaucuacgccagaaugggaaaaagccuggauaauuugcaaaggaaauccuguauuaauuuuugccacauuaaaaaaaaaucuuuuuuuaguccugugguguuauuuugcacuguuuuaugaccuuuuccuggaugauagguauucugauuacagaaaaaaaaaagauuccucuucucucuuuuuuuuaaauuuuaaauuauucuuucauguaugugucauauguagucugggagcuugaauuugguaaggcaaucccaggcuugccaucuuggcuuagacagaacaauagcauaauccucacuaaggcuuucuaacuuguuguucucuuuacauaguuagcucccuacucaacugcagucugccugagguuggauuuugugggauuccuugauguacuauuacuuguuugcauguuuuuggcacauaauacuuccaaaggcuguuuauuguuaaaugaugaaaaaugucacuccacaauuuaaaaaaaucuucugugaaccucacugccuaucaaaugaggcucaagaccuuuagcuuggcuucaagagccaccauaauuagacaugccauguuuucucucacagcuuccaccaguguagccuguaugcuccagccauacugagccagucaccuuucccugaauuguccuacacuucccuggucuccuauuucugcuucugguuccccacccccagcuuaccucugaaaaccucauccugcaaggacaaacuuuuccugauucuccaacugaaaagauugucucucuccuuucugcuuucaugaaacagucagcuuuguuuuauaucuauuauguauauauauccuauguauuuuacuuaagucuuagacgauaaggggccaucuuauuuaucucgucuucuucuaugccuggcaaaugauaguauuucaauaaauacugugugacaauaaagacauucaauaaauacugacugauugugaagcaaagcauuuuuuuucauuuuuuuuguucuguuuucuaucucauccaaagggaagagaauugaauuaaucuagaaaaaaaaaacaaaaccagacagaaugcuagugggagcaguuaaaauaaaugagccagaaagagcaaguaagugacaugccuuagacuuauuuuuuacuauuuuggcuaucagcauuaguguacugaagucauuuguuuauguacuaguugauugacuauauaguuaagucuaagauuuuggauuuuuuuuuaaacccagaggagucacauugaaacaaaauuuuauucugucuugaauaaaaugggauauauuagaaacacacugaaaccuaacucagcacuucucuguguuggucuguuggcaguacauuuggaugugggugaauguguagacaacacugaagaaugcuggcuaacuauauauaggaaaugaaguuccagcucugucuuuucuuugaauuucucuuuccugggugagaauugugaauggaacagagaacugaaguagagacggguuugguauuuugucuuuuggugcuuucuuuauauaguuucuuuuuuaauugaaugaggaguagaaaaucugaccauuuuaguggacuuauguguuuaugugcguguuuaaaucuacagauguaucccuuaccauuucuuaugcagaugaauacauuggcaagaaauagaauuugcugagauuucauaguagcauuuccaaaacuauuuuccaugaaaaaaauuuuuauuguauauuaucuuucgguucuuuugccaaaguucuuuuggcugagcuuuuuuuuuuuuuuuucuugcuauaugucucuguguucuuuuucaaugguuucucuaggauuauaaaacagauaauuaaauuuucacagucuaaaguuaacauugucccauuucauguaaaauaugaacuccucagucuuacagaugucauauauauuauauuugcauauuuuaaagcucccucaauacaacauuuuacuucuuuaaguagccauauauauuuugaagaaauucagagaaagagucuuuuauacuucccuacguauuuaccauuuccagcacccuucauucuuucaugaaauuucagccuuccaucuagucucauuguccugcagccugaaggacuuccuuuagcaccuccgguaguacaggucugcugguaauaaauuauuuuaguuuucuuuuauaugaaaaugucuuuauuuugccuuuauucuugcagacaauuuuuugcuggauagaggauucuagauuggcagcuucucuucuccuucucuuucagcacauuucuguuucuuauugcuguuguaagaaaguaccacaaacuuaguggcauaagaaaauggaaaauuccuuuugucuucacaggcaacaauaucaugcugaguucuuaccauguaagacugaguucuuaucacugccgucucucugguucuuuuauuugugucuuucucuuccucuuccauuuuuauuggauuauuuuucauucauuucacauuuuauucauaucacauuuuuaagauucuuuguugauauuuccuauuuguucauuacaagcauauuuuccugucuuuucuugggcauaguaaugaaagcugacuauaaacauucuuaccuaguuuuugaggcaguugggccauuuuggguugguuuucauugauugaauuuuuuuuucuugagaaugggucacccuguccucuucccucauaugucuaguaauuuuggguuuuauucagaacauuuuuaauauguuauagguuucuggauucucuuauauuccucugaaguguguguguguguguguguguguguguguguguguguauugcuuuagcaugcuauuauauuggcagaugugugcuccaacuuuguuaccccugugaagggcagcaacugaaaucacuuuucaguucuuuuagacuuuuccggacugcugggccucuccucaaugcauguggauaguaggggucacccagagauucaggcauuuuaugcacuagacucuggcccucacugggauuuuuuuccugucacuuuccuuuuguuucuuuaagaagcugcagauuucuauccaacuugcaguugccccagcuggcacagccagaaaauuucuggcuucaauuuaaaaagcuuuauaaacaagaaacucaucuaguguuuuucauuuauuuucaaguguuaacucccuuccaguuucugucugcuuuuggccacucucuaguaccuucaguuaguuuuuuuaaaugucgaauccagagcuuauaguuguuauauuugguauguuauauaugggaggagcugccuuauuauuaccagaaguuuuauuaugguuguugcuucuaguguauguucacaguuuguuuuuuuuuuuuaauuuuuuuuggcaaaccaauaaaaaaggaagauaauuuuuuuuuauuugcaaaacaugcuuuacuaggaauuagccuaaggauucucaaaaguacuggucaaagucaaugcuuuggagcugcagacugcuuauuaauuuaguuugaucuuaucuagauauccuucuggugcuacugaccugggccaggggugucuaaucuuuuggcuucccugggccacacuggaaggagacaaauugucuugagccauacauaaaauacacuaacaugaaugauagcugaugagcuaaaagaacaaaaaucacacaaaaaaacuuauguuuuaagaaaguuugcaaguuugcguuuggccacauucaaagccaugcugggccacagguuggacaagcuugaccuaggccgagaccaauuugccaucuauuacacuugauuucuucuuaggaaauugugccugacacaugggcauaugguugcgccagaauggagucauacggaacuucuguaguaucuggcguugugcuuuccaguaccucuauggagguuuggaccauaaucuugagagacacuaucuugaaugccauaauuccaaauguugaaauuuugaaagauuaaaaucccuaaagucuaguuuuauuuauuuauuuauuuugagacagagucuugcccugucaccuaggcuggaguaccguggcgugaucuuggcuugcugcaaccucugccuccgggucuccagcaaucuuuccaccucagccucccgaguagcuggggcugcagguaggagccaucaugcccggcuaauuuuuguauuuuuuguagagaucggguuuugccauguugcccaggcuggucuugaacuccugggcucaagcgaucugcccgccuuggccucccaaagugcugagauuauaggugugauucacuagcuccagccuaaaaucccuaaauucuaaaauccccaaaucacaauucugagagaccaaaauuucaaaaauauaauuguggaauaaaguuuuaaaaauauuuaaaauacauuuguuacaauuuuaaaagaagacuuuagagacauauaaauacaugacugaacacauuauaggccacuuuacacaguaaaauaggcaacaauaccauacauguucucuuugcaagcaucaacacacagauauacuaaugggagucacucagcuauuauagcuaugaacagacaaacuguauuuauaaagaaauaggucagaaagugaaaugugugaacgcuuauuacuaugguuggaaauuguaugcauccaucguuguaacugcagucaucaaaaauacccugacagacauguuuugaugagauggaucaaaaaccucuggucacugccacaaauacagucacucaaagagccaaggucucaagaaauuuuaucuuucacaaauggagacacagaaaaaaggcaguucuucauuuauggaagaaguuucaguguuuuuauguacaugcaccaugcuuauacacaaagcagcauugugauaaugcguguacuuggaauaauguuucuuacguccaaggcagaagaaaagucugucucaucucucagagagaaagcaguuuaccaucuguguuuguucccucuggacccaaggcugauuggauggugcccgccaacauuuuaggcagaucuccaccuacuccauucagagucauguacuaaucuccucuggaaacacccuuacagacauaucugaaauaaugcuuuaccaaguuacuagauaacucuuuaauccagucaagcugacaccgaaaauuaagucuacaagucuaccccuugugaaucuggcaccuguacacaucuuaaaccauagcuaauuuccagaugaagacaaccacaagauaagaguccugucuaacaugauagaacuaacacgauucauccacacugagcacagcggaaagcacacgaaucccuccccagaacuaacaggaugcagccacagugagcacaguggaaggcacacgaaucccuccccagaacuaacacgaugcagcgacagugagcacaguggaaagcacacgaaucccuccccagaacuaacacgaugcauccacagugagcacaguggaaagcacacgaaucccuccccagaacuaacaggaagcauccacagugagcacaguggaaagcacaugaaucccucccccgaacuaacaggaugcaaagacagugagcacaguggaaagcacacgaaucccuccccagaacuaacacgaugcauccacagugagcacagcggaaagcacacgaaucccuccccagaacuacacgaugcauccacagugagcacagcggaaagcacacgaaucccuccccagaacuacacgaugcauccacagugagcacaguggaaagcacacgaaucccuccccagaacuaacaggaagcauccacagugagcacaguggaaagcacacgaaucccuccccagaacuaacacgaugcagcgacagugagcacagcggaaagcacacgaaucccuccccagaacuaacaggaagcauccacagugagcacaguggaaagcacacgaaucccuccccagaacuacaggaugcagcgacagugagcacagcggaaagcacucgaaucccuccccagaacuuggcuuucaggauugcagcauuugggguuucaguguuuggggauuaugauuuucaggauuuucgauuucagagauuucgacuucaggcuaauuuuuacucucaggccuuuuuuguuuuuaaaggccuguauaccaauauuuucagggaugauggcauucaggauuguguccuuugggauuauaauggcaccaccccuagguacuaggcucuucccauacucaguaaucacuacuugugauuauaguggggauaaauaagucugaaauuuugaaauauuuuaauugcacaaauaauguauaaaugcaauaacuuuauuuuaaauaauuuaaaacauuuuauaacaaaggcaaaauuccccuucaucauuguccuuaaucccuguuuucucccaccguccuacccuccuuccuagaaguagccacugcuggcauuuuggcaccucaccuucagcauuacacauccccacucccacaauuuuuuuuuacagacacacacaaaaaauuguuuuguguuguuuugauaagcagcaccauauuguauauauaucugcaacauccuuauuuuuacuuacuuacacaucuuagauaucuauguuuauuacauauggauuuacuguauuugacauucuauacuccagugcuucugcugauagaauuaauuuauccuauuguaaucuucuuaggaaacccuucaacaaguauuucugaucgaaccaguaaagccucauuguuuuggagccuacuuacuugaaaucuguaauaauuaugccuagaauagaauuaaaauuuaugguugccaauuaaugacuuaaaagaauauuuguccccacuaagagauaaauagcuuuuaaauaccaguuuaaaacauaccaauuacacauaaauuuuuaucuguguuucauuaucuaacaaggcaguggcuuguucugcugacccuuaagcauuugcaggcgauaaaaggugcaugccauuaaaaccauccuccaguaggacugggcacuaauuaggacuuugcuuaggugaacguaaacacaauggcucccucuccacuuuaucucgccauucacuuuguucuguugcuuuuugaucaggguucugacagauccucaggucggugcuucaccucuucgugaggaggacuccucuuggggcccaucucuggguacuuuggggaagugaauacaggaagauuaucuuaugguguuguaguacccugaagcuuuucaucauuuuggaugucacuuuaaaaagacaaaauggaaaugaauaaaagcuaauaacuaaaagcgcauuauuuugagauggauacguguauaaagucucuuacagauugcugcagaaaugcccagauguauuucuggcuaaaacaccaagagaguauauuuggaccuaaucgauauuagauaccacuuucucuuucuccuuugagaauuaaacucacuuguggcauuuuccucaucauccauaaaaguaagaugaauguuaucaguucagcccucaggauggaggucccgggaaaugaaaagaaggaccagagacugcuguugccguagguuuagaaauugccaguucccaccucacuaguuuucggugugucucuugguagucuuugacucucuaaguuccugugccucucacccuucaagauagucuaggacgggcagggcaaccaucucucaaagcauggauccacucucugaacacagauuuaggccuaagaaguggccagcaccuccacaagccugccucauugacggggagagggaagggggcaauugagauucacuuccccccaaacuaaggcuccacguaggagggaugugggggagaugaugguaucuggggcaguccaauagcucacuguccaucuaagcauuccugggaagaaugacaacagucucauucguccugcccaccaccaaccccaaauggaauaaauggaauucagccuucgcaggcagcuggaggagugagccugcugcugccucugccucaggauucuucagaggaagccacaaaggguuuggaugggggugaacuucaaaguggcaugaugaaaagcucgaggugaugucuuccgggauuuagcaaugccaucuuucuguuuuauguuggcuuucuuucuugauuugggauuguguuuaucaguucggcuuauuaauauuaaguaauuacaaacaaucauacaugcauuuaggaacuuauguuuaaucucuggcaacagcauaguuuauuggcaaaaacaaaugcacauacacuguagguuagugaugaacaucagcagacaggccugcucuugagauuuuugucuaacugaggagcgucauuaccauggcaguauuguucuguuuuaugugaaauguguuggauauuuauguugaguuuaagauaucuggcacgaagcuuuccucacacagaagaaaauuuucacaacuuuugcagauucucaguuuguuuucuuuuauuacaaauuaaaacauuuugauuuagauuuucuguuucacaauuuucauuuuuaugguagaacaugauaaggcagcuacaaggucaugacuaagaauacagaguccagaagcagacaggcugugugacugggggcgguuaucucugugcuccagcuacagcaucucaaaauuggagagaaucuaaaugauguucuauguaguuggucgccuuugucauguuauauuuucagaugagagccaccuuguuuucugcacagacauauccuagucagugauucuucuccuucccauguugguuuuugaugguuucauuuuugaaaagggagaccagcuuuucauucgcuuuuucagcagaagcauaagguaagacauaagggguaagguaaggcauaaguuggagguaugacugguaauucuggauugauggcuuugcaaaaggauggcuguuaugccugcggaacuggcuccccuccaagaaccauucacacugacuucauauuaaggagguucuuugauuuguuacuaauaagaguaguauuuuuuauugugguuuuuauuaguguaacaauaacaaaugcuucuguaguucauuauuaugaacaguaaacucauguaccugauuaugcuuuuugucgagaugaggaaacugugguagggguuugacugguagcagguugcaggcacccugcgcuccgucucuauguucuuguucuucccucagccuuucugcccccucccagucauagccucccuccugagcucugcauccaucagcaaagacuuuaaccauuuagguuuagaucaucauuacuucugacuauucguuuuugauuguguugucagaagacuuuuuguuauaaagaagagaauuauaaaacauagauuugaagcaagcauagcauauuuguacccuuuuaacagagguggcagugaaaugacagcuuuuugcugcguggguguucuuuuuuuuuuuuuuuugcugaccuguaguuugauuuccagugucuagacuuaacagucugaauuuaaacacgaggcauauacacaaaaucaucuggaacugauuuuuucacacuaaacacuucuuucugauccuacuuuccaggaggcuccuuccuccaaacauaccuccagaugaaaaucacuuaauuaaccaagaaagacucaaccgcccuuaacugcuuuucuaaacagucacacauacuggauuuacuuauuuugagacaugacaaaccaguugcaaaccacaaauucauucucaugggcccuccacacggucucuuguuccuucugaagagggucuugcugaggaccauuugucccccuuccugcagcagcuacucagucggugccggagaguguggccuuucgaacuauuugcgguuuuccugccacaugaugcugacggaccucagccucucccggccuuggugcacauacaacagccuguaaaagcuccacuuucuauuccagauugcuguuaugcgucugcuucucauucaaaggaaauaagaggagauguaaaucgucgcugugcaguuacguguuuaaugaaaaugaucuugcaugcuagauucacguccaggagcgagucgcccuuacugcugguauugaacucacucuccuuggagcgccccaaggcugugggcugugggggggcauuagugugugugggcgcagcuauuauuuguaccaggaggcacaagucugcacagcaaccugaagauuuagauuuucaagaaacugcaaauccugacacaccuggugauaaaacccagaugcucuccccaacucauaccuugucccgcaacucccacuccccacuuccugacuagacuuuuuauuuuuugguccagaagauagggguaagagaagaaugcugaagggagugaguggaugagagaaugcuuggcuuacuugcccauuagauaguuccagcuccaaauacuguucuaauuaagaacaaaauaaaaccauucucccccacuggcugucugguauguagacaaauuuggaaauagguaaacaguugcuguauuagaauuggguauauuuuagcuugaugacaauauuuacuugauuuuaucacugaagagaaucacgaucuuugugacauauacaguccuucuuauucuuuuagcucuaucuuuauuaaacuagauugucaucaaauggugguacgugacuucaaaaggacucuaccagcucuuauucaccggaauuuuuacuuuuauugacuaucuaaaaguuuaccgcuucaaagaaagacuguuccuacugagauaaaguacugaauucugccacucucuccuccugucccagacuuuaauuauaaaaucacaaucacaccagauaguaagccuuaaauauuuuaacauuuuucccagugggaagacagcaacacauaaaacgacaugcaauuauaugaaaagauuuauuugucccugacccaggaagcuaugcaccagugcuuucagauaauagucugcccggcccacccugagggaucuaaugaauuaacauaaauaccugugaguagguuaaguacacacaaggagcagauuacaaaagaaugaaaacuuaagcaauuagcaaggauuuuaaaacauugaucuaucagguguucuagaaaguauuugcuucuacauuucgaguuuagcucaaauuuuacugagcagcuuaaacagcacugucugcuuuugccucuaggucacaggucauugucaaauucauuuauaagauaguuucaaucuguacuuauuuagcagugcagagaauuuuagacacacuaccuuuucacuguuuguaaaaaaaaauuugaaaaauaagaauuguaauguaaaaaauauuggaagacuaauucuuaaccuacaugaagaaacaguuuucagcagcuuucuaaaugucuuguuuacauccaaauuguugagaagcucguugccaaucuguuaauucaugaaaauucaaccuuuuaggauguccacuaagcugccuuuuauuagcccgguuugaaugacuguguucguacuugagaugaguugaacugaauugccuuaaaaauucaaaucuguaaugaauucauaaggaguuuucaucccaaaguucaaauugguagggccuaguaauaacuuuagacauuuauguggugacgagcuuuuaaucuuccuuaagguuuuuaaaacucugcauguacuguccuucuucuauguucucuuguccuuuuaguugguuuugguagaaauuuuauaaggcaaauuaaugaaaguuaucuccugaguggcaguuuacaacaaaaacagauguaaaggagaaaaaaaugaaaugaaaauuuggauuaaagaagaaaaaagucucauguuaguaacagauauaacaaaaagagugaacucuacguggcuauaaguuccuugacagcaaggacuuugccuuucuuagguggaaucuauugacauguagagaaggaauguuuuacuuaggagguugucaaggaaugucugucaaguagggguagaaggaaggaauuaacagggcuuugagaacauucucacauuugaagugcuaauaauuucuggugugaauuuggugauaacaguguuucaguauuuaauauuaauuugaauuuucuggcugguuauuaacuugaguuacguuuauaggugaugaaacaaacgaagaggauugcauguuuauacacaguagaacuugaggguuuucuaauaagcauacuuuaacauugccucagccuguaaaucugggauuacaaggcagauaaguuuuagggugauuacuucuuucaccccauaauuacuucauggauuugccgugguguuucuguaaguagugagcaucucuaguaaacugacauuuugauucuauuuaaacaacucauuuuacccaguuuuucagcagcacauugacuggauaaaguaaggcgcgcaucuguccucacuuuuuugagucuugcuccuaagucuugugaagaaaauaugggugcacguaugcauuccuuuauuuagaguaacuucauugcaugaaguugagcugaagaacuaggaggaaaauagcucuuuuuguaaguugugcuuuaggagacuuuggauuuagcuaggaaugggauacugagaaaaacugagguuucaccuccucuaaacaaugggacaguguucucaucucuuugggacuauauacauaucuauuuauauccugcuuuaguccagaaggaauuucagcuuuggaaaaaaccaugcacacacacaaagauacaaauaaaguguaagugaaguaaucagaguaagagguuggggaagguaagucgaaaccaaaaguguaauuaguauacagauuauaggcucugcagaccuacacggucacaggaagaccaccacauauuuggcuguuagcuuuugaacaaagccaaugcaaagaggauaacaugaacgaugcacgguucccagugucugugccaaaaucgucuaaguucaguccggucuagaaggccgggggauggagcugaccucaggggaacccugcugaaguugugacauuuauucagucaagaaguauuuauuggacaugaacaauuugucagugaccaugcuagacacuggggauacgcagucccaccuuuaaggacacacaguauaggggauagaucaauaaaauagacugaaauugcagugcagugggauaaaugccguggaggggaguaggcaugagguauuagacugggagacggggauaucuggggaagauuuguguuggugccucagcugacuucuaaagccuacauacuucuuaacccaggcaaaaguggaaaugcauucuagguagaggacaaguagccagaacaaagugacaaagguaagaaagugccaugcuuucugagaacugcauuuaauaguucaguuugacuagaacagagaguacaaaagggagaaaguguugagaaauuagagagaaaacuugggcacaucagaaaaaggcccuguuuuccacuaugcucgggagguugagggcagugggcagccuucccggcaaagagccuguggagaauggauggaaggauaggcaggagacaagguaggaguuccggcagugaugcgagcaagagagaacagaggccuccauuaaagcccgauagugaggacaggaagaagggaguacagggaaguuacucaggagcaaaauugacaggauuuggccuagaagagaugagggacagugaagaaguaggaauugggauuauuucuugguuucuggccuagucgcugugcagaaaagaguuaaccuagcaggccuaaacugcuuauccuugaaaagaccugggcugggcgugguggcuuacgccucuaaucccagcacuuugggagguugaagcggguggaucacuugaagucaggaguucgagacuggcguagggaacauagcaaaacccugucucuacuaaaaaugcaaaaauuagccaggcaugguggcaugcgccuguaaucccagcuacucgggaggcugaggcaggagaauugcuugaaccugggagguggaacuugcagugagcugauaccauaccacugcacucuagucugggcagcagaggaagacuguuaagagagagagagagaaagggagggagagagggaggaagggaaggagagggaggggagaggaggggaggggagggaaugggagugagggagggaaggaaggaagggaaggaagggaaggaaggaggaaaggaaggaagggcaggcccacaaguuuggcccuuggcugacauuuagcaacugagauuucagcaaguguuucccccuuaucugguaagaguggcugacagugccuaaacuguuugugucaacauuaugguuuaugcugauccccugcuguccuuccaggaguccaaaauuagaggcugccuacaggcgauugaacuccaauaaagacccuggguacugagucucuaauggguuucccugacugggacauuucucacguuaucacagcuuuuuguaggaggagugaagugccucccuugugacucccugggggaaggcccuuggaggcucccacucuguuuccacagacuucuccccaugugccuuuccccuugcugacuucgcuugguguuguuucccuguaauaaacugcagcugugaguacgacugugugccgagcccugagagucugccuaguagauaacugaaacugaagguggucuugggcucuuccugaugcagucagcuguggauguagugguaccucucauagcauaaagaacgcaaaagugguagcagguuugggagugggagcagugaugcauucugcuguaaguuuuccaagguagucacuuauauugcuuuacuaggguuauuuugagcuagcauuuauuauuauauguuuucuauuucaaaauuaaguuaccaggaaaaucuaauuuuuuucaacauaccuucgcucauuaauuaauucauucagcaagcauuugcugaaacguuauugaacauuuggaacugguuaggcauuuuaagugccauaaggaugcuuaggaauaugggucaaguguucaaagggguuauaaauacacuggguagguaagacaucaucugccuuugaaaaauaaaauagcauucauuucaaaaaugaaauguuaaaauauaucaauauguaaacauuuuguccuugagaaauuaaccaaggcauucuuggguuagugguccaaaugacuagcauuuguaauugggaaaauuguaauccaaaacagacacaccacauauuagguucaucaucacuaggacaauuuuuguccucuucuggugucacaagauguuuaaaaccaagauucagaguguuuucagugauuuaggaguucuguaauugcagucacuguggagaggugcucuaaauucagcacauuuucagugguacuccugauggauguuuuuucucgcagaaaggccaagucauugucaaaugguagacuauaaagauccccaaaucagugacuaaccucuuuaugaucucggggaaauauucuguggauuuuuuucuccccacucaggaacaaugaauggugacgaucuuuaagucaaugaugugaaugaaucacauguggaugaacuaaggcucuuuccugauucucaguccuaaugagcagcucuucauuuaaccugugggauucguuugugcugcccugaaaaacuaugaaguuuuggcuugagguuguugagauccuaaggaaauaucagccaaauaagucauuuuauuaaguuagaugaaaaaucaauucacuucccuuuuucagauuuuuauauuguaacguuguggccuuuuuucccuccaugaagaaaaauaagaauucaaucuuugguuuagaaacucugagaagcaccaccucuugaucaggcaaugcacgucuuuguaauagugccggucuaucaaggcagcucucauuucaucacuaacgaaucaaaagcuucuuucacaucacuguuucuggguuuuuguguauauuuuguuagcuuuaacuuuuaaaauuauuuuauuuuugagacagggucucacucugucgcccaggcugggugcagucaugugaucguggcucacagcagccucagccucgcucaagcgauccucccaguucagccuccugaguagcuggaacuacaggcaugcacuaccaugacuagcuaauuuuucuuuucuuuuuuuuuuuuuaaguagagauggcgucuugcuguguugcccaggcuggucuugaauuguguucaagugauccucccaccucagccucccaaagugcugagauuauaggcacgagucucugugccuggcuuuuucuuuuuuucuuuuaccauuuuauuggacuugauguggauuucccuaccacgcauuugauccuaaagaaacucuaucagcacauuuuuuccaggugauauguguuugcugaaauagucauaugguaccuaccaguccuuacucauauaucuuuuugcaguuauuuuuacaagaauuuaagcacuugagacauuucuuuuuugugugugugcgugugacggagucuugcucugucacccaggcuggagugcaguggugccaucucgacucacugcaagcuccgccuccuggguucaugccguucuccugccucagccucccgaguagcugggauuaugggugccugccagcacgccuggcuaauuuuuguacuuguagagcugggguuucaccagguuggccaggcuggucucaaaccccugaccucaugauccgcccgccucggccucccaaagugcugagauuagaggcgugagccaccaugccuggccuaaaacauuuauuucuaaugagaaugaauaugugaauaaaaucagcauucuguuaggaaugaaaaggaauagauguguguagucagccaguuaguguacacuaaaccaguugguauugucaguagcaguaagagugacugucuccucagacuuuugaugggcuggcuuagaaaaguaacaugaagauaaaguggguccuggaugucuuucuuuaugggagcugagugauuaugccagacaugagaucuaggacucauuuugcaaaugaagaaaaaacagcugaaaacuugucaauaaaaaugauaaccaaaggagaaauuaucauaugauccaauuuaguaaugacugagggaucauaaaaauuuauuaaaaugaauaacaguuuauugcuuuucugcuuuuucuauuuuuuuccuuuuuuaucuucagaaaucaagaaagacauuuugcugcuuugggaauguuaugccauuuuugucguuaaacggaauauuuagaguuaagauaugauuaggauaagguaaaaccuuaugaaauguucucacauauaaauguauggaacuuuucaauuagcuguuuaaaaugaaauauuuauauauggagaucuucucagauauauaauguuuaaaaaaaaaaacgcaaccuuuauuuuuauuuuuugagacagucucgcucuguugcccaggcuggagugcaguggcauaaucguggcucacuguagccucaacuucuugagcucaagccauccucccaucucagccuccuaaguagcugggacuacagaugugugccaccaugccuggcuaaguuuuuuucuuuuaguagagacaaggucuuguaauguugcccaggcuggucuauccugagucugagcucaagugauccuuccacuucggccuccuaauaugcugggauuauuacaggugugagccauuaugccccgccaacuuuuuuuuuuaaagcaauauauuuaguggucucuggaguagcucugucaacacugucgaauuugaaauuguaacuuaaguauucuguacugucuucucuauuuuaacuuucauauuaaugcuuaaaugccuacuguuccaacauaaauggauuuugcuuaacaaauacugugagugauugggcucuuaccaguuuaagcuggcuuccacaagcaaggggcacauuucuucuucauuaguucuccugauugaguuucagaaaaugaaaucuuauuaugccacaaaauaaucguaucuuacuugccuuuuuccugaagcuucucaaaaguuuuuaagaccuuuuaaaaggaaaggaaugguuuuuuuucuuaaauccaucuguuccucagccucaagucuaagauaacgucugagauauguuguuuucaguuuagacucacaagauaugcagcacuugggcauggcaauggcuggcucaccaugcuugauaauaaaauaggagaaaaagguccuagugccaguggagucgagagagacaaaacaccuccaguuggucauaucucuguucaguuuuucagaacaauggauuuaacuacuuuuaauaguucuucuguuaguauagaauacuuaaagucaucuuaauuugauuuuuuuuuuucucuagguaaauguguuuuauuaucccugccucugcuggcuuagaaaaucuagcaaaagccugccacuugaguuggcuguaacaucagacccaaaggaucuauugccucccucguuuacuuuuaccgcuggugaauuugcaguccauuagaaauguggaguugugggccgggugcgguggcucacgccuuuaaucccagcacuuugggaggccgaggcaggcggaucacaaggucaggagauugagaccauccuggcuaacacggugaaacccugucucuacuaaaaauacaaaaaaauuuagccgggcaugguggcggacgccugcaguuccagcuacucgggaggcugaggcaggagaauggugugaacccgggaggcggagcuggcagugagcggagaucaugccacugcacuccagccugggcgacagagacuccgucucaaaaaaaaaaaaaagaaauguggauuugaguagguaaaugggcaccuuuguuaacuaugagaaacauuaucuauagauuacuuuuauuacaauaaaaguccuucuauacuauuuaauuuugaaaauuuccaacaauuuuuauuguuuccucaauaaaaaugguuuugcuuuugugagcugcuauaaguucuguagaacagcaaaauguuguauauggcuucuagacugccagcuguuauacuuggcuauaaaaagcuuuccucaagcuuccuuguacuggcuuuugaaagacaaucuuccaaauguuugagaaaguguaaaauuuuuauuucccuagaaagagaaaggcaggaaaaugacccgauucugccaaagauaaaugaaucauuuauuauuucguaagauaacgugcugcuucagguuacugaaugggguuuucuuucaucauucauaguuuccaccauacauguuuuuuaaaaagaugauuuuugaagagcaaauuuagguucacagcauaauugagaggaagguacagaguuuucucauaucccuccugcccuccucccccaccuccaacacaaaacacacagccucccucauucucagcauccucuaccagagugggacauuugugacagcugaugaaccuccauggacucuucauuaucaccaaaguucagcuucuguuagcguucacucuugguguuguacauuccguguuuggacagaugaauacugauauguauuuaccuuuauggcauuauacagaggugcucugugccucaccuguucaucucucucucaacucucaucccuggcaaccgcugaucuuuuuaccguuuccauagcuuuaucuuuuccagaaugcuauauaaucgggaucauacagccuuuucacacugccuucuuucgcuuaguaguaugcauuuaagauugcuccgugccuuuucauggcuugauaacaucacuuacuuuuagugcuaaauaauuguccauugucuggaugugcaacaauuugauuauccauucaccuucugaaggccaucuggguuacuuccaaguuuggggaguuaugaauaaagcugcugucaguauccacaugcagauuuuuguguggacauaaguuuuuaacuccuuuggguaaauaacaaggaguaagauuucuggauugugugaugaguauguuuaguucuguaagaaauugccaaacugucuucccaaguggcuguaccauuuugcguucccaucagcagugaacgagaguuccuguuauuccacauccuugccagcauuugguguuaucaguguuccggauuuggccauucuaauaugugcguagugguaucuucuuguuauuuuaauuugcauuucccugaugacaugugauguggagcaucuuuucauaugcguauuugccaucuguauccaucauacauuuuuaaugcaaaaacuauauuugaggaacagcaaugcauuuuaagggagagagagugggagggaggaaagaaggaaggaaggacaacauuagugaauucaaaccacuaccuguaaaaguagcuuuuucuuuuucaguucugcauguaacucuaccuguaccuagcuauuacagauagaccauagcuguuauagguagacuauauggaagaggaaggcuaauauuuauugagaauuucguaugccucuaacgcuauguuaagcacuucacauccauuauuuaaucaucacaaaagcccuuugagguagaugcaauuauuauuauuguuauuuuuauagacaaugucuuacuguguugccgaggauggacuugaacuuggagucagaucuuucuaccacagcuuccggaguagcugggaccacaggcaggugcuacugugcccagauaguuacaauuauaauccgcauuuugcaguugagaaaacugaggcaaagggagaucacgucaggucacagcaguaggacgggaccugggaagugugacuguggaguguguguucuuaaucugugugcccaauuguuaaguaaggagaaauuacaaaagacaaagguuucaauaacucuuugcaagaaguccuuaaaugugaacagaaguaccuauuuuccacacauuuuauguccuuuuuuuuucuuuuuaguuuacauguauuuaugggcuacagagugauauuucgauacauguauauaaugcauaaugaucaaaucaggguaauuagcauauccaucagcuugaacauuuaucauuuuugccacacuuuuuaucuuguugauagugcacaauuuucauggcuuugccucuuguuauuuccccucauguauguaggucuggugaaaucacacguagggagaacauuuuuacaaugcacauuugugaaggcuuagaaacacggugguuacaaacugagcuuugccacuuaaucucgugugaccuggauaaacgacuucauaccaaacuucauauaguuuccucauccauaaaccuguaacacucaggcuuauuggaguaacauaugaaauggagguuaucuaaguauuuguugaaugaaugucccccugcccgcacucccuccguuuuuuucuuuuucuccugcuuccuaugaaauagaaaacugguaggcauugcaggaugaaaugaggaaaggcagggaggagaggcauaaaauauauucuugcuaauuugcuagugucuuuuuuuccccucaucaacuuuauugagcaauaauuuuaugcaguuaaaugaaucuauuuaauuggaugaauuuugacaguuuuauauacccaugaagccacagucacaaucaagauagagaacauuuccauuacuuccaaaauauuucugugccacuuuuuucuuuacuauuuccuuauuguaguaaaauguauauauaaugaaauuuuccauuaugaccacuuuuagguauacaauccaguagcauuaagugcauucauguuguucugcacccguuaccacuguccagcuccagaacucuuuuucaucauccagaacugaaacuuugaacccauuaaaugauaacuccccauuccccuuuugccccagccucuggcaaccaccauucuacuuccugucucucugauuuugacaauucuagguacuucuauagguugaaucguacaauauuuguccuucugugucuaacuucuuuaauuuagcauaaugucuucaaaguucaccaauaugauaguauugaucagaauucccuuccuuuuuaaggcugaauaauauugcauuguauguauauaccacauuugauuucuccauucaucuguugaugcauauuuggguuauguccaccuucuggcuauugugaauaguacugcagcgagcaaaggugugccaauaccuauuugaaucugugcuuucagcucuucagguuauauacccagaaguggaauugcuggaucauauaguaauuauuuuuuaaaauuuuuucuugucuucuuuuauuuuuaaagacuaggucuugcuauguugccuaggcuggcuuugaacuccuggucucaaaugagucuccugccucagccugcagaguaggaguaccuggggcugcagauguaucacugcacccagcucguguuuagucuuuuaaggaacugccagacuguuuuccacaauagcugcaccguuuugcauuccuaccaguaacgcacaaggcuuccaguuucucuacauccuugccaacauuuguuuuuuuuuuuguuuuuuucugagacagagucuugcucugucacccaggcuggagugcaguggcaccaucucggcucacugcaagcucugccacccggguucacuccauucuccugccucagccuacugaguagcugggacuacaggugcccaccaccacgcccggcuaauuuuuuuguauuuuuaguagagacgggauuucaccauguuagccaggauggucacgaucuccugaccucgugauccgcccgccucggccucccaaagugcugggauuacaggcgugagccgccgcaccuggccuuuuuuuuuuuuuuuuuuuuauagucauccuaaugaguguuaaggugguauuuuaucaugguuuugaauuugcauuuuccuaaugauuacuaauguuaaguaucuuuuuaugugcauaaaaauggccaucuauauaucuucuuuguaccuguacccuuuuucagucuaucccucacccacccccagccccagcugauuagugaucuccuuuuugucacuguacaucaacuugcauuuuacauaaagugaaaucaguauguacccuuacauccaacuguuuucgcuuagcauaaugguguugagauguauucauauuauuggaccuaucaguaauucauuccuuucuguuuaugaauaguguuguguuguguagacauaccacauuuuauuuauccauuaaccuccugauggacauucacugugaacauucauguacaaaucuuuguaugacauacguuuucucuuaggaaaauaucuguggucacaguggcuacguuauaugguuaguauuauaucuaacuuuauaaaaaacuacaagacugcuuucugaaguagucgugacuuuucguguuccccccaguaguauaugagaguuccaguugcucugcaucaucaccaagaccugguagugucagucuuuuuaauuucagccauucuaauacgugcucgguggcaguccagugugguuuuaauucccauuucuaauuaguuaaugcuacugcuuaucuuuuuaagugcuuuuuugccauuuguaucuuuucuuuugagaaguauuuguucaaucuuuugccuauauuauuuuggguuguuuucauguuguugaguuguaagaguucuuuauaugacauggauacaaguccugggucagauaugcauugcaaauauuaucuccuuacuugugacuugucuuuuuguuuucuuaauggcaucuuuugaagagccgaaguuuuuaauuuuaauaaaguucauuugaucaauuuuuacuuuuauaguuuguguuuucuucuuuuauuuaagaaauauuuucuuagggaaagucacaaauauuuucuaggaguuuucuguuuuagcauuuacauuucaauuuauaaucuuuuuuuuuuuuccauagagaucgggucucacuacauuaugcaggcuggauuccaacucccaggcuaaagcgauccucuugucucagccucucgaguagcaggaauacaggcauuugccaccaugcccaacuauaauccauuuuuaauuaacuuuugaauauguuauggcauaaggguuuucuugauucuccacacaaauauacaguuguuccugcaucauuuuuuugaagagacuuuccuuucuccauuaaauugccuuuucaucuuuguuggagaucaauugcccauguuuguguaggccuguuucuggacucacuauucuauccuuucuucaguaccacaccauucugauuaguauagcuuuuuaguaaaucuugaaaucagguaguguaugcccucuaacuuuuuuuuuucucucuuuaaaauugauuuggcuauuuucacuugccuuuucauaaacauuuuuuaaucagcuuguuagcuuuuuaaaaagccugcuauuuugauugaaauggugugaaauguagaucacuuaggggagauuugacaucuuaauauugaaucgugaacaugguaugucccuuuuuuuaaaaaaauuuuuuuuaagacagggucucacuuugaccuccagggcucaagcgauccucccaucucagccuccccaguagcugggacuauaggugcauaccaccgugccuggcuaauuauuauuauuauuuuuauuuuuuagagauggagucuugccauguugcccagacuggucuucaacuccugguaucaagcgaucuuccugccucagccucacaaaguacugggauuauaggcgugagccacugaggcuggcccuuucauuuauuuagagaucuuauuuaguuuaucccaaaugugcuugucuguuuugauugugauuuaauguaugcaacaccuauucuaggacaggcaaaguacaaagugccuuacacuuaaucucccauaauuacuuccugaacauggauuguucucacuguguucagaugucauaacugcaccugagcguuacagagccaacaaauguuggaacugggauucaaaggagaucuggucacuccaaaggccaugcucuuagucucuaguagucaagauaacacauuugagaauucuguagauaaauauuuaaagacauuuuuagcaauuguugcaugcuuguuucucaccuccugucucccucaaccaaaaauaaacacauaaauuguaugaguggauagauguaucuguggaugaauagauucgucuuuaauucaccaucucaaacucacaguggacuugcguacuauuagaaaaucauguuaggauuaucuuugaaaugcauuuuaauuagccuugguuuuuuuuuccuguuaucuaucucaucuagauaucaucaagcauaaaguacaucuuguacuaucagcaucacauaggaaaucauuagcauuccccagaguugucugaucacaugccgucccauugauguguuggucaccugaccccaucaucguucccugcaucucugaggaggucuaagaaugugaccuacuuggaugucacuuguuaaaaguugucuggaacuuuaguucugccuaaugguuuuuuccuuccuuuaaaagacaagaaaaaugaaugggcuguuuuauaacccccuuucaauccucugaucuucagagagaaaaauguuaaaaggcaugaugcagccguuuuauguugcaguuuauaaucuaauuaaguguauuuuauccagaucauuauggacuucauuagagcucuggacuuuuuguaagaaagaugaugaguuagauuuauguagaaucauuuggguauuuuaaauguugugaucaugccagcagugccugauuaaaaaacauucaaaucugccuaucugauuuaguuggucauuuaauuuuggaaggcucuugcuuccaauuuugcucacuuuuuuuguaagcauacaguuucagcaugauuaauaagagaaguuuguuguuuggggagaguaccauuugggaaugauucuuuuuaguagccuauauacuauuugaacauucugauacauaugggaaauaaaacaucuaaugcaauuggcauaaucuaggucaaaaagaaaugaaauuacauuuuucuuuuuuuuuuuuguacugcagaagaaauuaauuuuauggccuacaguuuaauugcuauuuuuuucuggugucagguauaagcauuuaaucuauaaauugauuggaaaacggaaagugacucauguuagucuuaguuacauuauuugaauguaaauagucaagaguauuuuuacucuguuuuagauaugaggaccaacuucuguguuacucccuagucuguuauauuaaaaaauaaguuaauauuggcugggugagguggcucaugucuauaaucccagcacuuucagaagcagaggcuuguggauugcuugagcucaggaguucgagaccauccugugcaauguggugaaacccugucucugcaaaacauauaaaaauuagcuggguauagugggagacaccuguggucccagcuacucaggagguugaggugaugagccugggagguggaggcugcagugaacugugacugcgccauuauacuccagccuggguggcagagugggaccuugucucaaaaaaaaaaaaaaaggaguaagaaaaaaaaagaaguuaauauuaagcucugcuuaacaaacaucucaucuuuccaaagaauaguacuugguaugucuuccucuucguaauuucauauuuucugaaucaaguugugucuguagccuugaauuugcccauccuuuuaccucucaucauaugauccuaguaacauucauagcuuauccccauuuggauaauuuuuucaaucaguuuacuauuggucccaagcaauccugaauuguuauucaguaagggacaauauuaaaauauaauuugauaguuaauauuagguggaacauugguuuugccugacuccuuuaagccaugaaacuuacaccuccucuugggaggagcucgcuaccucccagcuuguuuauauacaugugugcaccugcauaaucaaacaaacacacuauccaacugguacaacacaacaaaaaucuuccggcagucucagcguucaccauuuuaguucuaaccugcuuacaaagacccaauuuguuaucuucauaccccuuaauuucucaucuucaucaugucuggccuagaaauuccuuuugcuuuuuaugaccucaccauuuacguuggaccugacacuuagaaccucuucuucauuuauauaccuuggcuuucuuccucaacagugauagagauuguuccucuaggcagacuaccuuauauuauucuaggugaaaaaccacccaguuuggccuggcuuugaggcccucaucuuuugcccaaccuuuuauggaugaugcccuacucucugucuuguagcugugucuuaagaaauauguuguacauugagucucucugaauucauaauuggguaacauuaucucugugaacuauuuuuguguguguugcacugggcuaccuggcuggaaucaucuuggcacuacuacuucaguguuuuugcgugauccucuuaauuagagaaagaaagaaaaauucuagacuaugagucuaauuaaggccuauauggaaccucugaucuuucauuucaaagugaaaagaacacuagcuuguaguuuauggcccuaaucucuaaguauuucgugaaagguuguuuguugguuauauuaaugcguucacuaguugcuuucagacuaauacuaaaugguacugcuuuuugauauuauagucaacuucuguuuacuuuuguucaguauuuacuacgucuauugaaaaauuuguauauuuuaucuugguggaaaccacuguuuauuagugggcuauugaagugguaaguaaugacugaaacauugagauggguuaugcagugcuucuuccuuccgaggguuugugagccacugaguaggugugggaggaaucucauaagcugacuuaaguauuagaaaaugauaauuuacaauguguuuuuauauuuuuuacucauuuuacuugaaaugcuaguuuguuuuucaguuacaggcagaagccuagccuagcugaacuggcacagcgcaguugacgucuguuaaauacauacuguguuuuuuguguuuaaaacacauaguaugggccggacgcgguggcucacgccuguaaucccagcacuuugggaggccgagaugggcggaucacgaggucaggagaucgagaucauccuggcuaacacggugaaaccccgucucuacuaaaaauacaaaaaaaaaaaaaaauuagccaggcgugguggcgggcgccuguaguccuagcuacuggggaggcugaggcaggagaauggcgugaacccgggaggcagagcuugcagugagcugagguugcaccccugcacuccagccugggcgacagagcgagacuccaucucaaaacaaacaaacaaacaaacaaaaaaaacacauaguauauauuuaacgacucuguuuuuugugagguggcuuugauaagucuuccccuugcagagucuaagaagcacagagucguuuauugucaggauacuuguggccugcaacuagaacugggcucuugaaggaucucaggguugggcucaugcucacacuugcuccuccccucaaaaugccuccaaccccauuuuccuuguuucucagucucuuagggcaucuguacauaaugcugcaugccugcuauggucuccuuuuacuaagaacuagccaaauccucucgucguaugccacaguccaaacccagucucgcuuccuuaauuaauaacuaucgccuccuguuuggacaaaaaccaucccagauggacaauguccugguuuguucaggcaaugguaagugagauaagaucuguuaucuugacaaaaaaggaaucccacaacagacauuacuuugugacuuaauuuucuugaaauugauuuuaagaacacuuuuuuuuuuuugcuuuaaauacuuuaucucauuugagccuuacaauaaccuugugaaguugcuaucauucucccuguuugcugaugaggaaacggguccagagaacuuaaggaggcugcugaaguucacaagguuaggaaguggugaagcccagacuuggaaugggcugucgggcuuccauccucuagagcccuuacuacuguauacuauauuacaucucacugcagcaaaauacaguuuuuuugcauaaugugugcauuauguuccguagaaauggcuguaaugugauauauucagucaugccccauuaauggacccaguauuuuuacuuuuuugucacuaaaauaugcgauagacauucuagugcauacagcuuugcacacuggcccuuuuauuuugacugaaaaggcucuucaaaguagaauuuucuuuucuucaaggccacgugaauuuuauauucuagaagguguugccaaauuuccccaagaaauauuguuuguaauggauuauaauuucacccacaauguauuuuaccagugaaaugcuugaaaugaaauauuuuuccaaucuacuggguaaauaguguuaacuaacgugaguuugcauguucuugagguugaagaccauuuuauauacugguuauuugcaauuccuuuuuugugauucacguguacuauucauuuuuucauuuucauggugaauuuuuggucuuuuccuuaucgauuuauagguguucuuugugacaucaacacuuuguucaacauuuuacggauauuuucgcuaggaugucacuugucucuugacuucaguuacuaacaaauuuuacauuuuuuacacuggaauaugacuauguagguuuuuuuaaaaaaugcccuguggguuuccugucguggguaucuuugcuuauaucaaagcuauauaauuauuuucacauuuuuuuuuuuuuccuucugcuacagggucucacucuguugccaggcuggaguacagugguaggaucauggcucacuguagccuugaccucccuugacucaggcgauccuccugucucagccuucugaguaguuaggauuauaggcacacaccaccaugccuggcugauuuuuuuguguuuuuuguagagauguaguuucaucauguugcccaggauggucuugaacucauaggcucaaaugaucuacucccucagccucccaaaaugcugggauuacaggcaugagccacugugcccaggcuggugaauaauuuuuaagauugagauauuuagucuaucuagaaauucuuuuguguaugcuuugagguaauacaauccagcuuucuuuuuuccacagguggagaugcacauaugcuaaugccuuuuuauuauacaaaugguucuuuuccccacucaauugaaaagucacaauugagugauuuaacacuuggcuuaaaguuaucauaacacuuggcuuuuuucugugcuaucugguuaauuguucaacuuuucugucccuguucuagaaucauucucuuuucuuuucuuuuuccccaugguuuguaguaaguuugguaucuggcaagacaauuccacucccacuauucuuuugcacacuuuucuuuacuguucuguauggacauuauugcaaaugagcuuuaaacuuacuuuaccaaguuggagaagaaaaaauaccacuggauucuaauuggaauauauggaauuaaauguauguauuaaguuuagaaagcaugacauuuuaagaaaguaaccuccucuucaggaacauauguuuaucuuuuuguucauaugguauuuuauaucuuucaauaauauuuucuguuuguuauauagaguuuauauauauuuuguuguuaaauuuauacuguguggcauuugauauaaguugcuacuuuuuauaaaauauuuuucauuugauuuucuagcuguuuaucucugguacagagaaaacuaaugauuucuuuguauauuugucuuacaucuuuguaucuaaguacauucucuuauuagaguuggauuuuuuauuaaaguuggauuuucaaauuauguaaucuuaucuguaaauaaagaucaccugcuacauauauguauauaaaauuucuucuuacaucagcaaaauauauauauuaaaaaaauauauaaaauauauauauuuuauauauauauauuuuauugcauuuuaaguucuaagguaccugcacacaacgugcagguuuguuacauauguauacaugugccauguuggugugcugcacccauuaacucaucauucacauuagauauaucuccuaaugcuaucccuccccacucccaccgccccaugacaggccccggugugugauguuccccuuccuguguccaaguguucucauuguucaauucccaccuaugagugagaacaugcuguguuugauuuucuguccuugcgauaguuugcugagaaugaugguuuccagcuucauccaugucccuacaaaggacaugaacucauccuuuuuuauggcugcauaguauuccaugguguauaugugccacauuuucuuaaucuagucuaucauugauggacauuuggguugguuccaagucuuugcuauugugaauagugccgcaauaaacauacguaugcaugugucuuuauagcagcaugauuuauaauccuuuggguauauacccaguaaugggauugcugggucauaugguauuucuaguucuagaucccugaggaauugccacacugucuuccgcaaugguugaacuaguuuacagucccaccaacaauguaaaaguguuccuauuucuccacauccucuccagcaccuguuguuuccugacuuuuuaaugaucgccauucuaacuggugugagaugguaucucauugugguuuugauuugcaguucucugauggccaguggugaugagcauuuuuucaugugucuguuggcugcauaaaugucuucuuuugagaagugucuguucauauccuuugcccacuuuuugaugggguugauuuuuuucuuguaaauuuaaguucuucauaguuucuggauauuagcccuuugucaaauggguagauuauaaaaauuuucucccauucuguagguugccuguucauucugauggugguuucuuuugcugugcagaagcucuuuaguuuaauuagaucccauuugucaauuuuggcuuuuguugccauugcuuuugguguuuuagacaugaagucuugcccaugccuauguccugaaugguauugccuggguuuucuucuaggguuuuuaugguuuuaggucugacauguaagucuuuaauccaucuugaauuaauuuuuguauaaaguguaaggaagggauccaguuucagcuuucuacauauggcuagccaguuuucccagcaccauuuauuaaauagggaauccuuuccccauuucuucuuuuugugagguuugucaaagaugagauaguuguagauaugcagcauuauuucugagggcucuguucuguuccauuggucuaucucucuguuuugguaccaguaccaugcuguuuuguuuacuauagccuuauaauauaguuugaagucagguagcaugaugccuccagcuuuguucuuuuggcuuaggauugacuuggugaugcgggcucuuuuuugguuccauaugaacuucaaaguaguuuuuuccaauucugugaagaaagucauugguagcuugauggggauggcauugaauguauaaauuaccuugggcaguauguccguuuucacaauauugagucuuccuauccaugagcauggaaugcucuuccauuuguuuguguccucuuuuauuucguugagcagugguuuguaguucuccuugaagagguccuucacaucccuuguaaguuggauuccuagguauuuuauacucucaaagcaauauuuuauaaagagucaauaaugguuauccuaguccaguuugucauuuuaauaaaaauggcuuuaacacuucaccacugagcauuaagucugcuauugaauuuugcugaaugguucuuaucauguuuaaguaauuuuuaccuuuccuauuuaaguauuuuuaacagacauauuuauugaccuaauuuguugcacaccuguacauaugggaccucauuaccucucuucugcagccuugauagaauaaagaguucugguaaaauugcuaacugggcuggaaaucaguuuguaagcauuuuuuuccucagugaccagugaccucuagccucucugccaagcaugagacggagccugacugaucuauaaauuaguucugguuuuacguaccuacaaaauuucuugcccaaacaacccauuuauuugcaaguucuuguacuggcaucaucauuacccaguuugugcacauuucucugaagguaaaauagacaucaugcgauaucuccauuugacauggaguucucauguuuacuguaugaacaccuguguaucuuacccagaacauguuauuuugguguguauggacauggaguuguuuaaacuauuuucuauaaauugaaccaggaaucauuauaauuugcacugagaacuaaauugagguaaugaauuuuuuuuugcacagaaacuccucuuaauuuauaaaaaugcacugugaaucaguucaaguuggucuuuauucguagaacuguugaauuagaagaaaacuggaauauauaauauuuuguggaaugaucucucuccguuuuaaaaauugaaaucuuagacuaaagaggcugugaaagaaccucacugaggugugagagaaaaauaaaccacaccaggaaccacgugcggacacugcagcagguagagcgaguccugaauauuccuaaaggugaaugugcgaacaggcuucccuguaccuggagauccccgaaacuguuggugcgagucauuauccaguccacucucuguagccagguuuucuccucuggcagggcucuaacuccaacuccaguguuugggaggaaggggaaggcacgcugugagagcuuugggaagcugccagggaagaacuaccuccucagacaauuacuuucuguugugcuugacugcacauauuauucaucauuggcugagcauguucaucauaaaugcuguuuaaucacauuuuaaagguaaacagcauuuaucaaauuaucaucuggugucuugcuccaagucaccacugauucuucaccagaaaccuaugcccugcaggagaacguguguguuuauuuguugucacaugaucuguccaaaggcugagagccacacucaugucccauuggguuauuuccuguguucccagccauuccucaucuuaaaauagucaccuuguuuugguuguguugguucuaucucaagauauaguuucaauaugggcaggacuuaauuuugcuuuuuuggaucuuucugaaugucuguaguggguguugaagcauuuuauguucagaacauaugagcauuuuaauugauuggcuucuacugcuuuacauaguacugugugcucaguaaauauuagucugaauaaaggcaaugcaugaggagacuuugguagauuaugugauuuugugugaauaucauaaauucuuaaauuucuuccuuugucuuguuuuuacaugaaagguaguagaugaagcagaguuaauccauggaguaaucgaugcuguguauauguguacaugugcauacuuaagugcagguguuggcauguguuuauuuauguguagauagagguggggauaaagaaguagugacaauggcugaaaaaagagacaaacauuucccaguguguucuggaaauuguguuaggccacucggaccauuugauuuuucauuuaucccuaagaguauauuuacguauuuauuaagaguagccacuauucagagccccuggaaauagccucaacaaaaugaguaaaaaauuaaucuccaguaaaaaacauagcagagaauguguggucaaagcuuuguugaagguaaauacaggguuucugggguugggggaagacaaaacagggcagccauacuagaauggguucagaaaggcuuugaaguguguguugagcuuaguccugaagauuaagaaggagguaacuuaccaaaaagggugcaaagugguucuauacaaaggaaaccguguaagagaaugauugauuaacgcagcucugauuucuucuggggugaucagggagaaauauucugaacuuaagacaucauaggagguuccuguguuagaaucgguucacuaauaaugcgaaguccuuacauggagagagguaauugaacgguguucccaaagagcagaccggugccacugagugcuccguggcuuggagugugaaccuguggaaggugcugagcuccucacugcuuaaucugcaguuaggaauuuuuacaaacccugaguauguggcucuugaauuacaguuauauucuuauacguucccauggauuuuccuccacaguuuuuuuccugucauauuaauuuguuuccaaucuuaguuucucuccauucuuaaaauauuuaguauauaucugugaauccagagaaacguaaguauuuguuacugcuggagaguguuauaaauucaaaugaugagcuauauaaagguagaauuuagagggaaauauuagcuuuucuuuguagcugugccuuccagaacacacagaaaacuugaagcuuucugcaguuagaggauuaugggcauucaaaucaaauggacuuggggucccauccucaaaaugugacuuaucagucauaagaccuugaacaaauugcuuaaucuuuuugaauccaucauuuucucaacuaugaaaugaaagcaauaaaaccaauuuugugguggagaguguuagaaaaaguguuucagaguguaccucauaagggcccaggaaauacgcagguagcaauuuuuauugguaguuucaucuaggaauacaaauuaugauuaaagcguauguauuuagucacccuuuuuuuuuuucccaauaaagauuacauaccaucuagauugagcuagguauaacucugaguccguccauuggaagagagguuauacccccuccaauucucuuccagaaccagaagucaugauuuuucugauauacccaguuuaugugaucacucaggcuaugaauguuuuucucucucuuccuuuagcguuaccuacuuagagaguaugaacauugcugaguuuacccacuacaggucuuggacuuaucgugugcauacgacguagggcccuggcaacacugggauacaugcccaggcacacacacacagagacuuuccuuucacaaaagaaguuuaacuugggacaagcuaauaagaaacuuacuauuagaaacuucagaaugcuguuauguagguuucagcauaugcagaauuuugucuuuugaugauuaguauuuuuauuuugaaguccgcacugaggagagagagugagaaacaugaagucauuucacucuguggggacucuaaagagcuucuuuccacccucaggaugguggguccagcguguguugcuuaagggugggaauauuuucugggaagugcaucuucaggcaacuucauagcugagcaaacaucauagagguaccuacacagaccuggaugguauagcccacuauacaccugggcugugaaguaucgucucuugcuccugggcuauaaacccgaacagcauguuacuguacugaaugcugaggcaauuuuaacacaagguuaaguauuuguguaucuaaacauagaaaaggaauaguaaaaauacaguauuauaaucuuaugggaccaccauuguauguguguucuguccuugacugaaaugucauuaugcagugcgugacuauauaucugucuuuuuucuaccaugugguucuuggagaauuuauauauaucagagagggaaaaagacacaaccaucuaucuucuaguuauuugcuauuugugcgauauuuuacaugauuuucaaacauauuucuaagcagcaaauauuaagauguguuacaaucagugacauguagaccacaaaauucuagcgcucuauaagaacugaggaaucaaugacuacaggaguuuucagaauauuuuaccaccucagcaccuuuucaaaugaaaggagauacgggagccccaugagucauuuuguucuggggaauggagucgguaacuacugguuuaauauaagccccagcugaggaccuugacauccagaaggauuuauccccacguggcuaaacuuaaauuguuucucuguuugguggcuggcugcauuuuggguuaauuuggcaaauuccuacgagaaagcagugcucagacggcagcaucagcuucauugagauacuucuucuaagagaagugagacguugggucagcaccauucugagcccaaggucacauuuucgugagaaaaaagauaagcggcagcacuugcguuugugguggcgaagcacaaguauuuaauuucugaauaagcugugaugguggggugucugugccaggaagcuugaauccgggucauguuccuacuuauugaaccccuccggagcuacauaaauccucuucuguuuucaucuuuguuguuauuaauaucccgguuguauauguaauacaggaaauauccaaaacagcccaauauuaauugcaaaccacguguuagaauacagcuauuugaaaagugaaugcuauuucuguuucaugauaggaucuuguaagguugacugaauaaauacaguuuaauacuagccgggagaaaugucuuacuuaauucuauuacaucacagaucaugucggacguuaacuguaacuuacgcuaagacaaugguacuaaucaaugcugcguuaauguuguuacuuuucuaguacuugaaauaagcuugggcuuagccacucuucuucucauaucccuuuugaucuaguggcaagauguugagaacuauugggccuggucugugucuuugaaauacaauauaggucauuggcagagaguacugaaccugcgcccuuggcuccauuacagcaugaccuaaucaauugagaaaacgccucuccacggcuuuucucuggaugauucuccccuccuuacuacccugugacugauguuugucaucuuguggcucaacuaaacugucgccaguuacuccuacucuuuugaucucacaugcugugagucuuacccauuggcgcuuaguagaauuuauggaaucaauuuguguaaauggagacaugaaaucucaguuuguaguaucaguuugagggauacagcaaucccacauuucgaaggcugcuacagaucauucacagguguuagacuuauuacagagcugugucuuucuuauuccccaaagccuuugccacuuugguuuuauauguugguuucgguaaauacacauuuucuaauaugcauguuguagacaguauagugaaguguggugggugcauaucugcauauaccuauguuuacaucuagaugaacauauaaauaaaauauacaucucaauaugcauguauauggggaugagggcauauaaauaugaauaacuuuguuuuggucaggacagagcaaccgacuacaauugccaggauaauuuuuguaauucaacaagagagauuuuaaauuguuauuacacauugcuauuuguauuuuuuaggaugcaaauccaugcugaaaccuccaaauuuccacggucuauguuuuguuccuucacuuauaacugugucugcuucuccaugguaggagaaaacaaggaaaggaaauugugacuuuaaaauauuaaacucugguagagacuugaacggccaauuuuuguuuauuuguuuguucuuuuucccauccuuuccccaguguuuuuuuccugaaagucuugccuauuuuaugcaaauaacauguauuuuaauuggcaacauuuuacuuucccuguuucuacuuacaaaauuuccacaaagauauuuguuuuaaauuuauagaaugcaaaaacuaaauucauuacaaacuaaggcuaggagccuuuagacccuggagcacagucaugcaggaacagaagaaugaguaugaaguggaaaucccgagagauccccuaguuguaagaacucuaacagaugcccccaugucacugaugucggaaagauguuggagcuaggcaaagccugauagaaugggugauuugugaaauuuuuauacagcgaucaccuagaaaacacuuuucuaauuuucuuuugauaggauucguauuugugucgagaaguguuuuuuaacgucuagaauacaguggccugagaguuacccgaggcacauguggauagguacguccuggcucccaccaggaugcucgcuccauuuugugucucagccuuccgucgaaaguuuucauuuguucguuugcuuuuuaagaaagaguuuuugauaauucugucuuagaaggaugaguaguugucucauuaagaagacucuuggugguagcauggucugacuagcuuaagguacagucuuuccucuuugaguuuccugugguuuuacuaacucuuugcuuucccucugacauaaaaacuagaagccauaaauuacggauaaauuccacuacguaaaauaagagaucuuuaaaacucugcauggcaaagccacuauaagacaaguaaaaaacuaaacugggagaaaaauaguugcagcuuauaucucagagaaaagauaauuucccuaaugcugggguugggaacuacagcccaaggcccauaucuggccugcugccuguuuuuaucaaucaaguuuuauuagaacacagccacacucauuuguuugcauauuguuuguggcugcuuucacccuaugguggcagaauugaauagcugcaacagggaccuuaugguccacaaaaccaacaguauuuauuaucuggcacuucacagaaaaguuugccaacucuugcucugaugaauaaggaguugcuacaacuacaaaucaauaugaaaagaccaacaaaccaguagaaaaauaggcaggagauauguuuguuagugucucaggaaaacaaagcaauagcaaacagguuucuccacaaaugcuucuucuccccaaauggggcaacuuacagaggugagggcaggauuuuggggacaaaaagggaaugacauugugacgcucggagaccugcaaaugugggaagcuauuacuaucccugggauugaaggcagggacaaagagagagaacggcauugccggagcaggaaagaugggucauccgaagaaggcugugaucauggaggauguagccacugugagaaauauguccuugaagcaggauggaaaugggaaagauaucucuccuuccaccugcuaaccuccugcuagugccucccagaaguuaucagaggagggaguccaggugaugcuguccucaggggugagcuuccuaugacacagaugaaaagcuccucagcucauucauaauaagagcagugcaaaugaauaugauacugaaaugucacuuuuaaccuaucagauuggcaaacagcagaauguuaacaccuuguauuggcaaggguauagggaaacagguacuauauagauacagauauguauauaugaagguaauaucuuucaaaauuauaaauucauauauccuuugacucagcaauuacauuuauaggaauuuagcuaauacaugauacuuuagcuaauacaugaaaugaccuauguguaagguuauuuauugcaaccuuguuuguaauaggaauacaauggagauaaccuaaaugucuaucuguagggaacugguuauauaaauuaugcuacauccauucaagggaauucucugaagccauaaaaaacgaugaggaagcucuuuguguccucauaugaaaucaacgcucaguuaugccauuaagaguacagagaauuugucucagcuuuggcuuucauaacuaaaugaugauaauaaaauaaaaggcgaggcgugguggcucaugccuauaaucccagcacuuugggaggccgaggcgggcggaucacgaggucaggagauugagaccauccuggcuaagauggugaaaccccaucucuacuaaaaguacaaaaaaaaaaaaaaaaauuagccgggcuuaguggcaggcgccuguagucccagcuacucaggaggcugaggcaggagaauggcguaaacccgggagguggagcuugcagugagccgagaucgcaccacugcacuccagccugggcaacaaagcgagacuccgucucaaaaaaacaaaacaaaacaaaaaaaaaaaaaagagagaaagaagaguacagagaaaauaaaauaggauguguaguuuaugguuauuuguguaaaaaaugaagaaaaggaagauauaaagcauguucuuguguauguauaaaauaacaucccaagaaaugaugaaauuggaugccucuggagaaggagacugcggggguggauggggggauggucauccuguugugucuuuugaauacugauuaaaauaaguuuaaaaucuccuuaagggccagguaaacagcuuucaucugaaaauuugagaaacaucucaaaauucuagucccugccuguggcuuucaauaauuaucagauaagaucugaaaagcugauuggcaaauccaaugugaaaugauaacuugaaggacuuccaggaggaagcccugucuccucuucaacccaauuuuaaccuuggccuguugguauaagucccagguacuguuucuuaaauuuuuuucuucaacauacuuaaaaucaaugacacuguauauuuuuuaaaugcuccgucauuugcacuuucaacugguucuggcugcucccaucuguugguucgauuuauugaaaguuuuguaggugugucaucccuccuugucacuuaagacagguacaugcuuuaguuguuuagagcugcaucuuuagaauauuuauuuugauguggagaaaaugguggauuaucaacaaguaaacaccuggacaaucagaggaucaaaauaaaagacaaaucuggauuuauaagucucucucuuuuauuauuuuuuuucugggcaagauuugccugaaguggaaagaguugaauauggaugagcgcauguugcagacugauuuucagccguaauugcuuugcagcaggaaaauaggcaaagaaaggagauugggaauauaggcaaucaaagacgagguucucacaccugccagauaccauguguagcauacaggcauccgcagagaaauggaaauucucuuauccugugacaagauguuccaauuaaugcgauucggauacaucugucugcccguagcucaccucgugaaacgacagucccguccugcugcuggagucagucaaaaggcucauuuugugaguggcacagcagucauccugggaacugugccgcggggcugugacccuccuuccuuucgguuuacuucaacucagaaacuuccuuuccguuuauuucaacuacagggaacauccuagcuggaaggcuugcagcaagauggcauugagaucauaaacgccauucugaaagcauauguucuucagacacguggcuguggaauggggguugacauggcaaauugccagguuuugauugcugaaacaaagauauguuuacuauauuaauuuuggcaugaaaaagaguuggacaguguauggauccuuucaggccuuaacuuagaauugaguuuaaacagggccuccugggugauuuuaucuccugaggcagugaccuggaaggguagggucaggugggaggcuggggagacguuugcugugccacaggcuuuccuccuaauuuuauuuuugaggccggaacacuaugacgcuucauacugucugcauauauugggggaggaaggugucugugugucuguauuuucucuuauaaaguauacuuauaaaguagccaggagcuucauacaagcgaauuugugcggcagggaucuggcagcaggggauggagaacucugggaaaggugggauuacauugcagcgucggcaaaguacuaaggauugccgcgguccuccagaaggccaaggucgugcgucugccaucaguucuucacgcaguccgacagugcuguguggagccagcagcccccaauucccuuauuugccccagccuugcucaccucucaccucccucuucugcacucauuugcccccagccaugcucaccuccaccucuucugcagauuuuuugcacugauggucuguucuccacuuguucucugagucuucauauaugagacuuuuccugucuuaacuagcugugaacucuugagcacaugaaaccaagcuuuauucuuuucauguucuuucuucauugucuguaaaagagcaugccaauuaauuuuuggccuugauucaucuuuuuugacugugacucuuaaccaacuggaucauaauccccuacaaccugcuccacuggucauauuuuuugauggaagaaauuaguuggcaccugaguuguacaguuuugcuguaggaauguggaugaauguuauuuagcgugaaauaauacuuccucaaaguucagauucauagggaaaaaaaggcuaaauguuccaaaaaguguguauguuaugaucagacccuuucauggaguuacgucuucauuugauccacaaauaaaaaucuacuaggaugcauucugucuauguacaacuucuuagaggaaagaaauuaacauuuaaugagcuucuguuauugccaagaacugucugugcuaggcaauuuuucauauacguaauaauuuuuaaauuauugcucaauucuauauauuuaaucuuugcagugauauucugaaauaugauuauuuuaauuucuuugaaguaaaccuuuuauuuuugagauaauuauagauucauauacaguuguaagauagaacacagagaggacuuuguaaccuuuaucuaguuuccucagauggcaacaucuugcaaaacuguaaaacuaucacaaccagaacacugacauuuaaaaaaauuuuuaauuuauuuuuuaauuaauuaauuaauuuuuuugaggcagagucucacucuguugcccaggcuggagugcgguagcgugaucuuggcucacugcaacuuccaccuccuggguucaagcgauucucgugccucagccucacgaguaggugagauuacaggcacgcgccaccacgccuggcuaauuuuuguauuuuuaauggagaugggguuucaccaugguuggccaggcuggucuugaacuccugaccucacgugauccgccugccucggccucccaaagugcugggauuacaggugugagccagcacccggccagaacauugauguuuugacauuugauauggucaagaaacagggcauuucuaucaccacaagaauuccucacguugcccuuuuauagauacauucacuuuccuuacaucccaaccgcucuuuaaccuguagagcuacuaaucuguacuccauuucucuaauguugccauuucaagaaaguuguauaaauagaaaaugcaguguguaaccuucuggguuuuuuuuucacuuaggauaauaacucuccagagauuuauccagguuguugcccuuaucccuaguuuuuuuuuuauuaccaauuaguauuccaugguguggauggaccacaguuuaaccuuucacccuuugaaggacaucuguguugcuuccaguuuuuuauuacuauaaauaaaguugcuguaaacauucaugcacugguuuuaugggaacaugguuuuucaugucuuugggauaaaugcucaggaaugcaaauugcucgguuguaugcuaguugcauauuuagcagguuuagcuugcaacuugcagcgaucccuaaagcauucaugauuaucauucuuauuauauacauuugaggaaauuaaagccuagaguaguuaguucacauacccaaaauuacauaacuaguuaaguaguggagccaguacuugaacccaugucugccugaacucuccaaaucuacaucuuuuccagugaggacucugcuaaaguauauaaccuuuuacauguaucaguguuuggaauggaaacuaacgguucuguuuucaccugaccuugaaucacuaaaaaugagaagaugauuucauagucacaauauuguaucugauuuuuuuccucaaaagagcagaaagcaaauaugaguacagaagacaccaaaguucaugguagaaauuaucaaauuaggauuccuagcauuugaaugcgagggaauggagcuuuaugaucccaucuuuggugagagguuguugcucagugaaucaagggcagagccaggacucggauaugagcucuccaucccguucugucuggcugccaucugucucuccuucagugcuagggcaggcagcucauggcugguaaugcucagaaaugcagauacuaucaauuauugguguguuagcggcaaauauguggguagaggagggggagagugagagauucccagguguuaggugaccugaucaugacagguacugaaacucugaggccauuuaugguuaugagaugcacuguggggaauugcagccccuuccuguaaucuacaggguuauuucugggugacauuuugacaggaagauguccugugggaaaagacugcuaacucaguuugccugcccaacaguuaauuauuaauacuucauggcugaaaguggaguaauguuccuuguaugccuuuuauggaguucuugguauuuuguuuauucuuuuuuucugauaaaaaggagaagguuuuauuaagcaguuugagaaaauuacagccacaaaauugcacguugcuucgaggguguaagggucguuucaacguaacuuuagagucucuguaauuuaugcugcuacaggaaauaucccuucugucucagagauuuuaaacaaaggcagggugguuaucacucugcuuucuacagccuaaauauuguuucugaauuaaaauggcugauuucaauuuagucucugcagacuacaauaaagcuagaaugaaaccaaccuaauuuuaucuucauagcaguaaaacccuuugaaaucagcuucuucacuaacuuuuuuuuuuuuuuucgagacaaagucucgcucugucgcccaggcuggagugcaguggcgcgaucucugcucacugcauccuccgccucccugguucaagcgauucuccugccucagccucccgaguagcugggacuacaggcgcccgccaccacgccuggcuaauuuuuuauauuuuuaguagagaugggguuucaccacguuagccaggaugguuuugaucuccugacuucgugaucugccugccucggccucccagagugcugggauuauagccgugagccacugcgccuggccccauaacuucuuuuuaaucugaaauaauuuuuauuuccagggaucaauguuauuucuauuguaauaauggauuuugccaguuaauacuucauuugguuucugaccuugauauuuaauauauauuuaauaccuaaauaagauuccagaaguuggucugaauaaacccauaauccuucuuugcuugacaacuaguuugcuaccaagaucauuuaguaugauuuauuauaaugauuaucguaucaaugguccuuucuuuaugugauuuccuaugaaaacccuguauaauagugucauaaaacauugcuagaaacauacagauaaaaggucuagucuauagcccucacuuuauguauaagcaaguuccuuaccuggcaggugauuccauacuaaguuugucugggaauaagaagcuuguaauacaucagugauuuuuucaaacaguguuuuggggaagcagcccuguccucucccuacaagcacaggcaugcuugugcacccccacuaaacacguccacaugccuugccuugauuucaugagaucacuguuacugggggauucuauuuugggauuuacguaacauuguuugauguaagcguuccacugcaaaaaaaaguuugaaaacuguagucaagaggcuuaauaaggcuuuuuagggcucugacaucaaugauacauaguaaauaacguaauuugugugcggguuuguauuuaugaucuaugugacagguguggcgauggugcaacuccuuuuuuccuuuuuaguugacacauaauaauuguacacauuuaugggauacagagugauauuuucauauguguauauaauauguaaugaucaaaucagagugaucacuauaccaucaccucaaauauuuauuuguguugugaacauuaaaaaauacucuccucuaacuuuuugaaaaauauaauacaguugagcauauucagcguacaaugcugcagaacacgcaaacuccauccucucuauguaacuguaauuuuguauccaucaaacaaccucccucccauucuuccauuucccagccuccaauacccacaaguucuacuuugaugagcacaaaacaacaucuuuuuugcucccacauaagagccagaauaugugauaucuguuuuucugugcuugacauauuucacuuaacauaauguccuucgggcucauuccuguugcugcaaaugacaggauuccauucuuuucuauggcugaauaguacuccaucaugucuguaucuauguuuucuuuauccauuaaugcuucaugcgugaaaguagagugguguuacuuguaugucuuuuauggaguuaaauauccacugauggauauuuagguugauucaguaucuuagcuauugugaauagugcugcaauacgcauugggggugugcguaucccuuugauuuccuuucuuuuguaaaaaaaaaaaaaaaaaagaaagaaagaaaggaaacccagugcugggauugcuggauccuaugguaguucucuuuuaguuuuuuuguggaaaugcugugcucuuuucuacaguggcuguaccuauuugcauucccaccaacagugugugaguucccuuuucucugcauuuucaccagcauguuaucuuuucuuuuuuugauaacagccauccuaacugugguaagaugauauuucauugugguuuugauucguauuucccuggugauuagugauguugaacauuuuuucauauauuugcuggccauuugcauauuuucuuuuucuuuuucuuucuuuuuuuuuuuuuuuuucugagacagagucucacucugucagccaggcuggagugcagugguaggaucuuggcucacugcaaccucugucucccgggcucaagcaauucuccugcuucagccuccuggguagcugggauuacaggcgugugucaccacgccuggcuaauuuuuuguauuuuuaguagagaugggguuucaccauuuuggccaggcuggucugaacuccugaccucaggugaucugcccgccucugucucccaaggugcugggauuacaggcaugagccaccgugccuggccugcauauuuucuuuugagacauuucuauucauaucauuugcccacuuuuuaacuggauuauauuuuggauauuaauuccuugcugaacauguaauuugcaaauauuuauugcuacagauugucucuucagucucuugauuguuuucuuugcuguacagaaaccuuuuaguuuaauauagugccauuugucuauuuuuguuggcuguacuuuugaggucuuagccauaaaauauuugccuagaccaauguccugaaguguuuucuucuaguaguuuuauaguuuuggguccuauguucaaaucuuuaauucauuuugaguuuacuuuuguauacagugauaauggucuccuuucacucuucugcuuuggauauggaaucuucccaacaccauuuauugaacagggugucuuuuccucagucuguuuucuugacacauuuuacaauugguuggcuguaaauaugugaauuuaucucuagguucucuauucuaugcuaaugguuuguguguuuguuuuuauaccaguaccauaugguuuugguuccuauagcuuuguagcauauuuugaagucagguagugugauacuuccuguuuuguuauuuuugcucauuauugcuuuggcuauucauggucuuuuguguuuccauacaaauuuuaggauuuaaaaaaauauuucugugaaacaugugguuugguauuuugacagguauuacauuacaucuguagauugcuuuggguagcauggucaucuuaacaauauuaauucuuccaauuuauaagcaugggacaucuccauuuguuuguauucucuucaguuucuaccaucaguguuucauaguuguccuucuagaguucucucuccuccuucaauaaauuuauuguuagauacuuuauuuauguuuuuguagcuguuguaaguggaauugcuuuucuaauuucuuuuuucacuacuucguuauugauguauaguuuuguauauugauuuuguaucuugcaacuuuacugaauucauuuaucaguucaaagaguuuuuugguggagucuuuagauuuuucuguauauaggauuaugucauucacaaagagggacaauuugacuuccuuuuuuccaauuuggaugcccuuuguuucuuucucuugccugguugcucugacuaggacuuccacuacucauuauugauuuuuucagguuuucuccuucuuccuaauucaauuuugguagguuguguaugucuaggauuuauuuccuuuagguuuuucaguuugucagcauugucaagauuguuguucguaacagucucuaaugauccuuuguauuucugugguaucaguuguaaugccuuguuuuucauuucugauuacuuucuucacugaagauuugacccccucaaagucauccaugaggauuggaaucaaccuuccaaacucuuguuaauguugauauuuugaucuccuucuaugaaguaugaguguuccuaauggugucuggaauagugaauccuuuccagaagguuuucaauuuacuguccccagauccaucagaagaaucaauauugauggcagcuauagccuuacaaaauguauuucuuaaauaauaagacuugaaaguugaauuacuccuugauccaugggcugaagacuagauuuuguguuaguaggcaagaaaacagcauucgucuucuuguacaucuccaucggagcucuuggaugacuaggugcguugucaaucaacaguaauguuuucaaagcaaucuuauuccugagcaguaggucacaagaauggacuucagauauucaguaaacuaugcuuaaaaacagauaugcugucacccaggcuuuguuauuacauugguagaacaugggcaguacagauuuaccacaguucuuaagggcuguaggauuuuuuaaaugguaaaugaacauuugcuucaacuuaaagucaccagcuggcauuagacccuaacaagagagucauucugucuuuugaaguuuugaagcaaagcauugaccucuccucuaguuauggaagucuuagaugguaucucaucccaauauaaggcgguuucaucuacacugaaagucugcuuuuccuuguugccacccucaucagucaucucagcuagaucuucuugauaacuugcugcaacgucaccuugcaguuuuaaguuacggagauggcuucuuuccuuaaaccucaugaaccaaccucugcuacuuuccaccguuucuucugucguuucucaccucucucagccuuuauagaauuuaagcaaguuagggcuuuccucuggauuaggcuuuggcuuaagggaauauuguggcuuauuugaucuucuguccagaucacucagacuuucucccuaucagcaauaaggcugucucacuuucugauuauuuguguguucacuggaguagcacuuuuaauuucccucaagaguguuucuuuugcauuuacaaguuggcuaacuguuuugugcaacacaugugucuuucaguuuaucuuaguucucgacaugucuuccucacugagcuucaucauuucuagcucuugaaucacagcgagagaugugcaacuccuccuuucacgugaacacuuagaggccauuguaagguuacuaacugggcuaauuucaguauuauugugucucagggauauggaggccugaggagagggagagagacaggaaugaaguuggugaagcugucagaaugcacacauucauggauuaaguuaacugucucauaugggcacuguucauggugccccaaaacaauuacaguaguaaugucaaagaacacugauaagcaucacagauagaacagugaaaaaguuugaauuauugugagaauuaccaaaaugugacaacagacacaugaagugcacacaugcuauuggacaaauggugcuaauagacuuguucaacaaaggauucacaaaccuucuaucuaguaaacacaagauccaugaagcacagcagagugaagcucaguacacgcaaugagguguacuuauaauuuuguuuaguggagugcgucuuucaaggguaugugauuaaacucuguauauccuauagaugcagguaauuacuuagaagucacugauauaaaugaguauuugaucuaagacuucuuuaugcucucuucugcaagaccuagggaaggucaaaagaaggacuguuuuugaagaaagagaaacuuuuuuucugguauggguuuucauuuucuuuucuuuuuuuuggcgggugggggaugaagucucacucacucugucacaugggcuggagugcaguggcacgaucuuggcucacugcaaucucugccuucacugcaaccuaccuccuggguucaagcgauucucuugccucagccucccaaguagcugggacuucccaccagcacgugugucuaauuuuuguauuuuuaguagagacaguguuuuaccauauuggccaggcuggucuuaaacuccuggccucagguaauccaccugccucggccucccaaauugcugggauuacaggcaugagccacugugcugggccagguuuuucuuuagaacacuugggacucucacauauagcaccuuaggucacugaaaauucuguugcuuccucucaguaacaucacugaaucuauaccucuauugagcuuaaucauacaucacucagaugacaaagggagagaucaugcucacuuccuucaucaagaggguacauugcuaagcuuauggcuggagucucugucuuugcaaagacaccaaguccuggaaauuucugucugugcuuucuuugugguuggugugggcuagccuaguguauaggacgcagcuuuuucugagguaugaguguuuugaccuuacauaauucucuucaugauucaauuaaugaauuccagaaaaugaccgucacaguacugguaccucuuuucgguuuuuagagggaugugagacgucuuuguguuugggacacauuuggguggaggguacagcucccuuucugauggccacugucauauucagggcaaucuguuucuuuucuucugaauuagauuugcuguaucuuccuuccuagaugcuguccacuugcuguaucucccuuccuagaugcuguccacuugcuguaucucccuuccuagaugcuguccacuugcuguaucucccuuccuagaugcuguucacuugcuguaucugucuuccuagaugcugucuacuuccuguaucuccuuccuagaugcuguccacuugcuguaucucccuuccuagaugcuguccacuuccuguaucuccuuccuagaugcuguccacuuccuguaucucccuuccuagaugcuguccacuugcuguaucucucuuccuagaugcuguccacuugcuguaucugucuuccuagaugcuguccacuugcuguaucucccuuccuagaugcuguccacuugcuguaucucucuuccuagaugcuguccacuuccuguaucuccuuccuagaugcuguccacuuccuguaucucccuuccuagaugcuguccacuugcuguaucucccuuccuagaugcuguccacuugcuguaucucccuuccuagaugcuguccacuugcuguaucugucuuccuagaugcuguccacuuccuguaucuccuuccuagaugcuguccacuuccuguaucucccuuccuagaugcuguccacuugcuguaucucccuuccuagaugcuguccacuugcuguaucugccuuccuagaugcuguccacuugcuguaucucccuuccuagaugcuguccacuugcuguaucucucuuccuagaugcugcccacuuccuguaucuccuuccuagaugcuguccacuuccuggaucucccuuccuagaugcuguccacuugcuguaucugucuuccuagaugcuguccacuugcuguaucucccuuccuagaugcuguccacuugcuguaucucucuuccuagaugcuguccacuuccuguaucuccuuccuagaugcuguccacuuccuguaucucccuuccuagaugcuguccacuuccuguaucuccuuccuagaugcuguccacuuccuguaucucucuuccuagaugcuguccaccaauacaucuuuaaccuuuuguuguucaggcagaaugagguuccucuuuuuugggaaaaagauaaaauguaagcuauauaguacaucugugacuguauccuggaauauuucuuguuuucucgcuuccauauuauauugcagaaagcagaaucugauggaguaugaaaaaauauuggacuaugauagaagcaaccugauuuucaucucaauuugaccucuagguuaccuggccaggacauuugcuguaaauucagugaucucuguaguuccucauuuuauccccucccaccuaacagugauagucauauaauaauuuugaaagaauuaacugucuuuauucuuuauuuuuuuaaccaaaucaucaguauaugccauccacagaagucucucugaaauaguagcuaacaacuacuagguguguacuaaguacugggugauauuuuucaguaacacacacacacacacacacacacacacacacacacaguuuuguaauaguccugugaaguggguucugagguuaaaugacucaccaaagauacauagcuggaaauuggaaauccaggauuugaacucacgccccuguagccccugaacgugccgucuuuuuuguuguaugucccucucuuugucuuaaaguggaaagcaagagcuucauucuucuaguaaauauaacucccaaagugaaacaauuuauucugagcaucauccucuacacugugaaaaguacaaaacauaaguccuuuuuuuuuccuugacaaugcuaaaauaguaaugauuuuggaaaaugggaaagaacaacucuuuucuacugaaaacugugggggaaaugauucaagcagcuacacuuggucauuuucagacauuuaauauucucugucauaucuuugaauucucuaaucuaguaacaagacacauuugauuaaucugcgagagcuagcuauauuaucucaucucuguuuucuaauugcucguuuugaaggaccacaguuaugcacagacagacauuccaacacagcucucccucggugccuucagcauaucaucucuugagacucuucucacugauuagcaagagcuugguuuuuaaguagaugcuucuuuaauucccagcacuugugucucuuagcuguucucauucaccguggauacugaaaccagggcaguuacacugugaguuggaacaaaaaccugccuguguccuaaauggagaggcacaccugauugggaaguuuagagaauggauugguagagaaguucggugguauacuuuauugaugcuuaaaaaucguacagucuaacaagugaucucacucuuucuaaauugcauccuauauccugauuugaaaaagggaaauggaaaauucuucacagaauuaaaauuuagauaagaaaaucuagaguuaagguugcuauuuuugcuauuuacuguugugaggugguauuacccuggcaccauggaaagugcgaagugaaagccuucuccucccagccacuccuaauuuuugaaagggauuuauuguaacaauuugguaugugucccagaauacuuuccauguguauccacacaauauuugcacaugcagaguuauauuaguuauacccaucuacaauuugcuggaaacauuuucuuaacaaugacacaggccaucuuucuacgcugauagauacagcccuaucuuuuuaaaauguccauauacauaauguagcauaauaauaauugcuaacauuuauugagcucguauaugucaaguguuuuacuaaacucuuuauauacagacgaggaaaccaagauuuacagagguuauguaaguugccucaggucgcacuguuagugugugucaaagucaggauuuaaagcaaggcugcguggcuccagaacccacguucuuacccccucgcugugcacuguaguucucauacucaaucuccuauugauagacauuggcccucauuuuccaccauaacaaacauuucuguaaugaacaucuucguauagagaugcuugagagagcauuuuucucugauaugugcauuuuaauguuugagaaccaaccugguuuuugaaaacaauuuuugcccauauugacuugugcaaagaggugauggccucucuguagagggacugaugucuuaaguacagcaaugcauuugcuucauaaugaucaugaauuugcguucucucgucauuugauuuagacuuucauuuguuuaacgaaggaccacagucuguggcuguguucagcagugcucacucuuaguugcuguggauguucauguuuccagcgaucagugucccucuuaaccuaggagaggaaacgcugauuaugucacaguuugaagugcugugccccuaccagucaaaccuuccaagaggucacagacagaaugucgaagcaacacagaacccacgaagugagcugcugauauccuaugcucaauaucacauugaaaugcacaguuucauuuuuccaucuuuccauuuuccauuugaauggguuuugauuugcugaaaaaugaauaaaaauauacaaacaaaaaacuugcuauguaaaauuuuugccuguauugcugagaaagcaauagaauugaauugagauagcuuuucaucaauggagugauaauuaaucaggguguagggaggcugaucaauaauauaaugaugaauaaguaaauguucugccuuccaagaagcauuuccuggaccucuuucuuuccacaaaucugcaugaccaaucuuuaugcuagacuggguggcuaguuggccaggcagguauuuuugugguuguacgaacucaagucuguggacguuaguccuucucugaggccacuuccucaccucccauuacuuaacuacagacaauucugugucaggggcucuguggcgcagugugggugaucaggaaucagaauauaccaucuguaccacaggaagauuaacucuaagucuuucuucaggcuagagcuauauuuuguacucaaacaaaaagacauaguagaauucuguacccaugucagaaggcuucaaagcuccucugucuuccuugaacuuugcuguuuggugacagcaagggcaguagaaguggaacuccugaccuucacccgaggugaagaaaggaacuucuaucagagacugagagauacacuucauacuuuccuucucucuguuaaauuggugacugccuugugauugucacauguuucugguauuggcguugagaaucauucaccguuaccuuuacaaagcaaugauauucucuuuaguuuuuauguuuacaaucaaauuugcuguuuacuuagacaaaccuauacacguuuguucugggagcuguaugaacagguacaugcucaugcagguaggccuuaagaagagggagauguagguuugaugcuauaaugaaugaugaguuucagauucagucacguuaaaaguugagagggugggaaucagagagccagaaaagugguuaagaccaugaguuuacagucaggcuuucugacuucaauucugcuucuaaccuagaaaaaccuauucacacuccugggcuucaguuuucuuaucuauaaaaugcgacugauuauuaugaugaguaucuacuuuguagcuuaucauagaaugaugugaguuuacaccgauagagcauuuagaauacuaucugacauauagcgcucaguucaauaaguguuagcuacuguuauuauuguuaugauuucaucauaauuauuauuuugcuauucuaacagccuccuuucuuguaaugagucaggaccaaaacuaaagcauuugaaauggagagguuaaaguuucgaauaccaaguuagguuuaguguuuguuggaaaggaaacagaauuuacagacuuuguaggcuuuugaaaccuaagaagccaagaagaauucucuucauuauguaauuucccauagcucauuaggaaaucaagaccacaagaagccuccccaauguguuuaguaauuucucguugaaaaucacaggucuugagaacacuguuuuauuuaugguacuuuuuaaaagguauugugcugaagaaaaggaaaucaguauagauuuugcuugccuguuagccucuagauaagucuuauugcagucagcagucugcuguguucuugugcaaugguggcagaaauagaugucaaauccgucaguaggacaggauuacguucagacggaccccauaagacacugcuuugauuggguagaggaggcugugaaaucccuugguucugagaauugaauacuugugaagaugauaguaaacucuucuggcaggcaaguaacaagucuauaaccaagaagauauauauuguguuugugaagagaaaaaucuccuuucuuucuaauauaucuuacauaucuuguuaaauugcuucaugccaugcugcuauauauguauuuucuuucaaaggccugaguuccaagaaagcaacaauuuuauuuguaauacuguucuuuauuuuuaaaacuauguauuuuauauauguacauuuauauauauguauguauauauuuacauuuaguaccuugguacuggccuuauaggauuugaaaaaauuaaauuaauaauuacauuuuucuuucauuggcauuuaagauagcacagauggaccuagguaaucuagauaugaauucuugaccacaugacaaacacagauuuaaaacuuuaugaauuaggugagucccuuuaugucaagaacacagcuacgaucaucuuuuguggaaauaacaaagauaggguuuuuuugguuggucuuuuugacaaugcuuuuggauucuauaagguucuaugaccaguauuuguaacucagaccuaggauuuagaaaaagucauugccuacaugaaaaauauuccucuuuuagccuuucuuuucuaaugucuuguuuuggaagaaaucaaaagaauagcuguaaagcguuugagagacuccagagcagcguuugacacuagugacauuuugggcuggauaaccuuuggucgugggggcugucuugugcauuguaggguguguagcaguauccuaggccuuugccacuagaugcuaaucauacuuuccuacccagucuucagacucagaaaugucuccaaacauugccagacuuccagggggaggagcaaaaucagcccugauugagaaucacuggaguggagaguaauggagaaguucagaaaugcaaaaagcucagagaaaaauggggcucagaggaaauagaaaaguagcaagggguucaggcuuucuaaaucaacaaaauacaauuuucuauuaaaaaaaauaagucaagaaccaaauaagauaucaagaaauuaucugcaacauuuaagccaaagcauugauaccuuuaacacacauacagcguaaacuaaucaagaagaaaucugcugggcaugguggcucaugccuguaaucucagugcuuugggaggccaaggcaggaggauugcuugagcacaggaguuugagaccagucugggaaaaauagcaaaauccaucucuacaggaaaaaaaaaaaaaagccagcaugguggugcacaccugugguccuagcuacuugggaggcuguggcaggaagauugcaugagccccggaauuugaagcugcagugagcugugauuuuugccacuguacuccagccuaaaugacagagcaagaccccaucuguaaacaaagaaaaaaaguuuaaaaucaaugagguguguauagguaaauagacaaagcacgugaagcacaauuuuuacagaaauaugauggcaaacauuuaaaauauucagacucaucuaugaaauugauaaugucuuguucuuacuguuucucuaaagcucaguucaaaagucaugagaugaggcagagcaaguugagugccuugacuguggagcgugggguccugggagagagggaagccacuuuggcucaaagcugagugucugaacucaggggagugagagcauucacguggaaaccuggcagccgggcaggagagggcaacagagacacggcugguuguuuuggaaagggaaggaacuggaauaaaacucuguucauuagagagacuggugugaacucuugguauuccacagagagaaagagcuguguagaaauaaacauagaugcagaucuuugugucuguguguuccacauacguauauuucccggcuguguccacugagaggaccugggaacuguaacaccuagugcacaccuagucugggacuuuggcuucuaaauacuguucgcuacuuaaaggugcucuuuggaagaauggcugauuccagggcugggacagagaaguagaagaugagccugggaugucuucuuguuucauaaaguaaggaaauguccaaagaugaggauauagcagaaggacauaggagucagcuugaagaggcuccugcuagccaaaucuguggcaauuucagcaucaaaauaacgguaguaauagguuauaacucacugaauaaaauaggaauuugugaguucagugcuuaaaguccuaaguuugcugaggaaugucauauaugcauucucucagaguaacucuccccacucccaaauucuuaggaauucaaagagaaaaugagaaacuucacaguggagaagucugacagauaacacuuuaaccuagugaucaaaauuaauaacaucaguaauaagacugauugaaguuauguaccacgugauaggauaugagaacucagcaucaugacugugaugcuccugccaaagaugcagaaccucaaucuauucgugaagaaacaucaagcaaccccaaacugagacgcauuauacaacaaaauaacuggccucuagucuucaaaagugucaagcucaugaaagucaagcaaacagaagccuugauucugaacuggaaccuuuugcugugaaaaggaucaugguggaaugauuggugaaccuaggauuggaugguaguaauguaucaauguuaacuuccugguuuucauagguguaggacaaugucauugugcauaagaaauacacaauuuggaggugaugggccauuguguuggcaacuaacuuucaaauagcuaagaaaaaauaaguuauacuauucuauucuugcacuguucucuaaguuuaagauucuuucaaaauaaaaaaaaagaauaaaaauuaaugguggcagugcugauggccucauaccuugcugauacuuuuggcaacaguauguaucagaagcccuaaaaauguucauguucugacauuuguuauucuguccucagggaacaaaaaacuuuggaaagacacuuguauuaugguauuaagcagaacaguuucauugauaacuguaaaugcaguggguuuuuaacuagguacaaaaaaaaaaucauagaaaaagauuggaagccccuucucccaucauucuuagcauuagaccgacaaggcaggaugcuucugaauggccacacauuggcugaacuguuuuuccauuauuucuuuccaaugucuauuuuauucucgguaacauaauuccagcuuccuuguuuucuuuuucuuugaccuuaguuagcucgcugugcucccucauucugcccucaucucagccccuccuggccccucuuccacagugcuucugccugccuuuguccuacugagagcaagauuucuuguguuugcuguguugaaagauuuuucacagguaaugcuguuguucuguuucuuuuucuuuuuuuuucuucuuuuuugagacugaauuuugcuauugucacccaggcuggagagcaguggcaugaucucggcucacugcaaccuccaccuccuggguucaagcaauucuccugccucagccucccgaguagcugggauuacaggcacaugccaccacgccuggcuaauuuuuguauuuuuaguagagacuggguuucaccacguugaccaagcugguccugaacuccugaccucaggugauccaccugccucggccucccaaaauguugggauuacaggcaugagccaccgcgcccagccaguucuguuucuuuagcaugauguuuccuuucccuuuuacuauucuauuuuuuuuuuuuuuuuaagugaugggguuucacuguguggcccaggcuggccuugaacuccugggcucaagcaauccucccaccuccgccucccaaguagcugggacuacaggcgugagccagagugccuggcugauacuuauuuuuuuauagaccucaugucaaugcuuuucuguccgccacugacgggaucagccuagccaugaccagcucagcacuccagcauuccaguuagcaagaaugacugcuuaggccucgaucucacauuucaaaaugcucucuacuuccuuagaacauuagaaauaaaauuauuauaugauccagcaguucucuuucuagguauacaccccccaaaauuggaauccagcagguacucgaacagauauuuguacacauuuggugagagcaacccacgugucuaucaacagauguauggaucuacaaaaugugugccacauauaaaauggaauucagccuuagaaaggaaacuuugacacaugcuauaacaugggugaaccuugaagacaugcuaagugaaauaagguaguuacaaaagggcaaauauugcaugauuucaccucugugaggcaccucauguuugaaauucauagagacggaauggcggguaccaggaucugaggggagagggucgggaauggagcguuauuguuaaugggcacagaguuucagguuuagaagaugaagaaaguucuggagauggauggucgugaugguugugcaacaauauaaauguacuuuguagccccugaagugaauacuuaaaauguuaaauuuuacauuauauauauuuaaccucaguuaaacauuuuuuaaaaugccauacaguuguuagaugguagaacauucagugauuaaugcugaacuuaaaggaaacuuuccugagauuguuggauaggggaacuucuguuaucuuuagcuuauaggacuguggcuaguggaguggccaagggaaaauguccccuuuuuccucugaaguuuugcugaaaaucagcugcuaaaggcauaaaaaagcauacacguuuguuaaugugcaugagggagagucacagugaugaccuaccacgcccugggggacagauguauacacccuucuucuuaggggaaagggagauggggaaguguggaugauuuuaacgggguaggaacugauuuuuagggaauucagugggcuugaagaacauaccauggccugggaccaucuguugggcccgcaaagcagauaggagucuguucagguguguugacagauuucagucuuuguuccugggauaggaguucaguuacugaagacgcagggaaagagccagaggugauuguuuucuucuuuggcaggucugggaguuugggcagauaagggaacuccaaugaacaaguucaucgucugcuugggagagagagaagauugagagacaguggguaaaguggaaggccagagagaccuggaggcuucuucaguucaggaugucaaagcgcuguauuuuaggguauugguuuaugagccccaacacuggauucuguaccuuccuggguauuuuaauaggaaauuaaaagaaguuaucuacaaguccaaaagucuaaaaguagcucuuaucagacaccuacuaugaauaaauaauccuuuaaaaauauccaccauagcuuuacaaaagaucuguuauggugucauuuaccguauuuuggagaacuggagacauuaauaaugcggcugugauuaaccacgcuacuaaguccuagagucagggauaagcccgugacucuucguucaaaguucauaguucaugcuguuucaugaaaccccacuuccuacagaaagcaugaaugcaacauuaucugaccaccaggaaaucauauaggccgcacuugacaauguguugcuuaggacagauacucacuuuuuuauuuguuuguuuguuugagacagucuuguucuucacccagccuggagugcaaugccgcaaucucggcucacugcaaucuccaccuccugggcucaagcaauucuccugccuuagccuucugaguaguugggauuacaggcugcaccaccaugcccggcuaacuuuuguauuuuuaguagagacgggguuucgccauguuggccaggcuggucucgaacacccgaccucaugauccgcccaccauggccucucaaaguguugggauuacaggcgugagccaccacgccuggccgacagauacuugcuuuuaaugcaaaauugcugaugaaagccaaauuccuccaaugccucugaacucuaggugauguauuuuaauuuuuuccucuguauucucuuuuuucuauuuauaaaacaauaagauacuguguaccguauaccagaaagcuucuugaggguacuuguccaacccucucaucucagaaagcaggaauguggauguuugaugcuaugugacagggacaguacaaaaaacacacaucaucucuuucuagugcugcuuauuauuuucuguguaauucuccguauaugugcucauugacuuuuauacauuuuugaguacuucuccagcuacacaugccagacugucuaauaccuggcgugucccuuuaggcuggugauuuacccaucagucaguuugaucucaucccugcugcauugacgagauuuucauuguuaaauugcuuuaaaaaaacaccacagauucaaaauuaaauaaauguaacauaucaaaccaauaacuguuacauuauaggcuagaaaccacagaguaccugcugcuacauuauaaaauuauguggccaggugcaguggcucaugccuguagccccagcacuuugggaggccaaggcagguggaucacuugagguugggaguucgagaccagccuggacaacauggugaagccccaucccuacuaaaaauacaaaaauuagcuggacaugguggcacgugccuguaaucccagcuacucgggaggcuggggcacuagaaucucuugaacccaggagguggagguugcagugagccaagaucgcaguacuuuacucuagcuggugugaaagagugagacuccaucucaaaaauaauaauaaaauaaaauaaugcaugugaacaaaaaacugagcuauagauauugaaugaggaauucuugacauggcacuuuucuccuauuuaaagcucacacaaaaacccuaggaaacguggucuugucuucucggcacaugugagaaugguccugacuucuguguuuuccuugugggaauguaagaccuguuucuguugauuccuuucaaauauggagcaugcucuuuuguagcagaagagugaaaacagcgccuaccagaaaugucaguacaguagagugcuuuucuugaugugaauuaagauuucucagaacuucgcuuucucagucauuugcccaaagugugccccaggaccuuguaguguauccuuucucuuguauguguggcaggaaugggugggugacagacauguauaugauaauugaggaucagaacauaugugauggagucgauuuuccuucugccuuuucccugcuuugcuguuuccucaagggaaaugaugccugugcauagacuauuguguggggaggggcguggguauggggagaguagcacuuggugaaacugcauuuacacaaaucucaauguuuuccugcaugcauuugcauuuacuacauaggaacauaugcacacgcugucgauagaggcgguuacaaaacuguuaaugccuccuggaaggugaaaucacaaacugcaaagguuucuugccagggaaaauguagaaaugacacugccaccuguuguuuaaaccagagaauugcuacaaguucuguugcacccaugaagggggcaaaugcugggaguagauuucuccucucuccucacguggaaacucuacuuauuuauugauaaccgguacauuugcuauaaaauagucuaucaaauguggguuuucacagugugaaauaagaggaaaauaauuuauugaaaacaugcuugggucuuuauugucauggugugugguuuucaacgcuuuauguaauggagccuaaggcuuucuauuuuguguaguuuuucccucaagaagacaacaaaggaauuucucuuccuuaugcuaaugguggaugaaaagguaggaaaguacuuggggcuagugucguuggcuuauguucagucaucgagcaagcaguugguagccaguaucaguggauaaugauauugacagccaguaccagcaagcaauugguagcugguaucaguggacaaugauauugacagccaguaccagcaagcaauugguagcugguaucaguggauaaugauacugacggccaguaucaguuucauuugggugucugaugaaaaacuuaguucuucugcagugaggaaaggguagcuauugaggguacuaagagcugguguucaguuuguguaguggagcaagcguaaacuuagcaagauaaggaguuugugugugaucaugcagauuucagugaguuaucaauccacuuuaaugcuagagccagugccccuccacccauauuaauuaguuaugccauucuccuaugugaauuaccauggcauaaguuagugguuuuaacagaguuaaugaacucuguugagauagcugggucagaaggcagcuaacuaagagggagcuugcacuggggccuuuguaaguaggaauucccacucacagcaucgacaguggucuaggugauuuuuaaauucuccuccuuuuuauguccuuuuucuaaauuuuacaggcacauaggccaaaccuguaguguucacuuucugaccaugaaaaaccguuaugaauaauguucacuuucugaccaugcuaaaccauuaugaguaaacuuuaagucaucuuauugaggauugacaccagcugaugauuccuauauugguauuuaaaauuccagaaagucaaagcucaggcagaauaguaaaagaaaaugaaauaauaugaagucccagagaggaggaaggugguguuugaggaguguuuuucaaccuuuggcaauuucuucagcucuuagggccuugauuuccccaucuaugaaauggggaauucagaucacaaaaguuuugagguuccuucugccuaucauuuuguugauguauuugaaacuuaucuugcuaauacaccauuagaucucuaaauuuguaauacgauuuaaaauguagauuucuagucccaauguggugcuagacuucgcucuuccugggccgcauauggggacaagaugacgucuucagccgucuucaaacccugugacucuggaagcauguuauauguccuuccuauguaagaaaguauccaaguuuuccuaggagacugucaaacuaggauaagcacaccuuuccuuggggaaacaccaucuuuccuuaaccuucuuuagcuuaauguuuuugauauucagcacauacuaucuaaauagaugacgcagauauccauagacaccaugccauaguuaauaucuaaugccuucuaacagcuacauauggaacaauuauuuuagcccucuaaaccuuaagauuggaugaguuugccuuuuaauccaagaaauauuuugggaugagaagucaacuuuuccccauuuuuccuugucuuuccuauuuggacuuucuccgucacacuguucguuuaaugaauaagcaaagauaacucagcugcuugccaaaaaugcacucagauuucuccugcaaacacucauuuuuaaguaaaccaaaguaguaggaaaugaagaaaacagagagggaguuuauuaaauuauguuuaggcuuucuuccuggcaucauugggcucuggauacauguugaucaauucuuauccaugaguacaucacgcuagaguuuuaggucuuucucugcauggagaagcuucaucucuggugugaggucugguagugaacugaugaaggagaggagaaaacaagagcagggggucacuuuuuaaaagucaauuuuuauccugcugugauugaauuguugccccaauagacagagcauacgauucuguauuguuucucaacagagaacuagaagaaguaaagaaacuucuuaugacauucacaaacacaauuucuacuguuauguuuuaaaauauugggguuuuuguuguuuuuuuguuuuuguuuuguuuguuuguuuuuugagauggagucuugcucuguugcacaggcuggagugcaguggcgcauucccagcucacugugaccucugcccccuggguucaagcgauucuccugccucagccucccuauuagcugggcaugguagcacucaccugugauccuagcuacucagaaggcugaggcaggagaauugcuugaucucacgacacgaagcggagguugcagugagccgagaucacgccacugcacuucagccugggcaacagagcaagacuccaucucaaaaaaaaaaaaaaaaaaaaaagaucuuacaugagacaacgucauauuccaauagcuucuucuacuucauucuaguuacucugccuggggucacaacaauaauuuugaagguauuuuaaugucuuucuccuuuuuuaaauaaggagaauacuaagaccugauuggagagacuugccuuacggcucuggccaucugcaguguuggaaguagaugaucuaacuugaaucuaauauucuuuccacuauaugauauauacacaaaccaguauugccuuuugcguuguuacccuuuuauguacguguguguauguguauacacacauacauguuacaaaguaaucaagucccaguuaaaaauauauauucacaaauauuucugugacuucaaaaaaugugaagacucuuaguuuagacaaaaaugcauuaaaguuaggauuguagacucuuccuagaaacagaagggacacuguagauaagaguaggugguguccucuagcuucaggcuauuuugcaucaaaaacaaccuagacaaaucacguauacuuuguauauguuaguauagcccccaauacaugaauuccaaccuguauugcugacuucgcuccuacagucugcagcauugugagcgccuugaaggaugcuauauuaaaguacuuugagcgugguuucacauuauggcccaacgauacacaccugucgauuuuugcugguuuuaccaccauuauuuuauauaguuaucauuuacugaguguugacuaugggccagucguuucauagcaggcccguuuuucauauuuugcagcuaagaggaggaaaccgaagccaagugacuugcccaaggccacgcugcuagcaagcgguacggcuggcacuugaacuugagucugugacuccagagccgaauucuucauccccggacucuccugucucaccuggggaaggugcugaggugucucagaggauuuaccucacucugcaggccuaaacagaauuaauccugugguuuagugucuuaauagggaugcugagggcaaaggagaggcucuuauuuucaaaacaaaugacuuuggcagcaugaaaaaacgaaaccgagaaaauugccagcaccaagcuuugugugcaaacacuacugcuuuguuccccgguguugagacuccucauuaaacagcucccucccugcguugcucgagaaaggaaaggaaaacuucagagguacggcuacuccccaagcgcuguugcugccagagccucuaguauuuauuuuucaaaauuuuaaaaauagucauggcauucuuacagcucuuaugcccuccaggaucccagccgacuucuaaguacagaaauguuaaugggccgagggaggggaagcccagagggcagaucaccucccagaaacucaggcuaagccaguccucggcugagaggaguucugcuuucagugaggcccaccuuuauuucuuauuuacgucgcauuacaggaugugucaagagcccuuagacauccuaggcaagugguaacugauguuucuccaacaccgcucugugcgucuguggauaaggacacaguuucuccgaggccuuucagaauacaaugcacagguuguguuucuucauuaccauugagguuuggaaccucuggcuauuucagccuuccauucuugcccuguuuacagguaaggaaaggcugagagaaaugaagggacuucauuuuugucacaucgcuugugauaccauuaggaccuccuccagauggcugucuucguaggacaguagucuuucuuuggcaucacuuuguugaagccccuaugguagggacuaugacuuaaacacuuuuccuuugguguaaaaaucacagccuucuuauccauggggaauggauuguuaacugauuacugucauuuuuaaauauuucaguuuaguucuuuucuaaugcauuuaauccuguuucccacgucugaguacaaauugccccacaguauauuuuuugucaugcccuacugccuuuuuuuuuuuggucagggucuggcucuguuucccaggcuggagugcaguggugugaucacggcuuacugcagccucaaccucccaggcucaugugauccucccaccucagccuccugaguaguugggacuacaggcauauggcaccaugccuggcaaauuuuuuuuuuuuucuauuuuugguagaaugggguuucgccguguugcccaggcuggucucaaacuccuggacccaagugauccacccacauagaccucccgaaauacugggauuacagaugugagccaccaugcccggccuccuucugccuuuucuuuaguccuuucaucuccuuuuauuccccuaacucuuccaucucucccccuacaugaaacccaaagugccaggugaaugaaucucauuuauuaaggugagaucagagaguugucucugcaaguagaucauugaccagggagcugacuccagacucccuuucacgaggcacccaaaucuuucccuucugggaagagaaagcaccucaucccauccuucauggcaucaguuuuccucuugaauagaaaccucccacaaggccaaagacaaacgcacaugcuucagagucuugcuuucuacggauugggaaggauaaguuacgguccugugggauggguagcagagugcugccugauaaucccuagagaaggaugucaggccccagucguggccgcuucuccagcagccucuuuagaauguggggaguugaucacuuucuguccucagcuucgggccuuagccucaguucuggcccaggagaggaagccccucucagcagcaccucagaacagaaccguguaacaggaaggaagggaggagugagcaggauugagcaguccagcuccugcccaugccuuuucucgagcucuggcugugucugcucuuagauuucauagugcuaauugguuuucauguuuuagaggcuccaggcuccuugaucuuguuuguuauggagucuucaauagccccgcgauuauguguucaugauuacguuaagcacaguuaauauagcuguggggucugcguggagggcuccuuccgagacagcucaccucccuguggugugugucccucuguucucagugggcugaaagacagggcaguuuuguuaggcgagacaggucaguauuuggcacuugaugucuuuuaaauugucucuauucacacaucaggaaggcugcagcugauuuccauuuauuuuuuaguuuuuuaaaaaaucuucugagaauaagucagaauuauacaggggcugcauaucacuuuccagcuuucccccuaacuuuguaaguauguggggaaagacagaugugcaguaagggcuucucacauuaucacccaggaguuccgucugggaaacagggagcacgucccaguuccccuuugguaggaagaggaaccuacguggguccagccuggauaucccuggacuguuccucaccacccgugucuccccugucccgccccccgccgccccuccagcaccccagccccuccaacaucccagucccuccaacucgcucaucaguuuuaagguagaauagcaaggcgggcucuuccuacaaaguagauuuuuacuuuaacaacuuuaaaauccacuuuggggcuuugggggaccaugacauauagguuagauuucuuuuagcagucaggacgugguugugcuuucaacacaaacaucaaaucaccgucuuuaauuuuuaaaaccaauccuaaaacaguguaguagaauugcuucccaaaugucaagaucccgccuuuucuccccuuucaauaucuagcugucuucggaguauauaaaacccauucacagagcuugggaacaauuagguucucaaacuccacaucucauauggaggccaauugaagaugaacaucuuuaaaugucaagagguguguguucuggccuguaaccacggcuccauaugugugcugguucugacaggggcccuaaauucagugacgacgucugguaaugauugagagugacugcugacuggagguuugaaggaccuggcuucccccacuuuuucuuucuuuaucccuuuugcaguuuucauaggauucucuguuugugagaggauucugcaguaagcagguacuuguguuuugcuuuuauaacaucacuguaagcgugccccuuuacaugcuuaaacuaugcccauaugacucucugcagaaaacuggaccuguuuccuaggcccugcuguauuccagcugagaggaggcauaggacauaccaagggaguuuugauuugcuuauccucacauccucuaauuuaauggguagcccuuuauagagacaggugacuauccgcauuuuagaugagcaaaccaauguucagggaaguugcccaaggucagagagcuaguuaauugagaaaccaggauugaaaaucaaauccaguuccaaguacagcguuggcuccaccauaugugauggucuuccagcuguaagcguuugcuuugcuacugugagaaacauuuauacuugucugcugagucauagggcaaugggaauauuuuuggcuugcucuaucuggcuaauuaagcaauggcaguaagauaggcagagcccacauuuuugagguuuuucuuuguaaccaacauucuucauguaauguuucccccuuaaaauguuaaaauuaggccagucccaguggcucaugcauauaauaccagcacuuugggaggccaagaugggcagauggccugagcgcaggaguuugagaccagcaugggcaacauggagaaacuccaucucuagaaaaaaauacaaaaaaauuagccaggcaugguggugcacgccuguagucccagcuacucgggaggccgaggugggaggaucagcugaguccaaggagguugaggcugcagcgagucaugauugcaccacugcucuccaaccugggugacagagugagacgcugucucaaaaaaaaaauuauuaucccuuauucuuuuauuucuuauagugucuguagcauauaggccuccccagggaacagugcuguccauuuucuggguugcccugccucaacacaacucuccagaccacccucugucuggccucaacccuacguaacccuuugugugcacauacauucccugggcucccaaggauagagccucuugcaugaggaagcuggaugaaagccuggaaagguuauuuuguuuaaauucuuaccuugaaguuccuuuggugagggagccagccuggaaaucauuccagaacagucguguuucauaguuacaguguaaucgggaggcugucauucauggccauuaaauugcuuccuuugaaguauaagaaaaaccaggacaacuuuuauggcccuuuaacccacaggauuguaguacacaugaaugaaagucaaguguguuguggacucuugcagguacuguggcuggcagaauuccaucuucacccuggugcucauucauugguugacuuucaagugaaaacuggggugagcgguaucagaaucuuggaaggcuuuucuucucucucuuuuuugcauuuuuauaaaacaaaucagaaaugaggagucuuauuuuguagcuugacuaaaaaugagaauuauuauuucucugguagaucucuuuggggcugggcagcaccuucuagauguuagcacugugcuggccauuuugcguaccgauuuccauuuaauccucacagcaauccuaugaagucgguaggcucauucccauuuuacagauaggagacaggcuugagaaggccccuuaguaaguggcggugcccgaauuccaaucgaggucugagccaaagcaugugguuuugcucccaugcccuguggcuucccagaacucauaccugagcuuauauaacagaggaacauugguggagccccaagucgugggucccaguaucucuaggauaaucacuuguguaauaaaucacuuagauuuacacgacuguauuauauuuuguucuuaagagaaucacaugggaaaacuguggagaaagaaaggcaacaaaguaaauauuaguguuuaaugacuagaugugugagauauuuauauuacauauuauaauaaauuuaaugcuucaugacauugaucuguauguaauuuaaagagaugcucaaaauucagaucauuggaauaauaagcaagguaguuuuacauugcugaaaaagguacaucuaaaggcaauguauuucuuauugaaaauuuuguugauagcugagccguucaaaauggggugggaagagauaaaaaggaauggggagggaaucuuucaguauguggauuguaaaguuacucuacaauuguucugagaggagauaauccauaggacguaacaaugugugaacuucagcuguccauauuccucaauaauauauccugucaccuguauuuauugccuggaauuguugcaagacggaauuaguccuaaaagaguuugauuaggucaugauaagucccaccgcuccaccagauggcgcugugguagcauagcuacaccugaugccccugccagagguuugagaagcagaugacaaccuucuguggggauccuccaaagccuaaugaccugugaauuggagccccacagaacaauagaguuuuuccccuuucugguucuggguucgguucuucugugugccuacacaucuucacuuggcauuucuucgccccuuuaccgucuuucccuccgccucuuccaucauaucucuucccugcucaccaauccuccuaccuacaaccuuucucuucucugccuuauccuucagacuucuuuucucuuuggugaguguagaacgcacuuacaucgugcggugguaaacugagauguuuccgugugagccaugcagugaggccgaagaauggguugggaacuacuguaagaggagguggccgggcgcggaggcucaggccugugaucccagcacuuugggagagggagguggaaggaucacuggagcccaggaggucgaggcugcggugagcgaugauugcaccacugcacucuaggcugggugacagagcaggaccccgucucuaaagaaauaauaaugggccgggcgugguggcgggcgccugucaucccagcacuuugggaggcugaggcggucggaucacgaggucaggagaucgagaccauccuggcuaacauggugaaaccccgucucuacuaaaaauacaaaaaauuagccgggcgugguggcgggcgccuguaaucccagcacuuugggaggccgaggcggucggaucacgaggucaggagaucgagaccauccuggcuaacauggugaaaccccgucucuacuaaaaauacaaaaaauuagccgggcgugguggcgggcgccuguaaucccagcacuuugggaggccgaggcggguggaucacgaggucaggagaucgagaccauccuggcuaacacggugaaaccccgucucuacuaaaaauacaaaaaauuagccgggcgugguggcgggagccugcagucccagcuacucgggaggcugaggcaggagaauggcgugaacccgggaggcggagcuugcagugagccgagaucgcgccacagcacuccagccugggugacggagcgagacuccauuuaaaaaaauaauaaaauaaaaaggagguggucaucuugcccgucagaccggagucuccucacaacuggcaugcgcuucucaguggacuuaugacuuguuccugcagugaauuuggcaaugucucaaaaaugauggguuugguucuaguaaacagaaucguaaggaagauagggacucugcaauuacagugguggauguggaaaguauacaaaguaucugugaucucuuggggaucgcccagaaccagagcuggaaaccagagcuggaagacuggcggccggagaaucugucaaaaucucuuguucugaacaaaggaaagagauccagaggaucccaggucucuuucuggccaguuuaaugcucuucucugaguagcugccagcucccaaaaggcagagcauugauauucaaagaaaggaaccaucugugaauguuauuuacuguagggucugcaauucugaaaauuaucagccagggcaaugaccccuguuugacuaucauuuguaguucaaaaagaggaucauggaaaacauuuaaacuauuuucugucuuccccauaaaauguuagucauuuauguauaggauuauuauuguuuccgucuucaaaccacagcucgcagagccagcgaccacaugaugagaaacagccaugcuucuuagauuuuggcaaggguggcuaauguaaaaacggcccaucuccaaaacaugauggaugccacauaccccaugguuuccaggaugaagccagacacugucucuuccauaguaccuggagcaaggagaaacuuucaaaaacaucugcacccuauaagguugaagauggguuggcaagaggaggacgugcuugugggaaucauacuuguagguaggcagacguguuuggacuugccuggcauauuuuucuccuuggagcaauucaucuucucuugacauaaaacuuucucacuagucagaagcaacacuuuccgagaugucauuuaauucacacuaacaaauuacaaggaacuucaggugaauaggugggaaggcagcguuuggagcuagcccgauaggauccuaaauaugguucugucuguuggccuuagaguaucauuugcaucagucucguuucccuccucgucgggggcgcaggacagcggccucauuucguaagacuugagugaagugguguaaaugggcugauaauuggugggcuucuucuuaccaucacagaacuuuagaaauuaaggaaaaccuuacucggacaaaauaaagcagucucuaaguuagcuagacuuucgaucuauguggaauguagaaaugugaucuucuguuuccaaacacuccauaugucauaagucaagauguggcuuuagcaaauacucacugauagauauguucuguuagauacguucucugucuuccagcaucuuacaguuuacuugacaaggugaacucagcgaaucaccagugaugaguguaaggcuuguaggccuuguauuuuagucucuguuaucuugauuagugagcgcccuggaaaugaaacuccuuaauaacuguuuuggccaugaugcaaaauaaaaggucaucauugaacuguguguauggugguguccaggggagggggaaacagagagaaguccugugugguccaaaggggcuuuuuagagucuggagaagguuugugucauuuuugguuuaggggcaugguugaugcuaugggacauucuagagagaaauggaagguggacgcccccugcagaccacagcccuuucuaccccagugggagagaagggaaggaaguaauauccuaucuccaucuucacauucuguuuuuuuuucuuccauguuccuuuuuucuccugucuccuuuuccuuucuccuuucuguugucucuucccaccccuucugggaagaacagaaaaaaaccgacacuuaucggugcccugccaugugucaucaucuugccagcuuaaggguaagaaagaggguggggcacaaggagccgaguagcuguguagauuugucuacagccuggcagucacaaugccuccauugaaaacccaagccgcaugauuuauauaucuuaucaucaucacgaauuuuuauucugagaaacuaggcaagagaaaacaucuucagucaaccauuacugaguguaaacuaggagucaagaacagucauagccuaucucauuuagcuuucuuaacccugugaaguagguauauuauuccaauuuuauaaaagaggaacuaggauucaaaacguugagugaacuagccagcauguucccuggugccuagcagguacucauuacauacucgcuaaaugaagaaguaagcaaaguaagucauugagccaggauuuuaaagcagauuuuauaaccucgaguuccgugcucuuucugcuuuauuguuuguuuucugggagagacuugggugagccuaaaagaucaguaguauccuguacuauuuauggaacaauuaauauuugacuuuugaaauaagaaugcaguauguugguuucauuagucuuuaucucucuuucucucucucuugcuuuagguaguauauaauuguuuauacaucccuauccuuaaauccuuuuucuuucuuucuuuuuuucuuuuuuugacucacucuuaggucuuuuauacuggcaaccagcuuaguuguuuaaaaacauagauuccaggucaagaguuucuggguuuaaaucuagguuuugccaugucuugcucugugaucuugggcaagauacuuaaccuugcugguuuucagaauuauuaacuuuaaaaugaggauaauaauaaaaaccuacaucaagggguucccaugaagguuauacaaguuguuauauggauagcacccagaacaauuccuggcacagaguaaauacuaucuacaugcaguuaauauggcagcauugcuaauguuauuauucugugugcuuuuugcaaucuuccccuuuuauuucuuaagcucuuauuuuuuuuuuauuuccaccuuguuuucuucuuuauaguuugguuucauguuugguuguuuuuguggguuuuuuuuggugguaaaauauaucuaacauaaaguuugugauuugaaugaucucugaguguauaauucagugauauuaauuacauccacagucuugugcaccauaucuauuucuaaguuuuuccuuaccucagagaaauuccuaccccgugaagcgacaaucauccacuccccuuucaccucaacccuggacaccaccaaucuguuuugcgucucugugaguuugacuacucucagaaccucucguaaguggaaucacacaguauuuguccuuuugugucuggcuucuuccacuuaacauaaucucuucaagguuugucugugccguagcauuauuagaauuccuuuccuuuuuacggcaaaauauuauuuucugucuacaccacauuuuuucuguucaucugaugacggacccuugggauguuuccacuuuuuggaaauugaauaauguucgaugaacauuggugggcaaguaucuguugagucgcugcuuucguuugcuuugggcauauaccgagaagcagaauugcuagaucguuugguaguuuaacuuuuucaggagcauccagacugcuuuccacagcagcugcaggaguuugcauccccaccagcaaugcacgaggauuccaguuucucuacauccucaccaauauuuacuuuucauuucuuuuguaauagcccuccuaaugggaugggcaugugguugucacauggaaauauuggcuaguaaauaaaaggaggaaaaauugaaaauugaagaaucaaacggugcuucagacaugagucccuagucaggucacugacuuagaauuauuuauucagcaagaaucaugucucuguaggagcuaucacguuccaaaaccucugggagcucagaaaaugaaguuucauuguacucuuuacccaggguuaaagaucuccauucccuccccaaggguggguaagagaugaguggggugccaccgaagcaggggcugauagcaggaagauacuuccuuaucuuuauuucuuuugaugaagcacugugagccaagccucagaggagccagccugugacuguacauuuuggaaucugucugcucacagguguuggcaggcccugguccugguccagcacagcguuuucccuggaggaaugccaugcuuugaauuuccuugucuacagacuguguuauuguccagccucucagugggaucagaaagagguugguuugucuggcaauugccagaacagugccuauccgugaccucuugucugagcaucugccagagaaagcugugaucucuccagggaaguguagggcuugaagacacacuuagcaauggcugaucuuucucccagcaguucugaucacucccugaccauccucacauccugccuuuguccuucccccuuuguccuaaagugcuguccgcugccgugacugugucuuguuucccugguggugguggaggugcugaggucuggggaaggguugggaaucacgauggugggugcagggcuugcuccucuguguaacugcauagccugcuggccuggagaaaguccuuuccugcacagcacugccucucaccacccuaccccagccagccagcccacaucuugguuuuccucaggggagauaaucccugccacugcugauucacggcuccaaggaagugaaaucaugugaggugaaacugcauugcuagccaaaaaaauaguuuuucuuaauaaugucuaucagaagcauguugaggaggaaggaugucuucugugucucccagcagcaagcgugcugaaauagcagcucaguagaugcucaaugaauuccaguugaaagaaagaugcucguacuucugauuucacaaugaaguugauuuucuggggaucacuccccaguugacauccccccugucugagaguaacacucaguugcuuugacugucuuuuaacaaauugaucuuuuucuccuguuccuuuugcuucucucccuaaagggguuccccauauuuggcaucauuaaauaaauucauuaagugucccgucguguagggccaguguuucauuucguuaauuaaaauccaugcccugaacugaguucggaagcccuaagagccagagcagacugcgaggcaccugcggaaaaacgcagcauaugcgcauacccuagacacagacgucaugguguuccgcaccagcgacgucgccucagugccaauucauaaaucagaacuucucugagaugcaggucauguucuggggccgacuucuucauggaaagcacagaggcaucuugcuaaagaagaggaggagauggaggaaguguaaagcuggggcugguaaauaagucccucucccucccccacguuccccucccauaggcuuugaacuuucuguguuucuguaggugucccuaguuuggauggggacacuggaaagcuagccagcucuuguucuguuguugcacuucauuuguuuugggcuuuuaaauacugggcuuggcuuuauuuguuggaguuacgccucuacuuugcauuucauaggugaaguuagaggcaguauugugucuucugugaguuaacauucaccagauaguuacugaauuuuuacucugugccuaguagucuucuaggcucugggaaugcauuagguaacuugauagaugugguccuggccuaaugaguaugugucuauuuguucaguuuucaagggguuagagcacaguguuuaaaauaacaccuguaucaugaauucuauucuauauaaacccauuagcauugcauggagaaaagguccauucaucacaacacauuauaccccuaaucccagcccacugguuggcaggugugugccauugaucucaagagucuagggaaguuaugagcugcccuggacaauuugucacccaucagccaacagcuuuuuauuuagcauccucuauguggcuagcaacauauagaaaaucguuucagaauuuaugcccugccaaugcucuuuucauuagagcagcacaaucuguggucuuuuuagucagagaagauggcuucucuauauguauuuaugaaauuaaacaagaaacauuucuuccauugggcauucguuguuaacugccaggaggauuuuagguguugggaaguuaaauauuauaauggguauaaaacucaguccccaaacucuaaugugccaaaaauaacauuucauuuuuuuuucuauacaucugcccaauuucuggcugauugucuuuccacuggugugguggaaaacuucaucucccuucucaggguucugggcucauccccaggaccaagcuguuaggggcauggcucucuuggccugcccccugugcaugucuauuggcucucugaugcauccuugccacacauaggacucaggaguugcaugugucucugucuauccaaaucccccuccuggggaaguugugcuucuggguggcagcccugcuuagaacuggggccuaggccccugcuccgucagcccugcaggcugcauuagucucucccccacccccuacugcaucccagauuuugcagaugguuucugcuuucucuacugccacaugccuccccugaggcacugagcagagucugaucugugggagaaaaagaaaggcaaugcaaagagaagagcacaaauugauaucuugaaauaucauccagcccuacaguucauaauuguaucaucuguaaauauuuaccaaacacguuggcauaaauuaccuguuuaauccuuauagcacccucaggcauuuguuacuguucuccauuucucagguguauaaacagacuuaggcuaaauacuugucauauggguggacgucguaaucaacaaaugaauuaaugcggaauucaggguuuggaccuaguuguuucuacucuagucccaugacuuccguguagcacagggcugcuucucagguuguccugaggcuuaugaagccaccugugauauguaacuuuaacaagcaugacaauuuguuuacuggacauuagaaacuucuagguaagugguguuuuauuuauucaugugucuuaaucauuccauuucuucgaagguuagauuuucuuuuucuuuuuuuugagacggagucuugcucugucaccaggcuggagugcaguggcgcaaucucggcucacugcaagcuccaccucccggguagcuuggacuacaggcgcaugccaccacccucagcuaauuuuuauauuuuuaguagagacaggguuucaccauguuggccaggauggucucaaucucuugaccuugugauccacccaccucggccucccaaagugcuggaauuacaggcgugagccacugcgcccagccgaagguuagauuuuaccuguguccuuuuuacagcuuuuuuuuuuuaaguuucuucaucucuuacuuucucagucucacuucauaccaccuaguacugugauccgcacauagauggauaaugagagggaagugagugguaaauuaaacauaugcucuuaacuaaggcauaaaaagucauuuuaugagaaggcccuccccuauuucugaaaugaggcaagcaaaggccucauggaaguagaacuuuccuccuaaaugugggagaugaccagaguggugaggaaaaugcuuggaguccccagcuccuugaugucccgggagaaaaugcuuauuucagagggugagggcauccaaagugcugaccucuagagagaguaacucucacagcgucucuagccauccgacacguggacaacaguaacccgauggccagggccucucaucguguguccuuuaccuaaagccccgcgucccucucagcugacgccuucgcuuucauuuugucgggccaaucucugacucucaaaacacacagggcacauccgaggaaggguguaaauaaugagaaccauagaggaguuccuaauguguaugcuaugaagcaccucgugugggcagauuuuccuggcuuuagaaauggaaugcacuuaaauuaaaaauuccuacuuaaugugacuugggaaagauaagaguaacagaaacucuuccgacauuuuauuuuauuucuguaaugaaaagugcaaugaaaagaaguugagagagcgaugauggaccaaccagaaaagacaaguccuuuuggauuucuuccuacaccuuagaacggaacgauuuucuaugcaucuaaagcgauuaaccauggggauuuuccauuuugaggaagccccuggauggaauauuggauauuguaguuuaaugucuucuuuuuauggugguaagauauacauaacauaaaaaugaccauuuaaaucauuuaaguguauaguucagugacauuaaauacauucccacuguugugaaaccaucaccaccauccaucccccgaacuuuuucaauaucucaaacuaaaauucaaugcccauuaaauuuuaacuccccauucccuauucccccagcccuggcauccaucccucugucuuuauaaguuugaccacucuaggucccucauguaaauggaaucuauaucugucugucugucugucugucugucugucugucuaucuaucuaucuaucuaucuaucuaucuaucuaucuaucuaucuaucuaucuuuuuuuuuuuugagacaacgucuugcuauguugccuagccuggucuugaacucgugggcucaagugauccucccaccucagccucucuaguagcugcgauuauaggugagcaccaccaugcuuggcuccuauuuuuuaaccaauuuuuuaaacgugguuucuucuuuuaaaguuuaguauugcugaugauuuuauaguguacugacuugcaucauuuccauacccucuguuagagaguacaguggguuauaauguggacuuagaugccaaaccacuuagguucgaauccugacuaccucuuacuaauggugaggcuuuggcaaauggaugaacucucuuugcuucagucuucucagcucuuacacagcagugaacauuguaaccaccucagaggguuaugaugagaagaaagugaguuaauaaggguguaacgcuucaaacaguaucuggaacaugaugaacacccaguaaacguugagugcagaagcagcagcccuucuaccucccaaaguuuuauuaauagaugggacuccauugucauuuugcggcuuuggaaaccgaggccuugauagauuguagaguagcugauccaugaccacuccaggccccaugaccgccauucuagaaguggccgauccaugaccacuccaggccccaugaccgccauucuagaaguggccgauccaugaccacuccaggccccaugaccgccauucuagaaguggccgauccaugaccacuccaggccccaugaccgccauucuagaaguggccgauccaugaccacuccaggccccaugaccgccauucuagaaguggccgauccaugaccacuccaggccccaugaccgccauucuagaagugggcgauccaugaccacuccaggccccaugaccgccauucuagaaguggccgauccaugaccacuccaggccccaugaccgccauucuagaagugggcgauccaugaccacuccaggccccaugaccgccauucuagaaguggccgauccaugaccacuccaggccccaugaccgccauucuagaaguggccgauccauggcuacuccaggccccaugacugccauucuagaaccaugcugauuuuacuacauggcuccuuuguugaaauguuuuggaagaacauggugugguagucaggcuucaaccugaucccaaugauuccugcaucccgagguucacacccuugggcacuccccucccacacugcaucacaguuggugugugugaccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugagguucaguuguaaguugguguguguggccaauagaauaugauagaaaugacggcaggccguuucugggguucaguuguaaaacacauuggcuucuguuuuggucagaaucucucucucgggucacuugggaagaagccaccugccuucuuguagcagcucuaaggggaagcccuccuggcaaguaacccaagccccuggcaaacagccggggagugacugagguuccccagcaaccacaggagugagcuuagaugccccagccuuuguccaucuuugaguugacuguggcucuggcugacaguuugacugcaaccuccugaaacacccugaggcggaaccauggcagcuaagacacuccuggauuccugacccucagaacugugugaagucacuuagcugguugcuuuaagcugcucagaaacagauaacaaaugcacguggcuuaguucucugcugguaucucugucuauaacgacauaacuuuuaagcuguggcucuauuccuuuuuccuauuuuaccauuaaugaacuaaugugaaaauuuuuuuccacaccugcccuggcucagauagauggcaggaaacccucaggauucuucacagugccuggcaggugggagaggcucuguaaauuauguguugaauuaaugaauaagugcauuuuuuccacauauaggaaagaaaucauuuuaguuaaagcauguguguauucaggucucuuuugugaauauaagaggaauguuugauacugaauuuuucuuguuuggaucuuugguaauuguuagaauuuucuuuuuucuaauugacuucaacuuacgauugugacuucuuaugaugcuucauguugauaaacauaacaauuuuuuuaaacagcacuacuguuuggaaagggacuaguguagaugccaguuaguggucacugguacagggaagucagugcacucacuuucuguuucugucauaacaaauuaccacaaaucaauggcuuuaaaaaccacacacguguuaucuuacagcucuguagguccaaaguccgacaugagucccacuggacuaaaauucaagauuguuggcagggccggcuccuucuggacacucuagggagaaucugcuuccuugccuuuuccagcuucuagaggccacucuuauuucuuggcuccugaucccuuccuucagaccaagaugauuccugucaaugaggaaucuggguugcaggaaauacccugguuuuugagaagguaaucagguguuggaguaugaauaacaaaucuacuccuaguuugugcuguauacuuccuuucucauugcagccacugaaaccaugucagauccagaaauuuuauucaaggucgagauagcugugugaccaaaaggaaguaggaguaggagacaguucucucucaccauuuuucucacuuaaagaaaaagcuggccaggcaugguggcucaugccuauaaucccagcacuuugggaugcccaggcgggaggauugcuugagcccaggaguuugagacuaaccugggcaacauagugagacccugucuuuacaaaaaauaaaaaauuguccaggugugguggugcaggccuguagucccagcuacaucccuguggucccagcuacucaggacgaugaggcgggaggaucacuuuagcccaggaagucaagguugcagugagccaugaucacaccacugcacuccagcuugggagccacagacugaggcccugucucaaaaauaaauaaauaauaaaaucugaaaagaaaaagcuagauacaacaaacguagaagaaacaccuuccaacuaccucagguaacacaggaugauauuaaauuuacaguuguugguguuagagaagaggucacagaauagaucuuuuguauuugguauguguaauauuuuuuaaaauugaauuuuuauaucuuaaggucagggcaucuauaggauuugagucucuacuuuuauuauagaaaacauaauuucauuaauagauguuaagcucugaguaaguuuaauaagauuggaaaaaacucuaaaccaccuccaguccccaaaacccuaccauacccaaguuggccuguaauccucugugggaggggggaagccccacuugucauuggaaaucagcagugcaagauggagaauguuuuucucucuaaucccuucaagguacaagguaggacaccuagaagguuaaggcagaagccuucguuguguuugcuucuccuuuguauccaguuaaccacucauguggcauugaaugaaugagugguuguuucuugcaagccugcugcaggcccagccucaucuuaggcauuggacaugugcagcaagcuggauuugugcuacuuugcugcacaguuggccuguuaacaaguaaugccuagggaaggggguguugucuucaaagugcacacagccuaaacauaggugaagauaggagugagaaaaguacacaaugaaauuaaggauaagagaggaaauggucaaguacugggggagugcacaggaagauggauuaacugacuccucuucaaagaucuugcagcaguggacccauuucaguuggguccuaaaaggugagcaggauuucuuaagaagagaaagggggacaggauguuccaggcugcagaaaccagucgucagaaguguuauaaaugugaagacagguauuaauuggauaaagucuaagaagucauggaaucaugaaguuagaaaugaucuaagugguuacaucucaccacucccagccaggggauucuggauaaguuacaauguguucagccuuggccauagaaaaacaaccucaaggcuuaaauaauaugauacggggaauuuauugguucacagaucucaaaaauauggagauagcccaggcuucagacauaguuugauaaaggcucuugguagcagaauggcugcugagcgucagcucucaggcugaugugucauacauucuggaagaggagauacucccuuuccuccuacugacaaaaaaagccuuugaguucacucugauuggcccaauuuuggacacaugcucagccuccucccaaaccguucucugccagaggaacaccaucugcugauuggccugggcucuggucccugccuauggcuguggcaagggggccaggugugggcugauuggauuaggccagucagagcccauugcuaaaaucugggcuugaagccaauaggacguggccaugucagugggugggacaauggugggaauaaggggaagggugcugcagaggcggcccacgcuguccacaugcagaggcucgcuacagaagcuacagaagaagaugguuacauuucaagugggcaggugccguuugcuuaugagcaccaucagccacaucagccacgguucuuugaauuuuaccuaauugucucuaauucuuaacaauucuuugagguaaguguucuccaauaauuuccaguugagcaaacugagacucagagaaaauaacuugaccagagcuacacaccugagaauggcugaaucagaacuggaaauggcagccucuguuuccagagacuggguugucuccauuauaucguggcgcuugagcaggcagcuacagcuccauuugggaagcucuguugguuaggacugggcaggggaggcuuguguagcccugugguuaggacugguuuguggguggcgguguguguguguguguguguguguguguguguguuugguuugguuugucuguuuaauaacguaaagccaaaccugccuccuagugauuccucugcguuuauucuaguucugagguauggagcggugauucucaaacccagcagagcauuauaaaaauacaguuuucuggccuccaugccagaucagcugaagcagagucugugagugggaccguagaaacuggauuuucuuuuuucuuuuuaaguuucagagaugauucuccaguacaaacagguuuggaggacuccugcuuuagaauacaacgaagcuguucugucuuccauguuacaaacccucagauguuuaagacuggggucacccaugagccuuugcuucaggcuccaguguggugcuuaagugccgggacuuuggaaucagaaagacugaguucagauuccgucuccacuguugauaagucgugugccuuggguaaaucucuuaauauugcuaagucuuaguuuucauauuuauaaagugggaauaaucaauuuaaauuaaaaaucguugugaggaauaaguuaagaaaacgugaaguucuuagcgugaagcuggaagaacauggaaaaguuucaguggauaucaccuguuacuaaugauuguuaaaccucccuggcucuggcuucuuuaguucguuucaauuguuuuuuuucuagaucuuuuuuaccucuaauuuuugguguuugcuaauuuaucucaaaacaguaaugguguguaguggguagaggcuggcauaaaauucuagacaccugacuacaucagucaacagcagagcuauagcuuccuguggucugagugugacauuucucugggugcagauauccucuggguauuaaacgucuuggaauuucccauccuuguuuaaguccuuuucuccugggaaauugaucaguggcugauuaugggaacaucuggauucuucaagaauuuuuggacguucugcaacuugguuucaagccuaagcuguguuuggaggcaugaauaugaguugguuucaucauaaaaguguguugauuccaagacugcugugauccguuuuaucucgcauggaucugucagcguuuuccuauucauccgcaaguggugacucauuuaaaaggagguaugcucuccagcagagagccaaguuguuccacaacauguacauugacauuuacauaaaaugcaaauauguucaucaaguuuuacuuauauuugucucuggauuuucaaauacauguuuauuugcuguauccaccuauaccaguuuucuuuaaaaauacuuguaaggcacgauuuuaacuacuugaagcuugaugaagguuguacacagccuguuucaaugcacuuagcauauucucuuugacgaugacccguucuugccagccuugcaugugggcgugggugggucaccuuuaggcuggaacaaccgagaguggagacauggagacuuccuguucuuugauaacguacagggagggcuuuucagggcaguaaaaccgucacugaagaccaugaaaaugcccaaaugcuacauguuccagucagcuaguucaggcauuuauuacuggccuuaaaauguuauguaauuuuguuuauggcaucauaauaguauaaaagcagcugggcucacuagggggcugugugaguaaucuauaaaacuuggaccagcuacaggaauaacagcacaguugcauacagcaaaaauguauuugggaguagcugucuuuuacugaaaugguagagaacaaacugagguacagaaaauguaaaacucucaaguaucugcuucccucagcucccuucauucuucuaaugacuagaaaggaaacacuguuguaaugagaaaacuucuccagaaaaucuuccaacagguuccuaacauccccaaacugaauuucaguggguccucucucaguuccuugaagaaaugaaguaaacaagagaugaaacauguuaaaguugagaugaaauaaaugugauguuaguuaucuaaaauucuguaggaggagaauuaaacgcuaaaaacgauccuaaaauguuugguagacucgcuuacucuacugccaggggaguguguuuccuuguucagaaucacugauguauguuguauaaaaguacuuuuuaguagggcuccuauuuugagccagguauuaucagcacuaggaauucaaggauuuaccuuugaauggcgcaguguuaggcuuggaaacagguaauugcuguaauggaggcagguuucaaguggaaugagagccagaaaggaguccaaagucaagaacauuugggaagguuuuggaaagaacauguuggugcagggauuuuaauaauuuuccaagcagagggaauaaaauauauagaaguuuuccauuguaagagagcaugccacauucaaagauaucauuaacuaguuuuugguguuauuggagcuuaaaauaugagaaggaggugacuagaaaugcaguuaagaaagggaagaaccaaguauuaugauguugaccgaaguuggagcaacagucuuggagacgggaauaagggagcagauuugagacaguuaagagguggauuggacccaccucugaacugugauugugcuugagacguaaggacauguuuuuccuuaaggacauaaaggugguuugcaugagugagcaguuggaggagccauuuuguuagguaaaaaauaaaggaaggggaacaggaacaagguagaaauuaauggguucacuuuuaaguauugauaacuuugagaugccuauuggacaaauauaauugucuaauugaugaucauucuauguaguugaaguuuagaagagaagucuagauuugagagccauuaggauauagauuauaggugaaagacaggcauggaugagaacucucaggcaaaauguauggcaucagaagacgagagccaaggacaggucccaagggauccccagcacuuauagggauggugaaaagcagauauuccaggacgggagaccaaaagggaggcagugaaggaggugguaggagauccaggauagggagagguuauaaaauccaagggaggagggaaugcuguguggucaggugagcgaugguagguaaggcagagagucaaacagggacuuaagaaguauccauuggccuggaaacuguuaaguucauguggggucgugagaugugcacauucagcagaguugagagggcaaauagauuacagagcaaggagaagucggauggaagugguguauggagaacauucucuuaagaaccuacauguguacagaaggaaagagaaauacacuacauucccagggaggucagggagacuuuuguuuauguuuuaagaugacaaauuugaacauguuuauaugcuuagggaaagaagcaauaugaaaggagagacucaaaaauguaggaugagaggauaaucaguguagcaggucuuagauuaguuguucucagagucugcucugggaucauaaaacaucaccuggaaauuguuagcaaaguaaauuaccaguccuuacuucagauuacucaauuagaaacucuggguuuggagcucagcagccuguguuucaaugagccuucugggugauucucacgcacacucaagcuggagagcuccuguccuagaugaagaggaacagugggauccagggcccaggugagugcacaugcccuugcacaggaggggaggugcuucugcgggcgcaggcacaaauagauuugugcugcaugguugugaaguugaugggcuuuguuccugaugacauacuuuuucuuuuugaacuaggaagcaguuuuguccauugaauccugagaugagaguaggguugggcugggucaguagcuuaugccuguaaucccagcacaugggcaggccaaggcgggacggaucaccugaggucaggaguuugaaaccagccugggugacauggugaaacccuguuucuaaaaaugcaaaaauuacccgggcgugguggcaggcgccuguaaucccagcuacuuggguggcugaggcaggagaaucgcuugaacccagaaggcagagguugcagugagccgagaccgcgccauugcacuccagccugggcaacaagagcgaaacuccauuuaaaaaaaaaaaaaaaaaaagaguagacuugauugaguuuacucaaaugaaauacacauuuaagguuuuggaaauguugcauucuaauugaccuauaauaugauuaguuuuaagcugaagcauaccuuuauucucucccucauuacacucuuccuccuggcccuuucucagcaggagcugacuguucuucuugcuacugauuccuugaaaccgaaacgauuccaucauagccuguguugggagacucagucuugagguguucaggggcuuuuuguuugugguuucaauggggcuuuuaaaucuuugucuuaaucuuuggauacuuucaggagauggcugagaucacaucauuuagagccagaauaaaggagaauguuugagcaaggauucaucaaaccaauaugagaaauuuacagauguuagauuuuauuaacacucccacacaggagguuugaaaugaacaacagcaaaacaggacguagauuuuuaagaagaaaagucaaacaauuuaaaaaucugccaugggcaucuggucgugggucccagggggccacgugcuggacuuuugaucucaucaaaugcguuucuuagcuggucaugaaagcugguugucguuucauuucaugauuucaauauggugaagaauuuggauaaagaagcagcauuuugauguguuuaguuuuuaggggaaauaaugaauuugcuguaacuagucauuaauuuucuuuuucuauuuucuuuccuuuugaugaaaaugcauuuauauuaauucuaauaugggaacacaacccccauggggugaaagagucugaaaaguuauaacugaaaacaaugucccgaaagcugccacaaaauaaggccagggagaugaggcaucuugucucugugaagaccuucaguaugaggucuucucagcugguagcauggggggaaagaucacguuggaagucaucuaccaucaugcagagccccagcuccuugcuauggaaggguagauuggacuuuuuagaucuaagaaccuuuuuuccacucaguaccuugagcauuugcguugauaaauguuugguuucugacagcagucuuggauucaacuguauaagggaaccuuugaauuugaaccgcuuugcaaguguuucuuguuucguguaaagaaugcuuggccacaucuccaaagguguggcuacgaaagaaauaaggaaauccuaccucuaaauggaauauaacaguccucaaagcgaacccagugagucaauucuugucugaguuuuugcuuauucuauggaguaaauagauuuuguuaauauuguaaacacaguuuaguggaauaugcaauguuuccguaguuccuugauuuuauuauugggaauaugaauuaaauacaaauuaaguggguuuagaaggggauuaguaaaaaacaaaacaaaaccugaauuagaaaauguuacuuuaagauuuauuugauggaaguauuuagccuauaagugagccuuuacuauuauauuagaucaacucucagacugacauuuugauuguuucacauuugaucagaaauugagacuauaggaugcuacuucuauuuaaauauaaaugugggacagauguagugacugacaucuguaaucccagcacuuugggaagcccagguaggacacuuguuugaacccaggaguuugagaccagccugggcaacauagugagacuucaucucuacaaaaaacuauuagccagcugcaguggcucaugcuggucccaguuacuccagaggcugagaccagaggaucacuuaagcccagaagguggaggcugcaaugagcugugaucaugcuaccgcacuccagccugggugacagaacaagauccugucucaaaaacucgaaaugugauucuauuacagcugugcuauuaaaacucccaccucuuuaaagauggaauugagcauuacccaaaaacuuuaaagggagaaugucucugggcuauguaaagagcuacaguuccacaaacccuccuaaaagaagaccccacgugcucaagguccccaugaccgugggucugcacccagagccaggcuggagggagggcugggagacucgccugcccaagccugguuugaagaccugaugcauggaagcaacaguucuuugagaggacaaaauagaaaaagagaaauaguauggaauucuuucuuucugcaacaaguucuauguaaucguuucccaaguuaaaggaccccuucuuacuuaacucuaaccauaaacaacuuuauuggagccagaacuuacacaugcuuucaguauuaacauuaaaggaucauucucagaaagucuggcuuuucuguuuccuucuuugcuuuuguuauggcaggauagauuggacuuuuucuuuuagaucuaaaaaucuuuuuuucacuugguaccuugagcauuuguauuuauaaauguuugguuucugacagcuguuuuggguucaguuguauaagggaaccuuuaaauuuaaaccgcuuugcaaguguuuauuccuuuaaaacauuucuaauguaaauguauauacauagaaggauucugaaagguucuucuuagucagguuuaaucuguccugacagcucaaugcuauugaauucuuaaaaugaagauguccugguugucugugcagcccagggcucccagagggcucucagguagcuaguuaaccaagggacacccagcaguggcagauccucauccucucaaaaagggcagagcuucgggacacuggucuagcccagcaggcauccccuuagcacugugugcuguuggcacuaccuguccuaaaaccucaauauuuauuuggccucauguuuauucuuugcagacuuauugagcaccuacuauaaaucagguaggucaucgucuagauaggucugacccagauaaacaagguuucuguccucuucaagcuuaauuuuaaguguaaucacagugggauacuccaaguuagggaucaacagaccucucucuaaagggucagauagugaaugauuuaggcuuucugggcuauaccgucuuucuuagaacugcuuuacucugccuuguagcucaaaagcagccauaagcaauacauaacuggaaaggcagggacgaguaccaacaaaacuugauuuacaaaaacaguggccgagguaccaugggcuguaguuuguugacugcuagucuagacaaugccaauccacugagacagaauccauaucauacagucuggaguagggauuuguuucccagacugcaaagcagcuuuccagucaacgucggcagccauagagaauaagugcauuucucagcauuugcugccuguugcagaguuacugacagcugcauuugucauguucuugaauuauuuuuuccaccuugguuuaauagguuucccaaaaagccucagugaggaagcaucacccuaauuuguucuacaugucaugugugugauaagcagaaaggaaacagacaaacucagaccuugaaacuggaaugaagcauuuaauuccugcucccaugcuagcuuggcagaguugagcaauacaucuacagacguccuuccaacacaaugacuucguugcccucuguguggccucuuaccuggugcugggcucuaggguugauguaggacuuggguccugcccucagggaucucacaucacaggaguggagucgaugaaguacauuccugccuucauucccgaggcaugucugacuaccugccacacaugugcaaggagagcaaaagugaccaaggccuggaccccguccuaggugaguucacaguaaagcaaaugaaaaaucaugcacaguaagguaaaauccagugcugcagccugugauagagaucaugccgcuuggguugcugaguucucccccucguuguaauucagcaggcuucccagugugcccugcauccucaucugugaggccgacuucacuaucauucccacuuauagguggaggagacugaggcacagagcucccaaagccccacagcuggcgaguggcagggcuagcgugcgauguccacuagacuggugucugacgcagaagcugcgcuucucaccccugggaucuggaagauaauucugaugugugagauccaggagaaugcauuguuuagccagaaaauguuuuguaacugcauuuuuguuuuugacagaaaugugacugcccacugaauagugagcauuggaauuagagaccaucuagcugccggggcuggguuuggucaucuugcguuuuuuaagucugaauugggaugcuguauucgauucuuaaaacggccauggugacauaccacaaacaggguagcuuaaaacaacaaaauuuuuuucacaauucugaggguaaaggucugaaaucagggcgugugggcagggugagcuccuucugaggcagacuguuccguuucuuucccguagcuccugguggcagcaggcuguccuugguguucccugcuuguaccugcaucaccccagucucugcccccgucuucauguggaacucuccuugugucugucuucucauggccaccuucuuacugggaugccagucauguugaauuucgggccuacuuacucucuagugugaucuuuuccuaacucauucuaucuacagugacuuuauuuccaaauaaggucacauuuuaggguacuggggguuaagacuucaacauaaucuuauuggagggaacauaauucaccccauaacagacaccuuuagacaggauggaacuuccuuauucaccccuagcccaucccaguuguuuuuacccuggaaaagauucccaaaucucuguugccauugcccuccuugggcauuugaguugacuccuucuuucuucaagcuauuucugugugaugacagagagaggguuuaaaugacucaucuccuaucuagguuucuuucauuaagaugccgagacucuucuuuucacuaaauauuauuuccacccacucauggagcagagagccacguuccauaaaagggcucucugauauacgguaguagucacaugcuuuuagcaaugcauaccugccaagaauggacagauaccucagauuaggcuguacuguccugaauuuuuggucucuuucccagguguuucccaggaaagaaauucauuaucaauaagguggaaaggacuucucaguauugagccccauaauuugccuucguaguguuggagggaacaaggggaaaugggagcagaaaugagaaaugggagaggaguuugggaaguaaggcggaaaggccagcacagguagcauugcugacgagagacaaagcuuggaugaggccacucugccuuucaccaccaaggccuguaauagacuggccaggcuccgaaacgcuggacucaacguuuaacugccugcucuggaggauuuaggacaaacagggaaaaaccuuuugaaauaguucucucugccccccgcccucccgcacuuauuuuuuuucuaauaaagaugauuucuacccacucgugaaguagaaagacgcagucuauaaaacagcucuuuaauucuggaaacuuaccucuggauucagaucagcucuauaaaugacuggaauggugacuguuguacuuauuuuuugugggaacucuuaguugaauuuuacuucauugcaauugugguuaauuucuacugaguuuuaaaugccugcacacacuaggaaaaguuuuuugagcgccuacuguuggguaucaugagaggcacgaagauggauaaaucaugauucuugcccuagaugaacuuaucaauuaguaagggacagaagaugccucccagcauaaauaguagaacuaggaauggguaagagcaccuagagaggaaccaaaugucucuggauguuccgacuuggaagcguuuacuucacgauuccuucugcccauguucacucagcuccuacaaagagccaggcgugcugguguauagugaugauaaacgacagcugacaggagccaggaugcuggggugagacugggcuugcaccuggcucuguggccugauggagggaggggcuuagccuccauaugcuucacaucuucuuuaucuguaaaaugggaauaauauuaauaucucccucacagauaugcuguguauacauagacacaacacagagaaaguaagaaagacugcuugccagccgagugcacuauaaaaguaguauguucccugcauggggccaaccuucagagguguuaauaacagggcaggaaggaaacaaaaagaggaauuauuauaaauggugguaaguggagggcaaauaagauucucaugcaagggagaaucuuuuaaguuuugggguuuuuuguuuuuuguuuucugagacagucucacuccgucacccaggcuggaaugcaguggcacgaucucggcucacugcaaccuccaccuccuggguucauguaauucuccugccucagccuccagaguagcugggauuacaggcaugcaccaccacaccuggcuaauuuuuguauuucuaguagagacgagguuucaccauguugcccaggcuggucucaagcucguggccucaagugaucugccugccucagccucccaaagugcugggauuacaggugugagccaccgugcguggccccuccuuucgguuuugugauuaaggauggacuuccuccaaugguggcauuuaaagccaugccaugagggagcaaggcuagaagaguggggauggcuguugugugguagaggcuggaucaagcggagccguguuaggccauuugaagaaguuucaauuuucuucugaaguagcagaaaaccauugaaauguuugaaaugugggugugacugaauccuucauguuuguaaaaagaugauucuaauucugucuagagaaguauauagagaauggauucaaggggucaagcaugagaugagguuaagagugucacaauaacauaggcuagagacgauggcuuucccugggccggagacgauggcuuucccugggcuagagacgauggcuuucccugggcuagagacgauggcuuucccugggccggagacgauggcuuucccuaggcuagagacgauggcuuucccuaggcuagagacgauggcuuucccuaggcuagagacgauggcuuucccugggccggagacgauggcuuucccuaggcuagagacgauggcuuucccuaggcuagagacgauggcuuucccuaggcuagagacgauggcuuucccugggcuagagacgauggcuuucccuaggccggagacgauggcuuucccugggcuggagacgauggcuuucccugggcuagagacgauggcuuucccugggccggagacgauggcuuucccugggcuggagacgauggcuuucccugggcuagagacgauggcuuucccugggccggagacgauggcuuucccugggcuggagacgauggcuuucccugggccggagacgauggcuuucccuaggcuagagacgauggcuuucccugggcuagagacgauggcuuucccugggccggagacgauggcuuucccugggccggagacgauggcuuucccugggccggagacgauggcuuucccuaggcuagagacgauggcuuucccugggcuagagacgauggcuuucccugggcuagagacgauggcuuucccugggcuagagacgauggcuuucccugggcuagagacgauggcuuucccugggcuagagacgauggcuuucccugggcuagagacgauggcuuucccugggccggagacgauggcuuucccugggcuagagacgauggcuuucccugggccggagacgauggcuuucccugggccggagacgauggcuuucccugggccggagacgauggcuuucccugggccggagacgauggcuuucccugggcuagagacgauggcuuucccugggccggagacgauggcuuucccuaggcuagagacgauggcuuucccuaggcuagagacgauggcuuucccuaggcuagagacgauggcuuucccuaggccggagacgauggcuuucccugggccggagacgauggcuuucccuaggcuacagacgauggcuuucccuaggcuagagaugauggcuuucccugggccggagacgauggcuuucccugggccggagacgauggcuuucccugggccggagacgauggcuuucccugggccggagacgauggcuuucccuaggcuacagacgauggcuuucccuaggcuagagacgauggcuuucccugggccggagacgauggcuuucccugggccggagacgauggcuuucccugggccggagacgauggcuuucccugggccggagacgauggcuuucccugggccggagacgauggcuuucccuaggccggagacgauggcuuucccugggccggagacgauggcuuucccuaggcuacagacgauggcuuucccuaggcuagagacgauggcuuucccugggccggagacgauggcuuucccugggccggagacgauggcuuucccugggccggagacgauggcuuucccuaggcuagagacgauggcuuucccuaggccagagacgauggcuuucccugggccggagacgauggcuuucccuaggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccuaggccggagacgauggcuuucccugggccggagacgauggcuuucccuaggcuacagacgauggcuuucccuaggcuagagacgauggcuuucccugggccggagacgauggcuuucccugggccggagacgauggcuuucccugggccggagacgauggcuuucccuaggcuagagacgauggcuuucccuaggccagagacgauggcuuucccugggccggagacgauggcuuucccuaggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuucccugggccggagacgauggcuuuaggagguuggcauaggagauguaggagaugggaaaaaugaaauagauucaagauacauucuggggucagaauugucaugacucugauagacuggaugacauggauuggggagaaaugggggaagguuuuauaauacugcucauguauuagagaaaaauaaauacugucaucucucagaugggaaugaaucuucccaucuaaggaguagguuugggggcagaacuuagucauauuaaauuugaaaaaugucauuuaaagagagauuuuuucucauugaaaaaucaucuuccaguacacaagugucagagugaggauacucacagugggaguggcuuugagagaggugggaagaggaaaggagggugccugaacagauaguggcaucuguuagcaagucagggucuggaggaagggcagccugauuuaguuugugacuugauugaaacuguuuagaccuauaagcauagguauuaaugaugaugauuuuguuaaaaugcaaaagucuauuuuacaaaaugacucucauaugagaaaauacucugaaauugaauuuaacauccaggaaguccuaucauauuuaaaauuuauuuuucuggacauuuacguuuccgaaugacuuggugagaaauaggucugugagugacucacugaaccccccaaaaaaguacucauauagguagauuuccucgugccgaucaaaagacguuauuaagggaaguguucuuuagccauggcuaacugggacauuuguucuugaguugggauggucugaugcuccuuggacagugucugguuacaagagcaacugaugggugcacuagaacucuuuucgcugagaaaauaaagcaagauucuuugguauguuugcucucucgugcagccucacaacauggguagguuuuguuccucuccuuuuucccuugucacauguacacaauaagcuacuuauuuucauuugauuuuuuuugugauaaaacuccugugaaaguugagggugaggcuauuaucuguaccuccauuuagcaaauaccugguaccucguugguuucacaaauauuuggugaauaguuuaauaaacauuugcagauugggugaacacccuguguauaacauggacaccccgauuauaugccuuccuaaauuuccuucuugugcugugucuauaagcuuuccugcuauaaccucaaaaacauaauaccuaacaaaagcaacaaugaugauggcuguuuuagcuaaguguuuguccuucaauagggcaugugcuuuaagcuauuucuucuagaguugaaaguuuugauuuuguuuuccuccagagccaucuucauuucauuaacuuuccuuucuguagcuaagggcagcaguuugugucuguggccguggaaccuucaauguguguaagaagggaacugcuuugcaugguagguguggcaguagugguaacagcagcagcaaugacaucauuuauuuauugaguacccaauuugugccaggcauuauaauaggugggaaaaacacuguuggcaaagguaaggccagguucucguaacaaagggacauaaugauaauugaguagcuucaaaggagauagacauuuauuucuuuuucacugauuguguaauguauguaccaggugggugggugacuccacuccaugcuguuauucagggcccggauucuuuccaugguguugcuccaccgccccucaggccuucacaagaaguggaaaaaggagcccagcagggccagcccacagucucaaggcuuagcuccagaagcaguucccaacucuuucacuuccacucaguuggagcgaacuuagucacguagcugugccugauuccagggguugggggaggaacugggaaacguaguucaggccugugcccugggagcaagggagaacagauguuggugaacaccuagcaauauucaccacauccugcaaugugcagauuauucuguacacuuuccagaugaugaauuagaaauuugagagguuaauuaacucaacuugcccuagaugaugagguuguaagggggaggugcagauucuaauucuguuauaucugauuuaaaaaucugugcucuuuucaccaccgugauaccauugaacacuguguuguugucauagagccauguggaguuuacagaggaaauucacauauguuaacuugcuuauggcuucaggagcaggucucccaccaccagacuuaccuagccagcuaaggugucucaggacuugguauccgaaugaaaauagagugcaauucuaaucuaucaaaaacugguuuucuugccugcuuuuaggagacaggaguaagaauaaugaaaacagucuuguaccagggacuuacauccuagggcauggucuguugucagaauacauucagaucagugcccccuucccacuugguucaguuauagugaggcaucaguggugcccgagacauggcaagaucagcagugacuauaggugacuagacucuguacagcguaguguuugcuucagacucugcaaagcugggcuuuggaguuugaaucuuuuacucacugaccagguauguagcuguggacaaguuucuuaaucuuccuaaaucugagauuccucaacuguaaggcaggauuuguuagccuccuucacagaguuguuuuaaguguuagugaucauguaagcaaagggccucccacaaagcagcaucugguuaaaugacagcugcuauuuuuaaaaaaauaaacccaccaaccaugaauugagugacugcuauguaccaggcaccaagguaggcuccagagauuuagagauaaaagguagagucccugcggccuucaagggacauccccguuaguggggauguuucagagagaacaaccuaagcucagguuuucccucaggaagaagaaugcguucuaaccagacgagagcgugugcguucucuuaauagauuguauaaacugaaauugugcaauagccaguuugggugcaaugagcuacucaaaugacacauugauuuuuuuuuuuaauuauacuuuaaguucugggauaugugugcagaacagugcagcuuuguuacauagguauacacgugccauggugguuugcugcacccaucaacccgucaucuacauuagguauuucuucuaaugcuaucucuccccuagccccaccuccagacaggccuuggugugugauguuccacucccuguguccacguguucucauugugcaacucccacuuaagagugagaacaugugguguuugguuuucuuuuccuauguuaguuuacugagaaugaugguuuccagcuucauccaugucccugcaaaggacacgaacuuauccuuuuuuauggcugcauaguauucugugguguauaugugccacauuuucuguaucuagucuaucacuaauggacauuuagauugguugcaagucuuugcuauugugaauagugccgcaauaaacauaugugugcaugugucuuuauaguagaaugauuuauaagccuuuggguauauacccaguaaugggaucacugggucaaaugguaauucuaguucuagauccuugaggaaucaccacacugucuuccacaaugguugaacuaauuuacacucccaccaguaguguaaaaguguuccuauuuuuccacauccucuccagcaccuguuguuucccuacuuuuuaaugaucaccauucuaacuggugugagaugguaucucacugugguuuugauuugcuuuucucugaccagugaugaugagcuuuuuucauaauuuuuggccacauaagugucuucuuuugagaagugucuguucauauccuucacucacuuucugaugggguuguuuuuuuucuuguaaauuuaaguuccuuguagauucuggauauuagcccuuugucauauggauagauggcaaaauuuuucucccauucuguagguugccuguuuccucugauacuuuucuuuugcugugcagaagcucuuuaguuuaauuagaucccauuugucaauuuuggcuuuuguugccauugcuuuugguguuuuagacaugaaguccuugcccaugccuauguccugaaugguauugccuagguuuucuucuaggguuuuuaugguuuuaggccuaacauugaagucuuuaauccaucuugaauuaauuuuuguauaagguguaaggaagggauccaguuuccccuuucuacauguggcuagccaguuuuccaacaccauuuauuaaauagggaauucuuuccccauugcuuguuuuugucagguuugucaaagaucagaugguuguagaugugugguauuauuccugaggccucuguucuguuccauucgucuauacgucuguuuugguaccaguaccaugcuguuuuggcugcuguagccuuguaguacaguuugaagucagguagcaugaugccuccagcuuuguucuuuuugcuuaggauugucuuagcuauaugggcucuuuuugggcuccauaugaaauuuaaguaguucuuucuauuucucugaagaaagucaacauugacauuuuuauauguuguuuuaauagucuuuaugauaaaugucaacaaaaauaauacuuuuuagagacacuugguuuuuauacacacuuagagagguaauaaaaucugccacuaaugcuaauagcauucugauggagugaagacuuagugguaugucaaaaaguaaggcaccuuucucuuuuccuaauguaguuugaauuucaaaacaacacgaaggaaugcuguugguauuuauucagggauuugugugcagauuugauagcuaccauuuaucuucagcagaggaauccguguuccuggccuuuccccccuugguuaguuuggauuuccucaaaccacuuugcccuuugaaggauugugugcuguuaaguaaaugaacggguauguuucugaguuugugcugacugauuuacaacaggauggcaaauucagcacugaaaacagggucagacaaauacccuggcuaugagacucagcugacucagacaagcgaggcuuugcuuagugguuuuuaccccuccaguagagaaaagucuuggcuaaggccucaaaggccuguggacuggaaggucuggcagaacaguguccaugucauuauuguuaguagaaguugugcaguuguauuguugcugauggucucacuaacacuagcuaucuuuuauguucuagccacugaagagucauuaauuauugugguucauucucacagcaaacccguguugauuuucauugaucccaggcucucaauuuaaauaagaaagcuagcaaaguuauuuucuuuugccuccccuucuggcuuaacaaagagaacucagaaguacuuacguuuugagaaaauagagacccauuuaaauaguguuaccagagugacacauuauuaacuaagaaaaucagaauuacauacuuuuuagagguugccuccacaggacacagugguaaucucugaagccuggaggucucauagcccuaugaugcagaauauuaucaaugauaggaagagaaagcauugccuccuuaacaguguacggaggcaucuuccaccagcacugggaacuaagccuccacugaugaacggcacaggagaaagacacagaccugagaaggcugaaauuuacaacgcgggaaagacgagggcagcacagaauuauuaaauggaauaugggaaacgcgugguuugugucuacaguccacacuugcaacacagguaccauuguguccauuguauagaggagaaaacucaguuccagaagacuugaguaacuugccccgagucacaagauucaaagaugccagaccagggagcuaaauccaugaauaucuggcuuuaaaguccuugccuuuucuuuaccucacagugguuuacaugaggugcauuguuacucguacacugaauuuccuucacuaccugccuuuuucaauauaaggugaauucugcaucauuuuguugaaauggaaaguucuaaccauuauuguuuuaauauaggaggcacuugggccuugaaggagaguugucauuccaguagucugguaaagggcauuucagauggaagacacagccuaggcaaaggcacugaggugagaacgcugcagcuuagucagggaauggagaauagauucauuugaggagaacugagugucucaguagauggggguuauaucaugagaaggacgugagagccucagcauggagcuggugagcagaggggggccauuuuugagggggggauuaaagugcucagaucuguggucuaacgcuguucugacagcaguguguagauugaaacagaguagagauaaauugagggggaaguagcauuaucuauauaaacugucagcgaguagagaaaucuggauuuucauguauuucguucagggaacaguaacuuucccauagguauuucccaggguugugaauaaauauuguaguguacuggucaaggaugcaaaguuuggggaaguuaggaacauccuuaagccacaaaguggaugcucaaaaguuaaauauucacuggaagugacaaguaagcaauggaaauaugaaaauaauaguucacgccacucuccugccuguugccuuaaauuauuccacugaaagcugcuuucugcuauuuuauuuggguaaauuagucgcaaauggaauuaucugcauuuaaugcucugccguuaucccucuguuuagguuuuugucucuguuccuuuaauaagaagcaauucuuggguuaugucugcccucuggucugagggcuccaggaagcaucccagucaugaaccuuccaguugaacuaagucuguuccagaugcuucauugacucaacacauuucacacuagguagacaccggaaguaaucacaggccagccuuucuugccucucaggcugaaacaaguucacagugcaacagcuuuucagagacaacuccacacuuccacaaaugccccuaugcauuugacuuuucuuggauggcuuguucacaaucacucagcaguuacugaucauagguuugugccuggcauugucugaguugauaggaaggucuacaugugaaaauuuaggauuuugaauuuaggauauugaacuucuuuucaacuuaucugguaaguugcccauaacuuuaaagacaaauagaaaauacuuuuuugaaacauucagucaaauuugaaaugaccauguuccugccagacagugaaauauauuauaaagccagauuaauaaagauaauaugguauuacaauaccauguaagaauaagaauugugauggaauagagagauuucuaccucuuucuucucucagaaaucauccaucaccauagaauggcaaggagaaugaggaauggaaaaacaaauucuacuuuugauggaaucaaaagucauuauaacacauugaucaauaaugaagacaaaaagcaguuggaguucugaugacugaauuaacaguggggagcuaggugggaucugagugccuacagugguggauaucgaugagaagcaagcauauuuccugcucagaaaggcucagaaauuaaugaagugagguccugaggggggauagguucauauggggaccuuaaaagaaaaggaguauuugaaagacugcaucagauccuccccuguacucccuacagccuugaaugugccugcucaucuucagagugacgguuucuggagaggggcccugagcaccaggcacagcagagguuggggguagaaaggaaauaaggacucgagaugaucugaaagccugucuucccaagggccagaucuugagcacucugguugauauucuccaugaauuaaguaauguuuuuaaaaaucagccuguagaaaagauuagaaggaaauaguccaugauuuuagucaugauuggagaacuuuuguugauuuauuuuucuuuuugccuuuguuuuucacauuuaauuuaaugugugcauaccauguuaugcuagaaaauagcaaaauugggucuggcaucgugaugugcgccuguaaucccggcccuuugugaggccaaggugggaggaguucuugaggccaggaguucaagaccagccugggaaacauaaugagaccucaucucuacgaagaaacugaaacauuagccaggcauaguggcaggcgucuguaguucuaguggggaggcugagguaggagaauugcuugagccuaggaauucgagguuacaguuggcugugauggcaccacuguacuucaggcugggcaacagagugagacccugucucuaaaagaaagagagagagagaaggagagaaggaaaauagcaaaauaaugcggaaaaauaauuaugaugaagaagaaagaagguaaauguuuaucaaggcuuaguuguguaaaaauccuuuaaaaaauuaauaaacuuuuuauuugagaaccguuuuauguucacagcagaauugagcauagagguuucccauauaacccuuggccauucccugccccaccccuaucucccaucaucauaaacaucccaaaccagauugguacauuugcuaaagucgaugaaccuacauugacacauuaucucccagacucccgaguugacauuagggcucacccuugguguugugcauccugugaguuugcacaaauguagaauggcaugucuucacuguuagagcgucauacagacuuuuuucacugcccccaaaaucuuucauguuccaccuguucaucucucccuccccucucaucucuggccaccauugaucuuuuuacuaucuucauacuuucgccuuuuccauaaugucauacaguugaaaucauaccguauaaaguguuucagauuggcuucuuacacuuaguaauaugcauuuaagguucuaccauguccuuugauggcuugaugacuaaucucuguuuagugaugaauaaucuguugucuagauguaccacaguuuaccuguucaccuacugaaggacaucuugguugcuuccaaguuuuggaaauuaugaauaaagcuggauuuuauaugauacuguuuucucuccuuuauuagcauauuaauuauacuucuuuuuacuuuuuaaaaugguugccguagaguuugcaauauacacuuacuacuaauccaaguccauuuucgaauaacaugaaacugcuuuaucaguagugcaaauaucuuauaauaacaaaauauucccaauucuucccucccaucuuuggaaucaucacugucauucauuucacuuauacauaagcauauauaugcauacguaauugaguacauuguugcuauuauuuugaaaaagauauuguguguugaucaauuaagaauaagaaaacaaaaguuuuucuuuuaccuccacugaaguauguucuucuucccucugggguauuuuuuuaaauauuuuuuuucuuuaucuuugauuuucuuaguuguaaauaugauaugcccagagguaguuuuccuggcauccugcuuaguguucucuaagcuucauggaucugugguuugguguuugacauuaauuuggggaauuucucagucauuauuguuuugaauauuauuucuucuguuccuuucccucuuuauucucuuucuaauauucccauuauauguauguuacaucuuucauaguuguccuacaguucuuggauauucuuuuuuuuuuuuuacaaucuuuguucucuuugcuuuuucauuucagaaguuucuguugucguauccucaagcugagauuuuuccucaguuguguucagucuccuaauaaguuggucaaaaggauuauucaagucuguuaaaaugauuuugaucucuagcauuacuuuugcuuucuuagaauuuucaucugcuuauacuuaucuguucuuucauguccuuuuuucauuaaagccuuuagcuuauucaucauuuucaaaaauuuucuugucgaaugauuccaauauuucugcuguaucugacuaugauucugaugcuuguucaaucuuuucacacuguguuuuuugccuuuuaguaugucugguaaguuuuugcugaaagacggaugucaugauguacuggguaaaaagaauugugaaugggucuuuagugauguggugguaaaucacuggggagugauacuguuuggauguuuuguccccuccgaagcuuauguugaaauaugacccccaguguuggagguggggccuggugggagguuuuggaucauggggguggaccccucaugcauggcguggugccuuccccuuggugaugagcagguucuugcucuguuaguucacacaagagcugguuguuaagagucuggcucuccuucccuuuucuugcucccuccaucaccaugugacaugcuggccccucuuugccuucugccaugauggugaacuuccugaggcccucaucagaagcagacgccuacacucugcuucauguauggccugcagagccgugagccaaauaaaucucuuuucuuugaaaauuagccagcauugguuacgucuuuauagcaaaugcaaaguggacuaacucagaauggaauuguucuccuguaguccugugagugggucucagucuucuagugagcccaugacccuggacugugagcuucacucagugcuucucaguuuguuuguuuguuuucuugugggacaggaugacuagaguggacuggaguuggguauuuuccuuccccagguagguuaggcucugccaaagccccagcaaguuagggucugguuaguuucucuggagggcaaaaccuuguuaagaacauaauucucugguguuuuuuucuuuuucuuuuuuccuuuuccuauggugcugaucucugguguuuuuucaaaaugguccuuuuccuccuuuuuccacuggaagcauaagggaauuuuucucugauacucacugcgaggcccugcuagagcuccuggaaaaaaaaaaacucacaaaagcuuaucccucccuacuccccaugaugggcaccucuggaguuuuaaacucgaagaguuguucauucuagacccccagcaguaugucgaguacaauugagguuucuaccggguacugauuuccauggagguuucuguuguaguaaguugcaaugcucuguaugcgccccucugucucucuagucuugggggcagcagcuugcccugugaccuuauuucuuuggcagaucuaagaauuuuuuuuuaacacuguauauugagaaauuauaguuguguauauuuauaagaugcaaagugguauugugaguuuuuaauacaauguggaauaauuaaauuaagcuaauauaucuagcaucucaaauguguaagaagaaugguugauuuuuuaguuuguuuagcuuuuuacuuguuguuaggauggaauggugacuucuaagcuucuuacauaccagaucagaagccagaagucucauccuguuuuuaaaaacaggacuuugaacauuuuuauuuuucuuagugugcuaagaaaauaaugccagcggcaguaacugcacggcaauccaguggucucuagucuuauaagagcuuauaaagaaaggcuucgugucuuaccugauaaacuccccuugacuguuuuacaguuaagugaaaccccaauuucuggcaagaucugaaacuugguuuuucuuuuuuguugccuguuuaaaauaucagaaguaagcccgugaaagcuauuaacauguauucaggccgacuuugguuucuccucuauggauguuucuagaaacauagugaaacaacacagcaaugauugguuuugcgguuguugaggucaaaccuuggcacaagauuuuuggucucuguuuucucuuuauuguucgacgcaacccacaugcagguuuguuucuccaucucuucaccucaucuggcugacauguugauaggagcuuagccaggcugucuggccacgaaaccuaaaaucauauggcuuguuuaguugguaaggacauggaggaauaaaauaaccauguggacggcacugugcaaggucuucaaugacagaggcguugaacuucaggcagaguuuagcgaucaucucaaccguguccuuguuucacaauucugggaucaacauccgcaaaacuacacuucugacaacaucaggauccucuaauauuucauguauacucaucuugcaagauagguuguaaaauaagaugaggaaccugaaacaaugagcaguuaagccacuugcgucaagucccaaggguggcaggaaaaacagagcaaggagugagauugauuacuugcagccuuuggauuucaccaugaaguuggugguuuuuaaaugguuuuuucuccccuaacaucgaccuuucuccagucaaauggugggaaaccucacauguaaaacagaugaaauacagcugcuggcucacgugggaggcugugucaugugguaugauguuuagaaggagggucuuggaagccaggcugcucugagccucaguuugcccaucugcaaagugaggauaacuacuauacgugccucacaggguuaccguggaaaucagcgaaaucaguucccagcuguaauaaccgugcaguuuauucagucaaaaaacuuuuauccggcagcuuacuguauucugggcccuguuaaaaggacgaggugauggcugugaggaaacaggaaucccggcuuucauggagccuacauucucagucucaaaauacauguuaauuauaguaacaugugucgaaggggcaucagaccccuccuauugauaccuccucugugugucuggcucuaaagguuccuuagagcacugugugaaaaccacuguccuaggcuacacaucuuaacaucuaggauguuuuuaagagcuggaguggggaaaaaaaauggaauuauaugacaguguuuaaauuuuccauuacugacauaaacuauuccagaaacaacagguagaagagaaggaugauuuaggccuccaguuuggagaguaauuagugacuugucugcuuuuccuuccuuagucaucuugagcacuugcagcugugcaucuuccuuugugccugaugcaagcugauauuuuagggugaaagggugagaaggaaauuuagauucaaagugcugacaagauaaaguacauucuguaaagauucauuccccuuaaaauuggaguucuuaccgagauaucuucacuuagcagacugaugucaggaaaguaaaaaauggaagggaacuuugugguugaaaauuauguuccuagaaaugaggguugacccuguuucuaugagaagagagagcaugugcggcucugcugauggguacagagaagugccuuugugguagcgcccaagggagaaugcagaguagaccaccaucucuacucugauuguuuucaauucuuucucagaugccuacaaacauuuaaaccuugucugacucugccuucccuugguaguuuuaaggcauauggaagaauuucaacaaacugaauugauuugggggagaaggagguuagauuuuuuuuuaaauguugccauuuuaaggagcuagauaauauacaagagaccuuuggccuucggccuuccuguggaauaggucccgagggaguuaugaacuuccaaaugugaaaaugccuauguaauuauuuuucucucugugaaaaaugcaaaguauaucugaaaaaguuaaguaauuccucuagauguguaacgauucuauaaauucaggauuaaaguaauuuauaaggcuaauuuaugccauuuauuuauuuauuuauuuauuuagagacagagucugguuucugucacccaggcuggagugcaguggcauggucucagcucacugcaaccuccaccucccaggcucaagugauccucccaccucagccuccucaguagcugggacuauaggcacacacuaccacaccugacuaauuuuugugucuuuuuuucguagagauggggguuuucccauguuacccaggcuggccucggccuucuaagugcugggauuacaggugugagccacugugcccagcccuaugcccauucuuuagugcugguaauagaaaugaaccaaucuaucaguugguuuucaugucggggucauuuucaggcagaaaaauagauuguugucccuugaccuaaauugucugcuuucauaacagaaagccaaugauaacaaagccaugugaaucagucuuuuccuguggagucaaccuuacaacaaggaggauucaaacaucuucagugaaguagcaaaugauuacauaucacagaucuuugcaucaagcaaggucaaguaugcacguguuaacucagugaauucuaaguaucugauuaaauuuuguaagucaaugccaauuucccuuuggacucagaguuuaccugcauaauuuuguuuuauuaauauuuuaaaauaaaaagauauguggccgagcacauguggcucacaccuguaaucccagcacuuugggaggcugaggcugguggaucauuugagucacgaguuugagagcagcuugggcaacaugaugaaaccuugucucuacagaaaauggaaaaaguuagccgggcaugguggcacacaccugcagucucagcuacucaggaggcugagguaggaaaaucacuugagccugggagguccaggccacagugagcugugacggcacuaccauacuacagccugggcaacagagcaagacccugucucaaaaaugaaaaaagaaaagugauguuguccagugaacuaaaaaaacagagauuuuacucauuuuguucugugaauguuaugcuuuauuuagagaaaugagccaucaaacagggaagacagcacugguauaagaugagcuggcagagaccuucagguggucacaagagaacacagugagcaaugggaaaauaaggcaauucucuuagcacuggaaggcguuuaacagaccaucuaguuggucagcucccccuagcuuaccuuucacccuuuguuuuauaaauagggaaacugagaugaaaucacccaagacuuuugggacugucuaccaaaaaucacacaaccaagucagagccagaacccagguuuucuaacuaugauaguuguguuacuguugugccauccugucuucugagauguuggcccaucuucaucagaaaacuuugaucuggagcugucgggagccguagaauaacagagcaagcauggaugucuuggcuugccuaacacugcuccucacuuaguguaaagagcucuuggccgggcaugguggcucaugccuguaaucccagcccuuugggaggcugaggcaggucaaucacuuaaggccaggaguuugagaccaaccuggccagaguuuguuuguuuguuuuuuguuuguuuguuuguuuguuuuuugagaaacuccaucucuccuuaaaaaaacaaaaacaaaacccaaaaaauuagcuggacaugguggcacacgccuauaaucccaacuacuugggaggcugagacgugaaaaucgcuugaaccugggaggcggagguugaagugagcugagaucaugccaccaaacuccagccugggagacggaaugaaacucuguuucaaaaaaaccaaacaacaacaaaaaagaguucuuaaugcuccugaaaguuauuaucuagccucugcuuaaauacugguucaugagauagcccacucccccaggguggugaucccagauauacuacccuuugauuucugucccaguucuucuauuuggggucuggagcaccuaugaugugucagucacuguacuauaugaaagagauacaaaguaggauaaaauguagcuucuucuuucuaggaauaacccuaguaguaaaagaaacagacaaguaaaucagcaaugaugguucagugggguaagugguauuguuagggguauguacuuugcuacggaggaggagaaccuaaaucagacuggagaaugaggaaaagcuuccugaaggaggcaacccuugagcuaaguuuuggaguaggagauagaugaagcaagagaaagggcagucacacgaaugaaagagccuguggaaaguacauucaucagcacagcacuuuagaaaaugguguaugguguucuguagggcuggaaaaagggagauuuguggccggugaugagaggaagggugaggaaaggaugcagaggccagauugugaagggccuucauggauaagcagucugcaucguguaugauuguauugucagaauguuauuuuauagcucauuccucuuaagaugcuuucagauuuaacuuguccugcuuuggaacaugaggaucagaaaaaccuggauucaauaucuggcaccacuuaagccucuuugagccuuagaagccucguuugugaaaugagggugauaguagcuucucccaacuuucgugguaaaaaaagaaucuagacaggcaccucauaaagugcugggcucauugcagauagaaaacccgcuuguuucucccccccgcuuuuuuuuucucaaagucucugaauaauuacauucagcgucccuaccuugucugcuaggaguucuaacauuagauuaacauuuucuugcaagaauucugucauuuuuuaaaccuaaccacacaauucuacauuuuggagugaagguaagcccaaaguaaagguuucccuuauuacuuuuuauggcuugauagagaaaauaaugaggaagguaaguuaugacuuuuccacauauccuguuuuaccaggccaagaguuagaugaugaggauacucagaaggcaaagaaaguagacaaaaggucagggaagcuauuuaauuugguugacguauauggaggaaacaguacugauaugacagauacguuuuguuugaaaaagcauuuugugccuacucaaguauagacacaauauauccugagcagcgagugggcaugaauccaagcggguguaagaaauacagcaacgcuagggaagauucagaaaagaaagaguugaguuauuuuagugaaaugauagcucaaguuagagaagugcaugcugagagaaacguugacguuaaagaguaaggacuggccacauuuuaauuuccucuaaggaucuuuucuaagagaggagaaagaaauguuacaguggaagugaguguaguaggugaugggaaagggaaagggggaagauugaauauugaaaacaggaaugaaggaaagggugacaugucagcuuuauuuuuacuucuauugugugucaaagcgauggucuuucuuuuuuuagcuagucaggucuaaacuguaauaaaaugaagucagagugagaugaaccgaauaauacucaauuucauggaaaaucuuaucuguaguuggcagucgucucuuuacuuuuggauuuaauuccuuuucaucauuuucuguaucaguucuuuugagaguaguuggcuggugcugcagaugaauacaugccuauuggugguuugguauaauuugucuuacauugcaucuucacuggcaguguuagccugaugauucguuucuaguuuagcaaaaugagaauuaguuuaauaagauguugagauggugaucaguuuuccagggguuugguucugcucaagagcuggcauccaauaugccaaaaaggcaauaagcaggguggaucaacugccuuaagauggguaugcaauguucaaaccaaaggauggcauagugagagacaaaucauugcuccaacagaauggaagaaguugcuggaagaugacuucgcuggcaggcaaggaaggaaaucaagaagucaguuuuuaccaccaucacuaaacccuucccagaguaccgaagcaggcucauacccaggggaguaggggaguaguacaggaggaggaggagaaguagaaggagggagacaaagacagggagagggaauuagcugaggcuggggagacagagagucacaagagaagaaaggaauucuugugaacuacagugguuuguaggacucaaaaguaagcagguggaauuaaccucauaaaaaauaaugcucugccugccucgcuagggguaggcacccaacacgucacacguccuguuuugcucccucacuugugucagcucagauuauuuccugccuguccacugcuagccuuuuguggcugaauaucagaucuugacugagcaucugagcaugugcuggccucuauggaugaggaagccacaaugaaucagacauaacuuuucuucucaaauucguuuaucuuaaaaagcauuuauuguagagaguauacuaugugccauauacauuaguaggugcuaguauagaaaauaccaagaggcugaauacuguggcucacgccuauaaucccaacacuuugggaggcccaggcaggaggauugcuugaucccaggaguuugagaccagccugggcaacaaaaugagaccccaucucugaaaaaugaaaaaauagaaaauaauguuaucuauuuguauaaccuaguaaugaacauagggucauuuguaauuuuuugcauuuacaaacaguguuccuauggaaauucucuucauaagcgccuccuagaagacacaucaagaggucugucagcuauaaacuauagcaacaugcaucaacauaaaugaaucuuaggauauaauguugagccaaaaaaaaaaaaaacccaaaacaaauugcaaaaucaucaaugcaguaugauuccaucuguaaguagccaaaaguaugcaaagcuaaacauacaauauguugcuuagugccuccuuauccaugggggauacauuccaguaccccagagggugccugacaccauggauaguacugaaccucauguauacuguuuuuucuuauguauacauacuuacaauaaaguuuaauuuauaacuuaggcacaguagauuaacaacaauaauacuaaaauagaacaauuauaacaauauacuguacuaucuauacucagguaucagguaaaucuauuuggauguaggaaaguuucuugaaggaggugacauuuaagccggauccuaaaggaugaauaaaauuaugagcgaucgcaguagugaaaaagauauuuuuaaaagaggaaacuaugaauaaagauauaaaagcuaugaccuggcaaucauaugccaaaaaaaaagaaaagacauaaaaccacaugggcggccaggcgcgguggcucaugccgguaaucccagcacucugggacgccaaggcaggagaucgagaccauccuggcuaaugcggugaaaccccgucucuacuaaaaaauacaaaaaaaaauuagccagguauggcggcgggcaccuguagucccagcuacucaggaggcugaggcaggagaauggcgugaacccgggaggcggaacuugcagugagcugagaucgcgccacugcaguccagccugggcgacagagcgagacucaaacaaaaacaaaaacaaaacaccacaugggcccacaaccugacuugggaaugacagagaagccaggauaacugaaauacguguugggugcagggaaacacaggaugggaguagauuauagggggcguuugaugucacacgagagaauuuugucuuuauucugcaacuacuggguagaucuccuguuucucuuuuguaaaaucaaaucuguuuuuaaaaaagauuuaucugaugacaauuuaaagaaugguuuggaaaaagacagggaccagagagauugacuuggaaaguugcaaguaagagauaaugaauacaggagacaaauaccugcaguggaaacgggaagaaagggcugaaugugagaguggcacagagauaugauuugauuagcacaugaauuuggaauaaacuaccacuguuuuaaaauuuaauuugcgacagucuugcugugucaccaaggcuggacaguggcugcaguggugcuauauuggcucacugcaaccccugcuuccugggggcucaagcgagccuuccaccucagcuuccugaguagcugugacugcuggugccugccagcaugcucggcuaauguuuuagcauuuucuguagagacaggguuucaccauguugcccaggcuggucucaaacaucuaggcucaaguaaucugcccgccucagucucccaaagugcuaagauuacaggugugugagccaccacaccuggccuaccacuuucuuuaucguccccuuuucuuccuguuuuucuuuggccuguuccuuacugccucuggcucaucuugaucugcaauuuuauugguauaauugccauauugacucaggaaacuagcuaccaacuacauuuuaacuagcaucuuuaaaacgcuugucugagaaagaguaacaauguuuacuacaagcauuuauaccagggcaaaugguauaaggacuaaggagaaauacacuuuuccuaauuacaguguugaccccuuaggacgcugagcauuuguaauuuaauuacaucagugaguuaauguggaaaaguaccugauacacuucguguuaguuucauuuugcuuccaaguauuacuuucacuuucuucuuuaauuuuuugaaguaaagaggauuaucagauuuaaacaaaguuacacaaaauccuuuuuaaaauuaaaauaaucauuguugaaaaucuugcugaaguucuguuguguuucuguagguacaaugagcuaaacacguuuuaaucuuauucagcauugaacaugcaggcuucauuugugaaaaguccuguguuuguuugaagaaccaggcacaagaguaaucacagaacauacuuuugaaaguacaugugggguuuuuguuguugcugcuguuuauuuuuaaaaacugaacccuacuuggccaggcacgguggcucaugccugugaucccggcacuuugggaggacaaggcugguguaucaugaggucaggaguucaagaucagccuggccaagauggugaaacccugucuguacuaaaaauacaaaaaauuagccagacguggugucaggcgccuauaaucccagcuacucaggaugcugaggcagagaauugcuugaacccaggaggcggagcuugcagugagccgagaucacaccacugcacuccagccugggugacagagcgagacucugucucaaaaacaaaacaaaacaaacugaacccuacuuuuaagccaguuuacuuuauguuugcuuuuucucacuuuuuauuuuuuucagaguuacauccuaaaaaauguuuuuaguuaauugaaagauuuuggucuaguuggaguugauauauuaaugugcagugaaguuucccaauguagcaaauuuaaacuauggaagaagaagaagaaaagguaaucuugcuuuguuucuuucuccagauauacugauaauauauauuaugaccaaagagaucuaacuagcuucaauuccucuuuggggaaauaacacuuuacccaaagguguuuauuuuuaucacuuucuggaauguuuuggggauuucaugaucacaugccgaccaaauuccuuuuagauucuuagagccuccugcucagccucuaauugccaccuacucugucugauaauuaccuuucuguuuggaaucuaguauuuuaugaaaacuaaagauacuugaucuucaccuugauauagcaucuagauacagacuauccccugcacaaggaaaccucaauggguagaggcuuuugcagagacacaacccuguaugcacuugaggguauguggggaguucaggcucaucauuuuaguaugcguuuucacagcguucugcucgagugcguagccaaggcuguaucuccuuuuagcuuaguaaaaaccugaucugucuccauuacacuacaaaacauauuauguugacuuucaguguuuuugcacagaaugugagaccugcuaagaguaggguacaugccauuaacaggagcauuuggggagcuaguaucacaaucuucucaaguuaggugagaacagugguaacagugaugcccaucaaccaguacucucagccuuuacccagaggccucuucacucauuugcuucugaggaucggcuuucugauugauucuaguuagguugacaauggacugaacuaucaucaagcagccauaaaaacgucauuuuuuuuccuaugcuugucagucuuuuucuuuuucuuuauuacaaucgguaauucucauauuucuuuuuccuccuggucuuuguaacuuuuuugucaucaacucaucuguucccuuaauccuuuucuuuucaugccuuguuuccugguguuugauuuugcuucauuucccaaagugauccuuacguuucagcuuuuuagucguuuauugauaaugcuuugguuaauuuuuuccccuucaaacaaguuuuacaguaauaaucucccucccacccagcuuuaucaugguauaauugauagauacucaucuuuauuuacagguauuucuguuuuauuuucuuugacaccaacauuucuuuuccugucauugauaacauuuuuuuuccagaaacggcaaauucuaaucuaaaucauuuugcuauuuauugucuuugaauucaaaguuggaaaccucacauaugcaaaugcaguuguuugcuguaaucaucaaacccugauuccuuuagugaauauauucuguuuugcauuuagauguaggggggaaaugagagcauuugugcaaaauaaagcuagagggaaagaaaggaucauguggaauuuuauuuuuuauuagaaauaacuaauuaaaucuguauauaacucaagaaaaggagaacuugaccuuuuguuuguaauaaugaagaguagggugacugguugaaucucacacaugagaaaguugagacguuucuucuugguggaagugauuacuaagcagggauuaugaaaaaggacaacacaggggaaaaguggagaguucuccuggucagaucacaagcagcacagucagacucguaggagguaggaauugacuauaucauggcaauuguuuuuuuuuuuuuuugagagagagccucgcucugucacccaggcuggagugcaggggcgcgaucucggcucacugcaagcucugccucccggguucacgccauucuccugccucagccucccgaguagcugggacuacaggcgugcaccaccucgcccagcuaauuuuuuguauuuuuaguagagaugggguuucaccguguuagccaggauggucucgaucuccugaccucgugauccacccgccucagccucccaaagugagccacgacgaguauuuucaagagaucugacguguacugugcaucgcgguaaagcagccauggaguggguaauucacccccgcaucuuucuguaaccaaggaagguaacaggcugucggcugccguggacuccgcugguauuuuaaauuauccauccccugguuugcagguaauaagagugaugcagaaacaaugugccuccuuguuuuucuucaguucuuguguaguuucucuaaaugccauuguguauccuucaucacuuaccuuauauguccugugaucuugagagcuggugcucucaauaacaaauagccaacuaauaugccggaguguucaaucccuaacucaaagacuugucaggcuaaugaugaaugacugugaaauccauccccaguuucccuacccaaauuaucugcguaaguguuuuuacucuguuauuuagagagagcggugugauaggugaaaaagaaaugugaauuuacguuugcaaauaacuaauuuaaacucugugccaagggaaauggcacugcuuaacugagcauggauagaaaauacugggaacauaugugcacaaagucaccuccagaguauggccacauuuggcaagaccacugacuuggcauaagcaguguaacuuuauaucggaggcauauuuuggauuuugagugacauaugauagcauauucuaugacgaccgacucggaauggugaaagcaaagaacuaugacgcugaaagugguggugaauccuucugggcaauguuaagagucaagaaggccagagcgagccaaucuguguagugacugaggcuccaagaacaggggguggucagacguucagggccuaguguggcuguggugacaccaacaaccuguacucagauccugcuguuacagaaaaaaauacucaguccuguuuguuaaagcacaggaccauggcgauagguacagggaccacugcaaccaggucuugcacugggggagaaagauuaggcucagcuccaaauacauugugggcacgugggaauugguagccaaggggcagugugggggucgguagauggaaaauuaccaagaggaaauauccagguaagggggauucuggcuaaccucaccuaacaguauuaggucaggcuucuuuuacuacuuaauaaaaauguuuuaaauuucuuuuucuuuggaaccuguugcuggagaauuaauguauuucuuagucauauguccuugcuuuugucauguuucuuguguccuuaaauugaugucugcacuccuggucuaacaauugcuucuuccauuuauuuauuauccauuuuuaaauuguuuuauuuauuuuucgcuuucucuuccacagacagugacuugugcuccuuccaguuuuuuaaauuugcauucacaggggaggauuuuuccugaagauaggucuauagugguguuuggguugggcacuguguuuuuuaauuuguuguuucuugguugguugggugggggugggggggguggguuucuuuuuuuuggagacagggucucacucuguugcccaggcuggaguccagugguacaaucuuggcucacugcaaccugugccucccagguucaagagauucuuccaccucagccucucaaguaucugggacuacaggugugugccaccacgccuggcuaauuuuuguauuuuuagugaagacaggguuucaccauguuggccaggcuggucuugaacuccugaccucaagugauccaccgccuuggccucccaaagugcugggauuacaggcgugagccaccgcauccggccuugguuggguacuuugguuuugguucugggugcgcacgguaguguagucuccauaugauuuuuuuucuuuuucuuuuuuggcuguaucggcauccguggugucuauaauuuccucaguggcucuggguggugugguuguuagcagaagcugcagugaaauuuugcuggggacagggaccccgggcgcaccaguccuugggccccacgguggcgguggugggcuaaaugugccuguccuuggccucaaggcuguguacacuggcauccacguuagcaagucuaggcaugucaguucuugggcauccaguuggcuugcuugggugcuggugguagguggcaucagugugcugggugggaggguccuugggcgucugggcaaugggcguggcauaggcaauggcaguagcaauggcaggaggauccccuggcucccaaguggccaguguugguguuggcugcacccggcugggcaguccgguccuuaggccugcaguuggcacaugcaauggaugcuagaugugcugguagcggcaggucgggcaggcccauccucaggcuugcagaggaacugcucagcugcccacagugguggauggacgggguagggcaauccccaggccuuugcauggcuugccuggucacuggggcugguggaacugggccagguguccugaagagugugugcuuugguccuaggugguggcugcagguggguuaaccuguccuaggguacuuguaugugcaugguggccuugcugcuggggccacagggucacugcuaguggcuugugcuucagcccuggcagcagcaggagccagcaguggcugugguggaggauaucaauggggcuccaggaauguggacauucaagggcuauuuggggcccagggcaggaugcugccugguggaagcugggcccucaaaauggugcugugcuguagcugcuuaggacucgagcaguauguggggcccagcacaagcucccucccuggagcagugccacagcgugguccccgggcagcacucuguuagucuaaggaccacaaggggcucuccuguggcucggaucacaggaguccaugugggaauguggacggcugggcaucucucacuuacucucuccacacaguggggagccucuucagggucccagccaaagaggcugccuugcuucccucuccuuucuugccuuaggcgucuccugucacuuccauguugaauuccacuguucucuguuagaugaucuguuccaguugugauuccguccugcuguuuccaguugcgauuccguccugcuguuucgauucuucuuuguggaggaagcaaguuccagaugcaucuucucagucaccuugaggccccucuuaccuaacuggauucuugcugaagacaggccagggugaucagacagcacccgaggguggugaaggaugaggaacaugaagauucugaguaccgagguucuggcgaaaccggcuaggcaggguucuuuugcuaaaacuggauuuugaggaacaacacggauggaccuaggagauucagaggcgugaaucuccucugaauuuggccaaguaaagaaucuccucugaguuuggccaaguaaagaaucuuugucacuaguuacguacacugugacuuacuucuggaaaccuagagguauauguagugauacuguauuucauuaauucugagauaucugauuuauaauacacaggcugacaguuuaauugguaguguuuuuucuuagugguacguaacauaaugguguggacuguuuauugagugggucuuacaguugaucgaacuaugguaauaauuaugaucuugcuaccauuuacuaagcuuccuauaugcccugagucauuccaaggcccacauguauuuucucauuuaauccucacaaucccuccauuuuauagcuuucugguaaauucugguaauuuauuucugggcucuuccuaauaaaaucucauuagccgaugguuuagaaaugcaggcacauuuaacacauuuuaccccacauaaagcaacugaaucccugauguuuuaaaauacggugacaugggguagcagaaggcauucacaaaacaggaaacaauuggguucguuuuggggggauauggaggaggaccgggguaggaaggaagcuuacuuuucuauucugucucugguugugccguguaugaauuccugcaaauacugugacauucacaugacagagugccaaggcuucauuuucuguuucuuccuuuagcuacuugcucuuuuguagccgauuuaucuuugcagccugccuuaggagagaauaucucucucucuguggcauuaauuugggaauggcggcuggcuauaguuagacaaugggagaguggaaaauucaaaggccauccauuuuaguugacgcuucccagcuggucuucaguaauccccagcaauucuuccuguggacgaucugacaguacguggaggccagcccgccucccagggccacggaagagcagcagacucauuuguuucuaaauugaucuggcagauucgacgcugccccgcauuauugcaacuuauguuuugacagagugacuuaacaaagaaauauggccaauagucaggaaaauaaucuuuggcugaggaaggcuaaaauuugucaaaauuagagagaaauggggaguuuuuuacauuuuuguuuuacuugggcggugaaauaauagcaacaugauuaaaagggacaauuuuuccucuuuucuuccuagugccuggcgcugugcuugguacauaauagacccuuaaugaaugaacaaaucuauccuucugaugggucuaguguacaacacuguguuucagacccgaccuuuagcuuaacccccuccccacucugccuguacguacuuccuucauaacugaguuuucugcaaagguuauuuugaccaaauuuccuugaugcgugagaacaucggaccauguagccucagaagcgucuguugaguucucuuaccuuucuuucaugaagauacuguacucauagcuucuuugugaggggauuggagaacuggaagaggugaggugaagugcuuugaggcgugaguggcgugggaacgucagauguuccucucauggacaacauauuugggauuuaguguaaagaccuguuugauagaaaacaauguguugaguggugugauuuuuagguggccuccacaugcgguggaggaaggugguggaggagagcuuugaggacaaguaaguuuggaacaacucugagaccaucucuccucuccuguucagauucuuugucacuuguauucagcucuuccuguaucuccuuucuggcucuucagagaaaaaaccuaaauugugguauuucaggcaguacuaucuuuaauauugcugugcuguuuccuuuuuuaaauuuaacugcgggggugcauguacaggacguucagguuuguuacauauguaaacaugugccauagugguuugcugcagcuaucaccccaucaccuagguauuaaucuaaucccagcgugcauuagcuauuuaugcugauguucuuccgccccucaauccccggacaggccccaguguauguuguuccccucccuguguccaugcguucucaauguucagcucccacuuauaagugagaacaugugguguuuggguuucuguuccugcauuaguuugcugaggauauugacuuccaguuccaucuaagucccugcaaagaacaugaucguguuccuuuuuauuacuguguaguauuccaugguguauauguaccaugauuuuuuuauccagucuauuauugauggacauuuaauuccuugucuuugcuauugugaauagugcugcaaagaaaauagacaugcauguaucuuuguaguagaauaacuuauauuucuuuggguauauaaccaguaaugagauugcugggucaaaugguauuucugcuucuaggccuuugaggaauugccacacucuugcacaaugauugaacaaauuuacauucucaucaaccauguaaaagcaucccuauuucuuugcagccuugccagcaucuguuguuucuugacuuuuuaaucaccauucugagugggugagauucucauuguggcuuugauuugcauuucucugaucagugauguugagcuuuuuuucauguuuguuggcagcauaaaugucuucuuuugagaagugucuguucauguccuuugcccauuuuuuuaauggggcuguuuguuuucuucuuguaaauuuguuuaaguuccuuguagacucuggacauuagaccauuguuagauggauagauugcaaacauuuucuuccauucuguaggcuguuugcucugaugacaguuucuuuugcugugcgaaagcucuuuaauuagaucccauguguccauuuuugcuuuuguugcaauugcuuuugauguuuucuucaugaaaucuuugccuaugccuauguccugaaugguauugccgagauuuuuuucuggaguuuuuuauaguuuuauguuuuauauuuaugucuuuaauccaucuugaguuaauuuuuguauaauguguaaggaagggguccaguuucaguuuucugcauauggcuagccaguucccccaguaccauuuuuuaaauaaggaauccuuucuccauugcuuuugucagguuuaucgaagaucagauggugguagaugugcagucuuauuucugaguucucuauucuguuccauuagucuauaugucuguuuuuguaccaguaccaugcuguuuuaguuacaguagccuuguaguguaguuuuaaguuugguagcaugaugccuccggcuuuguucuuuuugcuuaggauugucuuggcucuacaggcucucuuuugguuccauauggauuuuaaaauaguuuuuucuaauucugugaauaaugucaaugguaguuuaaugggaauagcauugaaucuauaaauuacuuugggcaguauggcuauuuucauaauaaagauuucuccuaucuaugagcauggaauauuuuuccauuuauuuguguccucugauuuucuugagcggagguuuaucguucuccuugaagagauucuuuauuuuccuuguuagcuguauuccuagguauuuuauucucuuuguagcaauuaugaauaggaguuuauucaucauuuggcucucugcaugucuguugguguauaggaaugcuugugauuuuugcacauugauuuuuuuuuuaaucccgagaguuugcugaaguugcucaucagcuuaagaagcuuuuaggcuuagacgauggaguuuucuagauauaggaucauguuaucugcaaacaaagacaauuugacuuccucucuuccuauuugaguacccuuuauuucucucucuugccugauugcccuggucagaacuuccaauacuguguugaauaggaguggugagagagggcauccuugucuugugccaguuuucaagaggaaugcuuccagcuuuugcccauucaguaugacauuggcuggguggguuugucauauauggcucuuaauauuuuugaguuauguuccuucaauaccuaguuuauugaggguuuuuacaaugaggggguguugaauuuucucaaaggcguugucugcaucuauugagauaaucaugugguuuuugucacugguucuauuuaugugaugaauuacauuuauuuaccgauuugcaaauauugaaccagcuuugcaucccugggauggagccuacuugaucaugguggguaaguuuuuugaugugcugcuggauuugguuugccaguauuuuauugaggauuuucacacugauguucaucaggaguauuggccugaaguuuucuuuuuuuguuguaccucugccagguuuuggugucaggaugacgcuggccucauaaaauaaguuagcgaggagucccucuuuuucaauuguuuggaauaguuucagaauaaaugguaccacuucgucuuuguaccucuuguagaauucagcugucaauaugucugguccuaggcugcuuuugguugguaggcuauuacugccucaauuuuggaacuuguuacugaucuauucagauucuacuucuuccugcuuuagucuugggaggauguauguguccaggaauuuauccauuuauucuagauuuucuaguuuauuugcauagagguguuuauaguacucucugaugguugguuguauaucugugggaucaguggugauauccccuuuaucauuuuucauugugucuguuugauuccucucccuuuuuaagucuagcuaguggccuauuuuauuuaaaaaaaaaaaaaaaaaaaacucagccccuguauucuuugauuuuuuuuuuuuuuuuggaaagugugugugugucuguccucaguuccucucugaucuugguuauuuguugucuucugcuagcuuugggguuuguuugcucgugguucucuaguucuuuuaguugugugauguuaggaugucgauuugaggucuuucuagcuuuuugaugugggcuuuuaguaccauaaauuccccucuuaacacugcuuuagcucuaucccagagguucugguacauaguuucuucguucucauugguuucaaagaacuucuucauuucugccucaauuucauuauuuacccaggagucauucaggagcacauuguucaauuuccauguaguugugugguuuugagugaguuucuuaaucuugaguucuaauuugauugugcuguggucugagagacgguuaugacuuuaguuauuuugcauuugcugauuaguguuuuacuuccaauuaguaaaacaauuagaagggaucaauuuuagagugagugccauguggcacagagaagaauguguauucuguuuugggggguuagagauuuuuauagguaugucagauccacuuauccagagcugaguucagauccugaauagcuuuauuaauauucugucuugaugaucugucuaauguuggcagugggguguuaaagucucccauuauugugugggagucuaagucucuuuguaggucucuaagaacuuguuuuaugaaucugggugcuccuguauugggugcauauauaguuaggauaguuagcucuucuuguugaauugaacccuuuaccauuauguaaugcccuucuuugucuuuuuugaucuuugcugguuuaaagucuguuuuguuaaaaacuaggauugcaaugccugcuuuuuuucugcuuuccauuugcuugguaaauuuuccuguaucccuuuauuuugagccugcgugugucuuugcacgugagaugggugucuuaaacacagcacacugaugggucucagcuguucauccagcuugccauucugugucuuuuaauuggggcauuuagcccauuuacauuuaagguuaauauuguuaugugugaauuugauccugucaucaugaugcuagcugguuauuuugcagacuuguugauauagcugcuucauagugucaucggucuguguacuucaguguguuucuguaguggcugguaacaguuuuuccuuuccuuauuuagugcuuccuuuaggagcucuugcaagguaggccugguggugacacauuuccucaccauuagcuugugugaaaaggauuuuauuucuccuucacuuauaaagccuaguauggccaguuaugaaauucuggguuggaaauuauuuucuuuaagaauauugaggcagggugcaguggcuuauaccuguaaucccagcacuuugggaggcugaggcaggcagaucacuugaggucaggaguuggagaccagccuggccaacauguugaaaaccugucucuacuaaaaauacaaaaaaauuagcuuggcaugguggcaugcaccuguaaucucagcuacucgggaggcugaggcaggagaaucacuuguaccugggaggcagagguuguagugagccgagauuguuccauugcucuccagccugggugacagagugagacucugucucaaaacaaacaaacgaaaaaaauguugaauauugaucccuaaucucuuccaccuuguaggguuuccacugagagaucugcuguuagucugaugggcuucccuuuguacgugaccuggccuuucucucuggccgcccuuaacauuuuuucuuucauuucaaccauggagaaucugaugauuaugagucuugggguugaucuucucauggaguaucuuacugggguucccuggauuuuuugaguuugaauguuggucugucuugcuagguugggcaaguucuccuggaugauaccuugaguuauguuuuccaacucgguuuuguucuccccagcucuuucagguaccccaaucauucguagauuuggucuuuuuauauaaaccaauaguucuuggagguuuuguucauuccuuuucauucuuuuuucucuaaucuugucuaccugucuuauuucagcaagacagucuucaagcucagaauucuuucuuccacuuggucuguucagcuguuguuacauguggcugcauugugaaguucucauguuguguuuuucagcuccaucaggucauuuauguuccucucucaacugguuauucugcuuaauagcuccuguaauguuuuaucaugguucuuagcuucuuugcauuggguuagaacaaacuacuuuaacucagugaaguucguuauuacccaccuucugaagccuacuuuugucauuucauccagcucagacucugccuaguucugugcccuugcuggagagauguugcagucauuugaaggagaagaggcacuauggcuuuuugaguuuucagcauuuuugcauugauucuuucucaucuuugugggcuuaucuaccuuugaccuuugaggcuguugaccuuuaggugggguuuuuguggagucuuuuuuguugaugaugaugucggugguaguggugcuuucuguuuuuuuuuguuuuguuuuguuuuguuuuuuuaacagucaagacccucuuccauagggcugcugugguuugcugaguccauuccagaccguauucaccugggugcuuccugcaccuggagguaucaccaguggaggcugcagaauagcacagauggcugccugccccuuccucugggagcuuccucccagagaggcacugaccugaugccagcuagaaugcuccugucagagguaucuagugaccccaguugggaggucucacccagucaggaggcacaggaugagggauaugcuuaaagaagcaguguggcugccccuuggcagagcaggugcacugcgcuggggggaguuccccuuguccagacugcauggacucuucagagcuagcaggcaggaaagacuaagucugcugaacauagagaccauagcugccccuccccccagugcugugucccggggagaucagaguucuguccguaaaccccuggcuggaguugcugaaauucccugaggggaaggugaggagggauggaucugugacccaccuaaagaaacagucuggccaugauuugccauagccgcuaugcugcacuguggagaauuccucccaguccaaaccacccagucuccccggcaccgacuggagccacagugauugcagcugucccucucucuucuucuuuuucaaugacaugaaggccucccacaggaaaagacuuucgaaccguucuuaagggaccagugguauuucaguagcuagaggaaggaggggagaacauucuaagcagugggacuguuccaccuggcagagacaugaaggugugaagacaggaaaacugagaggaaaacaugagaaggcagacacuagagaagagacuagaaaaguugauggggaccagaucuggacccaacagucagccugucuccucuaggccaggguuuggcuauuuauuuauuuauuucuuccugagacggagucuugcucugucgccaggcuggaguggaguggugcgaucuuggcucacugcaaccucugccuccuggguucaagcgauuccccugccucagucucccgaguagcuuggacuacagacaccugccaccaccaugccuagcuaauuuuuuguauuuuaguagagaugggguuucaccauauuggccaggcuggucucgaucuccugaccucgugauccacccgccuuggccucccaaaguguugggauuacaggugugaaccauggugccuggccugucuaucuuuuuaaaccgauacuucuauaaugcuuucuuagucaagaggguccugcuaacuagcuaagaagaguuugucaaacuguauuuucagcaauguccauuacaaaagaaaauauguuuaaucuacuuuucuaaauuaucuauuuucuucacauucuuuuuuuuuuaaauuuuuuuauuuuuuaauuuuuuuuauugagauggagucucgcucugucgccgaggcuggagugcaguggugugaucuuggcucacuguaaccuccacuuccuagguucaggugauucugccucacccucccgaguagcugggaauauagccucaggccaccacgcccggcuaauuuuuguauuuuuaguagagacaggguuucaccauguuggccaggguggucuugaacuccucuuuucuucacauucugaugaacucuugagucaggaaaggggaaccuuccuugcaaauugcugcagcaacucacugaagcgguguaggggcaguaugcugguguuuuagcuacuuaccaacucaggaaucuggucaggaaagaggcugggaauggcacuauuuauguauucaugauggugacuaguuaaaaaugguaccagaagagaagacaaaagaucaaaugauauccuugcauugaaaucccaccagucugauuuguguaucuggccaucuauaaaagugucuggaagaagaaggggaagaauuaugagcuacuucuguacaaaggaacaguguaggaguuggaaugaagccaugauaaauuuccucuuuuauuucuuucuauauuuccaaaaauaaaggagcauaccuggagagaucaaaagaggggcugucugaccucagagacucauuucuugaugccucuugacugcauaauuaaaguugugacucucucucgucugaucuguguuuguucuucccuggcuccugcccacuagguuaucgggcuguauccagggaucaggcaugcuugggcaaccaaagaaggaguggccccccaaggugcuccccaucuagccugucauuggcugccagaaacagccacgcacuaguccccaaaauaccuucaugcgggcccgcacagcuuguacacgagucaugcacacuucagcuacugucaugugaaauaccugcuucuggguuucacucccugagaugucaggcaucaucgguauggcaaacccuugccugccaaaaguucacccggagagaauauucaccuuaauuucuacauagugaaaggaaccucagcacgcacuguaucuuucauuuggggauuacuuuaagcaguugauuagugugcagucuuaccuuucacguguaacguuuuucuguaguuuccuuuucuccauuaauuugacggaaaaacagauaacuugagccacacgcugccauaucuaauucaacuucagucaggugcuaugcagcaccuagcauacuugauuuaggaauuuaguacugggaguaagauuacagugaggcguccugguacugcuggggguggauuuccacaccacuuacuuagagaauaaugaaacuagaguaucauagaagagaauguuuuugaagauuuaagcugaacaaaagaaucuuuaagugcgauacaugggagaaaguucaguucauugugauaaaccuuuuggguaggagcacaucuaaaugaaauugguagaugugaccguggagcuauggaaaccuauaaugaugucuuguaauaaauuauugaagaauuucugagccucaggauaugggaagaaaaugaaacaaugaaaaugaugugucagagcuuuauaccuucucuacguauuugacagacaucugugguaagugcuuguuucaucagauggcuuuaaggaggugaaaugccagguaagagccucagggaaggaacaguggacaaauaugugacuauuuugcuauuagcaaggauaguuguuuauaaguucuguugugaguaaagcuuuuagaaaaugaaaaucuguggauuuuagaaagcauguuaucuaaaggggcuucauuugcuaacauuuggcaguuugacugugggagagagauaaaauagaaagcacaauuuuaugauugccauuccuuaugauauuggccuugauauugauuuuagccuugacaagugauuguugaggauuuugugugucuagugugcacugcagacuuauuuguggccagagcuugaaaugggacagacaccacugcaguugugaaaacaguuggauguaucucagucuagaaagacaaauucccaaauauauugucauguguggugggauaaagaguuuucuuaaauaauauuauuauuuuauuuuuuacuugacuuguauuacaaagugaauuuguaaaaucuuuaauaaucauagcauauaaagacaaauuuuuaguuuucuccuuuaucacgugauaucgcaugguuuaaccugcuguaaauuaguuuuguaaaaacauuauuaccacaacauuuuuuuuuguggcggggacagucauuggagugcaguggcgcgaucauggcucacugcagccucagccuccugaguagcuggaccuacagguaggugcauggcaucaugcccagcuaauuuuuguauuuuuuauaguggcgagguuuugccauguugcccaagcuggucucaaacuucugggcucaaucgauccacuugccuuggccucccaaaguacugggauuacaggagugagccgcugcgccuggccuuaaucaacacaaauuuuuaaaugaaauauuauugcuuugggccuuagguugcauauugcuuucaugaccugaugcuucacauucuuauaauuaacucuuuaagaaaccagcuggauuauguuucaugacuucuauguucuuuuucucgauuauaagacaagaaagguuuuagguagcaaagugcaagcacauuccaaaucacacacuggggacuuucguggucuucacgccaucugcaaaaaaaaaaauaagauuacguauucaguguauguucuccuccuaacauuuuuucaaauauuagagaugucuugagaugcucuauaagaauuucaaccugguaagucaugauauaaagcaucuugagacaaauuuauagaauuaucauuuuauguauuuucccuuguuuuucaacauccuugcuuucugucuuauuaaauuauuuaaaauuuuaauuaacgaauaacaauuguauauauuuagaguacaaugugaauuuuugguaaauguauacaagguggaaugauuaaaucaagcuaauuuagcauaucccuuaccucaugucauuuuuuacggugaggcauuugaaauuuuuucuuggaaacuuugaaauauauauacaauuuauuauuaacuguagucaucaugcuguggugaucucaagaacuuauuccuccugugaagaaggugaaacuuugcacccuuugaccaacaucuccccauuucucuccccagcccaugccucugguaaccaccauuauacucuauuacuaugaguuugacuuuuuaauauuccacauauaagugagaucauggauuauuugucuuuuuguaccuggcuuaguucacuuaacauacuguccuccagguucauccauauucuugcaaaugacagaauuuccuucuuuuuaagggcugaauauuacuccauuuguguaucuauacuacauuuucuugauccauuuguugauggacacuuaggucaauuccauaucguagcuaaugugaaaaaugcugcagugcacgugagagugggagcacggauaucucuuauuuuaguuaguugaguacagaaaugggauugcuugauuauauggcaguucuauuuugagguuuucgaguaacuucuguacaguuuuucauaauggcuggacuaauguagacuccaccagugugcaggaauucccuugucuccacauccucaccaagguuuaucuuucaucuuuuugaugaaacaggcaugaggugauaccucauugugauuuuauuuuguauuuuccuaaugauugagcauuuggugauauugagcauuuucucaugaaucuuuugaccauuuauaugucuucuuuugagaaaugucuacucaaauccuuugcccauuuuaaaauuggguuguuuguuuucuugauauuguguugcuugaguuucuuauauauuuuagguauuaaccucuuauccguuguaugguuuauaaauacuuucucccacucuguggguugucucuuucuugaccauuuccugugcuaugcagaagcuuuuuaguuugaugcaaccccauuugucuacauugugcuuuggagucauaucuccuacuugcuucugucuuuaaucagggguccauuagguuugcaaaugaaauaacgugacuaagaaacaauggaaaacuauaaugucaaacugucgcaagacuagcaguguagugaagaugcagcuuagugacuaagucgugagcaugggccuuuguccccgcaaccuuacagcaugcucccugguaaaacuugagacccuccagcaacuuccuggcaaagggaaauguaguuggucauuguuucuauuauggauuuuuuuuuuaauugaaauugaaacagaugccgaaaucaccuguacucucguaaaccuuccgguaacacuuuguggauucugggauuugcgaaucaucauuuaagaaguauagccucuccucuccugagcugaccuccgucgccagccugguccccucccgcuguucugguuuggagauuucaaacccuuuaacuaugugaccaaaagaggcaaugggacaggcaaggacugaauuggguccugaaggauggauaaauauuugccauacagauaaggagggauugggagauacaauuuuuaaucucuuaagguuuaugagaagauucuggaaaaaaaucuguacuuaauaaccugucauauucuguggguagagaaaaauauacccugauuaaaauucuuauugugcuuuuaaaguuagagaaauauuaguucuaggagucggggugccggggggcagaggcaguuauguaguguaaaagcuucugcuucugguuuucguaccugccaacucuuccuccuuccaguuuuucuguccaggguuuaauaaaacuaaguacauuaaacuccguuuugaaaacucauauuuagucccucuaguuaguaaacuugaugugccuaaagucuucugugccagacacuguacugaacauuuuagacagaaaaguuuuaaaggagaugcagauggucuuggaggaaaccucuguauaguuguguucagaaacugaauccccuucuuuuuaaauguguuuuaaaauuuguauauauauugggaaauugaaaguauuauuugaaauaggcuguguagaauucaguaauugggggagggggcugggaaguggcuggguucuugucuuaugguguagaauuacucagcucugauugguugugaguuugcuuauggcuguucugauuuuuaccguugcaagauaauggcuuaguagugauuuucucuuguguugcaaauaucucaguuuaacugcugcuacaauacaaagccuuuaguccuaagaauuucaggaaaaauaugaaauuugaauacaugguaauacacucauuuuguaagguauucacuuuguguguugguauugauuuugcuauuugugucuaaucuaccggggaauugcuaaccucaggacacaaaugucagauucuggaccuagacucugaaccaaaugacauaagaauuugguucacagaacauuuuaaguuucacuguaguuguuuuuauaaaauacagaggcucaaugacaacucacuagauuuuugucaucuagaaaaacuauaauauuauauaugaaggcuuucaauuaguuuaaaggaaaaauuacagaaaguaaauauaacuuugcauucaauaauaaaacaauuuaaauauguguuuuaguuuuaagacaugguaaaaauuucuaaaguaauacucaagcuuaauuuuuagaaagaauucauuaacccaguugcauuuauuuuuuauugaaguaguaccauuaauauuuuuuucuaaauguuaucuuuuugugaaguaagcauucauuaauuguuuuaaccugugcaauucccuaagaaaacuguuuucacaaagacaguacuuugaaaaauguuuaaacuuuuauuucugggcuuuauuuccauucuuuuaauucuugauauaaagagcaauuccuuucaaauuauugagcacacauggacauauuaucuaccuauucuugcacuaaaaaaaagccagagagcuucugcauauccacuguugcuaucaguuguguaugucaaaaauauuuccugucagguuguuaauugagauagugcuggauggagccagcauuuuaaauaaaagugagaguaggcaaaaaacuaaaccuucuguuuacuagcccagaaagacuaacacguaacacucagacuaauauagaugaaauccaggagcuauggcucacuccuguaaucucagcauuuugggaagccgagacgggaggaccacuugaggccaggaguucaaggucagccagggcaauauagcaagacuccugucucugcaaaaaguuuuaaaaaauuagucagaggugguggugccagccuguagucccaguuaccccggaggcucugaggguggauuacuugagcuccggaguucgaggcugcagugagccaugaucgcaccacugcacuccagccugggugacagagugagaccuugucucuaagaaaaggaaauagauuuauuagugucuucuguuugccaggcuuugagccagguacaggacuagagugaugaaugaaacacugugucugcccucccaaguauuuuacgauccaguuguguaugauggcaaguaaauggguaaauaaugauccaguaugauaaaugcugcuaaagagggaagucaucuuaggaaaucaggaagaguuucccaguggaagagacaagcaagcugacauuuccucuuguuagcuuuuccuucuuaaacauuccaucagaauccaugaaauaaaccgauggaaaaaaacugauaaagauuuuuccuauuuugaaaaaaccguuaauuugcuucauaguccaggaaaaaaccaugcugguuugauucagaaguuaacagaucagauguguuugaccugguuuuuuuguugguggauuauuucaacuaaaguucucauuauacuuuaaaauauuuguuaaaacuuguaucccuucccaaauuauacacauuuaaaaauguuuaaaauuucaaaaauuaaacguaggacuuucugucuuauauuuuuaccauccaauuuauacauaaguauauauagacaauguacuguugcugcuuaaugcaaaauaguuguccuuaaagcaauuuagcauuuguuuacaaauauauauguauaauuuugcuccugauuugaaacugcaauuuuauauauuuagagggaaaaaagccaaaucaugcuagagugcacuagauuucauguaagagcuguuuggagcaguggaagagucucagaggacucaguguguuuucauacuucguguucuuucauguaaaccugauuugagaaauucgucaucacuuuuuccuuuacagaaacuuuauaacaagucagcauccauuuguagucucugguucaucucaaauguuuagccucuucuccuuuuuuuguuuuuugauggccuuugucauguuucauccuaaauuuauaucucuaggcgcaacuccucuugugaacuccaauuguucauucuuagucuuggcuuggauuucaaauuuaacuuaaccaaaacagaacuguuggacuugcucucaacucccuguaaccaaauuuguuccuguuaaauucuuccucaucuuaauaaaugguagcuaugaucuuccacuugcuucggccaaaaacucgagcauuauccugacuccuuucauuccccacaagccgucccgcaguaaguaaggccuguuggcugugcuacccaguucuccugcuaccgacauccgagucaccauugucuaucaccugggcuauagcagugacuuccuaaccauuuucuccacuuccauucaccuuuuuauagcccauucucuacacaacagccagaaugauccuuuuaaagcagaagucagacuccuucaugccuuggcucaaaauccaguggcuuucuaucuucuucagagcaaaacccaaauauggcaguagggccguaagugaucccacuccgucuuugagcucguguuuugcccccuacuuucuugcuccgcuuuggucacacuagccucuuugcuguuccucuguuaccacgggcauuccuagcguagggccuucgcacuugcucuuucuccugauaugagccuuuaucgccuauaaauacacacguucauuucagcagucccuucaggucauugcuuaaaugucaacucauccuaaagagcuuucuugacaacuuuuuuucucuguaaggaccuuguuucucuccuuggcauuuaucuacaugugacaguuuucuaucauuggguuuuuuaaaaaaucuguguauucaacuagaacuugagcuccacggaggcaggaacuuuuguuuuguuuuucuucacugcucuuuuccucgcaccugucugaagcagugauuuuagccagaaucuagauuuccugauucugguccagugcucuuuccaugguucugugugaccucauacaucaaccuuauuucacaaacgagguuuuuaaguuccuugagcacagucgauuguguuuuuuacugcuucugcuccgucccugcauaagacaggacugugucauguacccagugauggacuccugguaaauaccauggcuugacuaaaugaccuccagugcucccuguggucuucaccaacacgcaucagacgacaggcucagucacgggauacuucgcuuucuguaggaguaagagacaaguugcuaucacugaacagauacacaguggcauuuggaaacugcaugcaguuugaaaaaaucgugauacagcaggagucuaguuuucaauaaauagcuuauucauauucuggauuuugaacaguucauguaacuguaacuuugggguaguggauaaugagacugaaauuaaugguuccucugcugguuuccgucuguuuuuuuuuuuuuucucccaggagguugguauuucugcacuuaaccaccugauguuuuuagggggaguauaucccagauaaauucuguuguaagucaaagagcauccaugauuggcuuggcucuuucuuaagcaacuacuaagaugcuccuacauuuggguuugaacguuuuuuauucucuuggcuaugaaguuucuuaagugacucuaguaauacugaugguuccccuuguguuuacaggugaucugcaacucuuucaccaucuguaaugcggagaugcaggaaguugguguuggccuauaucccagguaugguguaugguacuucauguacuggaagacacacuuucauucccacccaaauccccagcccuuuggagguaguuagaaaggcaguugcugcagcuuguucaagagccaagcuuaaaacuuagcaauaaauuacaaaaaaauggaaaauguuaaguugaaagaaaacaguuuuauaaccccacauuauaugcugugauauuaacaaaggggcagaucucagaacuaaacucuuguucucagggggacuuugggugaagaaguugaggacggugggugcuaauuaaccaucgggcugauuuuugguuauuccccaguuuccugagcugcagcacaugcugauuucaccggacuugccguacguaucaguuggguucauguugucuuucgaguuggcacacucugagcccuuucacucaaggaggcaagaaaacucucaggcuuuggccccugaaugcucucuccagcuauugcugagcugacucuuaccacugagcuaugaaaccgucucuccacaagcacuauaggcacacccaguuucauuuuguuuuuaugccauaagaguccaaauacaaauuuagacuuucuaauaauugugaaucuaagaauucagccuuuuuucuuauuucucacaauugucauuaacuguaggucaggucuacugguaggugguucucaaaaggcaguaacauaggaugauucaaagcaugggcucugcguucaggccaccugguccaaauuccaucaccacuuacuagcuguauguccuugagcaagucauuuaauuucugugcaucagucucuuuaccuguaaaugauccucauaagauuguugugaggauuaaaugugaugaacaugcucaagugcaagaaaguguuucuacauaguaagugcucauucuaauuauuaccaauuccugauagcagcuuaaauccauuuuguuucccagaugguaagaaaugucccuccaagguaauaaaaugacuggaccauggcccaggaugcaucaggauguagguggcaaaauaacgucagcucucuauuuaagagcaaauaguccuaauuauuuuucaguguggauguucuagcaaaggcggccauuucuccaaaggagcucaacaaaugagauccuaugggagaggucagugguaucuuggcugcugcaucccauuaugucugaguauuuuuuuuuuuugagauggagucucacucugucacccaggcuggagugcaguggugcgaucucggcucacugcaaccuccgccuccuggguucaagcgauucuccugccuccaccuccugaguagcuaggacuacaggcaugugccaccacacccagcuaauuuuuuuguauuuuuaguagggacaggguuucaccaugcugaucaggcuggucucaaacugcuggccucaaaugauccacccaccucggcuuccuaaaguccuaggauuacaggcgugagccaccacacccagcugucuaaguauuucuuucugagucaguuucuuucugaccuucguguuggguugccuuauugacuguuaucuaaucagucaacuaugccccaauccccaaaaaggacucaggaaauuuuuuuauuauuaaaugacggaauucccuaguuagccugcaucuugaggagaauugcacuucgugggaggugugcuagugacauuucugugaaugcauccccgaguacugaaccccuggcauccugucaacccuaccugcugcugccccccaaaggaagguguauuuuacccacugcauuuguuaaauuuaguugacucuaccugcugagcugugacagucuuccccccuuuuuuuuuccaguaucucuuugcucaaucacagcugugaccccaacuguucgauuguguucaaugggccccaccucuuacugcgagcaguccgagacaucgaggugggagaggagguaaggaaacucaugcuucccagccuggccuucuuuccuaucaaagacccucucagcucggcccgucccuaaaacugauugugccugaggggacaacuuuucauuguccuucugccagugagaguauuuguaguucagucaccucuccccagcaaccuauccuuucuucucccaaauuacaaaugggcuaauuuuuuaggggagaggucaccauauuucuggaugaugacaguuccuguccugugugugagagagagaggaguuuguguaugacagaggguguguguuuuaugcacacacagggaauucaugaaaucuccucaguggcaacagcugagcagccucucauauccuuccgugggcaggggggggcaucccagcuugugagugggauccccaagacuucuucacucggaaggccacuggcuacauugaagguaaugaugcauguuaacuuugugcuaguaaagcaaacagcuuauacugucucaggcugacauugggacuugacaaacccaucagcaucucugggugaucauuucagcaaagaugcaaagggaauagaggacagggaggaugaccuccagcagugaacuggccuugaccccuccaguuugacagacuguccagccagccucuuuuggugcagaaccuucuuacaagacagcugcaaacgggcugcuccagggcucugaaccuaagcuugcacugguuugcacagugacuacccaugcugaguucugaguuacagauauuucuacuuuccagaaccccguuuccuucuccuuuccaauuugcuaaaguggauauuuauugcaaggaaaacaguacugaaagcuuuuauugcauuuaugcagcacucagccaauaaaaccucaacucagagguaccauauuuuauguagacagggauuuggcuuugacaagauucuccccaaacugauuuucaguggaaggagccacuucuuauacaacuacucgcuaaauuuccagauuuuaggaccaguguaugaaauauacugggauagaugucagugagauggacaauguaguuuuuucucuuuuuuuucuggggccgcaaaggacuucaaggcagguaagagaugaaaccgcuaucuauuuucagcaauauucauuugggggcugaagagcggcugcugcuguugucgaugaugacgauguuuuugcaaauuaaaaaacaaaccaaguaacuugacaaaagcaauuagaguugguuggaauuuucagaaacaacaaagaaaguuucuucuauuuuccuaggcucggcugccagucauucucccgugguugcuuuucauuuaguugaauaagacaccuugucuuuaggugcugcuuucacuuuuucacaucuuucucuuuccaucucuggagcaacaagcaaauccucccucuugccaaauacgagacauuuccacucaguguaaagcccuucagacucagauauuuuucccugugguacuuagcaaggcaucuucucaacaaaaagaagguucuccccacaaguccuucauauauaccaguuuaagagaauaaacauuucuccauuccauuuuguaggucuugcugaacaguguuuccccugauucaucaucguuucuguccacugugucucuuugucuuaauguuauaugcccuucgaggcuguuuguuaugauuuaaacaugucccccagauuccaucuguugaaaacuuuauccccaaauucuugcugaugcuuuguggagguggagucuuugggaaguaauccagauuagauaagguuaucagggugggaaccccaugaugagauugguggcuuuauaagaagaggacacuccugcugccaccucaugugacgcccucugccauguuaucaggcagcaagaaggcccuccccagaugccggugccaugcuuuuggcaucaugcuucccagacuccagaacugugagaaauuuauuuauaaauuacccagucugugguauucuguuaaaacagcagaaaauggacuaagauacccuuucaaucacaucucuuguguaacucuuucccugauuucccauauuagaagaaguucuuuuccuuugaguucucgcuuauagugguuauuaauacauuuuuggcacauauuauggcuguuuuggagaccucucuauuuagagcuuuaugaggacagacaaucgugucuuauuucuguaucucuuagcacuuagcuuugcauccaggaggcauuugauaacuuuuuguugaaucgacucucuauuauauugagcuuacucuaaugaccggcaguauuucuuguggggacacuauugccauuuugaaugggacaguucuucaucgugugggauuguugcaucauuggagaagacuuguguccuuggcgugugcuuaacuaaugccuguagccaucccccaacaacuaaaauauauccuaugccuuucaaacugaccccuuggagcagagguaggggagagggagagccaugagaaaagacaguuugaggcauugauuaagcaggguaauuccuauuuauuguacaaauauuagcuuuaaauuaaggaauaaaucuagacauuuuguguucccaacauacaaaaaugguaaauacaugaggucguggauaaccuaaauaccaucacuugaucauuacacaucguaugcagguagcaaaauaguaccuggaccccauaaauauguauaaauauuauguauuaauuuuuugaaaguuaaaauuccuugggaaaaaauuuuagacauuuugguaauuuccuaucaugaacuuugcauuuggcuuuagugcucauuagggcacccacaguuuuaauaugagcuauuugggaucugagugucagaauaugggauucacaauggaagacucaacagcaacugaggcagaaguuccucaaucaacauuuguugaguaaauuaaugagacuucuuaaagauaaaauaagagcuggaauagggcugggcaccguggcucaugccuguaaucucagcacuuugggaggcuaagggagguggaucacuugaggucaggaguuugcauccagccuggccgacauggugaaaccccgucucuacuaaaaauacaaaaaauuagccaggugugguggcgcacaccuguaaucccagcuacugaggaggcugaggcaggagaaucgcuuaaacccaggaggcgcagguugcggugagccaagaucgcaccauugcacuccagccugggcgacagagugaaacuccaucucagaaaaaaaaaaaaaaaaaaaaaaagcuggaauagagucucagacauuuacaaaugacuggcaguccucaguggugucccauggcuccugaaaggaagggaauaugaaagccagucuacugccaguuuaagaugggagcauuucaaaccucacacaaggagagcuggaaaauugcacaaggucugugauaacagaaguugccauggaaauuucucaccccauguuucucucuauauaaauccauccuuuggacccucuuuggacaguuuccuugcaaaccagcaacauuuauaauacuuugcuauuuaaggcucuccauuguaaugcugaguuauugggucuuuuuuuuuuauuugacuuuggauuuuugucuccucauucagccgccuccuacagagagagauguguaauaucauuuaagucauggcucacuugacuggauugcugauggcuaccuuuucaaaauuaucuuaaauaugagauucauuuguucugauaguuuuauaaaacauggaucagggaggaaagcuggguaggccaaagcagucuuaugguaguuccugguuaaaauaacuuguagcuguuacaaauaaugccauuggcugccagcauucucuggcgccauaucaacugggagaaaugugauugacacaaguugaaugcauuaguaucccuaaugucagucuuaaucugaugucuuuugggauuaagacagucuguuucuucuguuagucaucuuauuugcuaaaccauuaaacgaauucacugcauguuuacuggaugucaggaguugguagcaguuuuagaaaccuucucuaauacaaagauuauuaagacccagcccugacuucaagaguucaagguauaguugaggaaacugacagagaacagaaaacaauaauagaauuaagaugcacagugguguaaaugggcacaggcuuacagcagcucagagcaggagcacucgagugauuaguaaggggagggaguggagagugguuaaggaaugcuuccagaggacugacuccuagacucugaaaggauccauggaguuagaguuggaugaggcuggaaaaggcauuguagacauagacacagaggccagggacagaauggugaguucaaggaguaggaagcaguucucaucaauagacgacgaaagaauuuagaugugacccgaauuugagggaagauguagggaucagacugacaaaccccaugggagccuuaucacagaccuugguuuagcugaagguuucauaacauuggcuggucuauaggaggcgcccaguaaauauuuguguaagggagaaggacgagcagcgggacaugauugaaggguuucagcaaaggaacugcguggccagauuuucuuguuuuuuuuuuccugcauguuuacaaauguuacuguuuuuuauuguauguacuauacauaaaacacuugaagaaaacaauuuuuaaaaccccacccaauucuaaccccugaguuagauuugggauaucacaaacgaaacauuuuacucaguguacauucaauuuuaccucagucacuguugcuguagugugaguuuuucucaacucguugaaccauaugauugaaacgugauguuuccuuugccuuucauucacuuuuuguauauacgaccauggcuaugaugauagggaauauuuauagggugauucaauuuaggaagcaauagaugaagccuaauagguaaaaacaaaaaacaaaacccaaggacuacaaaauugaguaagaccuaaguagucuguaccaucuuuggaaucuuagaaaacucagauaauguuacauauucauuuuuuuuauuuuauggaagaaaauguaagguuuaaacugggaaaugauuuguucagugcuacacuuacuacuacgcaguguggaggggguuaguaauaaagcuucauucucaggauugaaguaacaaauuauuuaccuaggacagugcccagcacaugaugcuuacuacauagugauuuucuucuuccauuugugauuagaguuuccugaagggaaaaguagagcucaaauggugaguguccaaaaaaaaaauaugacauuagagauuucucauaaauuguggaaacauauuuagagaaucuaucaaaacuauaguaaaucucaucuuacguaucaaagcagaauaauuggucuuugguggagguggucuggcugauguuuggacucggcaagaaagauugcuacaacuguugaauaacauuugguuuguguauagaaguguugguccaugaugacaucuacacagauuauuuuccauucuuaaauuaacauuuucuauaggcagucuuuguucuaauacaugcuccucugaaauugaagcugaaaguguuaugaccaguuucacuuuaaaugaagguaccuuuaagucugaaaugagccggugcuuucagguuuaggcuguugaauacaaauacauacaaguuugauuuuuguuuuuggcuuaagaugauaaaauuacuuuuaacgggguuuuauuaaauuauauucaauaaauaacuaaauugugauuucacaguuaaauucauuauaaaagucccugccccauucuuaagaauggauaaguguaaaagaaauguaauuucauuuaccuuuugaauuaagcuaaaagaauauuuaguaaccuaauugugauuuuuaaaaaaauaauuucaacuuuuauuuuagauucagggggcacaugugcagcuguguugcauggguauauugcaugauagugagcuuuggggugugaugaaucccaucacccugguagugaacaugguacccaacaguuuuucaccccuugcccuaccucccucucuaguagugccagugucugucauugccaucuuuauguccaugaguacccaguguuuaguucccacuuauaagugagaacauuggguguuugguucgauagauucucuaaauauuuguuuccacaauuuaugagaaaucuguaauugcuggguuugguuuucuguuucugcauugauuugcuuaggagaauggccacuagcugcauucauguugccacaaaggacaugaugucauucuuuuuuauggcugcauacuauuccaugguauguguauauauauauauauauauauacaccacauuuuuuagcucacuguugaugggcacuuagguugauucuauuucuuugcuauugugaauaguacugugaugaacacgugagugcauguguguuuuugguagaaugacuuauuuucuuuggguauauacccaguaaugggauuguuggcucaaaugguaguucugagcuccucuccaaacugcuuucaacaguggguuaaccaauuuacauucccaccaauaguguauaaguguucccuuuucuccacagcuucaccaacauuuguuauuuuuggacuuuuuaguaauagccauucugacugguguaagaugguuucucguugugguuuugauuugcauuucucugauuagugauguggagcauuuaaaaccauguuuguuggcugcugguaugucuucuuuucaaaugugucugcucaugucuuuggcccacuuuuuacuuggguuauuugcuuauugaauugcuuaaguuccuuauagauucuggguauuagaccuuugucagaugcauaguuugugaauauuuucuccuauucuguaggucguuuguuuacuuuguugauaguuucucuugcugugcagaaacucuuuaguuuaggucccacuugucaauuuuuguuuuuguugcaauugcuguugaagacuuagucauauguucuuuccgaaagcugacguccagaaugguguuucuuagguuuucuucuagggugcauaaagucuguggucuuacauuuaaauuuuuaaucuuuguauuaauuuuuauauaugguacaagguaggugucuucugcauauggcuagccagccguccuagcaccguuuauugaacaggauguccuuugcucauugcuuauuuuuguaugaccacuuuucuauguguaggcaagguugggagaaugagcgucggggugauguaauaauccagggaagagauaacagugguagccugaagucggggagcucaggugguggcuugugauaggguaccugaagacuauaauauuaagaagauaaaauuagcaggauuugugaaacaaggacacaacuugugaaacaagagacacaaagauacucagguuugacuuuaaaaagaagugacauuuuucaggcuuuuuuccaguucagagccaguauuaacagaaacauucauaacugugaucacggaauucuagaaaugaaacaaggucuaauuuuaacuuggucaucuuuuuuuuuuuuuuuuuuuuuuuuuugagacggagucucgcucugucgcccaggcuggagugcaguggcaugaucucgucucacugcaagcuccgccucccgaguucacgccauccuccugccucugccucccgaguagcugggacuacaggcgcccgccaccacgccuggcuaauuuuuuguauuuuuaguagagacgggguuucaccguguuagccaggauggucucaaucuccugaccucgugauccuaccgccuuggccucccaaagugcugggauuacaggcgugagccaccguggccggccuuaacuugcucaucuuauccacucaguuguagacaaugaaaagaugguuucauggaaaaggaguucauuuugucuugagauuuuaauguaagcuauguauucaagaucuagaaaaucuccuucauuauauuacucuaaugucagaaaugauuuacugcauuuucuauaagagcugcacuaaaauggcagagcaguggucaauggcauuaauauuuuaaugcaauuuuguucugugccauuaaggugucuacugaucaauggccaaguuucacauauacauucccacuaaaugagccuuacauuuacugagcagauauuccauuacaacuagugagucaaugagucuuuaauaaagguuuuuaucuuuggcuaauaacaugauuuuagcugucauuaccaguuaguaaucuggcuguuuuuucccaaaaauaugaauaaaauauuuuugccauuaagcacuucacaauugauaaccagauauucugcagacuucauuggcauaaaagaagcacaaaaauggguggcuuucucugagguaauggggcagucgccauaggaagagguguauuugagccaagcuuggaggaugagaggcucucaggaggcugaguguggaggagaggcucgcuuagccagugaugcccagacacauguuggcaugguguucauuguuucagaggucuagcaauguacauaacugugacaggcugggguucagggagagacauggaggcuagaaaggcagacagaaaaacagcugagggaaauccuugugugccuuuauucaagggcagugagaaaccaucgcaaguuuuuauguagagaaaugacgugaucacaugugaguuuuaggaagaucucucucaaagcaguuuagaagaugaaagguacacugcaggcagcggggaagccaguuagaaagccauugcguaguccagguaaugguuccaggcaguuacaguaugccgagggaggcuuuaggagcccauuuauugggguuaaaugaaauaacuagucuccuguuggccauucacugccugacaagaucacucaugaguuuuggcccuuguaauaaagucuuggguuagucaagcacauuuuuuucuggcaugacaggcccuggaguuaguggcuucacacugggcacacuguaaucucccaauaacuacuguccauuuaccugcucugauaaugggaguugaugacuaagagccauugggcuggauucagaauuaguguccuagaguuaacccaagaggggacauagggaugcgcucauuugcuaccucaccuccuguaaggaaacugggacccacagagccugauaguauaagaugaaucuaucuacugucccagacuuacucauaggcuguuucaaaaagugagcuuggaaauagguuauuuggaauuuggaacauagcauucauuagaaacaagaggaacuugccugguauaggugacccuuugugccucagaggcaacccuggcuucagaucaugaagcaagagaaacauggaggaaaucaaaaaguggcuguugucucagcugaaggaucucaguugccacagaacauucucuaacacaggugugaguauuuuagguuugacggugcuacggacacuccuuaagggacgccagcuucuucuacagcccucucucccugccaaguaugagaagcagccauguaaaaguaaaaagagcaucagacuuaucaagagaucugggugcagucuucaguguuaccugaacccaagaccuuugccaguuuuuacugugcuaugcugccucgccacaaacaguagauacucaguaacgucauugucuguaucucuuaagggcagauauucuuguuucuguguguggagcagcauguuaugguugccuaaugugaagaaucuauggagagccagccagccagaucaggcugugacuccugucccguuggugauggugacggccaugguggauuugacagaucuggcuggccagcccagccauccaccaucaccccuacagcuugagagaguccuucccaaagcuuuguuuucugccagagaggguggcugccuuugcccuacuaugauuucaaacaaguaagaucaugcuuuguagacaugagaugcuuucuuuuaaguauaacaaaaaccacauggaguuuucugcucuagggaguuuuuugcaucccuucaguggauaauccugccuucuugcucugccaaagucuucacuucuccccccaccacacauaccgccaugauuacuuucuacuuuuaaaagcaaagaaguaauuucuacagucugguacaagcugauauaugauacaggaaaagaaaaacuagagcagguaagggaauuggguuguuacucuuaauagggcauugagguuagaccugaacgagaaagugggauuugacugaaacucaaaggcgaugagggagguugucauaguaaacggggcagaagggcagagggaacagccagugcacaggccuugagguaggaguguguguggagccagacgggaggccagccugguggagcagcagcaaugagggaaacugggaaaugagagggaacaggugggauuaugugaagccauugcuucucuaccuaugacgaaggaccaguuuuucuuuuccuucauaaucuauugcagaccaguauuuuuauaaaaucuagugaaaauaaauuauuagaaaaaugaagggcugggugcaguggcuuacgccuguaauuccaugggaggucaaggaggaaggauugcuugagcccaggaguucaagaccagccuggguagcauggcgaaacuccaucucuacaagaaauacagaaaauuagccaguguggugguacaugccuguagccccagcuaccugggaagcugaggggugggaggaucacccaaaccugggagguugaggcugcagugaguugugaucaugccacugcacaccagccuugguggcacagugagacccugucuuuuuuuuuuuuuuuaaagcccaauguuuuauuauuagagucacauaaaauuacccuuaccaaauuaguaaaaaacauuucuaaauauugacuuuguuucuugacucaugucgucauggacugguaacccacagugcgcacuggcaccaaugcggggaccauacuuugaauugcacuuggggaguuagaaggaccuggccuucacucaggcaaaguggggagcuguugugauguuucaaacagaacaugucaucugacauauuuuaugugaaucacucuggcuagaggguggagugcagggggccuggagaaagaaucagagagaccaguugugagacuauuacauuuuacaggugagagguaaugauggcucagaccaggaugguggcacuggaaaagguaaaaagugguugauucuggguaguuuuuaagguggagcccgcagaauuuccugguggauuggauggcaaguguaaaggaaagagugaagucaaggaugacucugaggcuucaacuuggauaagucaaaagaugaguuacugucaacugagagugagaaugcucuagccgagauggaacagguugaggggaagaucaagcauucuguuuucuggauuuugaauuagacuuucauaagagaucuaaucaagugcaaaaugcucaagcauuaugauguugccuaaagacccgugacuuaaugggacucaguguuagagaguguccgaggaguccuuuaaauauauccucucauuuauaacccuucaccauccgaggcaggggauauuacucugaaaggguguaaggcagucaguuugaaugcuuccaucaguggugguacucucaaguuaaacucuccccuauuuggaaauuauucuacccccccuuuuuuuuccaaaccuagauacaaauaagagaacuguuuucucauuucaaagauaccaaauuuggaugaccuuaaauuccaugaggcagcuauagaauugguuagaauuuaagagcaaucuggcuguaucaucugccacccuuucgguugccaggauuaauuuggcuucucugauugcuaaugguuauagaauuuauuagcaaaccuuaguaaacauacaacaguuuuugauauuuuccuguagugaaaaaaacuaagauacaaaaguggguagagaucauaagacccguucuuuaaauauaugauacauauauauuuaccacauagcaaagacugaaaggaaauagauuaaaaauuuacgugugaucauuuggguagagaaacuauaagcaguaccuucucucuuauauuuuugguuuauaauaaaaacaaguuuuacuccaauaauuagcaauaauaauaaccauuuguuaaagaaaugagcacagcagauguuucagcgcuucccucucucuggccugcacagcucaccaucugcuaccuggauaugcugaugaccagugaggagcgccggaagcagcugagggaccaguacugcuuugaaugugacuguuuccguugccaaacccaggacaagguauguaguauggaaccagauugaaacaccuccacggcaaaaucucaaugaucuucagagaacucugccuagauuucauaaacccaaaaguaaugacccucaguacaugguaggaaacagauaaauaagauaacucauugaacugcauauauuuuguuuccuggaacuuuugucacccaccaagcugagauuuaaccgauuuaaccaaagguaaggaucuguggaguuuagagucaagugggaauguaggcauuaaauauuuaauuaaaaggaugggugaaggccagagugcuaguagaacauauguaguaaguggguugaauuacguuaugauugacaaguuauugcucgguaaacaacauaccaaguuuuaccuaguuuauuucuuuaaaaauguuuuuuaaaauaaaaucagguuuguugagguacaauuuacaugcaaaaaauuuacccuacuuagugagacaguucuaugauuucaacaaacccagucaugaaacugccaucaaaaucaagauacagaaugguuucguuucccaaaaaagugcccucaugucccuuuauagucaacccuaccaccccuaccccaaccccugauaaccgcugaucuguuuuuuauccuuauaguuuuuuccuuuuguuuuuaguugacacauaauaauugcacauauuuugggauacagagugauacuuaauuauguguauacuauguguaguaucaaaucaggguaauuagcauaucugucaccucauauauuuaucauuucuuuaugucaugaauauucaaaauccucuuuuagcguuuugagaauauacaauaaaauaaagugaaccauaucccccuacagugcugcagaugagcagauucguuccuccuaaguuuguguucauuaaccaaccucuccccaccuucuuagccucuaguacccacaguucugcucucuacuuccaugaaauccauuuuuuuuaauucccacauaugagugagaacacggaguauuuuaucuuucugcaccugacugacuuugcuuaacauaguguccucuaggcccauccauguugccaugaaugacagaauaucauuuucaugacugaauaauauuccauuguguauguaugccacauuuucuuuauccauuuuuccauugauggacauagagguugauuucaucuuaguuuuucugaauagugcugcuguaauaaacauggggcugcagguaucccuuggauauacugauuuucuauccuuuggauaaauacccaguacuguaauugcuagauuguaugguaguucuauuuuuaguuuuuugagaaccccucaugcuguuuuccauaauggcuauacuauuaggugggugcaaaaguuauugcaguuuuugccauuaaaaguaauggcaguggccucauuguagaggccuuucaccuccuugguuaaauuuauuccuaggugucuuuuuuugggaguggguagcuauuaauuuuaauggcaaaaaccacaauuacuuuugcaccagccuaguaugagaguauguuuuccccacauccuugccagcauuuguuauuuuuauuuuuuuuggucuuuuugauaauagucauucucauuggggugagaugacaccucauuuugguuuugauuugcauuuuccugaugguugcugauaagcauuuuuauuggccuuuucuauauguguuagauaaauaucuauuuagauccuuugcccucuuuugaauuggaauauuugugauauuuuugcuguugaguuguuugaguuccuuguauauucuggauauuaguuccuuuuugaaugcauaauuugcaaauauuuucugccauuuuauaguugucucuucacucuguugaguguuuccuuugcucugcagaagcauuuugguuuaauacagucucauuuaucuauuuuuguuuuuguugcuugugcuuuuguggucuuagccauaaaaucuuugccuagaccaauguucugaaguguuuccccuauguuuucuuuuuuuuuuuuuaaauuauaguuuaaguucuagggcacaugugcacaacgugcagguuuguuacauauguauacaugugccauguuggugugcugcacccauuaacuugucauuuacauuagguauaucuccuaaugcuaucccuccccccuccccccacaccacaacaggccccggugugugauguuccccuuccuguguccauguguucucauuguucaauucccaccuaugagugagaacaugugguguuugguuuuuuguccuugcgauaguuugcugagaaugaugguuuccagcuucauccaugucccuacaaaggacaugaacucauccuuuuuuauggcugcauaguauuccaugguguauaugugccacauuuucuuaauccagucuaucauuguuggacauuuggguugguuccaagucuuugcuguugugaauagugccacaauaaacauacgugugcaugugucuuuauagcagcaugacuuauaauccuuuggguauauacccaguaaugggauggcugggucaaaugguauuucuaguucuagaucccugaggaaucgccacacuguuuuccacaaugguugaacuaguuuacagucccaccaacuguuuucuuuuaguauuauaguuuccaggcucacaguaguuaauuaauuuugguugauuuuucuguguggugacagauaaggguuuaguuucauucuucugcacguggauauccacuuuucugaugacaaauaauugaagagguguccuuuccccacuguguguucuuggugccuuuguugacaaucaguugccuauaaauaauguguauuuaauugugcguuuucuguucuguuccauuggucuauaugucuguuuuuauaccaauuccauguuuuuuuuguuaguauaacuuugugggauauuuugaaguuagguagugugauaccuccagcuuuguucuuuuugcucgguauugccuuggcuauuuggggucuuuuguguuuucauguuaauuuuaggaucauuaguucuauuucuugaagaauaucguugguauuuuaauagggauugcauugaaucuguagauugcuuuggauaguaucaucauuuaacaauauuaauucuuccaauuaaugagcaugguaugccuuuccauuuguguucucuucaguuucuuuuaucaauguuuuauaguucuuauugcagaggccuuucaccuccuugguuaaauuuacuccuaggugucuuuuuuugggggguggguagcuaguguaaaugggauuacuuucuugauuucuguuucagguaguucauuauugguguauagaaacacugcugauucuugcauguugauuuuguaucuugcagcuuuacugaauuuaucaguucuaaggguauuuugguggagucuuuuaguuucuccguauauaaggucauguugucugcaaagggaggacaaugugauuucuuccaaguuaaaugcucuuuauugcuuuuuaaacauuuuuauugauauaugauaguuguacauauuugugugguauaugugguauuuugauaccagcauacaauguguaaugaucagaucuggguaacugggagauccaucuccucaaaaauuuauuuauguugggaacauucuaaauuuucucuucuagcuauuuugaaauauacaguaaacuauuaacuauaguugcccuauugugcagcugaacacuagaucuuacuccuccuauugagcuguaaucuuguaugcauuaaccaaccccucuuaaucccucuaccuacuacucuuuccagccucaaaaccacuauuguauucacuaucucuauaaaaucaccuucuuuuuaguucccauguaugagugagaacaugagauaugucuuucugugccuggcauauuucacaucaugugaugucuuuaaguuccauccauguugcuacaaaugacaggauuuuauuacuuuucauagaggaacuauauuccguuguguguguguguauauguguguguauauauauauauauggcauuuuuuuuuuuacuuauugauggacauuuaggucgaccccugccuuggcuauuuugaauagugcagcaauaaacaugggagugcagaucucucuuugauauucugauuuccuuucuuuuggaucuauauccaacguuuggauuguuugguuauaugguaguugcguuuguaguuucuugaggaaccuccuuacuguuguccauagugguuguacuaauuuacauuccaccaacaaugugugagccuuccccuuucuccacauccuugccagcauuuguuauuuucuuacuuuuuuauaguagccauuuuaacuggggagaugauagcucauugugguuuuaauuugcauuucccugaccauuaauguuauugaacauuuuuuuauauaucuguuggccauuucuaugaauucagcauauuuugccuguucuuaauuggguuguuuuuugcuauugaguuugaguuccuauauauugugauuauuaaucucuuguccaaugaauacuuugcaaauuuuuuuuucaauucuauagguuguuucuucauugauuauuuucuuugcugugcagaagcuuucuagcuugauuugaucucauguuucuauauuugcuuugguugccugugcuuuugaggucuugcucaauaaguaguugcccagcucaaugucugaaguguuuacccaauguuuucuuauaguaguuucaugguuuuaggucuuauauucaaauauuuaagcuguuuugauaugacuuuuguauauggggagagauaggggucuaguuuuauucuuuugcauaugggcuaucuagauuuuccuuucucaauguauuuucuugaugacuuucuugaaacuccauugacuaaauguguggauuuguuucuacguucuuucauguguuccauugguccauauguccauuuuuaugcuaguaccaugcuuacuuugcuuuuuguaauuuuauagagcauuuucaagucagguaacgugaugccuccagcuuuguucguuuuguccaggauugcuuuuguuguuccauaugaauuuccggauugccuuuuucuuuucaugugcagagugucauugauauuuugauauggauuacauugaaaauguagauugcuuuggauagaacggucauuuuagcaguauucuuccaauccacaugggcuaucuuuccaauuuauuauguucucuucaauuucuuuuaucaaugcuuuauacuuuuauuguagagaucucacuuuuauuaaguuuaguccuagguguuuaugcuauuuuauuguagcuguugcaaaugggauugcuuucuuuauuuguuuucagauguuugcuguuggcauauagaaaugcuacugauuuuuguauguugauuuuguauccugcgacuuaacugaauuuaucaguuuaacaguuuuuguuggagucucuugguucuagauguaagaucauguugucugugaacaaggcuaacuugaauucuuccuuucuaauuugaaugcccuuuaauuuuuucuccugucuaauugcucuggcuaggaauuccaguacuguguugaguaaaaguggugaaaguggacaucuuugucuuguuccacgugguaaaggaggggcuuucaguuuuucccaauuaagugugaugcuagcuugggguuugucauauauggcccuuauuuucugaaguauguuucccucauacccaguuuguuaagauuuuuuucaucaugaaggcauauugaauuuuauugaaaguuuuuuucaacaucuauugaaaugaucauaugguuuugucauugauucuguuaaugugauguaucaccuuuauugauuuacauauguucaaccauccuuccaucccugagaugaacccacuugauuaugaugaaugaucuuuuuaauguugaauuugguuugccaguauuuuguugaaaaaaaagugugucuaugcuaaucagugauauuggccuuuaguuuuuuguuguugugccuuugucuaguuuuagcaucaggguaaugcugguuuuacauaaugcugguuuuauauauauacuuuggaaguauuuccuccuccuaauuuuucuggaauagugggaguagaauugguauucauucuuuuuuaaauguuugguagaauucagcagugaagccaucagguccuaggcuuuucuuugaugggaggcuuuauuacuguuucuaucucauuacuugcuauuguucuguucacguuuucuguuuucuucacgguuuaaccuugguaguuugugugugacugggaauuuauccauuucuucuagguuuuccaauuuauuggcauacaguuguugcuaacagucucuaaucaugcuuugaauuucuggggaaucugguauaauguccccuuuuuccucacugauuuuacuuauuugagucuuuuucuuucuuagucuagcaagucguuuauuaauuuuguuuaucuuuucaaaaaacuuuuuguuucauugaucuuuuguauuguauuguucuuuaaucucuguuuuguuuagaucuguuuggaucuuuauuucuuaccuucuacuaauuuugauguugguuuauucuuguuuuucuaguuccuugagauacauuguuagacuuuuuaacuugaaaucuuccuaccucuuuuauagagguguuuauugcuauaaacuuccaucuuaacacuacuuuugcuguaacccauacauuuugauauguuguauguccauuuucauuuguuugaauaaaguuuuugaucuuuuucucaauugcuucacugacccaagaagcauguuuaauuuucauguauuuguacagccaaaguuucuuuuacugauuucuaguuuuauuucauugcagucugaaaagguaccugauaugaucucaguuucuaaaaauguguuaagccuuguuuagaggacuaauguaucauuuaucuuggagaauguuccauuuacugaugagaugaaaguauauucuacagguguuggauguauguucuguaaacaucugcuggauuccucugugguacagauuaagugugauauuuuucuguagauuuucugucuagaugaucuguccacugcugaaguccccaacuauuaguguauuggggucucucugucuauuuagcccuaauaauauuugucuuguauaucugggugcuccaguuugggcgcauauauguuuacaaugguuauauccuaucgcugaauugauguuuuuaucauuuuuaaugaccuuuugugucucucuuuguuuuuugacuuaaugucuauuuugugugauacacuacagcuacuccugcucagcuuuggcuucuguuugcguggaguauuguuugucaucccuucacuuuuuuuuuuugagauggagucucacucuaucaccacguuggagugcaguggcgcgaucucagcucacugcaaccuccaacucccugggucaagggauucuccggccucagcuuccugaguagcugggauuacaggcacgagccaccacgcccagcugauuuuuauauuuuuaguagagacaggguuucaucauauuggccaggauggucucgaucuccugaccucgugaucugcccaccucggccucccaaagugcugggauuacaggcgugagccaccaugccuggccaucccuucacuuuuaaucuggcuuuacaauugaagugauuuuuuuuguaggcagcacauaguuagauucuuuuuguuguuguuauuccuaccuauccagccaaucuuuuaauugggggaauuuaaaccauuuacaguuaugguuauuuauaugagaggacuuaguccugacauuuuaaaaauuguuuucugauuguuuuguaaauccuuuguucuccucuuccucuuguauuguuugccuuuacaguuuggugguuuucuguagugauaacauuugauucccuucuuuuucccauuugcguaucuguucuaucagugaguucucuacuuugguguguuuucaugauggcaaauauuguccuuuugcugcuggauauaggacucuccuaagaauuuuuuuuagagcuagucuaguggugaugaauuccuuugguuuuggcuguuauuucguuaaauagguuuucucugacuuuaaauuauuuuauuuuuuaaaaaauuuguggguacauaguaggggcauauauuuauggaguacaugagauguuuugauacaaggaugcaaugugaaagaagcauguuaaggaaaauaugguauccauccccucaagcauuuauccuuugaguuacaaacgauccgauuacauuuuuuaaguuaucuuaaaacauacaacuagguaaucauugacuauagucacccuauugugcuaucaaauaguaggucuuacccauucuuucuauuucuguuguccccauuaaccauccucacguccccuguaaaccacguacgauuugcagccucugggaagccuccuucuacucucucuguccaugaguucaauugguuugauuuuuggauaccacaaauaaguaagaacaugugauuuuuuaguaauaaauaaguaaauaaauaagaacgugugauuuuucuuagauaccacaaauaaguaagaacauauguuugucuuucugagacugguauuucacuuaauggaauaaccuucauuuccauccauguuguuacaaaugacuggaucucauuuuuuucuggcugaauaguacuccauuguguauauguaccacauuuucuuuaugcauucaucugcugauggacguuuaguuugcuuccaaaucuuagcuauugugaacagugcugcaacaaacauaggagugcagauaccucuucgauaagcugauuuccuuuguuuuggguauauacccagcaguaggauugcuggauccuaugguaguuauauuuuuaguuucuugaggaaccuccaaacaguucuccauagugguuguauuaauuuacauucccaucaacaguguacaaggguucccuuuucuccacauccucaccagcauuuguuacugcuugucuuuauuauaagccauuuuaacuggggugagaugauaccucauugugguuuugauuugcauuucucugacagugauauugaacaccuuuucauaugucuguaugccauguguaugucuucuuuugagcaaugucuauucaaaucuuuuguccgucuuuugaucagauuauuagauuuguuuuuucuauagauuuguuugagcucuuuguauauucuggugauuaaccccuugucagauggguagcuugcaaauauuuucucccauuccauggguugucucuucgcuuugcugauuguuuccucugcuaugcagaagcuuuuuaacuugaugugaucccauuuguccauguuuucuuugguugccuguguuuauaggguauugcucaaaauaucuuugcccagcccaguguccuggagauuuuccuuaauauuuucuuguaguaguuuuauaguuugaggucuuagauuuaagucuuuaauccauuugauuuuauuuuuguauauggugagagauagugguguaguuucauucuuuugcauauggcuauccaguuuucccagcaucauuuauugaagagacugucuuuucuauguucuuggcacuuuuaucaaaaauuaguucaccauagguguguauauuuguuucuggguuuucuguuguguuccauuguuccauguuucugcuuuuauguagaccugaagccagcacagugcugggucucgcccaagaccugcuguaaccacucccuggcugcugacuguguuugcucaagggucuggggcucuacaaucagcagguggcaaagccagcaaggccuaugcccuucccuucagggccaugaggucccccaggccccagguggguccagaaguacugucugggagucagaccuuaaaagucuaccugguauucuuuuguauuacgacugagcuggcacuaaaacuguaagacucaaucuuucucagucuucccuccuuuuuccaaaggcacaggagccucaccccgcagccaccuuuaccccuggccacauggaguauugccagauuacugccaacauucccuuaaggcccaaggucucuaaagucagcucguggugaauguugcagggauuugggacucuagucaggggagaggacugcccuccggccgaaggcaggcccagaaaugcuaagacucaagucuuggagucagggaccccaggaacccauucuugggguucuugguaccuaagauguugguaguugagucccuuuuauuuuucucucugcuuuucucaaacagaaggaguuuugcccuguagcuaccacagcugguuaugugcugagucucaccugaagccagcaagucccggagacucacccaaggccuucgauguaauucaugggugucacugcugguuauucggggcccaaggguucuucaguuaguaggugaugaaugcuggcaggacuggguuguuuccuucaaggcagcggcuucccuuccggcucagaguaugucuagaaaugucaucugggagcuacggucuggaaugggggccucacgacucugcuggugcccucuccugcuguggcugagcugguauccaagaugcaggacaaaguccucccuacucuucccuguccucuccucaagcagaaggaaggggucucuuuuggagccaggugcugugcacccuggggccaggggaggggugacgccagcacucucucggcugucccagcuggugccucaguaugucgcaugcccccuaaguccacugucucugggccuaguucagcuguaggacuugccuacgaguugcagucguuauggccuagacugccuuucagguuuacuuagaggccaacaguacuuuggcccucaguggugagguuugcaggcacucaaguucggaccucugggauuggagauugcccccuggcuagggcuaguuuaaaugcucccucugugggcaacaucaggugaguuugguuugcuuuuccuuucuccucuaacaggacagcacugaguucagugccucacaauugcuguauucuuccuuguaugagucuguuuucacacugcuaugaagauauuaccugagacuggguaauuuacaaagaagagaguuuuaauugucucacaguuccacaugguuagggaggccucaggaaacuuaaaaucauagugaagaggaagaggcaugucuuacaugguggcagaugagagagaaaacgaagagcaaagcaggaagagcaccuuauaaaaccaugagaucucaugagaacucacccccgucucaggaaaacagcccccaugauccaaucaccucccaccagguucuucccuugaccugugagaauuauggggauuacaauucaagauguacuucccauaauccccacaugaccuggaugugagacauggagucaacauuugcagccugacgaugugguagaaaagaaaaacccauauucuggggagaaauucaagcuggcuacagaaauuugcauaagaaacaaggagccaaauguuaaucaccaagacagcggggaaaaugucucuagggcaucucagagacuuucacagcagccccucccaucacaggcccagaggccuaggagguaaaaaaugguuuuaugggcaggguccagggccccccugcagugugcagccucgggacuuggggcaucccaccugcuccagcuguggguaaaagaggccaagguacagcucaggcuguuauuucaggggaugcaagccccaguuacaauuccagaugagauuuggguaaggacacggagccaaacuauaucaucccuucccuagcacccagagaugcucuugucaccacgcaccacugcugggggucagggagagguggcacuggcgauucaggacaguuuguucuaugucuucagugccccuuuucgcaauaggaaguuaaaagccaguacugugaaugcucaucuggcguuugguucucaugaagguguuuuuuucuguguggauaguuguuaacuugguguccuugugggggugggggcaauuggugaagcuuucuauuccagcaucuugcucugccuguuuucucugacuuuuauaauuucuucuccuuuuggaaauuucgguauuugaauacuuuuuacuuuaugauguccgauaugucacuuaggcuuucuucauucuuuuuuguuagauuuucaccuuuuuuggacuguguuauuucaaaagcucugccuucaauucagaaauuccuucuucaugaucuagccuauuguugaagcuucucgauuauauuuuuuaauuuuguucauugaauucuucagucuuaggauuucucuuugguucuuuuuacgauaucucuuugaauuuauucagaucauuaacugcuuuucugaguuuuucauauuguuuuaccuguguucucuuguauaucacugaguuuccuugaggucauuauuuugcauuucguuucaagcauaucauagauuuccuuuucuuugauaucuuuuucugaagaauuauuguguugcuuuguaggugucauguuuucuuuuucgcauuucucguguccuuacgucugugcaucuggugucauaauugcuucuucuaaguuuuuggauuggcuuucauagagaaugacuuuuucauguagauauauuuacaguauuuguuggguagaguucuuuagcucugauuuuggguaggaacaguacuguggucuucauauuauuucuuuguccauaaucagugucagcagugaucacagguucuuuaguggcuuaggcugugauuguuaguggaggcuugggcaaccuuugcuggggauggagacaccaggugggcugguucuuaggccccuuguuggcacauguagguacuggugaugguggcagugggccaggcauucugguccuuaggugucuaaaugacaugagacugucugcaggccuuguaauggugcauauggcaccacuggagauggguugacccaggccuguccucaauuuccuugaugccaugugcaggcuuauccuaucuuccagcccccagauaggauacagauggggccucuggacauugugccccagagagcugguucucagguccccugaaggcauguacaggugugugguggccuuguccuuggaagggguggcaucgcuguagguggcaguggccccaggcaggcagcucccaugcuuugaggaaaaugugcuucagcuccauuugucaugggggcagccucccuggugcacugguucugcugguccccaggguauaggacacagugugggcuagaguacuggauaucuggcuguaccacuugguccagcuggccucaugauacugcagcccucugaguggauaugggggaauaucaguggcauuccagggauguggaauggaggggcuucugggguccagggcaggauauagucugguuguugcugggcucuuaaaauggugccaugccacagcaccuuggguccugaggggugacuagaaugcagcaugaaugcccuugggaacaauuccaugauggacuccagucaacucccuauacuaggcucagggccugugaagcugagcagcucuccuguggcuaggauggcaggcaucuguggugguaauguggacaacuggagauuucuugcuuaccuuuucccuacaauggggagccuuuccuggcucugagccaaucccggcugagacugcugcuuaucuucccucuuucucugugccuuggagagucccugucccuuuugugcugaauuccauuguucccucuuagaugcucuguuuaaccugugguuaucugcugacuguuuuccuucuuuuugguggaggagaugagugccagcugccucuagucagccaucuugaugaugucucucuguuucuuuaacauuugcuccauaaggcuuuuccacugcagcacauuauuagauugagaucacuuauguaacaacuuuuacucugagaaaggagagacaaaguaaaugccaugaagauaaugaauggacuuuucuucuguuacucauauaccuuuuucauguuggaccuacuuauuuuuagguccaauaugaaauauuucacauaaucagauugucuaaagaaaucuuacuuuggaagaauguuuaccucacuagaauucuuucguaauuguuaucuuucuuggucugaguaauuauaaguaaauuaggaagugaaacucggaaagguucagagauaugccucugagacuuaucccaggacuuaccccugggacuuaaaggaaaaaguggcaaaaccaagucugacacccagaugucaugacuaaaccuaaugcuccugccaguauaccacaacucacuguaacucccauuggcaacaugaaucaagagagguaguugcucucacugcaugagaaaggacccugagcucauucuaaugcugcaggaguccaugaacaugauccauuuugccuuaagaagaacuuuugaaaauaagggaauuaagugggaaaaguugaauauucuaauagcuccugaagauucaaucuacuuuauuguuagccuuuugccacaggcaagaaugacagaaaucaugggaaacugcccugggauuccucccagaccaugaucuggaauguuagcaagguagcuuuccaccagcauccuugguuggaaaugagaaggcucuugaauuuaguuccucuuaggugccaugaauaugguggaucuucagaaaauucuugagugaaugaaugaugaucuuuuauuaaaaugggggucauagugaucuuaguuuuauuguaacaggugacaucugggcugcaauaguauauuaggaaaggauuuggcuauaaauaacagauagcccaacuaaacguagcuuuaguagguggggugcauguucuaaaaauucuggagaaguaauccaagaugacagcagcgacucauagaucucaucauggaccugaaauccuucugucuuccuccauagucaucccuagcauguggguuuguccuuacagucugaagaugacugaugcuuccaaaccccagucaguguaucuaagcucuggagaaaaaagaugggguaauaagaggcaaagagcaaagggaagaccuccuaaggauaucuaccuacacuuuauugcucaaaaaugaugucauuuacuuuguuguucagaauggugucauauggccaccuuuagcuauagaagaggcuaggaacuguauuuuagcuuuuuagccuuuaugcaagaggaagucaagagaaaagagagguguuaaauggauuuuggguagcuagugcauaaugucuaccauacccacugagaccauuuucuuuacucuauugagcuaaagauucguuuaauauuaaaauuaggguuuuucagagaaggagaaccaacaagaugggguggagaaacagauuuauucuaaggaauugucucaccugauuauggagguugagaagucucaagaucugcaguuggcaagcuggagacccagaagagccaugguauaguuucaggacaagucugaagcccugagaaccaggagagccagugguguaaguucuguuccaaaagcuggcaggcccaaguuccaagaagaacugaucaguccaacucaagcaguaagccaggaggaauucucuuuugcuuuuacuugagggaauugcagccuuuugguuccacucaggccuucagcugguuaguuaagugccaccagagagagcagacuccuuuacugagucuguggauuccaauggcaagcucauaaagaaauacucucacagacacucuaugaauaauguuugaccaaauaucugggcacccuguggcccacucaaguuaacauauaacauugaccauuaaaauauugagaugggucuaauggugucaugaaaacaguacuugauuacucugcuggauuauaguccaugcuguaucuaacacauugaaugguccugggcaagucauugaaccucucuggauucguuccauccucuguaacauuaaagaauuacacuagacagccauagggccccuccccgcuccuguuuucccauguuuccaugaaauauuuucuaguggaagagaguagaguauguacuuagaugagaauauaaacuuaguuugcaacuaauuuuucaguuguauuuuuaaguuucuauuugagaauuuuguuuagugauauaaacacuccucugagaucucuguacuaucaauuugccucaaaaaaaaauacagagguaaauucagcuuagugcauucccaaaagaucauaaauucaacauuaguucaaucaaaauuaauuuucaguuccuggauuuaaaguuuccaagcuuauuuuucugcuuuucuuggaaccuagaaaauucaucucaccaguuuucugcaucaagcaauauuuauuaugugucuacaucugcauauuauuggacuuacacaguauuuuguuucaggaaggcaggaacccuuuuaauagcaaguauaauuugcauauuuacaguugucauuuguaaucagcugcagcuuaauuucuggaaaaaaauaaaacuuaccuucugagggagguuuuugaaugauuuggguccucauggcuugcccaggucagaauccaaggcaauaggagcugaacagaccaaauggaauugauuguuuccauaaguuuguggcaagaacauagcgugcugcuuuggaugucacaugccuuguugcaaaaaacaaacaagcuaugauuacuugccaugucaauuuuucuuuccuaaguccuguuagaguuaauucuuuugaaacaccaugucuaucagucuaucaaagcucuguugccucacugcuagguuauugaaauagccccugauuauucaccgggcucucaauuucuuucuuuucauccuuggcacacacuguuuuagguaaacucucucagaugccacuauucucauguuguuacuuugcucagaaauguucaagcauucagcauuaucuuuagcacucaggaucaacuucauacucauagguugccauucagugcucucuaguugcgacccuaacauucaaccugcuuuuguucccuuuuucuguuucaaaauaccaauuuccuuuaucuaauuguucccuuuccuccacccaaaagauuuugaaguagcuuacacgcacacauucacaaggauacauacacauguauauauguaucuacuugcauauguaauacaacagcaauaaauuuuauuuucguuugagaaauaaaagugacaaauaagaugaaaguaguuuaguaugcagaauuuauaccauaugauccuuuauguaacagcuagaaguacuacacuugagcuuaaccaaaaggccuagaagcaauauauaacagcuagaaaaaugaugaauuuacccuuaauguaucagcagccaaaccuaaaagacuacuuucaaaauucacaguagcccuaagaaggaaaacacagccagagcaguuuuucccugcacugaggccugaggcacucacaaagcauucuuacuggacuuccacagcgagugaaaucacugauuucuauaauauucuucaucauagcugauugacaauacuuuuuuuuuuuuuggagacagucucacugugucuucuaggcugcagugcaguggcacaaucucagcucacugcaaccucugccucccagguuucaguaauucuccugccuugcccccugaauagcugggauuacaggcgccgcgcaccaccacaccuggcuaauuuuuuauacuuuuugguagagaugggguuucaacauguuggccaggcuggucucgaacuccugaccucaagugauccacccgcccuggccucccaaagugcugggauuacaggugugaaccaccgugcccagccaaauuaauacuucuuaauaaaagagguaacuagaagcgugaaaaauuagguaaucuaagaucauaucucuuugaugguuuguuucuuuccaagaauacaauuuagucucuauggaggaaagcagugacugcaaauccuucagguaauccuucacuaguguuauuucuugcaaaugggcuuuuacauuucuuauuuugauuuuuuauuaaaguaauacauguauauaguuugaaaaauuaaaguacucuaacacaguugaaaacaaugguaccccuuuccucucuugcuccugcccacgaccuacuccucagagagaacccauuuuagcuucuggcauuuuguccguguuuuuaaacuuagagcucccuuaagucaggugcuagggauacuuucugcuuacugguucagcuuaaagaccaauuuuuauuuccaagauuucaaauuuguucuuuuucacgucucuguguuuuauuucugccuauuuugguuuuauaacuucuuuuuuacuuuaaugcaugcuacuacauuauucaucucuuuggguauucuaaucacacuucuuuuaaguguuaguuccaugaaguuuauuuuacuggagggaauuuauguucugauuguuuucaguugguuagcauugcauuucacucaguguucuggaauuuuguauggcaggcucauuuuuaguggacaguuuuuuuguuuuguucuuuucacuccuucugugcucuucccuucugucugguaguuuugccucccccaagccccucagccuccaguucaaaaccagaacuuaauggcauuuggaccucuugcgccccggugaugcugaggcuagugcagaaguguugccuagauggugggcgucauggcuguguaccuagacaagagagcauggcucuguuuggccccuucaggcccacagcuuccuguaaauaucuagcacaggggaacaggucaucagcccugguuuuguuuaucccggccucuuuugucaagcaagguagccucaccccauucucuggcuuuaagcuuuaagguugacuguacucaccauuuuuaugugaaacauuuguauucccuguuuaaccaccagcacucagcuuguaccuacugccaccuacuuccagaccucaggcccuggagcuucagcuuuguuuauugcuuugcauuucuguucuauuuuugguccagggagaucauugccuguuuuuuuuuuuuuuuuugacuuggcaaagcuauuuuugguuccuguuuuuauauuuuaccugucauuacuauggauuuggaguagaagggaacgcuuccagguuugaacuuacagcaucuugauuggaagucugcaguugcuuuucgaguacauagguaaaaaucuaagucuuuggaggcaaagaaaaaacgagaagauaaugaucuaauuuuccugagggcuuccaaguaugugugcaucuuuuacccagugucagccgucuguggagcaggggaucuauaucuucuuuuaucacagagccuucuaugaagagagauugaguaggaucauugugaaaauguauccauucuggaaacaguuuaauaaaugguucuguaguggggagaagccuuaauaaacuucucauucccugaugcuacaauucuaagccuacuuccucuuaguuucuucuguaaauauaaagcaauguuaauuuuugucucugguaauuauuucagcuucuuuuuagaaaaacucuuuuucugcaacacagaauugccuucccucguuuccuucugagacccuccacgacaccuaugaguuacacagcccugaagaagcccagcuucuacaaagaaaugacuuugugcuggugcugugugggaacugccuugauucccaugugggcuguacaucaccugggcuaugcccuguaaaccgugaaaaccggggaacagaggcagguuugagugaaaggaagaaacaaugauugucugaagaagaagaaaugaaagaauguuagcgcaaaaguuauauucaaaggaaaugaaaguucucagcccaagaaaguuuuuaugguacugagucuauuugaaaugggagcacuuacuuaaaggucacuaggaaaccaagauuuuuucugcugccuuacucuauuuugcuagauaaauuguaagcagaacugucuccuggugggaugaugagcccaaccagcucugcguuguucucaauuuuaacaaucuaagcagaauguuucccguuucuaaaguuuucaucauaaccaaacuauguuguccucaggaagauuugacagggaacugaagaagugugugcgugcgugugcguguguucauucccauuuuuaauuaguugaaaccuaacauugcuguauguuaccugugucuugcuucuccagacaagcagaaaaauggguuucccccagagugaaugacugucuguuugaguucauguuuaaucaaggaagggaguuacugacuucauaaucacauaaucccgucugcaguguugcuaugacauacggggagaggcuucugggcaugcuacgaugggcuguaaaguuggcugagagauaaacaauguagcuauuguguuugccuuggacuguggcguucaccacaucacaggauguggcacuucuucucugccuucuccccagaggacaggcagcugugcucaccaggcuccuucacguggcccuguuauguccaccucggguaaaagauggucucuccacaauuuguggugucgugaauucugucucaccuuuccaguucuugcacacacauucuuuucuaccaucuuuggggcuucauaagccuccagcucagaggauagauugagggauggcagcuaaugugauacagaguauguguucuuguguaccaaguaccauccccagcccaacacaugguccacagguacgcaguaguguucaggaagucuaguacaauaaggugauucuuccucagauacuacuggaaauuagaauaccugcuaaagcuuaugggggcacuuauugugugcuaguguguccagaguugguuccuuccgguggguucauggucuugaugacuugaagaauggagccgcggaccuuugcggugaguguuagagcucuuaaagauggcacggacccaaagaguaagcagcagcaggauguauugugaagagugaaaaaacaaaagcuuccacggcguggaaggggaccugagcggguuuccgcugcugguugggguggccagguuuuauucccuuauuuguccccacccauguccugcugauugguuccuuuuacagagugcugauagguucauuuuacagagugcugauagguucauuuuacagggugcugauugguccauuuuacagggugcugauugguccauuuuacaaaccucuagcuagcuacagagcgcugauuggugcguuuuuacagagcacugauuggugcauuuuacaaacgucuagcuagcuacagagcaccagcuggugcauuuuacaauccccuuguaagacagaaaaguucuccaauuccccacuccacccuggaaguccagcuggcuucaccucucacgagguacucugcagacuucucuguaugccucaucucauuucucucuacaaccauaucaaaguuaggguuacucuuacugccguuuuacagaugaggcaacgggagcuuucaagaguauagcccuaaccucuucacuaugcuguuucuauagugauaagaguaacagauagaccuucccuaucuuuuuaaagaauuggaguguaauuugcauucaguaaaauucacccuuuuuaguguacaguucuacaaacuuggauaaaugcagucugugaccacaaccaccaccaccaccaucaagauagagaagcguucuaucaccaccacucccaaauuccuucguacugcguuguauccaugucuauaccccacucccagcaccugcuaacccaaaucuucuuucugucacuaccauuuuaccuuuuccacaauaucauauacauuaaccagccauuucauuuggcuucuuuugcuuagccauguuauuuguacacacauuuauaauauauaaccucaauaguugguucauuuuuauugccaaguaguauuccauuacauggcuauuucauaguuuguuuuucuaagugaaggauauuugaguuguuuucuaguuuuggugguugucaaagccacugugaacauucacauacagguuauugugcaaauauaaguuuucauuuuauuuggacaaauaccuaggagugggguugcugggcucuaugguaaauauauguuuaacuuuauaagaaauugcugcacuuuuuuucaaagcagccccuauuguuuugaauucccaccagcaaugacucagaguuccaguuaccccaaauccucaccagcacuuguuuuugucagauuuucuuuuuguuuuucauccuccuaauacauuuagugugguaacauugcauugugguuuuaauuugcaguacuguaauguguuuucucacguguuugugugccacauguacaucuuaauuguugauauaucuguucaaaucuuuugccuauuuuaaaaauuggguguuuucuuacugaguuuugagaguucuuuauccuguacacaggucuuuuguuggacauauguuuuauacauguuuuuuuccucaguuugcagcuggucuuuucauucucuucacagaaugaaaagcagaaguuuuaaauuuugaaauaguuuaguuuaucaguauuuuucuuucauggaucagucuuuugaagccauagcugaaaaucuuuaccuaauucaagaggagaaagauauuucuucuguguuucauauuagauuuuauaguuuuagguuuuacauuuaggaauuugauccauuuucaguuaauuuauguguaugcauaauguucuuuuuuguauauggauagccaaugauucuaguaccauuugcugagucaauaucuuauuuaaagccacaggauauuauacaaagaguacagaguuagauuuagcagaaguuggguucuaguuccggagcaucagcaacuggccagagacaugaaauccaaaugguggauaagaggacagcuugauacgguggaaagagcaugugcuuugcagauagaugguucugguuucugcuguugaccaacccuuugacaucagcaaguuaccuucccugugauggucuuaauuuucucuuuuguaaaaugagaauacucuaaaccuggcaaagcuacuuuaaggguucaauuagauaauuagauaauauauguauagauugggagaugguagaugcuugguaaugguagccauuauuauuauugaaugaucuggggaaauagucuauuugggagguuccaagaaauacagcauccucaguucccaucauuugcugaucagagucucugaauuguucacauaauuuucuuaacaguuuuuuaacuccuccuguuccaauuuuuaguugucucugcuuucuucccccuuuuuuugugccuagugccucuuguuugguuugguuccaguggucacugugcuggggugguugguguuuuucuuucuuucuuuuuucuguuuugagacagggcgucacucuuucgcccaggcugaagugcagugguguguucauggcucacuccugggcucaggcaauccucccaugucagccuccucaguagcuggggcuacaggcgugugccaccaugcccugcuaauuuuuaaaaauauuuuuguagagauggagucucacuguauugcccaggcuagucuucagcuucugggaucaagcaguccuccugccucugccucccaaacuguugggauuacaggugugagccaccaugcucagcucagcuuguuuuucauucuuguauucuuccuggcuugcuccccugcacuuccuaaccugggcucuccuuccagaaguaagcugaccuuuguccagacuuagggggcauaucacuguccuucaucacuacucgugcuguccucuucaccccuacaguucccgacauugcugucacugaggggguguacauagcagaaggaagggaaguacagcugaguaagaagacagcaugaguggcacugcacagagucacauccaggucauugcuccccuccccccagauuccuggacaaaguggaugucauccugggcugucucugcaguuuauuucccaagagaccaauccucuuuuguaaacauuauuuauuuuuguauuuuuaaauuuugaauguuuauggcuacagaguaggcguguauauuuauggguacaugagauaaauauuuugauacugucauacaauguguaauaaucauguuaggauaaaugggguauccauugccucaagcauuuaucauuucuuuugugguacaaauauuccaauuauauuucuucaguaauuuuuaaauguacaguaaauuauuguagacucuggucacccuguuguaucaaauaguagauguuauucauucuaucugauuauauuuuuguacccauuaaccaucccccguucccucccuugcccacuaccuucccaggcucugguaaccaucauucuacucucuaucuccaugaguuaaauucuuuuaauuuuuagcuccuacaaauuagugagaacaugugaaguuggucuuucugugucuggcuaguuuaauugaacacaauguccucccauuccauccuugcuguugcaagugauaggaucucauucuuguuuauggcugacuaguacuccauuguguauauguaccauguuuucuuuauucaucuaucaacagacacucagguugcuuccaaagcuuagcuauugugaauaguagugcaauaaacaugggcgugcagauaccucuucgauauacugauuuccuuucauuugcguauauaccuaccagugagauugcuggaucaaugguaguucuauuuuaguuuuucgaggacccuucauacaguuuuccauaguagauguacuaauuuacauucccaacaauagugugcgaggguucccuuuuuuuccacaucuuugucagcauauguuacucccuaucuuuuggaucaaagccauuuuaacuguggugagaugauaucucauuguaguuuugauuugcauuucuuugaugaugcgggauguucuuauaccuguucaccauuuguaugucgucuuuugagaaauguuuauuuagaucuuuugcccagauuguuagauuguuagauuuuuuuccuuauucaguuguuugaaguccuuauauauauccuaguuauugauuccuugucagauggguaguuugcagauauuuucacccauucuguggguugucucuuuacuuuguucauuguuuucuuugcuguguagaagcuuuuaacuugaugugaucccauuuguccauuuuuguuuugguugccugugcuuuugggauguuacucaagaaaucuuugcccacaccaauguccuggagaguuuccccaguguuuucuuuuaguaguuucguaguuugagggucuuaaauuuaagucguuaauccaucuugguuaauuguuuuauauagugagagauagaaaucuaguuucauucuucugcacauccaguuuucccggcaccauuuauugaagacuauccuucccccaguguauguucuuggcaccuuugucaaaaaugaguucacugcagauguauggauuuaauucuggauucucuauuucuuuccauuggucugugugucuguuuuuaugccaguaccaugcuguuuugguuacuauagcucuguaguauaauuugaagucagguaaugugauuccuucaguuuuguucuuuuugcucagaauggcuuuggcuauucuggaccuuuugugguuccauauaaauuuggggauuaguuuuucuguuucugugaagaaugucauugguauuuugagagggauugcauugaugccucuuucagaauuugccauguaagaauuauuguucuuuucugaguaagaccacauuuggaaucucacaaugaaacaaauaauaaaaugccuugggacagagaccagacaaggcuucuauugacauuuauuccuucauuacaguagguguuggaggucacccacacuuugacccuaagucugaaaacagaccucuucaguggucacagaaacuucagggcugcaggguugguggagaguagcucacucugcagugggugugggcagcugugggcucugauuaaaacauguaguuggccccuccagugucaaugggaaggauguccuagaaggagaaaaagguauucuagucacuucuguuaucucacucucuauagaaauuaagagaacauggugccaugcaaaaauaaccuauuuauuuuucucaaaaaguacauuuuccccuuaucuguuaaucgggcucaacagugaacuugaaggcuuaugcuuuugguccauaguacaugcucaaagccuuuaaaacaugacauguuugaccuuaccuaacuuuggaguucuauaggucucugccacacaaaguuccacuaacagcucacuguugggauauggaaagagguuaaauuucacaauaacuaucuuggggcucacuauuuauauagucauuaacugcgcccucuagugacauugcauccuuggaagaaugaagcuggggaauugguggcauugguaagcuacagggaguauguaaugcagcuccguguauuagggaugguaggugaccaaaugugguuccacuuucucuuucccugcucugagaaguugcuguugggcuucagguagacaugguugauguagaacacaugcauuucuucacucugucuuuaaaaccugcugaaaugacacucagauugggcucuuucugcauguuauugauugcauaccuucagagcuuaaaagguagacgugagagagcauacuuuguacuuagauccaucgaauaucacacaagcuaagugguuugucagaaagucaguuaaauuugaauagcuagaagaaacauuaggcaucuaggucaauaucagcauuuugcagagaggagaaaugacuugugucacucacaaauagagugacgcuggacaauccggcccagaaaauacaaguaucauaauucuggggcagugcucuuuugauaaagcacuguggguacugcccuugguuguggaagcaagguuaaaagguaaauaaagguaaaauaacaucaagagggaacuuuuaggccuauuuauuuauuuacauuauuuuucuugagagaucacuuccauuuauguauucauuuucaaauacuuaacauacuaucuuuguccaauuucucaagcccuuuagaugguagaauucuagaaauauaaacaggaaaaauagauauuuuggguuggcuuuacuacugaauaauuuaguauauuuaaguguccauuuaagacccuagacugacauuggccagugcuuuuacaacccacuugggugagacuccaugacaggucuaucauguaagaagagacugaagcauuagcugcuguggagaguccagggagcccugacucaccccaacaaggacuagaauuaggaauaagucuuuucuguuuauagcuugaacauuaacucucuggaaauaaggcgucuuauauugcuuagggcuuaaauagacuuaagucuccuuuuuuuugcuuauuacucacccauaauuaccauuuucaucuccagucuuucagcaaaccugcuugaaucucucccucccucccuguuucucuccuuuugucccuuucuuucuuccucaaguauuucaugaugugagacauauaucauaggccaaccaugggaauccugagauugaaagauguccccuuccuguagguggcuuccauucuaauguggagauagauacccagacacaguuuaauuugguguggcagugauuuuacuggaagccuguuugaaguauaguggcaaugaaagagaaaaaaaaucccuggucagucuagaaagacuucacaggagacauugaccugagauguacagguuguauaggaauuuucauugagaugguuucaaagagauucagucuggggauguuacuggaaaaggggucccaauccagaccccaagagaagguucuuggaucucacacaagaaagaauucagggcgaguccaaaaagugaaagcaaguuuauuaagaagguggaggaauaaagaaugacuccuccacacacagcagccccaagggcugcggguuacccauuuuuaugguuauuucuugaugauaugcuaaacgagggguggauuauucaugccuccccuuuuuagaccauauaggguaacuuccugacguugccauggcauuuguaaacugucauggugcuggugggaguauagcagugaggaugacuagaggucacucucauggccaucucgguuuugguaggauuuggccagcuccuuuacugcaaccuguuuuaucagcaaggucuuuaugaccuguuacuugugguaacuuccuaucucauccugugacuuagaaugccuuaaccaucugggaaugccacccaguaggucuuagccucauuuuaccaggccccuauucaagauggaguugcucugguucacaugcuucugacagggacacacccugugaaaugucccagaggcuugagagaauauggcgcaucagggaacagcuaaugguuuaguauugcuggaggauaaaggcugguaaggccagcaguggguggugagggauggccuaugcugggcagaggguuugcauuuucaucauggagggaugggaagucauuguuagaacagugagguuggccuuucgacccgcaauagccagaaaaacgugaguguguguagaaccaagaagucagaaaugauugcaugaagaauaaaaaauucaaauaucgggcaaggaaauuagcaugguuuucacaucauuacacccagaagaagagcuuguagagagcugcuuaugcauaucuaugauggcagcuuucuuccucccccacaaagaaugagaugcuuuuggguucgauuaauacccggggauauggcaaacgguuuguuucaaauacucaucugcuuacaggcuguuucugggugcuucuauuaaagauuagaacauuuaccaauuguacuggguauuaauugcugaggugagggugugauggucucuaaacuagcuguacuucccaguaauuaggauauuguauugcuucaguugcagccaucagcauaucuucugcuuccucuucuuucaaccuuuguugacaagccguuuucagaccccgagaacucuaauaaguaaggagagaugugggcuuucucuuucucuuguuuugauauguaaauuagaauccuggaauuaugaaagcguugauaauguuuuccugucuauaacauuaaaauuggaaagcuguagcuaaaggcccauaaaacaguugucuccacauuugucauuaaacuccuuuauguaauaaauuuacucauccuuaauuuggaauuaucuugcuuuucucagaauuuagucaaucuuggcauuuuuucaauaccuucuuaugcuaauuucuuauuuauugugccuuuuaaaauggaacacauaaaguagcagccaauuaauaaauuauguuuucuacaacugaaauaaaaacauguuaauuauuucugaacaauuagguugcguucaacaugggugaguacuccaaugggaguaacaagcagccucagaggaugaggaaaauuaccuuaguuugacaucauauuaaaugaauaucuacuuuuuacaacuacuucauguuaugaauaaggucaguuaaaaucauuguaaaaauuguggauacuaaccuccuuaauuuuauguaauugucuuuuagcucaagaaaagaccaugaacguuuuuaugcagcugccccauaacuauauaguggccccauaacuuaaaaagggacagagagaaccucuaauagagaaacacuguagaaaaguaagacuuuaaagaaagacuaagggcauacaaacucuucagccugcaggagaaaggaggggccuuaucugguugauauaggaguuaaaaagaaauuaguugggcagauagugaggguaaggaaguccucgguaagguuuucccuuuaaugaaaagcaguccccaaaucacaucuuuucuaacaaagaacagccuguaaaaucgagucacagacauagacaagcaagcuggaagcuugcaggggugaaugcuggcagcugugccaauaagaaaaggcuaccugggggccaggcauguucaacauggugguguguccggaauugguuccuuccgguggguucuuggucucacugacuucaagaaugaagcugcagacccucauggugaguguuacaguucuuaaagauggugugucuggaguuuauuccuucagauguucagauguguccagaguuucuuccuuccgguggguucauggucuugcugacuucaggagugaagccgcagaccuucacagugaauguuacagcucuuaaagguggcguguacagaguuguuuguucuucccaguggguguguggucucgcugacuucaggagugaagccgcagaccuucgcauugaguguuacagcucauaaagguagugcagacccaaagagugagcagcagcaagauuuauugugaagagcaaaagaacaaagcuuccacagcguggaaggggacccgaguggguugccgcuguuggcucagguggcuagcuuuuauucccuuauuuggcccugcccacauccugcugauugggccauuuuacagagagcugauugggccauuuuacagagugcugauugguccguuuacaauccuuuagcuagacacagagcgcugauuggugcguuuuuacagagugcugauuggugcauuuacaauccucuagcuagacagaaaaguucuccaaguccccacucaacccagaaaguccugcuggcuuuaccucucaguggcaccaucuucccuuuugucaaucacguguacaguaaggaacagacaacauggcuaccucccagauagauaccugcauaauaaaagauuagggugggauggccagcuucuucaggugcuaugcaaacaucacaccugguccacccaaucucucaggcccuauguaaaucagacacugccuccucaagcuugucuauaaaaacccccaugcauuucaccacaaaaccggaaggaccacuccgguuccucucugucccugcagaagagagagcuuauucucuuuucucuuucuuuugcccauuaaaccuccguucucaaaaucacuuugugugucugcauccucgauuacccuggcaugagacaaugaaccucggguauuuaccccagacaaccaugcugcaucauggucagggagaccuauaguuuucaguccucacuaagauugggagaaauagacuucagcuauagguauuuggauucgauguacugaccuuuugggcuuuuuuaagaagauaugguggcauuuguuuuguacaggucuucuaagaacagucuuuuucaucugucugaucucugcauugcuaaaaagcuuccuaauccucaaguucuggaauccucugaccuggauaucccuguauaaauuuaauauuugagauuaaauagaaauauuagacauccuaccgcuaaaggaaaaaaaaucaugaaacuuuauaaaauuggacaauuuuucuuuuuuacaucacccacucuggguuuuggccauuuucaccuuuaucuguugcuucccacgacaaccagcauuuacuaaauaccuacuauguacucaauagccuagaagaaguuccuaguauaugaagcucccugaaaagccaaaaauaggcaagaauuagaaaaggauucaucucgcuagauuuguaccuaaauucuuacagugucagguccauggaccuuucaugauacucugugggccagcauggguaaaggcugcuuuaaaccaugaaggacagugaagagcaggggcuugaauggucagaaagaaguaauagucuuuuagcguugggaccccaaaagaaagaaauuauuauacaggaaauaaacuucuugacuccaguccugauguuuugggguuuuuuuccccuaguuuuuaagaaagaagugagaaugaauuuaaaaaugaaagaaaagugguagacuuuuguuuuuuaacccaaaauaaguggaaaauagcaaaauaauuacgggauguuguggguuucagacuuuuccuugggugguuuugagacuugaacaaggcacucuugucaaguuuauuuagaguaugucuuccgucuuugugcugggagucuacuuuacauauuaucucgauuuuuccaaggucauuuaauauugcuuauacaguuuggaaaaaauaggcuguuuccauaaugcaguugguuuaguaucuaguuacaaggguacacucagugaagagcacaaagauuuuuuuuaguauuaauagagcuucaagggauuguuuuuacccuuuucacauuugucuuuucugacccuaaagauugaacagacagauucaaauggaaaauugcuaauauugucaauuaugggcaauuacuggguaucagucucaguuucuuucucuaacaaucacagugcugcuacauuagcuauuagcgaagcacagccuacccuuucuaaaaagaguguacucuugaaaacaguuugcccauauaagucucuuuauugauugagcuuuucaugcuaccauaagcucaucucaauuauuucuacccaggaaaauuacuacuccugccauccagccuuucagugaaguaugcuuugcuaugugauauaucauuuagauuuuuuuauuaauuuaaacguuuugugucaacagaagguagaucauuauuaacuggugcaauguggugucucacaaaauacauacaugucauagaaaaguaauuaacucccucauucuauugcagaacagauguguaacugaauaagaacugggacccaaggguacacuagugcauuuauuuauuuauuuuguagucauuaaauuguugacugagagacuucauugcuaguuucucaaacuucauucacuuuuuccucucaacaccccucacccccacaugauugaaaauagauuuagaacuauuacccaaaauuauaaauugauuuuuggcucauuguagugauucaagccacagauaggcucucuuuucagaugagaugaagguuugaugacuuagggagcugcgaauacauaagauauaugggggauuuuuguugaaaaccagaagaagguuuagcagcugcuguugguggcaaccacaguuggguuaauaaaccuagcuaguguuucccaagcagcgugccagaaugagguuaagucaagaccucacgauugacagaggucaguugucacuucuugccucucuccccuuccagcaacauguauaauccugugaguguuucuucagcacccuucucuguuguuuacacuacugcaagagccucccuaagcggucugccuguuuccacccuguugucuuggaauuuaguuuucucgcaaaagccagagaauguuuucagaagguagcucuugagcaacuucccacuuucuuggaggggagauccagcuuccccaacaagaccagcaggccccugugcggccuggcuccuguucacccuaccagucucggcucaggcucacggcuggaauaugccgagcucuuucuuguccuggggccuuugcacuuggcuucccucuguccaaaaucaucuuccuguagcuuugugcuugccuagcucaucaucauucuucagcucguggcuucaaccuuaccuccuuggggagagauccuugacuacccuaugaaaaucaggugcugcucuccucauuauuuucugcaaugccuuuauuuccaugauugcacuagcaaacguuacguaucauuuuuauauuugcuguguauuugcuuacuuguuaggaaaguacuaaugacccuaucagucuuguucuguauuuuguccucagugcccaauacagugccuaauaaauuuguguugcgcaagugaauaugugaauaaauacuguuauuugccuagcauggaguuaagcucuauaggacaugccaaaaaucucuauuaccugaugcuucaaaaugacuuuuacucauaaaacaauuucaugguaguuuaaacaaugggcuaucaggaagggauauucuugcccucucuuccuccaacacuuuguaauacugaguauggccuaccuuacuuccccauaccaagaccuacaaacucacauguaaaccacccguuggaaagacaggauauauauuuccaguuaucaucaugacagauuccuuucugcuugcaguucaugccccugguguucuuuccuccuccaagaaugcacacauuccagaguugaugaaaccagacuugaguaacacaguguugguuuggugguauacuuagauaugugaguuuucuaaucuggucaaaagcaugaauauccccauuauccuguuggagaucuguauauuuuuauaaugaacaaauguagaagaaucauuucauaggggccuauaagcccaggaugggaagggcccuuagaggcccgccuacccagggcaaguaucuccuggacagugugugcccuggguggguauccguacucaaugugaacuuuuuuagugcugaucucagcacacucuuuuugagcacaauguuccacucuugggcaacugugauuguaaaguuaauuaaucucaugaacuaaaagcugccucuuuccacuuacaucagggucuuaguucugccccuuggaacaauaaagagcaaauagguuucuugucccaccuaccagucuucaaguacuugaauauuugaggcagugugguguagcagagagcacucagguuucugaauuauacaacugggaguucaaguccuucuccaccacuuuguagcuacuugaacuugaggagguuaaccugucuuucucagcugcagucuugucuucuauaaggauuggacugguuuuuaccugauacuucguugaaaugauuaaauaagauacaguguuuaaaguaauuagcacaauaaacccucaguaaauguuguuguuguuauuuggccugcaguuggccaucucugaaacucaccuauaucuauaaaauaaggaaaaugauuccuaccaaggagugauucaaggcugacaucaguuaauccuaagauauaguugguuguucagccagccagccaggaaccuauauauacuuucucauccuaaccagauagccuuaucuuacccccagaauauuaugaagauauuaacaaauccugguugaaaucgaacaauaugguguuaauaauauuugccccauauacuuguauaaucuccauggaauuaaaugaguucagauuggcaggauuuguucuuggugcugcagcugcaagaacagcauucacuagagacagcagcggugugcauggcaacugugcuaucucuaguguguacagcaacgcaccugugcuaucucuggcguguacagcaacgcaccugugcuaucucuggcguguacagcaacgcaccugugcuaucucugguguguacagcaacgcaccugugcuaucucugguguguacagcaacgcaccugugcuaucucugguguguacagcaacgcaccugugcuaucucugguguguacagcaacgcaccugugcugucucuaggguacaccauguuuuaaaauucuuaauaagcauuggucaaagauagacauugacuuauuugcuugaagacuuccauuacagaguuuuauuuuuauuuucuugagaccauauuugccgccacucuggucuucugcugccauucccuuucucucaguucuucagaguggaguaagaauaguuucaugaccauauuuuccaaguucuuucacuguccuggaauauaguucagcuggaauuaaagaugggaacuuuucuaagauuccuauucugcucucuccugaugaagaauaacuucuuuggggagaaaggaaaaacccuaagaauugaguagcuuucugugaucucuugauguuucucacacgcuugaagcagcgacucugucucuuccaugcuuucucguugcucagagagcacugaagcguuucucaucaccucgguuacucagcguuguccucuuacacucuucgucuccaucgcaguguucugcugccuacuccccaucucuucuguaacagcacagcucaugugcauuuagcgguuacugcgagccaguugcuaugcacagcacuuugcauauuaucucauuuagcccuuaggcccacccuaugagguaggucaucuaguccuauugggaaaugcuuaucagcuguuugugagcagugugcucagauguuguucuagaacgugaaccuuguacagacuagaaaugcauaaagcaaaugggaaccuaagcgacugucaagcauuuucagacucauaguuuccaauaguuuaaugacuaccgugcccucauuaucaagauuauagcugcacugaaaauggaaauggggagaugggcaagcgguucucagauguguuaacaugaaaccuagauuaaagaaauaacacugcucuuccuggaggccaaacaaauacaaauugguuucaugggcuaaacuguaguuggagaaaaggggcauuacucuuuugaaaaucuuagcauaggcagcuucccuucuuucucugccggaacccauguuuguuuacacucacaagcucaacgcccucuuccugccaucccugcguugucccucuccaacccuccaacugcugaugacaucaacaguauauuccugcaguucaggccccuguaaugcaauggggcugugaaagucacaggauccugcagacaggugcuggggcugcuucuggccuucccucagcugggcuuccuccuugccaaguuguccucagcuggccccuuuuuacccauucucuauagcacucccagacccucacuacugcuccauccuccuaagccucugcugucucuugauuucaguagauagggaaaaagaguccaucagacauaaagcccaucucaacuucccacccugcugacuuccagaugcaacucuaucugcacccauucugucucuuccuguuagaggaaauggggaccuccuugccaaagccgaguccccaccacccgcuucuaccaccugugcucuugacccuacccucugccuccucguggaccucgccccccuugcugccccaucuguuggggucugccuuuccguguccacugacuccuucccuguggcauaaacgugcccacacuuucccguuauaagaaacaaacucuuuuuccagcucagcucuugccucuaaccauuguuuccuguuuaaucugugaaaccccuugagucaucugcacacuuaaugacccuguuuguuuucucuuaacucccacaauaggaguuaucacuccccaaagcacgcucucucugaugucaucggugagccccugauuucaaauccauugaccuccuuugagucucuuccccauugaugccauuguugaguuccacaccaccugucccuuccuuccuccuccugggaacacucuccuuucguuuccgugcccuccuuuacuucuccgcuuugccccugagauucuugggccccguuggauugggugauuuccucugucgcauaucuucagauuccaccugcguggcguugacuuccaagucgacacuucucacuuucacuugucuucugggucuaguuucauauuucccgcuuccuagggguaacuguaccuggauucucugcagacaucuuauauuagcauguccaaaagcgaacgucccuuuccuaaacaccuuucuacauuccccaucucaccggaaggcuucgccaugcacucagccacugaagccagaugcauggccguuguccuggaauccucuacucuccacagacuuacucccagguuaucaucuuguuacacucucuugaauuguuccuuuucucuucagucucucucuuccucucucacuguugcuaaggcacggccuuauucagauucaugucaucucuuucuggauuguugaaacaucuaccuaacaccuuccgccuucagucccucccaccugcaaguguauuuuccacguaaauauuugaaaaacauagagauuauacuuaaaaucuccccaugucuccauguugcccaugcaggaucaaauucauucuuugaucugaccccuucccuaccucucuaccucauaucuaaaccuuuaucuccaccccuuucccccgaugaaccguuuaauucagcuuuauguuuuugggucugugggcucauucugaaguagcccuucagcuuaguggggaaaagagccucuaaggaaaagcagccucugaacagcaaguaacugcagaccuaguagggcagcagagggccggggagcugccccgucuccgcagcgccgcccugccaugcaugagugaaccagaagcacccaacagcguggccuccccaaggaccucuuucucuucucugcuacuggccuuccugcuugucucuccuugucuaaugcuuccauagccuccaagccugaacucaugcauccucuucuccgggacauuuucccuaaaucccggccaggcagagggcucugccucugugcucccauagccuccaagccugcacucaugcauccucuucuccaggacauuuucccuaaauccuggccaggcagagggcucugccucuaugcucccauagccccagggcuuaccucucuguuaucacgugcgguauuuagaaaugauacauuuguuuggccguuucaaccacuggaauguaagcugaggccacaucucagcugugucuucucagauccaguaccuggcccuggagugcacuggggagauguugucauauauugagcuaaagagcaccugaagggcaugagauuuauuccccguagugccacagacuuggucacuuuugugucuauuguaaauaaacuauuugugcaaaagcagagaacaugggagacagaacuguagauugagcagacaagaaaaaagaaaagcaaaaccaucaauacuugcagcaagucuuaaccaugucggcacgaagagugacagcaugaucgcagagauucggagcaauggcugaggcggcaaaggccacgcugaugguccuuggcccagacugugcauuggaaucaccuggggagcuuagaaaagauaccgguaucugccugcccccaagagaugcugauaucauuugccucgauggaacccggucuguauucuuaacagcuccugaggugauucuaaguauauacccaccuuaccuuacuaggcccuuacagcaaagaggagagacaaagcuggaggaacaacaggucugcaguuugagggaaagucggagcccucaguaucccuuaaagcauauuccugggauguguguguaugugggcaugucuguggguaucuguguguuugcacacucuugguagcauaggggaggaaguaagcucucugcagcccucuggagugaauuaaagccucugauacauauuuuaaaaagcacauccagagcuauccagcuuccacuggugaugaagaccugggacuuucucauauuaaguccucugaaugaaggucuggguaccccuuguucuugcacagagcaagagggauuuguaaguuuguuuaccuccggaaaagaaauccuugcguauuuuaguugguaagcauuuacaaaccuuaaaaucuuacuuucagaguagucucaaaaguuaaauggaaaguaaaacagaaaugguaaaggcaaacagcuagggcuguguaauuuuggcccacaaugaguaugacccaaaaugaaaacaaaaacuaaucaaaagguaaucauuuccuaaaucuucugugacuggcaucguagcauucccuugggcaagaggaagaauauuagggguaugagaagcauuauaucaucuuguauacucaaaaagccauuuugaacauccaaauuugaggaacuucaucagauaucaauauaaagaugauaccuauacugcuggggacagauuugagguuugauguugcccacaugccagguucuaauggaagaugugcacgacucaggcggcucagugagcaguucucugguaguaggaguauucugaguauauaguugaauaucuauuuccagcucuccccacaauuuccagcauguucugagugaaaucacuugccccucccuguaccuccuuuccuuccugugcaguagggaccugucugaucgucaucugcuaauguuuaugaagcuccgucagaccuuugucuggaagacucuguuaacaguaaugcaugcuugguuuaugagacgguuacaagagaauggagguggaggcagggugccaaacauggccaguacuuuuaucuuugacauuacaaagagguccucuggcugagagccagccuggaguuuacuggaaucaaaaaugcagacaugugcuuucuguuggcgugccaggaagcggcucgccgugccgucagccagcacuucacuuccauggcugcagagcugcuugcaggagcgucuaaguccuggugauuuuguguagucugucucauggauacgaggugaggcacaaaagagcuguaccauggaaucuggucaccccucucuccucccaaacuuuacaaaguaguguucuccucaccagaccuuuaggccaagugacugcccucuggggugacccacccuccagcuucaagggacagaucucuguauggauugauucacagacuacagacuuuucuuuuuuuguuuuagaauaauuggaggaacacuggcuuuuuuuccagugagauacaaaauacaauucuagaauuuuuuuuuaaaggcugagagauuaaaguaauuucuuucccucgaacagcgacauguuucuuuugaacuuuuggcuugugugacacauggucuaaggauuucagugcugccuuaugaaguguuuguagaacgggauaauuucugcagcccaacucugaagacuuaggggacgcuauggaacccuccauuaacugauguuaagagagagguucuaaugucaaaauaaaucauuucuuuagaugacccguaagauugccuccuaaaaagcuaugucuagacuugugucucagggacuuguuaugugaagcugucauuguggaccccagcuaaacuauuccuuuaauucagaaccacagauuagauaaucugaugugcucgcuuuagcagauaagcaaauaccauguuuacccaagcuuggaauauugccuguuauaaucauuauacauacaaauguuagagggaaugugugaauuaaauaaccauugucaaauucuugguuuggcagaagguaguaccauguugaguguugucuucaguccuguagacucucugugcuauggcugggguuguuuauacuugagaaaacucaguuuaaaauagaaugaaggagggacaaaucagaacaaaggcauuuacaauuuguugcacaaucacaaaccccagcaaccuuccuaucagaauuucaggucuguuuucauggacaacauauacuuuacacauaggcgacuaauggaguggaaggauuaguuuccaugucagugguaacccuaauguaguucucaccugggcaagcggagccaggaggcacuguuagacucuaggccucacagcuggccaguggcagagcugguaccagggcccggccuccuuaguuccacuuccguagugcugccugucacacagucuuacaugccaacagcacagaacccaaaucaagcuaucauucaucccaugucugaaugucucuggaguggccacaucuagguuauccuauaaccuucgccuucgggacacugcccuuuaaaccucacuugaaucuguucugcggcagcuuaaagcauuuuuaucucuguuggcagaggagaaugagagcaucuguccucaaagaagaaaauacaaaagauggagauguggccgauuaaaggagaugagggcugcagcuuuggucuucauuaagacaaaacucacccugaacuuuggagguguacuuuaucuuaauggcuauugucaggagaacaauuuuccuguaaaaucuuugcauuuuucccagaaucucaaaccucccaccugguagcguuuacacaacaguauuggcaggacuuggguaggaguugugaguaugggcuuacagcagccuaagccauccauuugguagucucucuacagaugugaaaagaauuugucugaaugugcauuugcaaguggagcucauagcccucugugucaucuaauccccauuauauguuauuacaucaggaacauaccuuuccaguauggggggagggugcaagcaagugucuccuuccuaaauguauucauguguguuuaacugccuuguauaucagcccaucaugcuaguuuucuacaaaaugcuuuucuacagaaggcucauuuuuagcaagcaccacugacaagagguaggcucucaaacugcccucaacguguagaugcuguuuuuauucucuccagguugacuugauuuuauauaagcaaauaagcuuauuucucugagaagcaguuuuauucacugggaugggaacaaccccacacagagggaggggagguguugaggcuguagccggaaaaggccuuuggugguucuagaaguucugacuucauaccuucaaggcugugcuccguuucccagaagcuaugaagggaauauccccuuccuucuggcaauucuguguagcuggagauugaaccuugaaaucgcaguugguuugaaugugugguuuguggaaauuuguaguugcaggagagcccuguuucugccugagaucuaaagcuaaaugggcauuuggcaaaugcuggcagcgacggugggaauguaaagugaaauggaacagagcugccaguggcuucagcuguuugaugacuucuucuccucaccacgagcauuuuuguuuggauugggcucacagccccugguugcccaagugcuccucaguuggauccaagggagugacggggcugcccgacgggagaaggcucucucaucugagaagaggacauccauccuggggucggccagcucagggaggccggugaaggagaaggcggcaggaacucugggcucucucaucugagaagaggacauccauccuggggucggccagcucaggagaugggugaagcagcaggaggcgggaacuuugggcucuugcgaggaugcaagcagcugcuuggacucacaauucagagcccugcuacauccugcuuguggacaucuguuaaaggcacugagaucccacaauuucaugaaauagaugaaaaaauaaccuuuuaaagccaauuuuacuucaccugugggcugaugacagcaucuggaagacaugcuuuucaucugcaucacaguuacgcucauugccgccaggcaguagagcaagcaucaugaaagccagugggaagugcacagggauugugccuguggaugucagaggcuguuuggugugguuugugguggaucagagaaguuugcuuggaugacuacguugaggaagagccuucccggcaaagggaaugggaugugcagagauguggggucacagcauaguugguuguugauuacauuguaaugugcucccuccuccaccauuuuuuucuuucccaccaaacaaagcugacucuagucagccuccuguugguccccgcccuguaggguggggauugaaaacucaggccacugugacauuuaggacguaaguaacucuagagggugcagaggaaaagaugagaaggugcaucuccuuagagaaucguuaccacugaagaaauugggccucuggaagguugaaggacuugccaagacuacacagcucggcagcagggauaugcagcagggauucaguuccacaucuuauggcuccaagcccggcauucuuuuucacuaauuucuguuaaucguuguguacauuugcugauuaauugcuaauuagaacauacuacaauuugaucgugcuucaaccugagaacauuccuuccuuuuccuuauuccccagccuauaauguccacugacuggucuguaguugauauaacagugaaugcucuauuuuuagccacuauuuuuccgcuuuaugaaagagccacuuuuccccucaaguuacaucugaacugcuuucaguuguuuuugucaaaggagguggaaauugguuccagcacagaugucuccuuuuaaucauaaagguuuugaaugauguuguauauuaaucuagucccaguauauugccccaaccagacuaccucagucaaagacacugcaaauuaccucagaauuuuuaauuucaagacuuuccaaucucucucuugagugcagacacuguauuugaaccucauucuacuuuaaaaacuaaaacuaaaaaccuuucuuccguuuaagacaugaauuauugaauuacuggaaaaguuuguaaguguucauuaauuuuuuauuuuucauccuauacuccaucucucuucaaucuaauuagaguuugcaugaguacuggauaacaggaaguacugggaagcagauuaccuuucuccuguuccucuucuuuuuaaugagaaccaucugaaauuggcccagcauacgaguuucaacaucaaacgcuugcaagcuaagugaacacaucuguucaaguguucgagcugcaaggugggucuggauggauucguguguuuaaccugacagagcccguggucacuuucucaaguuuauacucagcuagccuggcuggacuccaaacuuucccuauggaagaaacguagcuuuguaauucacagugacuacugguaucuggcagguaaacuucccacuccgaaacccaaaggaagcguuuggccaauugaauguaaccguguugagugauacccuuuuaugugguggugagaugaucucauaucaucugguaccuauuuuuacaguuaaggaaaugauccugggguauugauucagcagcuauggaugaaggaauguagguggccucacugauucaugcagggauagauggagcgagggaccucugggccaagagcgccauuagaaucucaggaugguguuugagguagaagccaggagagguaagcgagcccacuccccaaauaacccuugacgcgauugucagaaagcguggguccggagccggcgugggguuuccugugcugggggagggugucacacuuaggcucuaaaugaugaccaaugccagcuguaguauuugacaaauacccacagcugcggugggaacguaucugaucuuaguguaguaauauuagagucaagguagacgugugcugugaaaggaacaaccuguugucuugguugggauucucuuuguugugguggaguuaagguauuuuauucuuguaauacugucgcccauggguuguggaagaucacuucucauucacucuaucaccaaauauuuaccgagugauuuaccuugcaggcacugggaauacagcuaugaugaggucacggucccucagggcguucugaggauaccuggggaggcaauccaggaaaccauucgugucaguucagggcuaggggcugugcagaggggccuggagggccaggcuaacccagaaggcagaaccagagaagguuuccugauagaguacagcaggggcugugucccaaaaggacaaacgggaagaaagccaaagacuuaaauggaguggugagccgaggaaacagcagaaaacacgcugaguccugacagaagccacaggauggcgauuuuaguuggaagagugggugcagugaagucagagaugggcguggguaggauuuugggguggagcugugaggggaaagaauggggugagugaacugggagggcgguauucaaggggcuugugcggucagagagagaauggacaaaugagacucguucuuaccugagaacaacggcacaguucugucuuucauaaacuagcucuacgauuguacuguuuaaaauaaagacaggcuuuugaaggacuucuccggggcugugcaaaagagcagucaccagagauggagcuaaauugguucugcacugcugaaaucacuagagugguuacauagcagccauccagacuagcugcuccuucugcaggugaggaaggugagggccaggaaaaggaagacuugcccggggucaugcagugggucagggcagagaugccaccagcgcuggaaccagcagguucuucauucucucgaucauuucccaggaaagucagcuuucuuaggaauccuucugcuucuaggcugaauucuuuuuagcauuuguagaaaauccagcaauaguauauuugauguuuaaaugaauguaaaaugaauguuuccauccccuaaaaaaaaauuccaggacucacccauucaagcuccuuuuaugugguaaaaguaaaauucaaagagauuuuuuuuuuccugaauaacuuuguccugaauuauaucaagugucuuuguguuuggauaugaaauaauggaaauaaggauauaaauuuacuaauuuuauaccucagggacugugauaaaaaacaguaauuuacucuucuauuugcaaauuaggaaaguagaagauuaaaauuaugcuucccuaaguaguuuuucuguuucuguccuguuuauacaccugugcaacugaauguuuuccuccagccugguguggagagaggggagacgugacagacccaguguagacauaauugugaguagcagccacagugggauggguagggucaggggaaguuggaaccugagaggcaguuaccguaguggaacacuccagggaggugauagcuauuagugaguguagcuuugucuagcuccaauauaaaaugcucucagagguaucauuucuaaauguuuaggagcaguuucaaagcuugcuugcucuucuguuaagcaaauaaaggcuuaggaucaaccuaaaagaacagcuaaucagguuauguucacugguggcaaauuuaguugugacuguaauucccauaugaaauuguucugcccugggcugcggucucacccugcuugauagaagaauacgagaucugcuguggguucuauguuggaggauuuuacucuccucuuagaauugcuaguacuagauagagcuuaggaaacaagggugaagauauuuugaauugauuaacucagauaugaguuucaccuuuuaagcaaguccaggagagaaaucaaauugaagcaugaagguacuagaaagagcaugggcuuuggagccagacagaccuggguuugaauccuaccucggcaauuagggguagaaggacauuuggaccaauuauguaagcuucaggauuaucuugcaccucaucuguaaauaacaaguauuggugccuuucaaagauguugugaggaauaacugaaauaaacacaagagacaucaaaucauuaccaaguuaguucacuucuuccagauccaugcuauagacauucagcagagcauuuguuaaauauaagacugugcuagauauuugggagaggcaggaucaaagaagaauaagaccuauauucagcucuaaagagcuuacaguuaaguggggaagauaugacaugcacacacugcaguccacaagcucuggccaugcuggccucauguuccuggaacauucaggcacgcuucugcguccgcacuugcccuccgcucuuccuggaacugcugucuccuacuccuucaccuccuuuaaaugagcuuuacucaaauaucacuuuggugagaccuuccccgaucauccuguuuaaaaugaacucccuggugccaguauuccccaucccucuuccuuguuuuucucccaacaaaaugugugugugagugugugugugugugugugugcgcgcgcacgcacacgcacgcgcaugcacauaucuucucuugccguguguuccaccugccucuucaguaugaacaccaugauuaucugauuuauuuacugcucuaucccuacugccuagaacagugccugguuagguacucaguaaguguuaauggaauaaaugagugaucuaacuaaguaauuccagguacagagagggccaggcacaaagagccccaguggccagaggagcagaagguauguuagggacuacauuuucuguggcugcuguaacaauugaucauaaauauagcaucucaaaacaacucagauuuauuauuuuagaguucuguaggccagaagccugacccaagucucagaaggccaaaaucaaggugugggcaaggcugccuuccuuucuggaaacuccaggggacugguuccuugccuuugccagcuucugguuaaguucuucucacagcacaucacccugaccuccucuuuugccucccucuucuacuucuaaggacccuuguaauuauauuggacccaccuggaaaguccgggauacucucagcuauuuuaaggucagcugauuagcaaccuuaaucccaucuacaacuuaauuccccuuugcaauguggccuaacauauucacagguuuggagagcaggauguggacaucuuuggggauccauuauucugcuuaccauagagacuaacauuuugcuuagaucuaggguuuaagcugccaguugugaaauguaaaacuggaacauucaaucaggaaugaccaugauuguuaaggucuaaugggugagcuugaucugggaggcagugggaaguugcugaaggcuuuggugcaggagagggaggugaucuuuaggagaugaauacgggcuuaaagcaggcauuugaagggagacuguuguuuaccuucuuuucuuuucuuuuuuugaggcagagucucgcucuguuguccaggcuggagugcaguggcguggucuuggcucacugcaaccucugccucccacguucaagccauucuccugccucagccucccaaguaucugggauuacaggcgugugccacuagacccagcuaguuuuuauauuuuuaguagagacgagguuuugucauguuggccaggcuggucucaaacuccugaccucaggugauccaccugucucggccucccaaaguggugggauuacaggcaugagccgccgcauccagccuguuguuuaccuucuuaagggcauuuuaucuccucccuccuccauguacagaaaguuagggauguauuuagaauuaaaaaaaaaaagugcaccuauggugucuuuuuaaaauccacucuacuauaucacacagacacacagcacauacacauagaggcccacaaagcccaauuaugcagacacaagugcuccuaucuccucauacacacacccacugccccagccucagaaggagagucucaggaucuguuuucugugguucguggugcucugccccucccuuuguuucugcccuggcacacuugagugauauuucuucuucccaaaaacacagacugacucuggcagugguucucauggggucguucuauaaaccuccuucaacgggcacaugacagucuccagggggaugucuagaguaugaaaaugucccucguuccucacccuuaugucauccuucacacuggcccugcuuucauguaacuuccuagggugguucuugucucugacacccguugaaagucucauggauagugaacaccugguuuugaauagugucuucuaagagugcuuacccuuugacuagccaccugaaagcagcacuguccaacaggacuuucugcaaugacauagugaacuguucuguaucuggguuguugagugugguagccacagccgcaugcggcuguuagcuucuuggaauguggcugcugcagcugaggaacugaguuuuuuauuguuugaauuaauuuaaauugaaauagccacaccuggcugguggcuaccuguuagugcagcuuuaaauaagcaggacuugcugagcaugcugaaaagaccauagcaguaucuguggcaaacagaguaauauuugacaagaagauagccuuuuggaaucaaacagaccuggggugaaauuuugguuccaggcuagugauugucagguaagucacuuaaucugagucucaguuuugucauguauaaacuggguaugaucagugauauauuagggagaaagauguuagacacccucugaccuggggggaagaagaauauuucaccucugaauuguugcacauaauaaacaucagaccuacuuuucguugguuuuuauuauuauuuuuuaguauucuauagacagugugcccucucauugccugacccaggguagacuuuuuccacucccugccuguguuaccccaugggauuugaccuuacauacauagaagagcuaugugaagauacuuacauacauagaagagcuaugugaagauaagacgauaucaguaaauaucaguaaauaucaauaucaguaaauaucaguaaagccuucagcauugugcacacaugugguuuucagucauucauucaacaagugcugaguaagcaacuacuaugugccaggcacugugcuagaugccagacguacacuggccaaccggaagcagaggaccugcuuacugaauaggagggcagacauuucauacaugguagcucauaauuuucuuuugaauuuuuucaguguugggggauuuuguuuuuaguuuagguggaagucagaauugggucacauggguguaguuguacuuuauacuuaauaagguuuuagcuguaggucuccuaacaaauaacuauuuauccuauucuucuguuuuuuuaaaauaucagcauuauugagguguaauucaccugugaugaaauucacccaguuaaaguguacaguucagugguuuucagucucuuuacagaguugugcaacuagcauggugucaauuuuagagcauuuuuaucaccccagaagaaacuccuacccauuagcagugacucuccaguucccuccaauccucuuagcccuaggcaaccacaaaucgacucugucucuguggauuugccucuucugggcaugucauauccauggaaucauacauguggucuuugugauuggcuucucgcuuagcguaacguauucaagccucauccauguuguagcagguaucaguacuuuauuguggaaagguucauccauguuguagcauguaguacuuuauuguggagucauauuccauugucuggauauuuuauugauagacgugugaguuguuuccauuuuuuggcuauuaugaacaaugcugcugugaauauuugugaacaaguuuuuguugaacauacauguucauuuaucuuggguagauaccuaggaguaggacuguuaauaugguaacucuaauugggaacaugaaaacucuacguuuaacccuuugaggaacuuccagaguguuuuccaaagcuaccauuuugcauucucaugugcaguguaugaggguuuccguuucucugcaucuucacuaaccuuugcuguuauccugucuuuuugauuauagccaugguaguggguaucaaguaacaucucacugugguuuugcuuuauauauuucccugaugauaaaugaugccaagcaucuuuucaggggcuugcaggccauuuguauaucugggagaaaggucuauucacguccuuugccuauuacuaauuagauuauuugucuuccuuuucuggccugagcaggaugcugauaugcuaacuggugaugagcaaguauggaaggaaguucaagaaucccugaaaaaaauugaagaacugaaggcacacuggaguauccuuucgccuguggauugagguggacuguugggauuguuuccuuguuuucuugaagcccugucguaaugaggucagaggcgggguuugaccucuccaugagccagugguuuucauucuguuccauggucacaggccgcaccuccgacccuggccagcaguuugaguaaugacaaggaaguucguggcaaaaucagcgugaauaauaacucacuaccguuagguaauaaucaaaacucauggccuagcaguaguaggaaaguaagaauuagucucuuuauauguaaaagguaacaaauuccucaauuuucuucucccauaaccacuaacaucucuaggaaagaguagcuuagaauccuuaucauucagugccauugaccgucagacccagaagcuucauauuaaaccagccacgacuacaauggcaguggggauugcugcacgacacauuuucucagcaugaauaguaaugaccacagguggaccaaaguucagaguaaggagagaccauguaggaugaaggucaucugggaaggcuccacuaauguuuuacugugcaagauagccugagucaggggcaggauuuggauaggccaaggcugagaaggaggccgcuccugguagaggaguucauuggagugaagcugugaugaagggaaacagcaggcaagaaggaagagaucaagguggaugaaaagacugcaaaaggucauucagaggcucugggguaaauuuauaucccaggcacuaagaacauagcagaugagguuuccaauuugcugacgaugcuauuuaaagaguuguaaagagccagagaaggagguagagggagguuuccaguuuuaaaggugaaggacauaauuuugaaucaauagcccacugaguuuauuagcagucuuggguaaagaaucuaggauugguuacuaaggaauggaaaagaaagcugugaucaucacagugcugccugguuucuccaagagcgaaugaauccacagagucacagcuuucuuugguaaaguuuguaucgagacuuuagaaagggauuugacgaaaaguaaucaagaaacuuacauuagauguuagcaaagcuaacugaauagcuacacugaaaaaaugauguuacaugauucagugucauucuggaguguuguuuuuccaucucgggccucuuuaaugcauaauuccauaccucgaaugaagauacagaggacagguuuaucaaaucuccaaagugacguagauggggaggauaauagaggugggaugauagaaucaguaucucgaaagaaaaaaaagaguucaaaagaucucuaaauguuuaaaugguauccaaguuuuaaagacaugaaauauaacaagaacauauauaaaauuucuauucggaucaaaaaguucaaauauguaaauaugcauaagaacaugugaaaaaaauuuagggcuuuaguaaauagcaaaauuuaacaacauuuaagaguauaauauaaucuuaguacugugaucuugggcugcauuaauauugauuauaaaaugauagagaugauaguaccagucugauuauuucuggaauuuucuauucaguuugaggugggaaguauuaaaaaggauauagaaaaacaaacuaguuuugagggguggaacugaaauuaaggagggauuugaaacgcugucuaugaugagauggaagauacuaggaaaacggaaaacagucaacucuggaagcaggaggucccugcucaugggcucaaagagccuuuaugugcagaggaguagaccuguucuguguggucccuggcagcgguauuggggcccauggauaacccagccagaguucaguuucaacuggacaagguuuuacugaaaacggacugugugcuggguaccuugcuggucaucauucaccugaugguucagacagaaguuagaagacacagcccugcacucacuacucuccuauauugugggguaguaaaauguccauuaauacauauuuugguaaagauacagacuuauggcggcaucaaagacacaauagucaacuuugggaaguugaaagauuucacagaggaggugaccagugagcugcgucugggaggauuagugggaguucaccagaccaaccaagagaagaggcauccaacacaaggaaugaccugugcagacgcgcagaacaugcauugcuacugagaagcugcuggcugugcaauaugagaggaggggaagguggcaaggccuuaacugccaugcaccgguuagacuuuauaggugagaggaggccaugggaugauuuuuuaagcaguagaguaauaugauuaagugaauaaaagcucuguggucugacagucauugaaucucaguaaguugaguaauucccaagugaauuuacuuugcuucccuuucucuuccccugauccucuuauggucauuuaaaaguauucaggaaaaaaagauauccguucuguccacuaggaaucuguucucuuugggugcacucuccagcccugcuaggucuagagcucagcuccguacuggaacagagugaauuguaguaaacaccacacagaugccagggacuaaaucuuugagcaaauacaugucaguaguagcuuggggggaaaagccucuuaguuaaaauuauuccauuuuuuggcucacugggguguuuugcaggaaagguuuugccuuguuuggcaagagacaguugccagcauugugaagggaaauuggcacguagucccuuccagcuugcugggggauaaaauaaaugcauuccuaugaguagcugcagaacaucacaucuggcuucuacuucuaaggccugucaccucgaaccucuuuagaauaagugggaacauacauaaaugaacaggcaaauaauaguggaggucaaacagcacaauguuaaaauaagguacaagucuugccacagaaaugucuagcaauguguaagagacagucauuccuccugacaguucgucaaauaucuaauccuggaaugaaaagccacggagguuagcccagcaaucuguuacaaaaucagugcguugccuaagauacugcuucccccaaccucuaggggauacauucagcaaacuuugaacauacaugucagaugaaugcaagagcaaaucaugcacucgcuuuucuucaggaaaugaaccuuuucugggaucagggucaauuccuccaagacgggacucauccuaacauuguagugggugugauggaacaggcucucagcugugcauuggggugcuuuaaauucucaucaaggaacucaucuuuuggaguaagauacugugucuccgggaggccuuugcuggaaagaaaauacauuugcugugaaaguucauaaagguauuugucuccacucucaggaguggcuugauugguuuauuagaaguauuugcuaauguuucagaaagccguguucugagaaggguauggacauucgaagaggaagguuuugcuggacagagagggagaggggaccauaaacagugagcugucugcucagggcugggcgugcucuguuaggaccucagugaagaggguuuugaauugggggcaggggauggcacagagagcauggauuguaaagggaccaggucaugugggagugggaggggugugggggcacgaagggggcacugaguucagucaaacucaguccacugaaccacuuucuuuaagcccagucaggcucagaggucaugucacagagggaagguggaaggcacuaaugcuuguguagcaugugcuuugugcaugccacgaaauguuccccacugugucucugacaccuggaacucucccuggcucaugagaggacacaucaugaacugugucauuuuacauacaauauauuacucauucuuacguugacgugagucauuucuauuucuggccuaucauuaagcacuuugacuuccucagaaccucaacucugauaaaugacaggacucgauuagaucugaaucuagcuuuacuacagucaaaggcuaggcugccauuucugaucuucaaaccuuuucacccuacuggaaugacaacauaugaagcagaugaauuuggagcuccacugggugaaggugagacaggagugagagaaggaccagucccaguccugcacccuccuuggucuccagcucgccuaacacaccgcacagugaagaaacugcgaggucccaggguccugcacucuggccuucgcuguguuucccagagaauucacuggggagggauuaaaauuacgcuccauaaaccauguccucaguccucugacugccucuguaagacagggaauaucaguuuuaaaaagcgaagucacuccaaggcuacaugagaugaaguuacugacucaugguuaaucagaaaggcaguuacugagaaguggacauugagucuucuccccauccuuuuuaaagcaucguuucccuugccagcaauugaugugcauaagccauguuccuaauacugucucuuauuuuggggguuuaaaauaacauauuuuaauguauuugguuaaguacaggcuggggucacuguugcuuuauaaucggaaaaaaugagacccaguggaaaucuaugucuucaaauugcuccaccuagugugugccuguggguugugugaguuuuuggguucauguaugcccaaaacucagguaacacagaagcaaacaugagcucuuccuuuugaaaaaggaaucucucuaaagcaucuuuaauuucaaacaguuuuuaaacagaagcuaacagaguaaauaauuuaaaaucgaauuaacuuaaucuuuaguccaauuuaauaaaggacugcauuuauuuaugacuagauuuaaagagaacacaucuaggaguaugaagcaagaacaggucuuuggaaguuuuaaaacuccaaagcacaggccugguuacgagauaguuuguugauguaaacagaauucacuucacugagaugccucuucugugcuuuugcuucucaaguguguuuucaggcagcucaucugugaaaaauaacgggugcuucccucgcuccugugcuugggagcucuuuagccuuuuagagaaucuaauuuuguuuguuuuuuucuugaugaagacaaugaauccuuaacuaagguuaauaacagagugggagcagguucuggccaugugccaggcaaucauaagcagcaauucugaacggcuucccgauaucaacaucuaccagcugaaggugcucgacugcgccauggaugccugcaucaaccucggccuguuggaggaagccuuguucuaugguacucggaccauggagccauacaggcaagucccagggagagggcugacauaagggcuaggacgucuucacguugggcaaaggauccauguugugaagucauucugauuacuacuuugcauggagcauuuccagcugcuucucaaccauuguuuaaaaccaagucuuauuuuauucacuccucuuguucauucacuuaugcauucauucaucauuuguaaaguuccuuccaugugucagacaccguggguguacagaaacuaauuagaugcugucucuaucuggagcagaugauuacaauacgauguggcgcuugcagugacaaagacgggcucaggguggugggggagcuguagaggaacgcaggcucagaccuagcuugagaggcugugucaugagccucugcugguccaggugaggauggccauauggggcccuuggucuggcugacaguaagaaugguccuuuaucucucucaggauuuaugcuuucaguugaaucauuugccuucauaaucaccuugugagccagggaggacagcagggagacggcccugccucagcuucuccuugagucaggugaaggaacuauagguaauugcuucuugacugaucucagcuccuggagaccaguagguguuuugcccugagauguuuuuauaacucagaaaagcauugaaggggguaguguugaacugcugagaguuaggcgcugguggaugcugcacccugauuugcagucggcugagaacauaauucuagaaggugagacggagagcagcccaaggggaagggcacggagacauguggaccauaaucugaggugggaauggcucagucucuagcacagaacaagguugcuggcgggaagguaccucgaaagcaccugugaccaggagcgauggcagagggaggaggucccuggagaacaggggcuccaaccugggcagaucuuuaauuucccagcuuugcagacugugcaaauaccaugucagcccaaaggggcaacguaggacaacaggcagggaauggcuguaagcgaagaggagcagguggaaacgugagaguccaggguacuuccuguucccgcuagagggagaggaauuucccagggucaacauaagaacagaagugaguccagggucuaggauauuuguuuggacaaagguaguaaaccagaaaugagguguuuggucaggaagccaggcgugagccaggagcuuggugcaguccacaaggaccccgaagacggcagaggcuccaccagccaggcggauggcagaggucccuggccagccagugccaccagccugacccugagcauguuuucgggacuucuguagaugguuuccuccacugccugugggugaacagcuuuggaauccagacugugagucagcuuuaaucaaauguaugagggauuggcuugagggcugagacuguagacuuucccaugagcagugaaaugccugcucagagugaucgaucuuguggguucucggaaaauacgaaucgcauucaaagagauaaggcuuccucucugagccuuaguguugcaaaaagaggcaggucagaugguuggcguuaccucucugaacuccagggcuugcucugaggaagccaaacagccucugggugaguggauaaacuccauccaaaagaugcagacugaaaaauacccuucuuucuccaggcccccaacagcagcugcugguuccucacucuuggcuagcgcugcacugauucuucugccucauccucccuuucgacacucaggcugcccugcucgggccacucuuaagcacagaaacuuuacauggguccaccacauccauaaagaagaccacacaccuacacgggugucuguucugcacguauuuugcaaccuucucuuccccacaucuaccagggccucuuugaggcacuaacuuacaccuuaaguagcuggcaguuugacugacuuuaaacaaagaggccuuucuuguaagugaggccaaguccuccaccagaauacaguccauuauguuugggaaacguuugguuauauuuacaugguguuuggcaggucacaaucucuuuaagugugugcuguguucuuaugcugggugacaaauuuccaagccucccuugguuucucuucccuggcguguguugaguugcuuuuuggugguauuucaagaaauccaaucugcauugauccacuucacaugagugagguacgaaucauuugcuuuuaaagcuguaguugaggaaaaggcuauaaauaaaccagaaccaacaaaguugagagaaaugggcagguuagauguugucauacuuugccuuuuuccccuuuagcucaggcagagguaaaaauaaggaauguaugcaaauaggucagguacccugcaacccuguuagcaauuuuggaacaaaggcaggaauggagaaguuggcagugguuuucaccucucacaugugcaugagggaauucacacugagugcucucagccccccgcaucggcucccugcagacgcaggaggugggccuuuugcucaccuuuagccaaggacacagacaguuagcuaggcaugaguuaccaagggaugauugcauugccaucugcuguaacaguuuuacaauguuaauauauuguuugcaacaacuagauggaggucaagucuuucuugaugauuuugucacuccugaccuuggcuaaauuuuaauugcugaccuuagaggagaaagugcugcuauuccauuuuaauccaaauuauggccuucagcucccuucuugcuacucucauuuauuuuuacucaauagauuuuacucaguuuuuaugacgcaacucaacauuacauccuucauguuucauaaaacaaguuagaaaucacauacaacaaaauguauaauguuuaguauuagcccauaguaugucuucugauaguaucggcauauauaugugacuaauauggaaacucaucugucccuuagcauuguaaacaggaaguagaaugaagauaauuuuaaaauacuucauaaauuuuauuuaaaaguuuaacuuagucuaauguuaauucgccaauuaguaguucagaacuugggaugcauuuuccuauuaaagaugguuacagauuauggugaugucuccagacuaacccaugaaagucuacucagccuuugauagcaccacuguaugggcuauaaauuccccccccagccccuaaaaacggagagaaaaauacaaaauugagcacauuguuuuaaaauuuuugugcgucgaauauuaauuaaauuugacuuuucuuucggaacuagagagugauaaggagauauagaggguguuuccggcuuugaagaggacuuucaggacauucgcccguucuguucauuucuguugcgagauuaacauaugcuuguagggaaggacaauuuaagaggacagaaagguaaaaaucagccucaucuucaaacuguugucccacuccuuaaagauaaacauggcuaaaaguuuccuucuggaaauguuccgugugagaguggccggucugaauauauuccagagccagauagaccuccgucuuagcauggugucagaggauugaaaguaaacaguaauccuaaccuucgccagaaaacaugaacaaugguuccaucauaauacacagaauguuuuuuuaaagcccugcuucccccauuccuuuuauucugcuuucccaguuacucucaacucucuucccuucagaacuguucacgugggcucuuccacuuucuccugcacuucugcguuuuuccugcuugucuugcugggggaaagacucauuuccaauaggucuuuuaaauaugccugcugaggugguguauggaggaguggggauuagagaaaaggaagggaagccaagccaaagguccuccuuagugugcgggaaaaagagagagagagagagaaaaggauaacucccuagcccauguucuguaacuuuuuucacuuuacaagagaguguagacaucugucuagauuagcuccagauuagcuaccuuauucuuuuuaacagauacauaguauuucaucucauggauaugccauaauuuuuagaucaaucucugucguuuccauuuauguguacugugucaaacagugccaugauuaauugaauccauaggguaaauccacaugagaaauuccuaagugguaacuugguacaucaaaaguuaggucccccugcucuuaaagugaaaguuauauuuauuuuaaauuuggauaaccauuuccaaauuguaccucccccaccacacacacuaaaaugucacucuuuccucaagaaaauaugagaagagaugacguugacuuccguuguuucugaucuaaagccauuucaaaacguauuagggccuucaucucuucuuucaucaaagcccacauuauaggguaagauuuguugauauuaauuuuguuguccauaaauaguauuuuugugcuggugggaaugacacuuuugugacguaccugggaaaaaggcagaagaacaagaaugaugaagagacuuaaguugugaucagagaaagaggcaagggaggugggcuaugaaaucuccaucaaggagaagaaagcugauaagagugagauuucagcucagauaguuuucugugcuuuguugucagaaaaaaugggggcagguggagagaguggaaguauaaugcagcugguaguuuguguaccugccaugguuacaaaucagggguuuguaacugagagauugucaguuaauuacauagcagccccauucguuuuuaauuuugcgggggauuuuuuuuuucuccuuuuuuugagaagguuuggaagauagguugauaaacuaugagauuuccucauaacaguaccuucuacuguuuucaagcaggcuuuucugaagaacuccaguuguucuuucauggguuuuugucagugugacauucugguacaggagucugcagagcuugccggguacauguuauagugggaagaccugagcgcacguuuggugcagccacgcgcccagcgcuugcuuugggccugccuuccugaccccgcaucccaggugcguauuacagugggaggaccugagcgcgcguucgaugccgucacauacccagcgcuugcuuugggucugccucucccaaucccgcaucucuccuuguugcucagauguuguuagcuugcucucugaggacgcuugugucauugucucugacaacgaagcucauuccuagagggcaggcuggguccuuggcuguuguaucuaguuuagaacuuuuccuaauccaugcucauggaguaggaccuagagaacaacucagagccaguucucaccccagaagaagaaauaacuaucugaacuucauccaacauucuuuccacguauguuguuugccauuuauugucucugaugagauuuagagaauuauuucaccugauaaaugaauaaauguuuucuucucugcuuauuaaagugaacaguaaucuuguagccacuuaaucauguuuuccaugcuguaguuuucaauuaaaguaucuuuaguggaagacccucgauacaagacucugagcucuguaugugcguguguucguaugugugaaauacugaauuaucuggcaugccuaaucagggccucuuucuguuugcuguccauuuuguaagguuuauuucuuacugggacacuggggccgugaucaccugcacagugaugggcgaaggguccgucaagacccaagcauuuuuaaaaacuuuuaaauauaagccuuuuaauuuaauucugaaagacuuucuuaaugcagaaucuagacauaaaauccaaugaaaaaggaggugaaagaggggaaaauagagaaagagggaagaugaagaagaaggaaagaagauaugacaaugacuaguagauauuuauuacaccacugacuugcgcuuaggccucauuacuuauguuuuacuuuuauggauaauccaaggcuaauaugaggguuuagguaggagguaauggagaacauuaugaccgauuucucuggcucuucuuuucuuggaacaagagaaaugagaacaucucugcuucagccaucuacuccucuaaaguaccuugacuuccuuuagcccuaaucaccuugcuugagaugccaccuguacguuuggguaaagaccuucauugcccagcuuuguggagugguuccagcacugaaccuacugguuggugugagaaugacccagccuuguagucuuacuucuggaagaaaaaucuaggacacucugugcauggaacuggcauaagcucuggcccuucaacaccucugaaaaagaggaggcagggugccuugggccuacuccuucuccugaauguagcagcucuucugaccauugcugucaccucaggcauuugaacaaguguugcacauucugacagagcuuuggaugacagcagacaggcuuaggugaucuggcagcuucacauaccaugccuucauccagcuugccuauuucccaucugucuuaaggaugaaacaaaaugauugggugcugcugauguauguguagccccuacugggaaggggaggugacccauucauugcuuccaacaugcugcugcacauggcagaacaugcauaaagccugugcuuuccgucaccuccuggccauacaucucuauaguguuucacuccuggcuaguagaggccacuacucaaccaucuuucagaggaccccaucuucuguuucacucuggacagcauugccagaaccugcugcugaacuuuauucugguaacucucccuguagcaagagugcuagauauaguccacagccacuuucagacaagagaauugagaagcugcuuguuccuccccuguccccguuaugagcuccacugugcagcugucguccugccccaagucugugugugucuuuccacaucaaugcuagcaggcauggggcuuuaggaaaucagaucucuguaggaaccuccaucuuauuuguaugcaagaagucgaauauggccuuuagauaugccuuggccgguaggagacagagcaagagauaucauuuggacuaaagaagccugcccaucuucucuaccugauucucagcuuacugcauggccuccuggauguauagaucauaguugauuugaauggguacaucucacauuccugggucaggcacuuuuacucauccuuuucaacaaaaauauuuauggagaccuaccuacuuaaaugcacugugguaaacgaaacaggcaauacaaaguccucauucugguggagcuuacagauagccuucaacagccagcugaggggcaccugugagcaucuccagaaaaccaggccuuugacaaccugaggaggaauugcuggaccaaauccggccuggccagugauggacaagguuuuuagagugcuagaguaggaggcccugcaguggaucaaguacuuaucucucuuggagguccccgauugauuuucaggauuucauucaucauucuacuauuuuaaagccucauauagagaaucuagugccucugauuucccaaagcccucccuauggcuaaaccccuguuuagcuccacacugucauccucugagcuggaaggguacccagaagccagggccagcaugcucaggccuuggagugacuggcguaaagcuggaggcugugcucaugaccagcuugaugggugcuaguuggccaccagaggaugccuucucccagaagccagcaguccaggggacacugaugggggaauaucaucauuugacauggcuuuguuuaugcagcuauuuuaggguagccucauuuuguuuuuauuuuguuuuuugagacacagggucuugcucuguuguccaggcuggaguguaguggugcaaacacuucucacugcaguguuuacuuccugggcucaaguguuccucccaccucagccucucgaguagaugaggggggaccacaggcacacacccugacaccaagcuaauuaaagaaauuuuuuuuuguagaggcagggucuuguaauguugcccaggcuagucuugaacuccugggcccaagugauccucgcaccuuggccucccaaaguucugggauuacaggugugagccacugaacccagccugggauagcuuuagaaucaaacuuaaacucucaccuaccuuuacuauaaaauaauguguaaaauagagguucugcccugagaaauaaucugccuaaaacacuuucggguucuuuauacacaguuacagcugaccaagugauuaaguaucaacaaaaauugugcaguggcauuucugagagccccaggaccgugugggguggagccaagaaagccuguaauaugaaguuaguggcuuuacaucuggccagggcgaccugugacagcaugauuccacuugcauuucucauuucugccccuccuuugccucccauccuuaccugggacaaggauaucaauuccuuuuuccccccaaaccccaaguuauacauaauuccuacccauuuuuauacucuucccuggcuaugccaggacccuggaaacccauaccuuuucucucugucaucaagacagugaauaggccggacacaguggcucacgcuugcaaucccagcacuuugggaggccaaggcaggcauauugcuugaguccuggaguucaagaccagccugggcaacauggugaaaccccaucucuacuaaaaaugugaagauuagcugggagagguggcaugugccuguagucccagccaccagggaggaugaggugagaggaucgcuugagucugggaggucaaggcugcagugagcugugaucacgucguugcacucuaaccugggugacugagcgagacccugucucaaaauaaaauaaauaauauaaaauaaaauaaauaaaauaaagaugguaaauagcagagcuccuaauuucaaaucagaagugauaauccugcacuauuaccaccuuagagaggcccaaguucugguaagaaguacacugaucaacacuggguucuagagaacucuccuaaguggcagugccaccugacuccccuuuugguccauacacauaacucaucucugcuggaaguuggaagaucugccccccaaacccccucaagguaacuggaggucuucaaaccuuuaucuuaaagcacgguguaaaauauccucccgaugccaaauuccuccauuugacuuucaccaaauccugcucuuucugauaauccaauccccucuuuuaacacucaagcucccagucaagaaccaugugcuaaggggagcugcuggauuuccuguaacagcaugagucauucuagguagcaguagucuacugggaaaaguucagaccaggagggagccacuagaaucuacuuuguaccuuuggauaacuuccuagugaaaguuuuuguccaaccuggagggaccccaguccugugccuccuugguugcaguauccaaggaaaacagaaguucccagcuauagcuuucacccagcccauagaugcucgugguccuaaaaggcuuccugaacucuaauguuuuagauacuaauuccaggaucugucuucagaauccauuuguuuuucugucuggccuauccuccuuggagauauuucauucuggcucauauacuuucucucugcucacugucuaccuucuacauucuccucugcugcuccucccuaccugcagcaaggauaccuguuucccuuuacuccaaaaucccacagcuguggaccaaccccacuuauuccccgucuaccuugcuuggcucuugagccaccaacccaggccaggacauaagaaauaccuuuugugggccuagcacaguggcucacaccuguaaucccagcacuuugggaggcuaaggugggaagauaacuugagcccaggaguucaagacagaccugggugacacagcaagacuucaucucuacuaaacauaaaaaaaguagaugggcgugguggugguuggugccuguagucccagcuauuugagaggcugaggcaggaggaucccucgagcccaggaguucgaggcugcagggaaccaccacaugcuccaacuuggguuaagagucagucucugucucuuaacaacaacaaaaaauccagucaagguggcucaugccuguaggccuuagcacuuugggaggccaaggugggcagaucacuugagcccaggauugggaccagccugggcaacaugaugaaacccuaucucuaccaagaaauacacacacacacacacagaaaaaaauaacucggcaugguggcucaagccuauaguuccagcuacucagaggcugagguggaaggaaggaucacuugagcccauggaggucgaggcuacagugaaccauguucauaccacuguauuccagcuugggcaacagcaugagacccugucuccaaaaaaaaaaaaagacuuuaucucuguugcauuugccugacuuucaguauaaacaacuuccuuguggaauaagauggaagccacacuccacuccugggacuaggucaccugaacaggaaaacauuuaauuguuugugguucaccaguauguauggggcuaggucaccugaacaggaaaacauuuguuuguguugaccaguguguaugagcaauauauaugauuugagaaauuguguuuaggcuuccuauguugugaaagcauuuccagaauaagacauuuuccauuguaguucaauuuuuuuuuaacuugaacaagccaucacugagcacuuugacuuuccugauagaaaaauuuucaguuucuuauuacaacaaauuguacucuaagcagcaggauaccaaauuccuagggaaucuuuugggaugcauugaauuucuccuguugaaucagucucuuguuuggcuuccgugcagcuaccaagcugcucucuuuucuuuuucucaccucguggaagagaaaguaggaaaaaaagaaaucccauuuccccuguagggagccaaaagaaaucaggugggccugaaaaauggguaaugaaggauaaaacuuugaaugacucaaacacauuaaaacccauuuuaauuuuauguaaaggacacacuucauaauuuugaaaauaugaucagcacgcuuacaugcuacuuguguauuuugagugaaguucauauagaguuuucagaaacucccgaaggauagauggaugggacuucaguuacaaugcaaacauaaaacuaacuugucagaccuuauaauauuugaucgcuuguagagaaggauaauggcauuuauaaugagcaguaagagguccuugaaagaaauaaaaagugggguauaaaugacccccaaaauuacaguuauuuagagcaaggaaaauaucuucugggcugguuaguauaaagcucuugagcucgugagauagaauggaaaaauguguacuauucuuauuguuagauguguuaagggaaauggcccagccagguucuggggaacugaaguagcaaggguggccagccauagccuuugaacagggagagagcaggggcuugggaguagugagaggaguggagacagugcccugcucugcaaagagggaaacagaugauggaaauugcucuuccugcauaaaggacaccaaucauaauaacacugcccuucaguaugaaagaggaacaaaucugcucucaccuguaauuggaaauagcaccguaauguccucccaacgugagauaaacuggauucaacaaucauaaaagcaucugccagcuauugguuagcaucaucuuucuaggggaguaggugaaaggacuuuaaggacucuaccuuucaacuuucuuuaacugaaaaguaauugcuguuauuuauuaagaggcuacuguggaccaagcaacuugcuuguccuucuaauccucacagccagagugagaaggauguuaaccucucuuguccucuguggcagaagcugaggcugagacuuaguaacuugcacacuccaugacggagccaagauucaaacucaggccauggauucauuuauuuuauuuuggcuauaauuuuuuaaagcauuugagucagccugaacccagauuggcuuuguuagaaaaguauaaacuauuacuacacuacagagggcucuaguggucuuuccacuauaccauucuguuuuccuaccauaugacucugugaugcuaauuuuaauacaaguaacagaaauccaccugagcaccuucacgcagaguagaaucuguugccuacacacugcacagccagccacagaucuacugcgauggaauucagggaugcagucugggccgucggacugacgucuggcuccuuugcuuucuugcucuugcguucuuuuucucucccuccuuccuucccuuccuggaugcuguccucauucuuccucacagucuuguccacagcguggugagacagauggcuuccagcagcuucuucccccccaccccauucauguucugcuaucuguauaacaaaagaaaaaguucuauucccuccagcuccagauuuaaaaacuguguauuugggauggauggcuuuggccuuugugggucucacacccaacccugccuggaccgagggagaugaggugcuggcagcccugccaaaaaugcagguuugaaaugggacagacauucuugaaaaccuaggagggugggugaacucuggacaaaccagaagaauagauguccacuguacuauuccacucagaaauagucuaauaaacauuucagauagaaaacgacucaaagaugguaaagagaauccaauaaaaagacugaugaaaggacaauuacaugagagagaaggaagcagcagcucuccgccauuauguuaugcacuggggauugagcuuugcaagagcagguucuuagaauuuccaagggaacagcaggacccacuuggaccagagcacaagccagccauuuaggaggaagucugagagcuggaaaaggaaaagauggaucucuagaaagcagcugagguccuaccuggagcaaagaaauuaugucaggaccugauguaccugauggcagugugugacauacucuauggagguucuccaguuccccugugugcuaucuccuucuggcuacaggcauuaaguaauauagccagaaugcuacaaaauguagcauuuauuuuggaaaugcuacagaaacagugcaccuugauaucagcaaggcauuugauagugucuccuggcacauuuccuauggauggaaaaauaggaguuagugagguuaauuuauaccuuuuaaauagcuauuucugaaccauagucuuucacagauugauagaccccuuuggggaaauacgcagugggguauaugccucaaagcucaguguuuuuuuggucuuaaugguucucauuaaucaaagacuuaaugagaagaauacguagaaguuauguauaucaaauauggaagggauucaaagcagagaagaaucuuuuggagagcugaaccaaaguucaaauuaauuccuuaaucagaagcauuuggcaucaaagugaguagggguacacggaaaagucuucauuuggaaguaaaauucaauaauaggcuggagaaauuuuucuaguguuuaguagauuauuuuugguuuuuccaauaacauuaauuucugcauucuuucuuaauauaacuucaaauggguccuagccaugucguguguaugugauugaccacagaggcagucugucugugauuggcuaaagcuagaaaagucauguuucccuggucaugugacccauguuagccagguggcuucauguuggagccgugauggucguccguucuuggccuuucauucgaacuauuaagaaagaagacuucuccuuuacuacugcucauaacuaagggagcauagaacccuaagacugcaggccguuagcguucuugggacuaaaagagaucagaagaaaaaaaaaaagaaaccaaggaaguagaggugagaaauggaaagaggaaaaccggauccugaucacauuguuuaaacacugccucagaccgcauuuacuccuguacuguugaguugcauaagcaauuaggcugauaaacuuuauuuuuacuucgucagccuauuugaauuggauuucuucguucauacaacauaaaaaucauaacauauaucugggggguccagagagaacagugcagugcaguaaagcuaauccaaccuuaggcugcauuauuuuaaguauaguaucaacaucaaaggaugggguacauguauccaucaccccgucuagacaguuucuagcugaggaugaccaucaugagaagaauucuguagccauaugaugagaaauggcugaugagaacuggagguauuucaucacaagguuaaaagacugugaaggagagggauaccugcuguaaauuuccaaacauuuuaaaaggcugucuuguaggaaggaagaagaguuuuccuccuggccagaggaggaggaacuaggacuuguuacuuggaauugaggaaagacacauuucaugccagcaaauuaggaagaacaguuuguaacaccucagguacccaauaauggagcauccaacacuccaucguuggaaguguuuacauaacaacuaguugacaaccuguuggaauuguacccaaauaauuccuuuauugaauaggagguugcccacaugacuguaaugucccuucuagcuuucagauucugaguuucaaaauccuccaaaacuucuuuagucucagccacaaauaaaguacaaaacaaacuaacucagcuccaauucucacugccucucuugucaugaguuaucaugugguccauaagguuaggaccacacauacccuuuccuuccuccgacugguuccaagacaacauccugaggaguuaguauagcuuugguugcuuauaauuuuuuguguaacuuggugguuuaagguaauacaacugauguuacuuuguuucacauauauguauaugcacauacacacacacacacacacacacacacacacacacacacauauauauauacacauucauguauaugaaacauuucugauuagccacaugguggauauuuuaaugaaauauuugcuaacuucuaaaaagcaggagauuuuauuuuauuuuuuuaacuuagauuucuaguuuugccuggggaaucagaagacugguacaguggauccacauccccaaagcagcuguagcuaugcuggguagcagcugccuucuuaaaccuggcguauucucugucaguuugccaaagucuccacuaguuccccaccaggcuggcuuuacucguccacauccugucuaccccagugggcucguaagugugugaucccuggccuguguugcuuucuucccuaccagcccucacugcuggcaguucccacagcagccaucaugagugggagaguauuaagacauggaagcaugcuguguaaggcuuucucagacccaaagaacaugagagagaaaaaacacaaacacuucauucccacccaugaauuuucuauuaaaauguuuuuauuuuaaaaaaauacauauaagcugggugugguggcucacaccuguaaucucagugcuuugggaggccaaagugggaggaucccucgaggcaagaaguuugagaucaaccugggguaacauaggaagaccuugucuuacaaaaaauuagaaaauuagcugggcaugguagggugcaccuuuagucccagcucaucgggaggcugagguggaaugaucacuuuugaccccaggaguucgagguaacaguuagcuuugauuguaccacugcacuccagccugggcaacagaacaagaccccaucucuaaaaaaaaguaaaauaaaaauuaauauaaaacguggaacuuuucaccaguggagaugagugaauagaauauauagucugccgauuuauagaaguauggcaucuggauauaaguuaaguuucuuuucucauuaauuccccuguuagcaguugcuaauuauuauuaucaaagucggcuugcuguuccccagggccuguaguacaagcauaugacuuccuuccuguugaguagugguuuccagaguguguucugucaggauaauuguuccauugacuugaaaugaaaagagaauccuggucaaaugaauuugggaaaagcuagguuaaguaaaauggcuucaggucaguuggccgaaaaucaauuauggaaagccaauucaucaaaagccaguucacuguacaccaaguccacgaagagccuaguuuucagauaugcacauuuacccaugacgauuuaguagcccugucuacuaaguguuugauccuguuuugcugacaaugaaagaugcuuuucugaauauagucaugcauuguuuaauaauggggauacguucggagaaaugcgucauuagaugauuuuguugucacgcaaucgucaugaaauguauuuacacaaaccuagauugugaaauccuacuacacaacuagacuauauggugcuccuuggcuacaaaccuguacaggacauuauuguacugaaugcuguagccaguuguaacacaguggcagguauuuguguauguaaacauagaaaaaauagggcaaaaauaugucauaaaauuuaaaauuauauaggugcauagggcagcuccaguauaaucuuguggaacaacuauuaucacauaugcaguccauugacugaaauguuauguggcacaugacuguauuaacuaauauuaagauguuuccugucugagguaucaguagaaaagaaaauucuaaaaugcuggaaggcugacaacagaauucggcaucauuugaacaauuccuauaugaaauacaauuuuucuaccugaaguuuuggcauuucauaugugacaggauuguuucaacuacauuuuauuuuuuuauaugcuuuaaaaauguuauuuuauuuuguaaagaauuuuuaauguucuuucaccaauuuguaaauaguuuaaccuuaauuuuguguuuccguccguuuagaauuugaauuagaucuaaguuaauuuaaaauucugauguccuugagaugcauuugaauuuacauuuaacuuaaauguuuaauuguuagaaauacacaauaaaggccaguaggucauggaggaaaugagggaaaguaaaccuuagaaugcuuaaaauuuuaagcaaaguuaaaaaugauauccagaaauguccaaaagaaaccagaaguagucuaaaaaucucauuuguaaaaucuucucuguuuauauuaaugugugcucuacucacuuuuuggcuauuuaauuuucuuuugcaacuugcacauuccuaucaaaacuuugaaaacaaucccauugugaguauuaaaucuuuauuuuaaaaaaguugguaaauuuaguaacaucggcaaauuaacaguucaucaaauuggucuuucagcaaauugaccuguauuuaaaugaagucaaaaugguuuauauucuacagaacuucucagagcuuuuaauaacuuaauguauguuuugaaucuguaaaagggacaucaagaaugacaguaucucccaaaguuaaguaacuggacaacucacggucugugaaaugcuuucaugcaguauaguuuggaagugcgcagcuacccaaaugccaagccuuggcucucugcacugcuucuaggaucuguauuuaaaagucccguuaauuaguugaaaaaaaaaguuuggccuuauaucucauuuuuaaaauaaaaagcaguggguuucuucucccccugggaucccucccuuuuccuuucagaccugcuccuuagcugcaacuuuguuuuuuuuuuuuaaccaugucuguuuucaauacuucucagaguuauauuuauuaccucuauguaguauuuuuagauuuaaguuucuuacaacugaagaagugguccauuccuagguaugaaaaauaaagaucuagcuuuuauuauguucuuuucucuauucuacaucucuuuuuccaugaagguaauaguacuuuaauucuuuuauuggcaaccugugacaccucaaacacuauauugaaauuucuauuucuuguuccaucaacuucaggcaguaucucuugauuucccacuauuagauugagauuuaguacucuuguucuugguggagaauuagaauauaaaauucuccauucaaaauaauuuucaaugaaaauuucaaaagccuauuacacggucucguaagaucuguuauuucugaugcuucuuggcuucuggauccuuugucaaucacccguuuuaucuuuucuguaagguuuuaggcucugcucugcucuuugauguucugaaaguucacacugauguauucggcauggguaucuuuuucauuccuacaagacccuuuuauuuuaaacauucuugucuuccuuuagcucugggaaaaguuuucccuauuuuuuccuuuuuaauuuuauuuccucuguuuuucuguucuuucacucugaaagugcugguuaucacauguuaaacuucucuuuuucuagugucugggccuuuugcuuuaugcucuagggauuaucccugacuucauugugcagacauuuaaucaaaauuuuaucucuuaggaaacuuauuguuuuaauaauucacaagaacucuuucuuguuuuuggauaguuccuuuuucauggcucccuauucuuauuuuguggaugcagcaucuucuugagucucucaaaggauaauuggucauuuaaaaaauuguuuuuuuuuucugaaugaacugaguguucuucauuuuucccccugcuuauuaauucugcuuucucuugcuccaagcuuuucuugaauuuuagaugcuucuugguuguccguucauauuuuuaacaacuuuauugagcuaucauucauauaccacauaacugacccacugaaaguacacaaaucacuggguuuuacuguagucacauaguugcguauccaucaucacaaucaauuucggaacauuuuaauuacccucccccagaaaacuaugcuccuuggcugucacccccucauucucuuacugucgcccccgccuccccaggaaaccgcuauccauuccuguuugaaaauaaagguuagaaaggcuggccugggcugggcacaguggcucaugccuguaaucccagcacuuugggaggccgaggugggcggaucacgaggucaggagaucgagaccauccuggcuaacacggugaaaccccgucucuacuaaaaauacaaaaacuuagcugggcgcuguggcaggcaccuguagucccagcuacgugggaggcugaggcaggagaauggcgugaacccgggaggcggagcuugcagugagcugagauagcaccacugcaguccggccugggcgaaagagcgagaaugucucaaaauaauaaaaauuaaaauaaaauaaaaaggcuggccuggugcugugaggguuucaaaaugagagugagugagaaggcagugauuggcaaggagagggcagagacagaggucaagcagagcucaccgcccagaaagccagguguggcaucaggaccucagagagcccugagaggggcuagugcugcagacgagcaaucaagccauuccacugugaucugccucacuuccaaguucaggauucagaggacauucugaauagauguccucccauagaugauaaugcaacgccucuagauuuuagguuucauacgggugggauuguaugucuccugcacagcuuuauuuccugcaccucacauagcauacauuaaguauuacagauuuauagaguaauucaacaucauguauuuauauaauuauaguuugagauguacauuuauauacguaccucuuauuugagauaggcaggugugcaaaguuagauucaccaugacacuaacgagacuuaaacuguagggccuuccacuugcaggagccccuuugaaaacucuguucccauuucugcauuugucaacuuggcauucuuaaagaagguauacaaaauguuaggcaucagaacaccuaaaccuagaccuacauguaucuagauauagcagaaauuaugaguccccauuuagagcucugaaagcuguggcucagagaguugagcaccucacccaaagccacacaucuaggaggugggagaacauuucuuaccugaaugauuucucccaccauuagcccuccucaucccccgcagggugaagguguggcuuccaacugaugccuauucccaggacaccagccacuggaaacggugcaggaccuggguuacacccagagcagcccugaugcugacucuucaugggaggggucugugcccccuaagcccacaggcuuccccucuguccaauaugaaccaagcgaggagagcccaugcaccccacccacacaccugucauugcaauuuuaguugugaaauaacuucaaaaauauuuucuuugaacaaaagaaauacugcaucuuuuccacuucuguuucuggaugacacuuuuaaucucauguuguuucauggccuuaaaauaaaauguaggaccuaaggggaauggaaaaaaaagucagagaucauauuuucaacugccaacuaauucgaugauacucccuggugggaaaaucaaugucugcccugcagaggugaaucacacauuccauuguguuaugccguugacuuccuuucuucuuugaaaauuaacuuuacccuccaugcuuuucaaccuuucagugaaguauauuucaugccuugccuuuccccagacacaaauguauguguucugaguagaaaccugagcuggcggugccuagaggagauagucugaguguuucagaggauugaacugaauuccccggggguggacuagaagucuccgggugucucgggcugaguuuccaaagaccucccggcaccuaaacuaauguggaaauuggcuccuggaaauucuuuuuccugaaguuauugauccagugagauuugggaaggcuaaagucuccuggguacuaacacagugugauaaaaaaugcgaagguugcagaggcuucuuuucugugcuucuucccucguguacgugcccucaucucccacgacugcaggacagagaaucacccagaccuggugcugccugcugcuuguucaggccauagaaugccucuucccuggaggucaauagccacugcucuagccccuuugcccagccucucaggcuugccaccgaggacuuucccagaauccaagaagcaaacagggaggaugcccugcacuacgggggauuucuaggacccgucucccagcuguggcugccaucucuucuucaucuucuuccucuccuucuucuucuucuucuuuuuuuuuuuuuugagacagaggcucacucugucaaguagcugggauuacaggugcccaccaugccuggcucauuuuuguauuuuuaguagagaugggguuucaccauguaggccaggcuggucucgaacuccugaccucaggugaucuguccacucagccucccaaagugcugccacugcgcccaacuacuggcaucucuucugauuggucagugacgaugccgugucuuagguaauugacuaucaaaauauuaaauaauuaaguuguggauaauuugaaagaucauccccacuccugaaaaauccuguugaaauggacaauaggcuguuucaucuguuugaugcccugguuccuuggcaaaccagaagccaaguuauccacuuaaagguugaauucccggggcucugcucagggcgugcuugucguuuugcuuugccuugucaagguuucaucaacacuggugacacaaaaugagacauugaagccaucacugaaaccgagucgggacauugcugugaguguaggaccaguccccugcugccagugagugcucucugaguucuacuuccuuauaagagcagguacaagcccugaagaauggaugccacaagcaaggccagcuuucaucugucagcagcuucacauguuuaggacgguccacugacuagaaauacgcauccuagagaggugcccagcagcggauggaacacacaaaccccaaccgacucggagcauuugugccuuagguggccuuuggcugagccuggaauuaaccuucauaaacacagacuccucucucaagaacuugccuugcacgaagacggcucccuauggccagcccugaaugugcuauugugagugcauggucaguucaggaccgcacggaggaugggaaggccaguggcuaugcgaggggagcacagggaugcggguuuucagacucguuugaaaucagcuucaguuucuccucagcucaacugaaaccaggcugucuuggacuguaucauagcacuggcuucauuuucucucauccucuucaagcuccugcuucuguuuauauccagcugaaacucucauccuucucuccuggccacagaaguaguuaaaauaaccaaauugccaaugauucguuuuugccaaaggauauuuuucgaucuuggagacgucuaugagggucagauggguggcuaauguuugguaggaguugggaguugagguggggguucuugguucuggcaggaaugagccuuuguugucucucgacccucucugagagcagagagagcauuaacuagcaaagcaaguuuucgcuguccucuuaauuccugcccacaggcacuguuaacgcuaacaagucacgucgacggagaacagaaggaagaccagccaugauaauguccagagaggaucaaacaccuuggccuccugcuaaacccuggauuguucagaaggacuugcaucagggcgcugauaccuguuuuuccuaaugaucccauacaguccagagagugugugggaucauuagaaagguccccugccccugcagauuguucuugaggccuuccuaaaacugggguguuagaguaccaagcuugugcagaaucgagaccgggccaucugguaucaaccaugagacagucccuaguguaaagggagcuuggagugaaagggaauuccauguuuguuacuaauuuucucugugccaggcuaaaaauauuucagcagauugucucauuugagcucuauaauauccuugucaaguauguauuuuuauccccauuuuacccaugagaaaacugaagcucagagaaauuaagaaaccugccucaggggccgggcacgguggcucacgccuguaaucccagcacuuugggaggcugaggugggcagaucacgaggucaagagaucgagaccaucuuggccaacauggugaaacuccgucucuacuaaaaauacaaaaauuagcugggugugguggcgcaagucuguggucccagcuacucaggaggcugaggcaggagaaucacuugaaccugggaggcagagguugcagugagccaagauugcgcuguugcacucuagccuggugacagagcaagacucccucucaaaaaaaaaaaaaaaaggaaaccugccccaggaacuaggauuugagcccaagcauauccaacuccaagucucaugcauuuucuaccgugccacucuucuuuugguaaaaggugacaaauuuuuaaaaaugaaaggaauaguugcccuuauguaucuguaaguucacuuucucauauaauggaaaaggcccauguuccuauaacgugggaaugucuuccccaagagacucacuauaugaauuguugauuugauggauggcccuaugcgcuuauguaugcauguuacccaccaaaugcugcugucauuuagugggacaaaaauguaaccccauacccuaaaagaccuugucaauagccaaggcagagccugggccuaaaugacacuaggaucucccuuucuggccucccauguacgggcugaaauggugauuacucccuguguugccgugauccuccgaacaggaagauugcuccacuggggcugcucagaacugugaaaugagguuggcuaggaugucuauuauaauuugcuuccuaaauuuucagcuuacccaccugccacuacaguguuccucagaggacguuaagauguaguaucagagaacagaaguucauucuauuagagucagguaugaguccuggcaguuaaaggaugcaaagguuaguagggggcuggggugagcccauccucauucacagugguccaaugagcaggcagcucugauacgauuuuggaacucaguguucgcaugcuuaccugccugucuggaccauuuuuacucccggauaucgugacaaaggucagccacuuccauaggacugucaguauauccgugcauagcucacagacgugcaagcagagccuucccagggguguaugagaggucaaagaaaugcauuuaaaugcaucagaauugugacugaggaugucagaggcucugaagagcauuccuuuaugaggaagcuugccacagucaggcagcugggacucaaagcagauucagcuggcucagcccuguuccuuccccucuauucauagguucaggugaagaaagggccuuaagugaaaagaggacucugugaucaaauuaguuugggaaacuguagguuaaauaagguuacugcaggaugucccagaaccuuuacaguacacuugauucuaaaauaaaaagcccauguuuuuauacuucaauguuucuaaaauuagaguaaacuuuggaaucagugucagaagcggggaugggcauagagcaaguuaaaugaggugcauggggugcaagauucaugcgggugagacccugagagugagugugucuggcuucucacgccaaugagcucccggcccuggccaggacgcugagguugucccugccugcacaagaugcagggaccuagccagucuuuguacaugcuugcccauuugauggcaccucaggugaguucuuaaaauagggaguccaccaaaguugaauuuaacuuagaucccuucauuugcuacaccuugcaguggaaaaacuuggcaaacacuaccuuaacuaagggaucagguuagcuucacaagugaggccauguggcugccacguccccugugauaggauguaaugagaaggguacuuuacuucuguggcauuuuuuacaaaaauaccuccauuuagucuugagaaaagcaagagagaaacacagaucagaguacauuguacaguacauuuggccaggacgcuucaagacugucaagaaaagauugagaaacugccacagagcagaggagacugaggcaacaugacaacugaaugcauuguugucagaacagaacauaaaagagacguggguagaugcacgggugaaaucuaaguaaagccugggguuuaguuaauagucacauaccaacauuugcuucuuaguuuugacaaauguuccuugguaauguaagauguuagcaacagaggacuggguaaaggguguauaggaacacucuacuaucuuugcaacuuuucuguaaaucuaaaauuauuccaaaauguguauuuuaaaaacauuguuaugaaucagcauuauaaaagcagguuuuuuuuuuuuuuuugucacauauuccgggcaguaauuaaaggcaacagagauugccaaaugucuaggaauggaucguggaagcuucacugugcggagaaggugguuugacaguucuuggaaugcugauucccccauuaugaagaacuaucacuccaucuccaagaaucugucaagagcuuccagcugacacuuagcaaagucaauaccuuucagucacguuauucaauuaaggaaaauaugaaacaauaagcuuauaaaaaaaggcacaugaaacuugaauauuucuuuacaggauucaacauuauguuguuuauucuaaggauacaaaggagaccaagaucauaaguuuaugaaaagcaacuugucccucuaagauuccauauaacuucuaauggucaaaagugacucagugaacccuuagacucagauggcaaagagugauuagaugcaaacuguaacugagauacuaaagaagaaauccugagugcucaucuagauaaauguaggcucuuacuguguguuaaaaacaaaacuauauuacuuauaaucaggugucgucuucuccucaacucucaaaaaaaaaaaaacaaaaaaaacauuaaaucgaugaggagcuuaaaacugaugaugucuuagaaucuuagaaauaagacagggguggaaugcauugucccaaacuuaacugcccauggaacccuggaguuccauggaacacacuuugggaaagauugcuccauccuguuugcugccuguucauuugaugucggauaaauucccagccugaaggcugucaggguugcagccauuaaauuucagaaggauugugcuaggcagacaucuuuuauugagaagaucugaacccagagacacucauuauauaaacgagccccgaagggugagacccagccucuugaccaggcauuauugagccaggcuuuagguuagaugagacagacagauccuuucuggacugaaugugguaaaagaugccccagaccugcccauucauuagaaaguaagcccaaaaagcguggagguagacaaaguuggcaaaggccuccccucccuccuccaagaaaggcagugagcuuuaggaaacugauaucuguuacucagagaaaaaacaaacuguacucuuugaccguugauuuaggcaauguccggcaaaguuuccaauucaaaacgcccaaauuaggaaccaagauuaucccucacacacgugcaugcacacuuaaaucauuuggccaucuccagaaucagugccauuuucagggccaguuugagggguggccacaaaaccugacuuggccguguuuucuguucccuugucagugaugaguugaagugucguuucagcggcugcccucacaaaggaucuauuaauacaagccacugcuccagacuugaccuccagucacuggaaaacauugaaaacaacuucaaccaaaugaaaaaauacucuggcgaacuugguccaaacaucgacaaccuuugugugagugaugcuagaaaguggucuguguggcaggugcguuucucacugauggaaacuucaaguuguuagugguucuucugggacaagacuguaagggcaguugccccugcuguggcagaauagcacaugagaaaguuacccagguaccugguuuaccccgaaauauucaugucugagggugugagaggacccauggcacuuaucaaaggucuuggccaaaugcuagcuccuucccauuggugaagaugaggaaaaauugcuugcuaugcauaugucauggcuagcauuccaucauuguuaacagagcagcuacauuuuagccagcucaucguuugaggccuuuuguguaccucuguugugaaggacaguaauuuauuagucucaguaagauacagaacugucaucauggaaaagaauaacugagggugaggcccugcuaaaauauuggggaaucugucauucacacaaacguggaaccggauuucugaaguccaaaugcuguuuacuugggauuagcucuaguuugguaaagagguacgugaaguuuggaugagguuguugauacugcuguuuguggugagagaaaccaggccaacacuugugaucuguagcgaggaggggggcaggaccagcuggcaagaggccacccaccaagaaucuaugucuugcucuaaaugccaauucuaaaacucaacaugggcacuguggagguuaggaggugacaugaggagaggaagaagaaagaaauaccugucucuucugguuuagagauagguguugccuaucucaagugagauuuuagugaaucuucauacagcuggugccacucuagcaaacuguaaaucuuauuaguggguggguguugccaggaaaaucuguuaucgcuaagcuuucuacuuccuacaguagucugagcaauaucuguugauuacuaucugucaccaauuuuuggcccagaaacuuccccagagggguauucucuauagaguuacagaagaaaaacagcaacauggugcccaggccaguugccuacccacacacugauaagguuugguuguguccccacccaaaucucaccuugaauuauaauaauccccacaugucaagggcagggccagguggagauaauugaaucauggaggcaguuucccccauacuguucuccuggaagugaauaaguuucacaagaucuaaugguuuuauaagugggaguucaccucaacaagcucccuugccugccgccauguaggacgugccuuugcuucuccuuugccuuccgccaugauugugaggccuccccagccauguggaacugaguccauuaaacuucuuuccuuuaaaaauuacccagucucagguaugucuuuauuagcagcaugagaacaaacugcugagaucaucuuccacuaguucucaguauaucuucauacuauguuauguacaaucuuuuuugacauguaauucauauaacauauaauuacucauuuaaaguguacuacucaguggcuuuuagcauauuuacagaguucugcaaucaucaccacaaucaauuuuagaacauuuuuaucacccccaaagaaaccccauacucauuagucauaccccaucuccccagccccccagucccuagauaaccauuaaucugcuauuuaucuagauuugccuauucuagacaguuuauauaaauggaauuauaaaauauuugcuuuuuuguggcugacuuauuucacuuagcauaguuucaagguucaugcauguuguggcauguaucaguauuuucuuuuuuugccaaguaauauuuuaugaauguugcauauuuaucuaucaagugauggacauuugggcucuuucuacuuuuuagcuauuaagaauaaugcugugaacaugugugcacaaguuuuuauauagaaauauauuuuaauuuuuuucaaguguauaucuagaguggaauuaccagaucauaugguaaguaugcaauuaauauuuugaggaacugccaaacugcuuuccaaagugggugcauaauuuuacauucccaccaguaauauaugagaguaauacggagaguaccucuccauaucuuugcuaccacuuguuauuacaugucuucuugauuuuagccauuuuaguggaugggcgguaguaucucacugugguuucaauuugaauuugccuguugucucauccgugaaagggcccuaguguggaaccucaggagaauggaaacucccccugcuguguuuaaucuuauaucccuagggccuagaauagugcccaguguacaauaggcucccaauaaauacuuguugauugauuaaauauucaauacuuccauuauuuaaucccuagaauuaaguuagcuucuuauagguuaguuauaagguguucugaaaccauauaagugaacuuuucauacuaucucacauuaaaaucuguugaccuaucuuaaaaaaaaaaaagugauugucuuccuucuggagggcaguacagaaaaaaaaaaaaaaaagccaggcuaagaaggugaagaggacaacucuuggguaagugugaguuaguaaguagaaucagaaaaacuggccgggcgugguggcucaugccucuaaccccagcacuuugggaggccgagucaggcagaucaccuggggucaggaguucgagaccagccuggccaacauggcgaaaccccaucucuacuaaaaauacaaagauuagcugggcgugggggcucaugccuguaaucccaguuacuugggaggcugaggcacaagaaaugcuugaacccgggaagcggagguugcagugagcccgagaucaugccacugcacuccagccugggcgacaugagacccugucucaaaaaaaaaaaaaucagaaaaacugacauccauguccuaauauguaucagaagccucuucuaucugcaucagguuuucuccaaagauuuacaucuuacugggauaaaaauguguacauguacccaaacauuacaccaugcccuauaaauuuguacaauuauuauuugucuauuaaacauacaauaaaacuuuuaaaaugucaaaaaauaagcacauaaugaccuaucaucaaaaaaaaauaauguguucaaguguuucauuaacuauaaaaugcuucagagguguaugacuuccuuucuuuuuauuggaaagggacauguagauggcucuaacaauacagcaaaccugcaaaugaggugaaucuauauuuucuagaaggugucauuucauuuucaagguacugaagaaccagauauccuuuaauaauguuaauuuauugaagaauuuugagguuauaaaauguuaaugcaccucucuagucuuucacacuuuacucuggagagaauugcauuuucccuggcccgucuuaaggagcaagcaauauugaggugggaggggacagagggagaaggacagagugucuuuauuuaauauguggauaaagacuaggaauuugcauugcuuuuuauuccuuucuuucuguucaguauuccuuuucaucuuuuuuucccuauggaaauaaaaagguaguacuuucauaucuccuuaaaaugacuaaauguagaauuuaaccuuucuuuccucgugucugcccacuucaggcuuuagggcacaacucugugcugcaaaaugauaaagaauccugguuagaugggcucagcagcaggagaggacagauuagaagacagaagacuggguucuggacucggcuccucauuaauuagcucuguaaccacaugagugaccucacaucucugggucucaguuucucaccuggaaaauaagugugauaaggcagggcccacccagcucuuagauugcauaaauuuauggcauagccagucaaaaagcauucaucaagugcccugccaaauuccaggacacucuuagguggugggaugggaaggggaacacacuuuccuccuuggaagaucauagaguaggacaugaugcugcuaugagaguguguguccaaccgaauucagccagcagagcaaaggagaagcgaaauaccgggagugcgugugggaggauuuuacugucuggaagaagugagccuugagcugcaucuugaggaaaccaugggauguggauugggggagaggucacgugggccggaggcaaguggaauggagcagagagcccugggccaggcaucgugaguucgaggcaucaccccagcucuguagcuaaugggcagcgcagccacaggugucaccucauguaucugggccucagugucgcucucuguuguguugaucaucucuaaggcucacuggaaggcaguaaagauuagugacugacaacaggcuguagagucagagggagcuggggaaggucagagguccagauugcugcacuuggaagcaguguggccuugaacgugccguuuaaucucccugggccucaacuuucucaucuacagaucacagucauaacccugaaguuucugugaaaacgugugagaggcuccguuagcgcagugugagugcucaacagguagcagcgguggcugucauuguauuaaagcucuuccgagagugaagcugaauuaaaggagugauaugguuagguuuuguguccccacccaaaucucaucuugaauuauaauccccauaauccccaugugucaaggaagagacuggguggugguaguuggaucaugggggcaguuugcuccaugcucuucucaugauagugagugaguucucuugagaucugaugguuuuguaagcguuugguaguuccuccugcauucauucuccuuccugccgcccugugaggaagcugccuugcuuccacuucgccuucaccuuugccgugaucuuaaguuuccugaggccuccccagccaugcggaacugugagucaauuaaaccccuuucccuuauaaauuacacagucucaggcaguucuucauagcagugugaaaacgaacuaauauaaggagagaguuuuaaggaagcaacuugaugaaaugggucauuuaagaaacuuggcgugggaaauaaaauguaguguuuccagccuuaauaaacaaggaaauuuuggcuggaugcagcggcucauggcuguaauccuagcacuuugggaggcugaggcaggaggaucgcuugagcccaggaguuugagaccagccugggcaacauagugagaccccuucucuauuuaaaaaccaaaacaaaacaaaaacaaggaaauccugucacaugcuacaacauggaugaagcuugcagacacuacgcuaagugaagucagccacaaaaagauaaacacuauuugauuccaguuauaugaaguaucuaaagcaggcaaauucaacguaaaaaggugguugccagagacuggagggaggagaaauggggaauuguucaauggguauagaguuucaguuuugcaagaugaaaaaguucuggaugacuguuauacaacagugugaauauacuuaauaguacugaacuguacaccuuaaaaccuaguggcacaaauacaugaugcauauucuuccauuuuuauuuaacaaauauuuaauuaaauacaacauagaaagcagaugcuagguacuagauguaggagcagagauagaugauuaaggcagaggaggucuuugccuucauaggaaggucguuuaggagaaaaugacguggaguuuucguagagugacuucaauucuagacccagauacgucauuacucaggcagugaccuugggcaaguuacuuaauucuucuaaacuuuagauuucuguagauguaaaauaggaauaauuaguaucugucucacagauugucauaggaauuaaagaaaaauguauuuagaauaaugacacauguucagcaugcucagugaaguucuguuucuugcugugcucaucaauuccucucucacaggggcuuccagacucauggaacagguaggagaaagcccuacccacaacaaagcccacaaaggcauuuuuaaaagcugaacagagagggggacaagaugcccagggagggccacgcauggccucggcccgccuagugagccccuuccagccugaagacacagaagcccuccgcccaccuagugagccccuuuccagccugaagacagagaagcaggccagauagaggggccgccugucaaucucaucccagguggaggggccgcuugccaaucucaucccaguaacuucccccguaguaguuuccucuagauaugagacucaggaacaacugaagagggacuuaaaccacaagccgaagguguggagccaucuagaggagcuuguugggagccguuguggguuuccaaaucuaagagaacguagggagauggaaaaagcuucccaagagugauggcugacacacgcuggcaaagauuacagggagaggugguggaauuucuuccuuuaaugucugucuuaaggcaaagcugcauucucacgugucuggguggcuguuauggggucuacucugagaguaacacguccauuccugcugagcucuuggcgaguuuacauuuuccuguuuuguuuugguuuuuuucuuuugagacagagucuuguucuguugcccaggcuggagugcaguggcacgaucucggcugacugcaaccucugccucucggguucaagcaauuuuccugcuucagccuccugaguagcugggauugcagguacacgccgccacacccgacuaauuuuuuuuuuuguuuuuuuuuuuuugagacggaguuucguucuuguugcccaggcuggagugcaauggugcgaucucggcccacugcaaccuccaucuccuggguucaagcaauucucccgccucagccgcccaaguagcugggacuacaggcaugcaccaccacaccuggcuaauuuuuguauuuuuaguagaaacaggguuucuccauguugaucaggcuggucuccaacucccaaccucaggugauccgccugccuugacgucccaaagugcugggauuacaggcgugagccaacgugccuggcugcuaauuuuuauauuuuuaguagaguuggggguuucaccauguuggccaggcuggucucgaacuccugaccucaagugauccacccgccuuggccucccaaagugcugggauuacaggcgugagccacugcgcccggccugaguuuucauuuucaaagauuacuuaguacuuggcuugguugagaaaacaaugccuuccuuucaugugucguuucauccaaucaucgauccauucauguauacagcuaaccuuuagugggugcccaguauggaaaagauacuuagcuacaaagcaucucuuccuucgugucauuugccuaaauggcaaccuauauuuuggucauccuccaacugugugcaaagauaauuuugagggaacaccucuaugccaagcuugugcaggguaccgcuguuucccuacuuuggggaagauugcuagauggcauggcccugaugcuuucagacaccccaaguagcugugacugaagggggcagaagccacaacucuccagucgugaguaggggaggaagcugguauguaacaaaaaaugugacccuggaccuuuggguccuuaagaguccagagcugacaucugcugucauucuggccaugcccugcccugcgugcggugccuucgggagcacgugggucucccuggugcagucagcucuggaaguaaaaccugggaacuuugcccaccccauaguaccugauacccugccagaguuuuugguauagugcaguuuuauccuggagcaaguuugguacuaaaucagagaagugcuuccaauuuucuuuccucauuuggcggucucacuguuuugccuguccucucuucugcccaaugagagagcagaaaucucuacuuaaaggcuucccugaacgguugcccaacaacugaauugaacgacuugugggaaaaacagaugagagagagucaacaagguggaaguuggaacugugagagcuucuugaaugaguaucugugaauauuguccauauggcugaauuugguaaauccugcugagacuguugacaugaaugggagcuuugccugaacaaugcauuuggcccaggaaaucgcaguagugcgcggcgcugacuucagauguuugggguuaaaggaggaugugcccuucuuucauuucaucgccuucccaaggugcacuucuccagggacggaugccuggagccuuagaaaagagagagagagagcgagagcgagcaagcacgagcgcgcgugugugugugcacacgcacguguggcagagagcaagaaagcuugggggaagggcagagaagcagggacagagaaggagaaauggauuuugcaaucguccugaacaauguagaagagaugaaucagguccucuaaaugccauuccuguuacuggucacauuccuuuuguacuuuuuuauccagcucuauuccucugaagccaauggccucuaucuuacuauauuucacaccaaagaacugagcacucccucgucagggcccuugugccugugggaggcagaaaaagaaugucauaauuagggaggcagagacugaaaaucccuuugcuagcacagugucugagcacuuugccucacccauucaggacugacaagaacacgagcaggggacaugucuucuuaccaugaucaaauucuauuuauuaaggacucacuuggaugcagcccuguucuaguagagauuugaagagagucuuuccuaggaagauuuuuuuaaaagaggcuuauaacacauguaaaaaugucuuuugaucacggaguuaagaggaacuauggagagccaaguacaaagugggcccagugaaagggccccacuagagucacuggaugagagguuggugggauugcugcagagaaugguaagugaggcuucacccucagcggaggaaguuagcaucgugcaaaggauaccauaagauggugucagcaguaaaacagccgagcuccucagacugaggcagcaacuagaggcaugcuggcgguggcuuuuuuuuuuuuucuuuuauuauuauacuuuaaguuuuaggguacaugugcacauugugcagguuaguuacauauguauacaugugccaugcuggugugcugcacccacuaacucgucaucuagcauuagguauaucucccagugcuaucccuccccccucccccuaccccacaacaguccccagagugugauguuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuguauggcugcauaguauuccaugguguauaugugccacauuuucuuaauccgaucuaucauuguuggacauuuggguugguuccaagucuuugcuauugugaauaaugccgcaauaaacauacgugugcaugugucuuuauagcagcaugauuuauaauccuuuggguauauacccaguaauggcaugacugggucaaaugguauuucuaguucgagaucccugaggaauugccacacugacuuccacaaugguugaacuaguuuacagucccaccaacaguguaaaaguguuccuauuucuccacauccucuccagcaccuguuguuuccugacuuuuuaaugauugccauucuaacuggugugagaugguaucucauugugguuuugauuugcauuucucugauggccagugaugaugagcauguuuucaugugucuuuuggcugcauaaaugucuucuuuugagaagugucuguucauguccuuugcccacuuuuugaugguguuguuuguuuuuuucuuguaaauuuguuugaguucauuguagauucuggauauuagcccuuugucagaugaguagguugcaaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacaugaaguccuugcccaugccuauguccugaaugguaaugccuagguuuucuucuaggguuuuuaugguuuuaggucuaacauuuaagucuuuaaucaaucuugaauugauuuuucuauaagguguaagaaagggauccaguuucagcuuucuacauauggcuagccaguuuucgcagcaccauuuauuaaauagggaauccuuuccccauugcuucuuuugucagguuugucaaagaucagauaguuguagauauguggcguuauuucugaggacucuguucuguuccauugaucuauaucucuguuuugguaccaguaccaugcuguuuugguuacuguagccuuguaguauaguuugaagucagguagcaugaugccuccagcuuuguucuuuuggcuuaggauugacuuggagaugcaggcucuuuuuugguuccauaugaacuuuaaaguaguuuuuuuccaauucugugaagaaaggcauugguagcuucauggggauggcauugaaucuguaaauuaccuugggcaguauggccauuuucacgauauugauucuuccuacccaugagcauggaauguucuuccauuuguuuguauccucuuuuauuucauugagcagugguuuguaguucuccuugaagagauccuucacaucccuuguaaguuggauuccuagguauuuuauucucuuugaagcaauugugaaugggaguucacucaugauuuggcucucuguuugucuguuguugguguauaagaaugcuugugauuuuuguacauugauuuuguacccugagacuuugcugaaguugcuuaucagcuuaaggagauuuugggcucagacgaugggguuuucuagauauacaaucaugucgucugcaaacagggacaauuugacuugucuuuuccuaauugaauacccuuuauuuccuucuccugccuaauugcccuggccagaacuuccaacacuauguugaauaggaguggugagagagggcaucccugucuugugccaguuuucaaagggaaugcuuccaguuuuugcccauucaguaugauauuggcuguggguuugucauagauagcucuuauuauuuugaaauacaucccaucaauaccuaauuuauugagaguuuuuagcaugaaggguuguugaauuuugucaaaggccuuuucugcaucuauugagauagucauuugguuuuugucuuuggcucuguuuauaugcuggauuacauuuauugauuugcguauauugaaccagccuugcaucccagggaugaaacccacuugaucaugguggauaagcuuuuugaugugcugcuggauuuguuuugccaguauuuuauugaggauuuuugcaucaauguucaucaaggauauuggucuaaaauucucuuuuuugguugugucucugccaggcuuugguaucagaaugaugcuggccucauaaaaugaguuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagauccuguuauuggucuauucagagauucaacuucuuccugguuuagucuugggagaguguaugugucgaggaauuuauccauuucuucuagauuuucuaguuuauuugcauagagguguuuguaguauucucugaugguaguuuguauuucugugggaucgguggugauauccccuuuaucauuuuuuauugcgucuauuugauucuucucucuuuuuuucuuuauuagucuugcuagcggucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuagaucuuuccugcuuucucuugugggcauuuagugcuauaaauuucccucuacacacugcuuugaaugcgucccagagauucugguauguugugucuuuguucuuguugguuucaaagaacaucuuuauuucugccuucauuucguuauguauccaguagucauucaggagcagguuguucaguuuccauguaguugagugguuuugagugagauucuuaauccugaguucuaguuugauugcacuguggucugagagauaguuuguuauaauuucuguucuuuuacauuugcugaggagagcuuuacuuccaacuaugugaucaauuuuggaauaggugugguguggugcugaaaaaaauguauauucuguugauuugggguggagaguucuguagaugucuauuagguccgcuuggugcagagcugaguucaauuccuggguauccuuguugacuuucugucucguugaucugucugauguugacagugggguguuaaagucucccauuauuaaugugugggagucuaagucucuuugcaggucacucaggacuugcuuuaugaaucugggugcuccuguauuggaugcauauauauuuaggauaguuagcucuucuuguugaauucaucccuuuaccauuauguaauggccuucuuugucucuuuugaucuuuguugguuuaaagucuguuuuaucagacuaggauugcaaccccugccuuuuuuuuguuuuccauuugcuugguagaucuuccuccauccuuuuauuuugagccuaugugugucucugcucgugagauggguuuccugaauacagcacacugaugggucuugacucuuuauccaauuugccagucugugucuuuuaauuggagcauuuaguccauuuacguuuaaaguuaauauuguuaugugugaauuugauccugucauuaugauguuagcugguuauuuugcucguuaguugaugcaguuucuuccuagucucaauggucuuuacauuuuggcaugauuuugcaguggcugguaccgguuguuccuuucgauguuuagcgcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuuuaagaauguugaauauugcuccccacucucuucuggcuuguaggguuucugcugagagauccgcuguuagucugaugggcuucccuuugaggguaacccgaucuuucucucuggcugcccuuaacauuuuuuccuucauuucaacuuuggugaaucugacaauuaugugucuuggaguugcucuucucgaggaguaucuuuguggcguucucuguauuuccugaaucugaauguuggccugccuugcuagauuggggaaguucuccuggauaauauccugcagagugcuuuccaacuuguuuccauucuccccaucacuuucagguacaccaaucagacguagauuuggucuuuucacauagucccauauuucuuggaggcguugcucauuucuuuuuauucuuuuuucucuaaacuucccuucucacuucauuucauucauuucaucuuccaucacugauacccuuucuuccaguugaucacaucggcuccugaggcuucugcauucuucacauaguucucgagccuugguuuucagcuccaucagcuccuuuaagcacuucucuguauugguuauucuaguuauacauucuucuaaauuuuuuucaaaguuuucaacuucuuugccuuugguuugaauguccucccauagcucagaguaauuugaucgucugaagccuucuucucucaggucaucaaagucauucuccguccagcuuuguuccguugcuggugaggaacugcguuccuuuggaggaggagaggugcucugcuuuuuagaguuuccaguuuuucuguucuguuuuuuccccaucuuugugguuuuaucuacuuuuggucuuugaugauggugauguacagauggguuuuugguguggaugugcuuucuguuuguuaguuuuccuucuaacaggcaggacccucagcugcagggcuguuggaauacccugccaugugaggugucagugugccccugcuggggggugccucccaguuaggcugcucgggggucaggggucagggacccacuugaggaggcagucugcccguucucagaucuccagcugcgugcugggagaaccacugcucucuucaaagcugucagacagggacacuuaagucugcagagguuacugcuguguuuuuguuugucugugcccugcccccagagguggagccuacagaggcaggcaggccuccuugagcuguggugggcuccacccaguucgagcuucccggcugcuuuguuuaccuaagcaagccugggcaauggcgggcgccccucccccagccucgcugccgccuugcaguuugaucucagacugcugugcuggcaaucagcgagacuccgucggguaggacccuccgagccagaugcgggauauaaucucguggugcgccguuuuuuaggccgguccgaaaagcgcaauauucgggugggagugacccgauuuuccaggugcguccgucaccccuuucuuugacuaggaaagggaacucccugaccccuggcgcuucccgagugaggcauugccuuacccugcuucggcucgcgcacggugcgcgcacccacugaccugugcccacugucuggcacucccuagugagaugaacccgguaccucagauggaaaugcagaaaucaccgucuucuaugucacucacgcugggagcuguagacuggagcuguuccuauucggccaucuuggcuccucuuuuuuuuuuuuuuuuuuuuuuacauagaugaaggggaccucucauaauagauggcaccuugaguuggguuguagcuggcuuuugcaguugcuuagaugaguauugcauuguuccagucguccuauucugaaaugugucugagaauccuguuuuagagccaagcuccauucuagcaaacaguagugcaagccccacuccuuggccugauugauacaguaauggcacuguccacccccuagccaccccgggaguacucucuguggggaguuugcugcugccgucuaaacugaaauggacuugauuuucucuucugaguagaugcucagcuguaauccauugggagaaaauucuugauuucuugggauauuuaggaaggcuagcgacagguaggagcuucuuuauuuauuaugcuuuucucuagaagcuucauugaauacauuaucuucugccccacaccccagggcuuugaccaaaauauccuugagauacuguggcccauauucggucacagaggugcacuguucuuuugaaagaauggcaugccgcaacuuaccuacucaccuacagaaggugagugcugcaaggcagucccaguaggcacuuggaguggagcuuugaugaauccgaaggaucaugggcuuuggaaucacaagacccagguccaaggccugaucucugcuucuuaccagcaggcugugaaggcugugaaacacuucaaaggcccguaauuucucaguuuguaaaaacagcgauuuucauuucugucucuuagggguugauucagugagacaguggcuguggaaaaacuuuauagacuguaaaguguuaaagacauauccuuugucucuguucuuaucuaagaaugauguuuuaaugcuuuugagcaggacacagagaggugcuacagggacaggguugcuucuaccaccagccaucuggcuauguugauaacugggaucuguguacuucuugaccugugaugcucaagucuuaauaugcaucagagucacuugggggcuaggccccaugucucuaaaauccccuugguugaucugggauccaugugucauuagcuccccagcuauucugauggagguuacccauaagcuccacuuugagaaaaacuagagcguacagcuuggacuagaugaccauggagauugggauggaaggaaaagcaugguagggucaugucugugugcaccccugaaugagaggcaaggacuccuucguguugaguuaaccaacagcucuucugggcucugccacuaucacguuccauuuguuaacaguugcuuccuguguguguuuguguuuuuuucugguugggauguuuggccucuuuuaguugugagaaacaaugcuggggccaugaguguaaaagcaucuucuguuuuauuguugguagcaauaguugccuggcuugacugaaagucauuuuccuuggagguuguaccuaaagauuuagcggauggaucaagaccauuguccugcucuggcuuucugauaucaccucaccucauggugucugugggcuuaguuuacccuucauuuauuuugagcaccaauggacagcugucuuuguuuuguguguuuugugaggaagaugucuugggagccuucagugaagauagagugugugugugugcaugcgugugugcgugcgugugugugugcuugcgugugugugcgugcaugugugugcgugugugcgugcgugugugugugugcauggugggauaagggauaaggucauuugagaggaucuggaagccaagggaaacaggucugcugggaauuccaaaauucugucuaguagaagaucuuaaaguuuauuccucaucggagcucuuagcagagccggcacaagcuuaagugaccuugaagccuuuagaaagagcagcuucuccgcaaugccagucacauggcacagaagaucaagauguuguuuaaauaaaaucuugcagcagcauccauuucacaggucccuggggccgcguguagucaguacuagaagggcaagacuuuaaaacaaguaugugguguaacaguagcauucuuuuuauuuuauuuauuuauuuuuauuguuuauuuuuucguuuuuauuuuuuuuuugcccccaguugaagaagaccaggaaagaaucuucuuuuaaaaaacugagcucuaucuguccugauuccuggugcugcuucagguaucuaccuuaauuuucuuauauuccuaugaagacagugguuuggauaauuggagguagcuauacacugaaauuauuaaauuguuuaccuucaaaacaggaguagaccagaaaugcagguccuuguccucagaacugcaguucacaucauauucaguaauuaauuuaauagucacguuuuccucccaggcuagacaggaagggcacuaacuuugacuuaggaucccuuuuguagcucccacauuaugugaggauaucaauuugccuucuguuuauuuuucuuuauuauaaaaauaaauuuauuauaaaaacuuuauuauaaaauuuugcugucauuuaaaaauauacggaaaaggugaaacaaugaagaaaucuacaaucaccuaaaagcaacuacaaugaauauuuuagcugaucucaugccagugauucaucuguauauauauauauauauauauauauauauauauauauauauauagggcuccaugaauuaaccuaaaugacagagcagguuaggugcuuaauauucugaggccaucuaaacucaacaucuugccuuucucuugagggcagcuccuccacuagucccuuuucuucaugguuucagagacuuucccagccugccagucuucauuuggaggcuuucuauggagcuuugugaaaucacaguaaacccuuugacaugcagcgcuguugcccaccuagucuucagccuugcuguaaaggugaaguagauuaguuagacaggguuuugcccuucugacuccuuguugauuaucucuuuuuagauaauuacuauucauguaccuuucucaaugcccuuaggugagagaauagcuuccuuucuuccugauuugauucuguagcauagacaaccuuccuuucagggggcuggauucauuuaacucuuaucuucaggccagcugcugugcuugcaccugggggaaggagguuugcuugugugcugcauguugacccuuauacauuuuaucuaagagaacauuuucaaaugaaagaagcugucuaggccuggugcgguggcucaugccuguaaucccagcacuuugagagacccaggcagguggaucccaaagucaggaguucgagaccaggcuggccaacauagugaaacgccgucucuccuaaaaauacaaaaauuagccgggcgugguggcgggcgccuguagucccagcuacuugggaggcugaggcaggagaaucacuugaaccugggaggcggagguuacaaugagcugagaucgcgccacugcacuccagccugggcaacagagcgagacuccgucucaaaaaaaaaaaaaaaaaaaaaaaaaaagaagcugucucaugaccauggcuccaugccuuccucuccuccucaccuccucaccccaacuaccccucuauucuuugcucaaaucaaacuccggcuugcccacuagaugagauuuacucacccacaguagucuguauuuuuccaaagaagaaaaagagguauucaugacuauauccugauaaaugaugaagccuucccucccagcccacucugagugagugagugaccccuuucuucucaguuccugcuacugagugaguuucucugucucucucgcucgcucuuucucuuuuuuuuuuuuuuuggaacuguuguuuagaaguaagaauuugucauucuuaccaaagcacugggcaugggccuguucucucuugggcuacucugaccagggguugguuuccuagaccugcauccagguguguuuucacggaaaauaccccucccucucuuaggguuuccucgggcagcccuggugacguuggucacaauggaggaugcugagaggacaguggugguugggcacacccucucguagagcacaggaccaaugucuuccugacgguguucacucauuccuuugugcggccaucagauagcagugguggugccugguaguaggggaagguuuacaaacccuggggcagcuccugcaugaggagggccagcacauucagggaacugaaauaauucaggcccuccugagcacaagcuuguccucuaugcaaaggugaagcaguucauacacucagaggauuuuagaauuaaaaggaacaguuuuaacuguuggacuuuaguccuucaauccauccuuaugguuuucugggagagaaaaagguccaccgagguaaagugaguugcccacacacgugacuggcugauguggccugcagacucguaucccggagaucaugccaaucucaagccaccgaacauaauuaucaccuacuuccagaaugacauuccauaucccugaaaauggaaaaucaauuuugaaacaaucuaagcaaagaaagaggaccaucuucugugcuaguguguuguaugcaguaggaagaacgggcuucggaguggacacagacccauguucaaauguaaauucuuccauuuacuaggugggugauuucaggcagcaugcuuaaccuuucagagccucaguuuauaucaucaguaaaaugaagauaaccuuucaagaauucaucaaaaagauuaauggaacaguauccauagagcaccuguacagcacaucaccugauuuuuaacuuucaagaaauagugguuauuggccauuugugauuagagauguguucacuccucacugaucuguguuuaggaagauagcuuuuuccaaauaugaaauuuuuaugugucugguagagagaggguggaaauggaacugugguuguaaaggcaaaaugacaagaacggccacauuagaucauuaacuguuccaaaaaccucucaucagauguuuuuccaaauucagaagauccuaagcccaguccuuuaaaaaaauaauguuaaaaguauagugcuaagaaacccaagacuuucaacauuucaaaucugucugggaguacacauacagaaagcauaacagauaguuaauggaaucugucuuuuugaugauaauuauagcauucuuaaguaggcuggaaacacaucuguauaccugaacugcuucaaaauuauuugcuucaagggggcauucaguaucuugcuaaacuuucaaguuagagauaacuacuguuuaaauugauggcagguguuugaucuauaaauaagagcuguacuuugcacuucagcgcucuguuuaccugcugcacgguguucauuugcaucacccugggaaacuggaaaggccacaggaauaggcaucagugauacaccagacgugacagcugaaacacagccuucacacuuacaaauuccaggagggacuagcucuccuuucagaggcaagaagccauguugaauuggaagaugcaucagugagccuggagagaggugagaaaaucauaucagaaguguaaugagcacuagggauuuuguccagaguaugugauaaccucacuagcuacugaaaaaucuugccuaguuauuuauguuuucagucagccucaguguggagacugcacucccuccgucugcucggccacguggcuuuggcagccucaucucuuuucagcaucgugcccauauuucaauuugcuguuggggaauucuuugaaaagugcgucuuucucugcaguucucagcucaguucucauucaaauuacagaauucugaugcugguccuggggcuuacccaggcuagacacauaagcucuaagaggcuuucccuuuuccacgcuccucacaccugaaacugcugcucagguccauagcgcaggucagagggaugaucaguucuugaaucacuccccaaacccugcccccaccagccuucaacuccguggcugcaguggagacagaggcuuugggugaauaacagaguaggugcugucgacuggcuuccugacuacucacagaccacagucuugccaguaccaaugccaucuguacaaggaugcuuagaguucugggaagggaguaaggaggauuagcgggggauucugaaacaggugcccugccucagggcgccagagucaugggggucauccccaggggagggaucaccaguacaaauugcuguacagugagccugucucauacuugagcugcagaaugaguuguaggcucuuaguucugaguucugugacagccucucccagccuguugggugagaggccucaccuagcaagagaggugauguuuguuccaaagagcugcucuaacucgaaggcucugcugccuugugguagacucccagaguacugcggaaagagacaaggccgccuccugcccaggcagcaggaagaacuguuaaacuuggugaaauugguuucugguggugaaauggaugguacccaaugaguacuacuuaccucguuuguccccucugaaaccaaaaucuuggcuccagugguaaauuggguaccugcauuucagcuaccuggagggucucuuuaucuugggacuuugugaaaaugacaaugagagagaaccugucaucuaugaugaagacucaguacagcuaauuccaaaucuuuacaauaauaaguugucaaggauaauacagagaaacuucugccaccagucugcaguucugucucacuagggaauugucccugagcaguguggcccugggaagcuccucugugcuggccuggccaggauccucuuuucauuguccccuuuuuguccuggucaggcacaauugugcccgcacuaggauguuuucugcgucuugccuccuaaccacgccaagcuuucagccuuuacuugggaaucuaaacaaugccuuccugacguugcacuccuuguucucucucaccugaguguuuuugucuguaugaccagcugccacacaaaggaacaacagcaggguucucagggaggggcacuucuuugguucacaaaguuagaacucuacuccuuccuccuuuugaacucacugggcuugggaagaaagcgccucuccugcuuucucugugggucccaacugaggugggugcuauuggucccugagggagacacagacaaauccccgaaagccuggcauagcacugucugucagugcagguuucauacagaggguuggagaaaggaaaugggugcacaguuggagaagagaaaaguggcagaugguucugcagguuuuuucuucucuuauuugccugacagaugaaauuguaauugauuuaccaaaugaucacuaauaacaaggcccauacuuguuauguguuugauaguagugagcagcaggaaccagaggcaguacagagcccugaguuauuuggagaccucaugaaaagccuuuugagcccagucugacuucuuaaaaucacaaccggccaggagcaguggcucacgccuguaaucccagcacuuugggaggccgaggcgggcggaggucaggaguccaagaccagccuggccaacauggugaaaccccaucucuucuaaaaauacaaacauuagccaggugugguggugcaugccuguaaucucagcuguucgggaggcugaggcacgagaaucgcuugaacccaggagguagugguuccaaugagcugagaucgugccauugcacuccagccugggcaacaaaaugagacucugucucacaaauaaaaacuaaaaaaaaaagaaaucacaaccuaauuuauuuccaaaaaaaagcacuguccugggaugggacagcauccccaagaagaggcugaggcacacugcagccucaauggagacaacuacaccugcacaacaggcaaaccucaagagccucagcaaguugagaaggccagugugugcuugagaaaggggaaaguggccagccucacccgguccaggcggcucccuccugcaccagcucucaagaggccagcuccuuccugagucaggugguucucagauaaagugaaaguggaggcuacgcuuauuuccuuuugaauucucagaccugcugauuuccauuuuuguuggagccuugugugauuguguuacccucuucccuuuuuccuuucaaaaggauguuuuggggcaucauggcagcauguggaagaguauguguauaugggugcccagguuuguguauguguguuacguagguggggguaugcaugcccauauuggugccaggcucugagagacaaagaaacaaguaugccaucuuuagaucugauuuuaaaaaagaaacaccccagccaagggcguuuaucugcuuaauguaccagaacucaacugcaggaaacccauuucuauauuagcauaucaugaaaaugugcagugcagcugccugggaacagccaguuuauuauugcugggggccguccuggguuaugaucuggaagaauuugaaucgcccuuuacauuuuuuucuguccucauuuugauuuuggcaguggcagaagaggagaauacucucaagagauuaaauuauuucccuuuaaaauucucuuggaaucauaacgacuauuaaaaauuaaaggcacccauaucucaugcuauucagcuuaacugguaauuaaagugcaauuaaauuuuucacgguguagauugcuucuguuuuuuuguuuuuuguuuuuuuuuuuuuucccugggaaauuacaaacucugggcucuugagaguuacaggauuaaucuauagacuuuuaauaauucagcuuugaucaggugccgucacuugaugcgucucugaaagggaaggggggacuguaaaguguuguuuuguuauuaauggugaguuuuaauuuuauuugguuucuuagaaaccaggaaguaacuaccaguccaugaaugcaaggccguuuucgagugcgguuuugaguuggcugcgauugcucucacuaaugugugccgguaauucucucucugcugccaggccugcuucccucaaguagcauuguguaauuugggguacaguccugaguugucaccagugaacaaggugucaacauuggaccggaaguucggaggcugacuucgguggacccuuucuggccuuggccaaauguuucuuuuucucucuucuucuuccucuccaaccuuuuuuuuuucuuuguugguaaaaacgcguuugcauugcagagcuguaaucauaagcaauuucuugacuuuuguaagaccuuuugcugaccugaggcugauggccccagagagaccuggucagcagcauggucucuguguaaggagaguggcccuggucaguuuggccaggaguggaggugagggcugcccacuguagcccgccugcagcaggacuugccauuuuccagcaagccucccaguugcaccaugcagccugugggugcugcgugggaggaggagugagcagcagcagccugaccacaccccacucuugacuggucccagaagacaccuucagcccuguccucaauccugacucauuucucuguucauuucuaacuguuaggaagauaugucuuaccauuuuucucccucuuuuuuuuuuuuuuuuuuuuuuuuuuuuugagacggagucucgcucugucgcccaggccggauugcggacugcaguggcgcgaucucggcucacugcaagcuccgccucccggguucacgccauucuccugccucagccucccgaguagcugggacuacaggcgcccgccaccgcgcccggcuaauuuuuuguauuuuuaguagagacgggguuucaccuuguuagccaggauggucuccaucuccugaccucaugauccacccgccucggccucccaaagugcugggauuacaggcgugagccaccgcgcccggccuucucccucuuuuaacccacuuugaaaguucaucuuuagaaauaacacguaucccaaguuggcaaggugucaguuuagggccaaguuccugcaauauagcauagcaaggaaggguucagguaucggaggcagguagguuucugcggcaacuccauugcuuugagauauuuuauuguagacauggaauuuaacuucccugagccucaguuuucccauuucuaaaauggauuuauuuacaguaccuaccucacagcguugugauaaggauuaaguaagacaaauccuagcaauauggauggcaaaaaauaagcauucaacaaauauaagcuguuacuguuuuuauuauugaucaugaaauagaacaucagcauuucucuuuuuuacuucugguauauuuuaauucugcauccccacuuuggaguaauuuuauaauauuuccuaacagacuggaauucuuucucuucuuucucuuucuuuuauccucuuuaugaguagcaaaaaaaguugaacaacuggaaagaccccgucuucuucauaacugucuucccagcagcuaacauauucucugacacauaguaggcacucaacuuguaauagauggccacaggguugaaaggaauguccagaauugaucagaugaugggguaggaaagaagagaaucauucugguuucuuuauccuucuaucucaagucauaugcugcauauacugaagcaguagaaggaacuugggaauauaaauuauauuaaagcugcagauucuucaaauaaugugcccaagccuggauucugaaggcuuauuugucagguaagacagcagauacugaaucucauauuagcucacaggauaauggcacaaugcaucaucagucugaauggggacaguacacaauuuucuuuugauugccuggagccacagacggggugagcacugaauauugauuuuucaaaggaugacuaauagaugguaaaaaagcaaaauaguuuuugguuucaaccuaucccuuuccugugccacaaauuuuggcaguaaauuaaaauaaacuuuuauuuccccaaaacagguaaaagagcagaauuuaugcaggaagacuuaagacacaaaugaacagauggcugugacuuuacaaauugcacaucagcaaauguuuaaccagcucagaaaauagacaaaacugauuagaaacauugaguacuguucugcuacucuuaugguuaggauaaucugacaauauucuaguaacuuucaucuaauaacaauuugauaauuuuaauccagucuuaggucuuggcuugugcaauuuuucacaguauaccugacauccagcuucuugcuucugaugaggacauaauaaacuugccccucucuuauauuaucaacauuugauuaugaaauagccugauucuucccuucucugcauuaguaacguacugguuaaaucuacacaugugguaaacuuuuuuuuuuuuuuucauucucacuuaccaggaaauucuauuuucuuuuacccaggcucuuacaauuuaucugugcaggguuuuaacugcuugggccuugaacgcauguacuugugaaucagacuagaagccaaagcuuuuuugaaguuuugauaugaaaugggucuugcuuguugugauucaguucaacauuuugagauggguugguccagcaucauaagcuuuuguguaugugguggguaucuuugugcugccacaacaaaauaccacagacuggguaauuuauaaacaacagaaaguuacucagcacaguuggagaggcugagacaccaagauccaggcacuggcagguucagcgccuggugagggcugcucgcuccaacuucaagaugguuccuuguugcuguggccuccagaggggaugaacucuguguccucacguggcagaaugcaaaagggcaaaaaaggggccuaaguuaguucccucuagcucuuuuauaagguacuaauucauuuauaagagcagagcccucauggcuuaaucaguucccaaaggccccacucuuacuaccacuacagugggaauuaaguuuuuuuguuuuuguuuuuguuuugagacggagucucgcuuugucacccaggcuggagugcaguggugcaaucucagcucaaugcaagcuccgccucccagguccaugccauucuccugccucagccucccgaguagcugggacuacaggcgcccguauuuuuaguagagaugggguuucaccacauuagccaggauggucuggaucuccugacuucgugauccgccugccuuggccucccaaagugccacugcgcccggccgggaauuaaguuuuaacacauuaauuugggagaacauccagaccacggcagugagugcuauuguguguguaugcaugaguaugugcuuuaauaagaaagauacugacucagcugggcgcggugccucacgccuguaaucccaacacuuugggaggccgagaugggcagaucacaaggacaggaguucaagaccagccuggccaauauguugaaacccugucucuacuaaaaauacaaaaauuacccgagugugguggugggcgccuguggucccagcugcuuggaagucugaggcaggagaauccuugaacccgggaggcggagguugcagugagccgagauugugccacuccacuccagccugggcgacagagagagacucugucucaaaaaaaaaaaaaaaaaauacugacuuacguaacuggaaaguccagggauaucuggccucaagccugguuggauccagggcucaaaggauccaauaggacauuguuucucugcaucucucuguucccucuucuguuggcuucaaaaucaggcacaucaaauuuuagaaauuuucuuaagcugauagguuuguguguuugucauuuuccuuccagcuuuuguuaacucuagaaauaaugauuuuccuuuccuuaagaauucccaccuaauucuaguaguuccagaaggcauuucuauaaugucguuuuguuacauaauaacuuuuuagccuccacguggcugggguuugcauuugaguugucguccaucuucuucccaccaucauugcacucagagaaaaaccuguagaauaccacuuuccccagccacuggggggcuuuguguguauuuaaccauaugaaacuguugacagucaccauuguugaccugugaaauuggccaguucauacgugaaauuggccaguucauaugguucaaccuaaaacaccagguuuguagugguaauuguuucucagcaacagcaguugugucuagaaagcuuugcauaaauuaauguuuuuauuuugcuguugguuugcuccuagcaccucuccugugccccagugugacgaauaaacagcuggaggcaaaugacagagugcuugcacauacggcaagccauucauaacugaaucccaggugcaagaugaccaucuuucaugucacagucagagguuucggcacgccauuccggaauuucaccauuaaauuagguccugugaaucagauaaugaagaaagagaagaaguauuuuuagaagcuguagagcuucucugccagcccugugagucuugaacauucaugcuuuuuaacucauuucuggcaguuuugagaggcaagugguguccacagauucauaaaggccaauguugccugugugccaaggcaguuggcagcugauagaauuucagaacuagagaagacuuuaaaggugaucugauggcagccccucaacaagucucaaugacuuaagagauuugcccaagauaagagcuuaagacgaggcccaagguuuccagucugguucugucuuccgauuauuccauuaucuugaagagcaaugcuggccuggcagauucauuccucacucucuucauagcuugacuuuuguuguuuuaaaagaaaucacagaauuuuaggccaccaacaggcaccaugagggaacauuggaaacuggagccaccuuauuauccagaaagcucuggagcccaaagccaggcccuaggcuauagccugaagccacuaaccagggguagcugaagcaugguugauuccaucucuaguacugcaauacuccugcuuuggggagguaugcaaugcaaaauguaucuuuuuaaaaaaccaaucauuuuucaagagauuaaguugaauaaaaugaaauuaguugugaccuugauaucaaguagcuauuuucauaauuuguaguaaaggaaaaagagaguugucuuaugacuuggggagagggggaggucagcguuuggcucucuggcccuaggacuaguguaguugaggugaagacuucaauggcuucacagcaguugucuccugcugagcuuguggccacugagaacuucuagaacuccaugccaggaacacuaccaagucaaaucuccccauucuguggguauucaguaauuuuguugcuuaaaugcagguuuacuaugagagcaacucaaauuauuuuaaauaaguaauuauaaaauagaacucaguggaauacauuggugacaauguuguuuacgcauuccuaacgucaguccaccaggaaucucugcccuaagguuguaaaacaugcaaccuuccuuuaaucaguaggacugauugauuauauauaacaagucuuaagagucuacaaauggcguuauuauauuuuggaagaacacgauuuggugacauuacucaaagguuuuuuuuuuugguguuuugguguuuuuuuaaacaacuuacuuguuuuauucaugugucguuguuuuuguagauccuuccacagaguuuuguuuuguuuuguuuuuuuaaagcuacaugcuggguuucccuuuuuuauugauacaauuauuagcuuuagcccauuuuuccaacuugaguuuuugugauuuuuuuuuuuuuuuuaacaaauccugauucugcuauucuuuguguaaaagaagauaacuaacuuuacugguucacuuuauauaccuuggcucauuaauucuuuacaauaacccuacaaaaucgaaaucauugucacacuuuauagaugaagaaauggagagucugcuggauuaacuaccauggccaagauuauaagagcucuuaucccuuccucugagcuucguagcagcugcagguuugauaaacaugucuuaaauaucuucaucuaaaucauggacuuagacuugaaugccugaagucugagauauuuaugacaagaaguaaguuuaguuaccguggcuagaaaugauggccugauuccaugcccuccaggccagagggaugcacucaucagcgucuugugggaacaguuugcaaccacuuaacaauccaccuugucaaauccgauacucuguuuauugacacuauuauuguuuuugaaaacacuuuugcauauaaaagcaucaaacacauuuuuaaaaguuuagcuauuuuaaacauuuguaauuggcucuaguauaauacguagcacacccagacaaaaauaaacuucuuuaggauugaauucucuuaaguggggcuguuuauuuggcuuguccaccagaaacuugacuuuaaaagucaaauaagacguagucaguucuggccccccugcauaauaguaucuagagggcuguuucaacccaggauuuuauguaaugaacaaagaauuugcagagaauuacuacaccccacauucuguaaugaaaacuguauaaaauucauucuacacaauuauguccaacuaaccaugaguaugcccugcuauuaguuucuguuucuuugucaucaggaaggugguauuacucuuuagccacacuggccaagaaaagagucauugucagccagcccgaauccuuccccaaguuccuggggcccugugacagaugucucucauucucccauggaugguguugggauguccacuacuugcuuuaggaaaaaaaacuuagucuuuucuuaugcauuuguacaaaacagucuuuaagaacaaaguuuucaucauuuguuauccacagaugucauuuuucccaaccagcuugaucuagagaaguuaauggcuuauuuacguagggacaucugcaugacagggcuguguucuguuuucugcuugagcucucuuggucuguauccuuaauaccauuuguucauuaaugucacaaauauuuaaauauguauugaguaccuccuaugugccaagcacuauuagauauagcauuauuuaaaaaaaaaacccagcauauauaacccuaucacuagacaguuuacacucuagcaugagagacaaugacaucauuaccaaaauauaguguauaguuaugaacugcaugaagagcuaggaaggaaagauacacuguuagaagagcuuccgauggaaggaccugcuuuuagguagaaacaggaggugaugggaagggagcccaguugugagaguaaagugaacuaccggaggggcuggccagccucagagaagagcucucccugacccgguagcaggagggaaaauaccacacucaagaaccugcacaacagcuaggguggugacaggcauggggagaugaaggaagcgggacaggacaaguggcccagaaugaggcugaugaagugggcacauaccuuaggcccacggcugcacagcgguuuuugcaggguguuuguuauuaagugcagaugccaccuuggaguggcuucaaagugaugccaacuguuugcacauuggugugaauuccagugcugcagcaugaggugggcagauggacagguggacaggugugccuaggucgggagauccugcaggaagcuucucugccuuacugguucauuggugugaauuccagcgcugcagcaugaggugggcagauggacagguggacaggugugccgaggucgggagauccugcaggaagcuucucugccucacugauucauuagcagauaccacagagaaguuaauccagggcagacagaugccuccucuaccagcgucagcagccaaaauacaaagagaacaaugugcuguacccaguuuacucacaugacuaacauucguuacacuuuauaauaaaacauaaaaauguuuguuugcauaaacucacacauugccuagcuugcuucagaguaacuaaauuuacuucuugucaugauaucucagacuucacgcauucgaguccauuuaguguucauuuaauuggaaaggagaagagagggacuauaacagcacuugcuggugauugugguggauuggcuguuuucagacccuuuagagaacccaguuuuugggguccuacacaguugagagcagggcugaguguaggaaucagaauugagagaacugagugcaucagacauggugggacauggcagaccuuccugcugagcugcugcaaccccuccccucggccccucucucucugugauguugcucuuguugcugugcuccuugcacagcuguguaggaggaccagggaaggcuggaugcccagcccucucccuucaaccucucuguaccuaauaggaauaaggagcugucaccuauagcucugauuccucucugggagcauuuaucaucucucagaggaguaggcagguucucugcuauggagagggcuagagcuuguucugugaagaguaucgagggugcagacaggagugaaaagagaagagugccuguuggauggauauuugcugugugaaaaaguaacaaggacaucaucaggcugcagugaguccaguuggaagcagggccugccgggaacacuaaggcauggucugaggggccugagcaaggcugggcugagggguugaugguguucuagggggaaaagaaugagagaaagugggaggaagaagaaaauagguagugaaggccagaagggugaucugaagagauucaaacaacauaagagaggaauuaagcuuugaguggucaucuaauaagggagcaacaggaggcacaggaaaagccagcagugguagcggagggguagcugccccgcuccuguucagccucguccaguacaagcccagccugagaaaacacaucugggcaucacaaagaauggagcccaaggcucuugaaauuucccucuuucuuccugguucuggggugggcagauuaagaagcuggguggcucuuaagcauggggaaggcucaaggugugugugugugugugugugguguguuguguauguguguguaugugugugcauauuuuuauguguguguauguguguggggguguguauguguguguaugugugugugugugugcgcguguguguguugacaggucaagauccuucccucagaaggcuucucagucugcccuuccccaugggccggggccgcucuggcucccacuggaaauugcuuccucuuuugaggguagggaaggggcucagggacugcagaccagcucgacacaggcacuacugggugauggcgcaggccaggcuaaggagcuggguaggagugagcucgccugcagcagcucagugcagaauccucugugcuuuccuggaauaugaaauagccaguaauagccaagaguugcauauuuuaaaaaaaaaaauaagaauguuucuacuuucuagacagugauucauuuacauugggacacacuggacguugaugccgaaugagcaaaugaacaaggcuuuaucugguuucuguaccucaacccaaaauucucacguacugagcauccucaaacccauauugugaaaagcuuuguagcuuuugaaaauaaaauucccuagaacacauaagaagcagaccacaagcaaugagccucgcuggugucuugauccaccuuuuuuuuuuuuuuuuuuuuggaacccggaagcaauugagaggacaugucuuggcauagcuuugaaaaccggccaguagggggcgucugcaguggaccugaaaucuccuuagaguuggccguuucuuuuucuuuucuuuucuuuucuuuauaucuaucuaucuaucuauauauaauuauacuuuaaguucuaggguacaugugcacaacgugcagguuuguuacauauguauacaugugccauguuggugugcugcacccauuaacuugucauuuacauuagguauaucuccuaaugcuauccuacccccuccccccaccccaccacaggccccagugugugauguuccccuuccuguguccaagcguucucauuguucaguucccaccuaucagugagaacaugugguguuugguuuuuuguccuugugauaguuuguugagaaugaugguuuccagcuucauccaugucccuacaaaggacaugaaauauccuuuuuuguggcugcauaguauuccaugguguauauaugccacauuuucuuaauccagucuaucauuguuggacauuuggguugguuccaagucuuugcuauugugaguacugcugcaauaaacauacgugugcaugugucuuuauagcagcaugauugauauuccuuuggguauggaccugaaguaaagcccuguucaaaggaaaacauucaccaaauccccucauauucuguaucucacaauuugguacuugaauagaaagugccuuguaguaacuauucuugaaaacuuuguauuuacacuaccaaagaagcaauuuccucuauagccugauucuugaguacacuaaccgguacagauaugucuccuccuguccuuccaaauucauuauuucauagguguuuugcaccuuaagucauggccuuucguuuuugacagacuaauuggaauugugaugcuuucugcagagccagugggagaaagagaaaaaaaugcugagccuucccagcuucaacaggugguugcaguauguuuggagcuaauagaauggagcagugaucuagcuguccuaaaagagcuaacugcagaugcggagacuauggcuguggaguggagucuugaugacacucugcucuccuccacacucacaugagaauaugcaagaguuuugugcguaucaaauuucauugaucuggccucacugauuuugaauuuaugguacuguagagagagagcugauacucacauuuccagugucuguagauggaaaaaaauuguuuccugugaaaaucauaaauauguaggaaauuauaggggaaaugcuagcccauucaugcugccuuuacagcaugcuauccccgcuaaaaagauaguugaucauagacaguucuuuacuguucauuaaaguagguccuggcagggucucuauuuggcaguguccuguaaaccauuacucugugcuguuguacaggguuacaagaaaucagucuccauuuuauuaaaaaaaaaaucuagaauuccaaaucuccauuaauuuggauguuucaucaucccaauucgucccaauaagguuuuauuauauuuuauuuuugauaaaauauugaaacaagagacuauuugauuauuggacauaauaccuuaaguuccagguaauuucaucaucugaguccugaaaagaaacucagacuucccaacccaagaagucugcugucuuucacauugggccauaccuguacauauccuugaccuuuauauuuguaggcagcaccacugucaauguuagugguguagguacaucuuaccaaaaagaaguguggccuguaagcugugguuugggcgaucuugugacuguuugcaacuuugcucugaagacaacuaacuggauccaauuaauaaacaauugggagauaggguuacuaagauagagugaucagaaaagugccuucugagacuguauuuaagcugaaauuaaaaggcugagaauaguauuuagggagagagacuguauuuaagcugaaauuaaaaggccgagaauaguauuuagggagagaggggacaagagcguucagugcuuggcucuuucucuucaugcaugugucuggucuugaggugggagaaaucuugauugaccagagaacugaagagauagcaaaggaggugacuggagcgcaugggcccguggcaugaggugagguuguagagaaagucagggaacuccuuggugagcuggcaugguuagaucaugcuuuaggccacaagagacaaaauauaacaaugggaaauuaaaaagauauagcuaggcucaaagcgagugaaucugaaaaagaagagaaaugcaaagaagugauggagcugaagccacuggcuaccuggcucucggauaaaggaggcaaaauggcugggaauuuggcuccuggaauguaacagggacuagauauguacucugugaaaugggaaguggagucaggcucacuacugaaaaccggggauguugauaaaugagagaggacauccucacuaugaugggaggcugauaaaaguaacugcugaccuaugccuggaaugauggucgacaugaagcuugugagucuauggagguauaagaucccagacacaggauccugaccagggccugagccaagccaccugcugguucagugacuggauuugcaaugucccuaucacuggggauaggauccuugagcuagcauuuaagauccuguucaagaugagggcguaggcacuuguggggguaggaugcaaauggagacagggacagagacagaugggagagaaccugccacugaaaugaacaugcacaccuaaaugccaaaacacauaaagaaauagagcaucaaaaagagaaccacugagauucacaaucagaaauucacuccauauggaaauaaaauuauagaauaaaaguuuucaauuuauuccaaauccuuaaagagaaaaaaauggauaauauccacugggauugggggacaaacauaugugaaacaagaacaggagaauaggaacagaaccaaucagaaaucucagaaaugaaaacuauagucauugaaauaaaaaaacccacaaagauacauugaauuaagagauaguggugaggaauuuacccagaaugcagcucagaggaaaaagacauuuuuuaaaauuaugcaaaagcagcugaggcaggagggauauuuugagacuauccaauaaguuucuaauaagaaguucuuuaagaaagaguagaacgaaugaccagcaaauuuucaauuugacagaguuuuuaaaaggcaugaacccucaaauucaaagcauacccccaaguacugagugguaucaauacaaagaaauguaaauacacacacacuagugaaucuucagaacaucgcuggcagagaaucuuacaaccugauuucaauuugauugagagaacaucucaacagccagugacgucaggucacguggaaugucuucaaugugcgaaagcaaagaauugucaagaauucugucuauaguuaaacugucucucaaaagugaaaaugaaauaaagauauuuuaagagguacaaggaaucuuguuaaaauaauuuuuuaaaaagaauguguauuacaagaaaaguaaacccagagagaaguuguagaaugcguagaacaguguugaguauagaaauugcugaaaugucagaaaauagaauuuacuaaugaaugugaacacaacugcuuucccuguguugagacugaaagaugaaacuaaaauacuagguaaaaaugauaaggagaguauaaauccacauauaucaccauacauguaaaugauuaagaugaaauuuaaauauuaagagacagguuuuuuguuugguuuuuuuuaagcccaguugcaugcugcuuaagaagaaaacugcaccaagggguuaaaaauaaugagaugaaauagagauauaucaagaccacauuaaucagaggaaagcuggguuaacugucauuaucaaacaauauagacuuuagggcagaugaagcauuuguggagauaaaacucuuuauaaaagagaggaaagcaugaaccaggucauguggggcugugggccauggucagggauuugcacguuagccuaagcuaauaugguuggucccugcagaaaauagcuauauggaugggagggcaagguuugagagguguggcggguacagcauagaggugagggcaguugggggggcacugggcagagcaggggagggcagggauugagagaccaagaggggccuguuuugaagaaagugaugguaaacaguagugugugcuacugauggguaaaaugagauguggaccucuggguggcauucauuacagagugacagguggagauuugagagacgaagcaagccggagccuuggcaguagggaggaaguggcuacaacgguuuucauuccugccccgccaugcucuggaaagcauggucaaauuaguguuguuacacucugucugccagcgggaaaacaugcaaguaugcaagugaaacuuuaaauggaagauauuucuuuuuuuguuguuuuuuuuuuugggacggagucucgcccaagcuggagugcaguggcacgaucucggcucacuucaagcuccgucuccuggguucaagcgauucuccugccucagccucccgaguagcugggacuacaggcacccgccaccaugcccggcucauuuuuuguauuuuuaguagagacgggguuucaccguguuagccaggauggucuugaucuccugauuucgugaucacccgccucggccucccaaagugcugggauuacaggcaugagccacugugccuggccuauauggaagauauuucuaacuagaaaugcaguaaggggcaggaggcaagucuucugaaacucaaggcuuuaucagagauucuuacuuucagcacaguguuuuauaacuuaggagagcauauuuugucaucauuaugguacuggauggcagcagccacugagaugaccgagcugagccagcauaaaaucccgaggagacuucguugucuuugaacuucgacgucgucccucaugcccucucccuucguccacccaaacccugcagaucaugucugcacccuuaacugugauuagagcuacuguuuguaaagaagcuauauguuagcgauagacaacuuuaucuguucauuguaacaaauauuaaugaaguccuagcuuacagauauguugauggacuauguuccccauuaucaugacacccccaaaguggauaaacaaauggaaugucagaauuccaugcuaacugagaaguuguggaauaaaaaaauuuuuuuucugucuuuuucucaaagugaucagaaucuugcccauagucugucaucauuaauaagucuguuuuuggagucuauuguggcauaaagaauuaggcaugguaauuuacaaaaucugauuaccaagagaaucccuaucugcuagcaguugagagcaucuuaaaaagauccaaguuagauacagagcaguuuugcaguguacuagcuauguggcuuaggccaauuauuauauuuaaguucugugagaugcaauuuugucaucuguaaaaugagaguaauaauguuuaccuuacugugaggauuaauugagguaacacucaucuagagcgguacccagcaucuagaagagugcuuggcugauuguggguucucaauaaauauuccuugaagagaaugaauaaaugaaugagugaaugaaugaaugaguuggcucaguuguaaacccucuagguacaaagucagcacucuuucauauauauuugagaguaagcccagaaagaggacauaaaucaaauuucaucgaacagccuuuugggaauacguauaccgcuuacacacacacacacacacacacacacacacacaaguuuaaaauuagaauguuuaaaacagucuaaucagauggucugucauuggcaugacagugagaacuaccagaaagcaugagaggagagcugauaauggggaagggaguggcccagagaaaagaaaggcagcgauaauucuagagacagaaaucagagaaggcaagaggaggagguuuucaguggcuuccaaacacaugugaccucugcguaucagacacaaucuagcugaaggcuaaaaagaccagaauuuuuguugaauaaauugaauuucuacagaacaaauaccgacugauguacucaugagcaugcacaggcccccugucugccccccucucucuuucucccguccucuccccccauuccuuuccuaagagguagauaaacuuguuacuuacagaaaaugauaaucugucuggcugacccgugcuccacagcucuguucaagaaaaacacagacagugagcacguaaaccuugauuacuagcagagacacagugucaccaugcccugaguuugagacuccugccauuuccauaugcuguuuugcaauuuauccucaugguguuagcaggauaaacugauccguugcauuaauaaguguugcaaguaguacuuuagugcccaagaggaauuuggaaagcaucucauacuugccagaucucuuuuccuagguaacauaauaggcucucuuucccccaacugauuuuauuccccauaagaugcccagaguaguuuaguauagguaucccauguggaugaagaagaaaguggccagcuugaugaaaucacugagaccuuggauaccaggggaggaauugcuugucugguagggauguagcuuuuucaugguguagcuuauugaagacaugcagccuggguggugagcuucaccauggccuccuccuuucuccccaguuccugcacaucauuucuuaggacagagaccaaauucacauccacagucacaaaaaagggucauuuguaucaccuaccuuuauuuucccugggcuuugagguaaauguaauauuuugcaacugaaaaguacaguuugcucaggaaagcagaguaagcagaaaaaaaaucauuuuaucuggaaaugaaugagccugaugauuagauggaacagagucauccagucuuggauucaaaucuggcucuacaacucagucucaaauuugacccauaaagcuguucagucaucuuucccaaaauuagcaguguccaugcaaaugguucaguuagccaaagaaucacagaguacacucaucccccauuguggcuuaucuguggcagaaauuccugcuucagaaaugaggcucucccucugaccaaaagaggcuuucucuaauuaugugcuugugacucugucuuuucuaaaagcauccacauuuuuuaggugcugacugugugccugguuuggagccaaguauagaaaguacaauugcccucaaggugcagaugcugcccucgaaaagcuuugccgacccugacucuggggguucuccccucacuuggaccuagugccccaguggguagauaagagugggcucugcccguguugccccauucaucacugggguugauuccacuaaucuagcaaguagggucauucauucauucauuccucacugcagcucuccuucuauaguugggacacucuugacuuuccaucaguucguugaauucucaguguugcuguuuugugccccuggggguuuuccaccuacuguuuuuucaucagccuaauuuuuacucaucuaccagcccccaaugaaagugucucuucuaaguuuuuccugacucucuagagcagcucugacuacuguaggucccuuuugaagccugcccaguacucaccagacuuguuaauacuuuccaguaucuggcccuuccacagugauguaagauccaugaggacaggaaccguggucucccuuauuucccagcuuaucccuguagugucuggcccauaaugggugcucaguaaauguggaaucuguaaugugaaugcaugaaugaaugaaugaacaaauaaaugaacaaacuggucaaugaauucuaguuucacuuuuccaaagguggaugcaacaccagagauggaauuuuucuuuaaucaauaguauguaaggagcuauaauugccagcuagaaaguacaaagccugagcagggaaauccauuaacccauagaccaucuuugucccaacaauguuuugggagcagugaaagaagucagcuauucguguugaggagaauuggaaaaugguggaaauagguaaaauauagagcuuauaaaauucucuguggacuucauuuggcaccaauauuuaguuucaaggaaauuuccagaauacagaccacacaauuguacuuaaauauaaauaaaaacaauacuuucaggccaacaucaagaauuugggggucauccccuguuuauauuaccccaaucauucauugaauucuauaaucaaauauugacuguggcuuucuucuuagucuguauuuuauuuuuuuauuggaauauuuccuugcuuacagcuugccguauugcagacuauuaaaaauccugagucugugcagaaauauacuggguucuagugccauuccugucccugcuagcuugguuagaaagggcccuguuccucugugcaacaacuuuccauuuauacgugaggagcuacggagaccuuugccucauuagggagcugccuaugaaagucucucugaaaggacuuacaucauaauaggaauucagguccccgaaauggcacauuaucauggucugaaccuagugccacguacaccuugucauaccuacauuucauuaaggggagucauccgcaagcauccgggacuccaaaagcuccuggugccguguuccaagaggaguucuugacuucaccuucaaaggauacuccgugauagagaaacuuucggaaugcuuuccugagagccaccuucucgguccccuaguccaaaccuccuccuggaaggaagaaagaauuggcccaguuucugaagccuguguaguaauaauuagcaguggcacacuggcaccacuuggcacauaauuagagucauaaguaacugaguaaguggaccguccccuaacucacuuuggggucuuauucuggacucuggcauggucugugauuguuuuccaccagagacuggaacgaagaaugugggaguggggauggugggcaugggagggaguuauaaugaaaggagcauggaacuaggaagcagaccucaggaauccagccacuaggcuagccaacacuuauuaagcaccuuuuguguacccaacuugauagagcugaggggcuuagagcuugcugcauggccugagugggccuagggcaacuuuucuaggcuauuucaucaucuuuaaggugacaggguugaagcaggugaucucugcuuccuucuggcucuaaacagucugugauucauuucaauaauuggaaguaaagcaucccccacuccuuuaaccuaguaggcaugagccaggaauaacaucuggccucccgagucaugugaacgcuuaguagaaguagaggaaugcagaccacaaagcuuguagucuauuccagcagcucagaaaguagaagcaaugcuucauaggugcccuggacaccauucuccucgcccuguucccugugcuaaucuggucaccauucuucuugcccuguucccugugcuaaucuggacuccauucuccuugcccuguucccuguguuaaucuggucaccauucuccuugcccuguucccugugcuagucuggucaccauuccccuugcccuguucccuguguuaaucuggacuccauucuccuugcccuguucccugugcuaaucuagacuccauucuccuugcgcuguucccuguguuaaucugcucaccauucuccuugcccuguucccugugcuaaucuggucaggucccauccaugcaucuugcauuugcuucccaggacuaagugauuuaaaggacacuucagcagcaagguugagcaugugaccaguacaaugcccaguucgaaagucgacucccuauaccgugcuugaaccucuaccacacacaugaagcucaacucuccgugguuugcuuuugaggaaucugggagucgcuugugcccaaaaauccuuuuccuucccacggaugaaaaugcagcacguaguuguguuguuucaaauuuuaccuauuaaaaauuguuuugaguugauaagaauuucucccucaaaaucuaaacucaucuaugaaauuauuaaucauuaacaccuguaauuucaucuaauaagguugccuuuuuuuuuuuuuaacacccugaugggaucagacuuuucuaaaggaggcuuggaaguuuugacuggguaaagagggaacuucuggagaaagcugcucuggagaaggcagcauuugugaggccacacuaagaaggccguuggugaguccuucagcccaagugaaagagaaaacuugucagaacuaagagggauggaaagggaguaaagacaaacgaugcuuacuucacaguguggaugugaacugguccagcgcuaggucugaugauugguuauggaagagacugcccccgcgggaacuuacgagccugaaguaaugggagcuacauguaaagagcugccucauagaccuucagagagagggagacagagaggcuucuuuuccccagcagcauaaaugagcccauuuuagcaaaaauagcuguaauuugcacaagcguuaagaaucugcuuccaacuguaaaaaaauacugaaauauccagggcauagcaaggcugugguucggcccugugacaugaugugugaucuugaaaaguaaugaaaguggaagaaggcguuguaaagauaccgcucuaaugaacacaauucuguuugccagcauuuuuuccugcuagcaaauuauauuacuccaucaacuugguagaacaucaauaacaucuucagaggauagcugugagagcugaguuacucuaugacaggauuuuugaagacaauguaauuucauauuucucaauuuucuuugauuuugugcugagaaaauggaagaccauaauaaauauuuuccacaaauggugucuuaaauggaaucacagcugguagcaacaguauucuaccguuuauuuagaugcuggauuccagauuuucuaugugaaacaaccaugcuggcagauucauugguuucacauuuuucuaacacuuuuuuuuuuuuuuuaagggaugaauuaggcuucacgugugaacuccuggugggcgcugugggacgggugaugcugggcugccagcuuguuuguacucaguggucucagaguguguuaggguucuugcauugauuggaaauauuucaguuaagaaguuaacaacguacaugacuguuaggugagguucagugaggcaaugagauggcuggagagagcuggguucaggaagcacaggcugaguuccgaucucagcccuuucacgccgugaagacuuggccaaaucaccucgccucuuggaacuuuggguucuacauugcguuagcaacaugauaaacuguacaguuuuaaucaaugaaguaguggaugugaauuuggcuugugguguauaaagaugccauacuuacuguacuuacauuuauuagguaguauaaucuuuguuguuuugauaucauacccagguuuccguaggcuucuuuuucuucuuaauauucuguugccaccaucccccccccguccacaccccaacucaacucagugcuuauccuuacaaagcuuuguucucaacuaguuaucaugguaaguuuuuagguaauaguuguaguaucuaguaucuccaagagugauugcuuuuuaaaaaaaaaaaaaaaaagcaaaacuucuacaaguuaaaauaaauguaaccgugguauagcugcauccuaaaaggcucuuagaaaauucuggcugggcaccauggcucacaccuguaaucucaguacuuuggaagaccaagaugggaggauugcuugaggccaggaauuugagaccagccugggcaauauagggagacuccaucucuacaaaaaauaaaaaaaauaaaauuagccaggcaugguggcauacaccuguaguccuagcuacuugggaggaugaggcaggaggaucucuugagccaaggaguuugagguuacagggagcuauagucacagcacuacacugcagccgguggcagagcaagaccuugucugccugucucucgcucucucuugcucucucucuugcucgcuuucucacucucucacgcacucucucucucucucucgcucgcucucucucugggggagaggugcccugucucuugaaagaaaacaccaaggggauggggagggguugggcaaagggauccuuauggugaggaaucacccacccaaaaggugggaguaggcaagugaguguaaauuaaugcuucuuuggccuuuugagcaccuagcgggcagcaugugaaaggcacaguauugcaucugcaaguauaauagaaccuuccaugugagugauaaaaacuuagucuguugauugaaaggacuuagagagccucugagguuauaacauaauaccuggauaaaguggaaauuacuuuaguggaggauuuuuuuuaaaugcuccuguauuuuuuuacuguaaccauugugacaauugguauuuucaaaagauguccacuacaauaucuccuccuccacauucuccguaauguaacauuaccauuuccccaucaaaaaauugagucuggccuggcguaauggcucaugccuguaauuccagcacuuugggaggccgaggcggguggaucacuugaggucaggaguuugagccucaagugauccacccgauccaaccuugaggucagccuggccaacauagugaaaccccaucuuuacuaaaacccaaaacaauuagcugggcacgaugguacaugccuguaaucccagcuacucaggagacugaggccagaggaucccuugaacccgggaggcggagguugcagugagccaaaauugugccacuacacuccagccugggcaacaagaguaagacuccaucucaaaaaaaaaaaaaaaaaaaaaaauucagucuaaauucccuccccuugaaucugguuuucccuaaaugaagcucuuguaacugcuagaaugcagcagaagugaaucaaugcgacuuccaaggcuaggguggaugaaccccugcagcuucugccuugguccuuggcaacacuuggcuuuccagaaaggucauucuugugacauucccucuuagaaccaagcugccauguuuugagaaccuaaaaggagaggccacuuaaguacucuuguugauagucccugcuugaguucauuuuuuggucacuugagcucaggugccagaggugaaaaugaagaagccaucuuggaaauagaucuuugagcugcagcuguuuugagacacccuuggccauuuaagucauccuagcugaggcccagauauaauagaacagaggggagauaucccugcuguauccuucgugaauuucugacccacagaauaugugaccauaagaaaaugguuauuauuuuauaccacuacauuuuggggugguuucuuacacagcaguagaugacuagaacaaccauuugccauacauagaugcuuagauaccucuccugcaacacuuccaaacuagcuuuuccaaaguacaguggaaaacuggaaacagggcagcagugugguaagugaacaucgcagaauuagcaugagaacuagugcuugcuacuucuggucuucaguaguguacuucucuagaaacauuugaaaucagaucacaucaauccucuaguuuugcuccuuuuccaaaauugugcuagcugcucuaguuccuuugccuuugcaugcuaauuuuacaauacucuugucuauagcuacaaaaacucuuccugggguuuugauagaaauuguuuggccuauauaucaauuuggagagaauugacaacuucacuguguugagucuuccaaugcaugaacacaguguggcucuuuauuuauuuagaucuuucaucuguguuucguauguuuuagcauacagauacuguacaugguauuuuuagguguguaucuaaguauucaauuuuacauucauaccuaaguaauuuuguguuacuguguuuuuuauuuugguuuucauguaugucuugcuagucuguagauauauaauuaauuuacguggguugaguuuguccugcugcuuuacuuaauucacuuauuagaucuagaaauguuuuugaaaauuccuugggauuuucuacauaggcaaucauguuaccuguaaauaggggcagcuuauuuuuuccuuucuauucuauauccuguuauuuuuuuuuugccuuauuacacuggcuaguacuuccacuauuauguucaauaugaguauggaugacagccauccuugcuuuuucucccauuuuagugugaaagcauucagcauuaauguuugcugguggaaaugguacacaaguugcccuuggcuuagugcucuuuggauucccucaucagaucuguaacuggacaacagauggauaugcucagucuacagcugguucucacaauccaguguauuuuuaucuauugggaacugguugacugaaauggcaucuucucuuagcuugcuuuucugguacaugaaacaaaguaccuugaaaacugaauacuguagaauguacuucugugaaggcuccucauaucucagccuucucuuaucacguuauguaugauaccugcuuaugcccguauucaaugugacaccauuccugccacuucucuccacucucuacccugcauuuucccagaaguuaaagucuguauauggaauaaacauauuggcugaggagagagggaccaaaaugacugcguaugucugcuguagaagccagccccacauggugcacagacaguugugcagauucuugcuuggugcagacuugauuucugauccaugauucugacagugugaaggguccuugucacucuuuucagccaggcagucuuacccucauagcguuucacuaugcauugcccucagcaaaauuguggcucagaagaacuccuagacucuggcauuagguagucucuuucuagacucaggcauuggcccuaguuuuaaaguguuuuaaguugaauuuaauuuuuuuauauuuaaaucuuuuuauaucuuaauagguauuuaaaaauuaauugggaauguuguauuagagguaaauuguuagaugccguuuugacugugaguaucuaguuuaaucauucaauuacugauuuugucacaggcagucauagccccugcuuuaaguugccaaaauagcaaacaagccauuaauuauauuugcagaauuuaaaaagcauugccagcagcuucucaggaccaucaagucaaacccacaugguuuugccacuuccaugccgucagguguuugaauuccugccucacuuugacaauggcaaaauaaacagauucccaaaggggagaaaucuuucuuuucaugaacguuuacucuucccucaucuuuuucccuuucuuccucccuuugaaaaauacugcuugagcaguacuuauggcuauguguuugugcuuuaccaaaaacugucaaaaucuuacaaguugauaaguaugaauggaauaagauuauucauggcugcaggggcuccucuggagacaagauuaaaggaacuacaguaauuugaccucuaaguagggauuugauucucuaauuaagcauaggaaaugcauauacccuuccacaauguagaaggagugauacauauuugguuuagagggaggguaaagaacuagccuuuuugccuggccuucagagacugugagaggagagggugccugagcaaagaaagcucugaaugcguagguaucagacauaguuucuuuuuuaaaaaaaauuuugauuaguuaauauuuuuuuuuugagacauagucucacucugucauccaggccagagugcaguggcacaaucuugucucgcuauaacuucugccucccagguucaagugauucuccugcuucagcuucccaaguagcugggauuacagaugcaugccaccacgcucagcuaaauuuggacuuuuaguggagacgggguuucaccguauuagccaggauugucuccaccuccugaccccagugcucggccucccaaagugcugggauuacaggugugagccagcgcaccuggcccagacauauuuucuuuaauggucgcuauggaauuuggaggagaccauuauaagacacaugugcugaacuguuuuaaauuguauauuuuuaauguaauagcaacuaccuugcaaauuggugugcuaauaagagaggauggaaaugggguuacuugcagagaguuagguauauaaauagugcccucaaugugugaucauucuuugacucuuggaagaagguggcauuuuucucaauuuucccaguacuauacuuuauaguuagcaaauuacacuggauuugauuuagugguuaagaauuccguaaucauuuugccuggaaucaaauaauagcucugccauuuucuagcaaguuacuuaaucugucuaugcuucaguuuccugauugcuaaaauggcaacaauaauaguaucugucucauaagguuguuuaauuuuuaacagcuuuauugaagcauaauuuacauaucauaaaauucaaccauuauaaguuguacaguucugaguuuuagaaguuuuuaugguugugcaaaaauucucacaauccauuuuuagaauauuucuaguaucuccaaaguuuuccugaggccuguuugcagucaguucauacccauacccagcuccagguaaccacauuucugcuuacugucuccauaguucagcuuuuucuacaaauuuccuaucaauggaaucauauauguagccuuacuuuacugcuuucuuucacucagcauguuacuaagguucauucauguuguaacauguauuaguacuuuguuacuuuuuauugcugaguaguuuacauuguauggauauaguacaucauauuuaucuacucccaguugauuauuuggguuauuuccacuuuuuuggcuaugaugaguaaugcugcuguaaacauucacauauaagaccuuguauggacauauauuuuuauuucucauaaguagauugauuccuaauaauggaauucaggggcauaauguuuaaucuuuaaaaaaauugagauagcgcuugcauaccauaaaauccacuuuaaaaguguacauuucaguggguuuuuuagcauauuuacaagguuguacaaccaucaccauaauuuaauuccagaacauugccucaugcaaaaaaaaagccucaugcuuguuagcagucaucuccaacccccuuuggccacaucccauggaaacuacuaaucuaguuugugucucuguggauuugccuauucgggauuugucauauaccauuucacauaaauggaaucauauaauuuguggccuugugugucuggcuucuuuuacuuagcauaauguuuuuaaaguucauccauguuguagcauguauaaacacuucauuccuuuucauggcugaauaauauuccaccauacggagauaucaacuuuguuuauuuauaaaaugauaggcauuuggauuguuuccauuucugggccauuaugaauagcacugcuauaaacauucguauacauguuuuugcauggacuuguguuuucauuuuucaugggaacacaccuagagguagaauugcuaggucauaugauaacucugucguuuaauguuuugaggaacugacagaucauuuuccaaaguggcuguacuauuuuacacucccaccagcaggguaugaggguucucauuucuccacaugcucaccaacacuuguuauuaucugucuuuuugguuauccccauccuagugggugugaggugguacuacacuggcuucgagucacguuucccugauggcuaaucauguugagcaucguuucagguguuuaugagccauuuguguaucuucuuuggaaaaauaucuagucagaucuuuugaccaucucacucgagucuucuguuuaacuuuuuagguaauugccaaaauguuuuccaaagugcuuuaccauuuuauauuccuauuaacaauauaugaggguuccaguucuuccacaucuucacaaacacaaaagaauaguauugauaguuuguuugauuuuagccaaaaacugucaaaaucuuacaaguugauaaguugauaaguauaaaacaagauucauagcugcagaggcaccucuaggaacaagacuaaaggaacuuguaauuugaguaauuugaguaauuugagcucuaaguagggauuugauuaucuaauuaagcauaggaaaugcauauauacuuccacaaucugggagaagucauauauauuugguuuagagggaggauggagaacuagccuguugaccugugguaaaggguacgugguggugcucauuggaaaacauuuuccugguaccuaauuauguugaucauuuuuuccuguacauauuuggcauucauauauugucucuguagaaaugucuauucaagucucuugaccauuuuuucuuuuccuuuucuuuuuggcuuuguuuuauugaguucuugauauauuuuggauacaagccuucaaucugauguauauuuugcaaauaauuucacucuguaagcugucuuuccauuuucuuuuucuuuuucuuuuuuuuuuuuuuuuccccuugggacagugucucacucugucacccaagcuggagugcaguggcccaaucuuggcucauugcacccuccuccuucuggguucaagugauucuugugcuucauccucucaauuagcugggacuacaagcgcaugccaccacacccagcuaauauuuguauuuuuaguagagacaggauuucaccauguuggccaggcuggucucgaacuccuggccucaagugaucgacccgccucggccucccaaagugcugggauuacaggugugagccaccacgccaggccuccauuuuuuaaauguaucuuuuacagaguagauguuuuuaauuuugaugaaauuuuuccauuuuuuucuuuuaugaaucauauuuuuggugucauauuuaagaacucuugccuaacucagggucaugaagauuuuccccuacgucuucuaaaauuuuuacgaguuuguauuuaggucaaugaucuauuugaguucauggccucaucauugaccuugauauauaaguuaugaaguucagguugaaguucguuuuucuuccuagacuagacuauacauuuuccaaagaagauauacaaauggcugauaaacacaugaaaagauguucaacauuauuaaccauuagggaaaugcaaaucaaaaccacagugagauagcacuucacacccacugggauggauauaauagaaaagguagauaacagguguuguugaagaugguuaaaaaugccauccuuacuccauugaauuguucuuaugccuuugggaaaaaaaaaauaauuggcuacauuugugugaaucaauuucuugaauuucuauugugcuccauucauuuugugucuaucucuuugccagugccacacugucuugauuacuguggcuuucuaguaaaucugaaaauuggauugugugagcccuccaauuuuauuauuuuuuagaauugcuuagacucuuguaauuccuuuguguuuccauauaaauuuuggaaacaguuugucuauaucuacaaauaucaagcuuggauuuuuauuacaguuucacuaagucaauuuaaagagacucaucaucuuuacuauauucaccuucauuuuuaaaugguaguuucuccggauauagguaucucgguuaauaguuuguuucuuuugacacuuuguaucauuuuccugcccucugucuuuauuucuuuggggggugggggcaggguguagagacaguauaucuggugguuuugguuugggaacugaacauuuuaaauaauguguuauaacugcauucuguuuuguucugagaguaguuggugagcauuuugugguguauuguuuuguaacuugcuuggacuucagcugcagaguguggaguacgcaguggagcucaucaguauugucuuugcuuagugucuuauucuuuuucuucuuuuuugugaugugggcagaccauuaagcuaugcagaagacacagggggaccucuaggaaauaccuugagccuauaaggcuuccacucugcuggucacuugugugugagaagauacauuuaagguccucaaaucuccucugauuuuuacuuuugaugagguucuuuugggucucccuuguguacaugcaauuucccaguuauccaggugauacggagaguuggucucauuccuucuaaggcugacuugggggugaaugguagaugggaauagccucaggcaagaagaccauagaauccugauuuucuuaccuuaaaauauaguuauuuuuaaaaaaauaaacacuucucaauuuuuugucuaccuuagaucaauuucugaugcccuaaagugguugccuuuggcaauuuugacuaguuuuguacucauuuucuauggacaagaacuacuaauuacuuuacaccaucauuaccagagucugcuugaauaagauuuuuuuuuuagaauaaauucaacucaaaguccuuaggacagugccugacaugaggcaaaggcacuaacuguaugaacugcuguuacuguaauuaccauuauucuuacuagugaugcagacaacuaggcagccccaccucccagaccuauucaugguuguccauuacgaucauuuuuuuaagggauccucuuccuggccucuuauuuuuaguaacuccuuugucguagagcaagugucagcaacuguucugugaagagccagguaguaaauauuuucagcuuugcaagccauacauccuccuacuuaauucugcucuuguagcuugaaagcagcuguggacaauauguaaaugaauagacacggcugugucccaacgaaaccuuauuuacaaaagcauguugcucaugggauuuggcuugugagguggaguuuaccagccucugcuaucgccucacuuucucaugauucugcaucuaagcagugcuagcugcucugcuacaacaggcuauauuuuuucuuugaaaaucuucaaagaagagaacaucucugcuucccagcaccacaauacggcaccuuccaacaccugugcuauggaaacccauccuaugacuucuucaaggucugugggcucugaguacuuggcaucuguagugauugauuucaauaaaguaccaguaacacuacugaaaucuaugucaacaacaucacaugaguauaggguuguuaaacaacauuguagauacagauacauacggcuugguaagcucauugaugccaaacuauauuucaucuucuauuuuaaaguaaauugugcagcuuuuuauucauauuuaauuuuuaugacucuccucuuuucuuuccaaacaaggaaaagguauggguuuuuuuuaacgacaaugcuccuuucuuacugauguaacacucaaucuuugagaucguuaaaucccuagauuaccuauuaaccugacugcucuccgcaaacuggcuuuguacucagaaauuaaaacagaacauuaaaucaguuacauuaaacagaacauuaaaaagucuuaauuaagacuuuuaaaauuauuaaauaaaucacauauugugaaggauauauaagucacagaugaacuguuuaaagaauuguaaagaaaguauguuacuuucuuacggucuucguggauguagagaggcuuuaaaacgcuugaauacuacuguuucuccuacugauacauaugcuauaauuguuguguauuuuaauuuuuaccauauuuuaacccacaaaaauuauuuugucaguauucauagauuugcccauauuaagcauucucuuuguccauuuuuucuuguaucuuagaccauccaucugggaugauuuuccuuucaacuaaaauguuagaaauuccuuuugugaagaucuggugacaaauuuucaauuuuucuuugucuaaagauauuuuuauuucaucuuuauccuuuuuaagagauuuauugagagacaguuuauacagcuuacaauuuauccauuuauuuuuuuuauuuuuuuuuuuuuuuaguauuuauugaucauucuuggguguuucucggagagggggauuuggcagggucauaggacaauaguggagggaaggucggcagauaaacaggugaacaaaggucucugguuuuccuaggcagaggacccugcggccuuccgcaguguuugugucccuggguacuugagauuagggaguggugaugacucuuaacgagccugcugccuucaagcaucuguuuaacaaagcacaucuugcaccgcccuuaauccauuuaacccugaguugacacagcacauguuucagagagcacaggguuggggguaaggucacagaucaacaggaucccaaggcagaagaauuuuucuuaguacagaacaaacuggagucucccaugucuacuuucuacacagacacagcaacaaucugauuucucuuuccuuuccccacacuuccccccuuccacucgacaaaaccgccaucgucaucauggcccguucucaaugaccugcugcguacaccucccggacagggcggcuggccgggugggggugucccccaccucuuggagggggcggcugccgggcggagaugcuccucaccucccagacggggcggcggggcagaggcugcaaucucggcucuuugggaggccaaggcaggcggcugggagguggagguuguagccagccgagaucacgccacugcacuccagccugggcaccauugaccacugagugaacgagacuccgucugcaaucccugcaccuccgggaggccgaggcuggcggaucacucgcgguuaggagcuggagaccagcccggccaacacagugaaaccccgucuccaccaaaaaaauacgaaaacccgucaggcguggcggugcaccccugcaaucgcaggcacucggcaggcugaggcaggagaaucaggcagggagguugcagugagccgagauggcagcaguacaguccagcuucggcucagcaucagagggagaccguggaaagagagggagagggagaccguggagagggagagggagaccgugggaaagggagagggagacgguggaaagagagggagagggagacuguggggagagggagagggauuuauccauuuaaaguguauacuucagugguuuucaauauauuuuaauauaugugcaaccaugacuacagucaauuucagaagauuuucaucaucaucagaagcccugcacccuucagcucuucaaucuuauucuugaaagaugucuuuugggauguagaauucuagaggaggaguuuguuuuccucagaacauggaagaugucauuccacuggcuuucuuucagcuuccacucugcaacugcuugucagcucucugggacucuugcauguaaucuguuuccuucuguuaccggcaaucaugucuuacuuaccauuccaaauaaguugaacgaaaggaaggauuuccuacuagaccccauccugcuggggagacagugggcuugcucuuuugucccccaagucccacagagcagaggaggacagagacuccagcagaccagcaguucagcuauucugcuuauuugucaggaguccuucuucacucacauucuggccugacaaugccuuccuaucuugccagcaucuuacugcuuuuuagaauauuucaucgagcguucuacauuguuuucaguaugcucccauugaaucgguauagcuaccaugccugcugcauuucuaggaguagaauauaaaccaacuuuuauaaacuugaacuaaaacguucaaauaaauuuaaaauuuucugaaaauuuuaaacuuucugcuguuaaguuucuugaggaaugaucugaaugauaugaccaucuuuggagggcuugaguguguacauucagaacuuuaucccacacaaggauagacuauacagaauaaaugcaguuuuuguagggaauaucucauuaccauuuuuucucaaggauguauuaaacuaaauuaugguuauuuuauacuucaguugugcuagccagccuuuuugaaauccuucaagaugucaucaaauguuucacacucuaaaaaaauagugcugucauauaugagacaggcaaaaggacagcauuaucacuguuaggagucuucaagaggaaacuguuuacaugaaguggaggacuguccugccugccuggaagaugcuggccaguccucaccccugcgccacacugagggccauccacacagccccugagguuucccugcugccagccaggcugcucgcgggcaugagagugaggaaauuuuuaaguccagugugaagugaaaauaauugaacacacuuaauauaaaaguuacaaauauaggcaagaguuucucaguguguuuucuagaaggaaagaccaaaaccccaguuugguucauuauuggaugcuuaguccuaucugcaacauaagucuuucccuuaaugaggacacucacccagaaucaucucaacuacuccaggcuuuccuguguguugcugcccaagccccuuguauuuuaaaagaaacaggcaaauguagcaguaguucaagugguuuucuguuuuuuuguuuguuuguuuuuggcuguggaaaaugaccauuuugaugcuaucaugcuuuuuuuuuuuuuuuuuuuuagugauucuccccacccccaacccaguguguaaucuccaugugggugcaacagugcauuccacuaauuaccauacauuuacuagcccuggaaacuuaauaauacuaguuuguguucguauggaguuguauacauuuccagaugcucuccaaucucuuaucacauuaguugugaaauagucauucaacuaacuggaagagccaugucuucagcccaaaucuuguaucuccuucauucuaauuuaucuacugcuuuccuacccucugugcuccugagucugaauaacauggacauuucagauaauugaaagucucuuuuauucuuaucugauuaaagauucuaauaauggaucaugugcaaaguaacucuuaauugucaaacuaauaagaguaagaaaacccuacuucuaaaaaaaauauguauuuauuuguagagauagucuugucugucacuuaggcugaaguacaguagcaccaucauagcucacuacagccucaaacuccugagcucaagugauccucccaccucagccucccaagcagcugggaccacagcugugcaacaccaagcauggcugacuaguuaaauuguuuuuuuuuccuuuuguagagauggcaucucacuauguuacccaggcugcacuugaacuccugcccuggagcagucuucucuccuuggccucccaaagcacugggauuaagggugugagccauggcgccuggccuaaaccccaccuuuugagugaaggaccuauuugguggaagguuuuaagagaaguagaaauguaucucaguuuaugaaguaaaagaaaugcaagaaaaauuucauugcauuagauaaaaucucacugugauguugucaaauccugugugacaccacgaauuuucuuucuguuacucacauagagaugggggagugcagauccaucuuaaugauaugaggccaauaguacauaucagaaaccaaacaagagcugaggguucagucugggcuggaacccaaguucuuuuucuuuuggaaacaagaauucacggcccugaucucccugucaccaacaaagcacagcaguagaggugauggagaagcagugauucaucacccacuugggaaacagcaccucuccagaguagcagccugggugaauuaaggucaugguaagaaguaguucuccguguucugaggugguuucaugacuguggggcccaucuuuuuuuuuccccuuugguuuuguuuccugauguuaggaccuuuuuuuucccucccagcaacaaaaauauaucauauuacuaauaaaguuauccuaccacaaaggcauaaauaacuuccauaaaacagcugcuuuaaauuaaacagagccuaaggaacaucagaagacugacucuaugugccucuucaugccucuuugucccguuuacuccuggcauaugacacugaguuucuacauuugcuuuaagaccuaaagcgaagccuuuuaauguucacugugggcuguugcucccucugcuauuauucuagcuaucaagucuaugucugucuaaugucuugaaacagcauuggaaggcuguuauauacuguucauugaauguaucauuuuauuucuacagaaggcucaaaauuuaguaaaauuccaaaucuuuugaaacuugaggcuaucuccugaaguccaucauuucuaaaagugaaaaaguaaaauccagugcccugauuaugaaaauuuucaaauguacacaaaaauagaauaauaugaacuuucauaugucuaucauccagcuucaguaauucuuaucaagauuuugccacgccuaccuuaucccucauccuucuucuuuuucccuuugcugaauuauuguaguuucugugcaauucuuagcauuuuuuaaucugugacuugcugucuuuaguuuugaaaauguuccgccauuacagccauauguauguauguauguauguauauauacauguauauauauguauguguauauauguauguauauauguggguauauauauguauguauguauauguguguauguguguguguguguauauauauagcuucugccccauucucuccuuucucucauuugagauuccaguugacacauaugagaccucugcuccuguuuauuucuguuacauugucucuguaucuuugauggauauguucauuugaccuaccuugcaguucacuaauucuuuccucagcucugacuaaucuaauguuagacuguuaaguucuuaauuuuaguuuucuauuuuucaguucuaaaauuuccacugguuauuuuuuacauaauuucugauuuuucugcuaaaauucuuacauauuauuuaaguucucaaacauauuuaugagcuauuuuaaagucuguguaugagaaccuuaccauuucaguaccuguaggucuuaugucacugucuauauuguucuucuugguuuucagagaguucuugucuuuuuguaugccggguuauaauuuuaccaaaugcagaacauuauacagaaaauuugagauaaguugaggcugaggaugauguuaucuccuucagacauguuuacuuuugcuucugggaaucaggauagaaagaguucguaccuuaauccaaucaggauuugaagugauucauucuuuguaauggcugcuuuauuucuaauuuacuauaccuagauagauuguaguccuuugguggucagagucgaaagccaggaauguuuacuggagcuccuuguuaucauuguugaucccugaauuccaguuucugugucuccuuuucuaugagacugccaaaaauauugcucagcuggugagccucucugucucuaagaucaucaaagggaaaaguaccaaugaauacaagguucaccuuccacucuuuccaugaucuugacuuuucaagaucuugcugccucaguggcuccuugauaccuucaaacagauucuuaaaaauacuuuuuugucuauguuuuccuguuuacagcauuucguguuuucagcagcagauaagcugcuuggucugaaauaagcuacuccaccauugcuggaagcugaaaaucugcugaagauacaguuggcccucuaaauucauggcuucugcguugagugaucucugcuggauugaacuggaugcagaacauguggauaugcagggccagcuguguuuuugaucugcaguuguuggaaccugcagaugcuggaccuggggauuuauaacccagcgauaccaugggcugacuguaagagacuuaaacauccacagauguugguauuuguggggauccuggaacuaacgucuugugcauacagaggacugacuauauuuaagugaaaucucagauauuaggucauuuaauucauacguaccucaguuuuguaucucugaaaaaugaggacauuuuuucuuccaugcgcaaugccauuucaugcucagauuuccuggauuaucccagaaauauguuuuuacaguugucuuggcugaguaaggauacacaaggucugcaccucguauuuggcuguuacaucucuuacaucucuuuuaaucuacaguauucuucucccgcuaccaucuuuuucuuucgaugugauugacuuguugaagaucccggguccgggcuuuuguagaauuucccguaccccagauucagcugacugcucuacuugucccucugucccuuguuuuuugcaugaaaugggauuugacuuugcagccuugguuagauucagcuucagugugugggguucuguuuuguuucacaaggaucguugagggguggucaaaaauaauuccuucugcgucggauggcacuuagugucuaguuguccuccuucgguggugcuaagauugaucaguggauuuagauggugacaaguuaauccacccacuguaaaauucuuuaccauccuuuuaucuaaugguuucaucaagugauauuuucuccccucaguccaauaauucuccaggaguugcaaaaugauuuuucuaauucugucaucauuccacauuuaucagcuaaaauucauacaacuggagcuauuuaguuacucuaagauacaauuuaaauaggcagguuaaguucuccuuucagguucaguaauauguuuugcaucaguuuuuaaaaaauaauuguauuaacuuaguuugugcugcuacaccaaaauaccauagacgguaauucaccaagaacagaauuuuuuuuuuucucacaguuccggaggcugggaaguucaagucaugaaauccaagaugaaggugccagcagguugucuggugagggcugcuuuccauuuccaacaugaugucuuguugcuacauccucuggagggaaggaacacuguguccuuacacaguggaaggcaaacaagcugaacacuucgugaaaccuguguuauaagggcuuuaaucccauucacaaggggaggagccuugaugaccuaaucaccucuuaaaggccggaccuccaaacacuaccacauuggccauuaaguuucagcaucugaauuuuggagggaacacauucaaaccaaagcaguagcccugaauaacaaaggccuuuuccuacccugugaaugccaaagcugccaucuguaacggaauaaugugauugguaauugugucacguaggaccaauagagaucagcaaccucagccagacugauagagauccuggcaucagauauuucuucuccauguccuuuugacuucagaucccaguucccugacuuucagccucccuguaaaauauaucaguaagaucuuggugcuugugggucugaguuaaagcugguguguacauuuccuucuuuucucugcuuguuuaaacccauuucuucuuaugcacuuauucaccauagaaacaccaaaaacauuuuuuuccaaucuaggccaagcauucuggaacaugugauugcuagcauuauaccugugaaaggaaaauuuauaucacccaaacaaguaaacugccuuguugaaugauuuuguuguuauguaguuugcuuguauguuuuuguggaagcguuucuauuucugaaucauggagucaacucagacuccacugcacccccuuggauccccagauucuguuaaaucagcugcauaaccuuucuuguaccaaguccuucuuuucuguugauauugcugcuauccuaccucaaguauuuuugccucuagggucuguuuuccaauuuucuugguuuucuauugugauaaaauaucuucagcccccuuugguagugccucacugcuggcaagguaaguccagaguuccuagcuuugcgcgugugugucugcacagccuggccucacugcuggcaagagaaguccagaguuccuagcuuugcacgugugugugccucugcacagccuggccuugagugcaccucccuucccacuccccuccucugcuggccggaccagcaugcucacugcccuuuggcauucagcuuccuaucccaucaccagagcaaccauccaucccuucccuugucccaggaucccaucaucaucuccaguggaaacacacucaggcucugccacuccccugaucacuguggucccggcugcucccagagcacacauugugugguuucacacauauugacgggguuucaccauauugaccaggacugugcccuggucagguggcugucacaugccuuucuauaucaugauuucauuugccucaccugcaaacuacaugcuaaccaagggcagggacucacuuuggacuucugcagauugcuuauggggccggacccggaauccaguaucuuguaggugcaucuuccccucaccuucucacucagacuccugcuuuaguccucacgguccuuggacacaccugauugcugcuucacuuuggacucuuaaucccggucuuuauuuuugacaauccuaucaaaagaugaccgucuuuuuguccugucaagacuacuaccuccaggcccucuucucuccccaucccugcucuacaccaugaaguggauggaaggccacaccuuugaagaaugucucccagcaggagugagcuugaccagcuuuccuuggaguuauacuccagcaaggaaucaugauuuuuauucucuaugucagcugggaggccuccagaaaccaaccaggcccgcaaucagcagccccauagagcugugaggcugcccuggaaauauuuauuuggaagugccccuggacaagcgcuuccucaugcucuccuuuguaagcucuacuucauuuugaaauaucugagcuaccggggcagguaccugucauggcguaaugacacaccgcuuucucugccaucguagaacugaagauugucuuuccuucugcuaacugacaugacagacaucuacuuaguggagugaugauuaguguaagaucacuuuuuggccuuuaaguuuaaugaugcuacauucguaguaauaauauaacaccccaaauccaggcgugcuuuucaaggaaaguguccagggcaguuacccucugaugauggcguccugcccuuaugccuuuugucuggggaucuuaaagucauuucuacacaaauagauaaugauguucauuucguaaggggugagagguaaagugauugaccccuuggcauacugaagagaugaagaaaaauccaggacccagugucuccuuuguuguucccccuuccgcucccuuuucagccuuuuuuuuuuuuuuuuuuuuuuuaagacagagucucgcucuuguugcccaggcuggagugcagugcugcaaucucggcucacugcagccucugccuccuggauucaagcauuucugccucagccucccgaguagcugggacuacaggcgccugccaccacguccagcuaaauuuuguauuuuuaguagaggcgggguuucaccauauucaccaagcuggucucaaacuccugaccuugugaucugcccaccucgcccucccaaagugcugggauuacaggugugagccgccgcgcccagccccuuuucagcuuuuuaaaagaggcaugcccaacuuucugucgguuuaaauacuuuccucccagguacugcuuucuacuucuuaagagcaugaaugaaaaaaaaaguguuucuauaucacauuucaugggaggaagaguuaagauucagcgagagggaaugguuugcagauaugugugcauuuucagagaacauaccugucucuccugguaaauccgccucaucacuguuauauaauagagcuuagaugggguucucuggguucauggaugaaaagcaguuggaacagcgccuggcacauggcaggcccugcgugagugauggauucuaggucaucuuagugaugucugugggcaggcaccuccgucccuggagaagcagcauuuagagugugcccuugcucguucucucugacgguugggauaugcuucccuucuccuacccagccaagccucuccaaauccuugggagccaguguaaguccaauuucccaccuccaggaagccuuccccaguccaaccaaccaucagucaccucuuugucuucacaauacuuguaucauuuucucaguucaauucaacaaacuugaacuggacaucuaggguauacuaaguuaugccuuauuugggcgcuaaaucaugcuccguccuguaacauuguuuuaacuccugcaggaauguuuaucuugugucuaaugggaugauucagccucaaggaaaaaacuuuuuuuuuuuuugaaacagggucucacucugucacccaggguggagugcaguggugugaaacugcagccucagccuccagggcucaagugauccucccaccucagcguccuagguagcugggacuacaggcaugcuccacuacaccuggcucauuuuuguauuuuuuuuuuuuuuuuaauagagaaaggguuuugccuuguuacccaggguggucucaaacuccuaagcucaagcaauccgccugccucggccuccaaagugcugggauuacaggugugagccaucgcaccuguccugaaaagcucauuuaaacugugguuuuguguguguguguguguguguguguguguguguaggcauuuccaccagagacaauucugcauauacagcgggggcucaguauucucuaagaguagggguaggggguauuggggccagaagaggccaaacugcucauauuugguuaaauccaauaugguaaauucuuguugaauugaaguaauacagcucuucacagggucugaaacagcccauagccggagucgugugcguccucuuucuuugguccacgacaacaccguauucuauucuguucuaugugaaaggguccaguauggauugaguuccuccugcaugucagacaucauggagaacgcagauggggugccugaauaaaaagcacuauaauccagugagaugauaaauaaauacacacgugcucauaagaaagguguaccaugauggacuccacagcugagauucaaucaaagggcuuugcgguuaaaaggggggugugguaggaucuaguugggggaugaugaaaacuuuguuuauucaacaaauauauauugagaggcaaucugcuguuccagggcugugcuagugcugaugcugaugcuucauggaagagcuuggaggaggagauuagcaccuguucuccccgccccaccccucccaaauaucaacgcagagcuccaaacuuuuguuucucuucucuaguguuuaugagggagaccuucuaguccugucauuuuuuuucccuaacacaaaacacauucugaggagcuggagaccaguccugugucaauuccccucaguacugcauucuccuggauugcaaagcugauuuccuuucaguagcucauuaacauucacagcuagugucugcuuccacuuucguagucuccugaugaaaugcugacugcaaaggugagggcugcugacacuguuugccguuugguuucuuccaggauuuuuuucccaggaagccaucccgucagagggguucaagugaugaaaguuggcaaacugcagcuacaucaaggcauguuuccccaagcaaugaagaaucugagacuggugagugugccaagaucucacauaguucugccuggcauccuuuuuuucugcuguugcugggccucuuugugauuuguuagcagcucuauguaugugugcacgcauacacacgcaugcccagugugugcugguaaauguuuaacaaccacucuggaaaaaaccugcuucaugacauuugccuauuucugugaugcaggcaugcccaccauggcugauuuuaaauguaaaaucaaccuucuuauaaaaauaauauuaacaauuacucuugccacugguacaaaccagucugagaacaccacugcuccugugcccucuccacguuuagcaaguugaccuuguuugugccuccuccccauugcccacggaacacaguccgugucccucgcguggcaagcccuugaccaucuguguggcaguucaccuuugcagccacuucuccccgcccuuccucucuuccuuuccacccacccagugaucacugcuguucaccaggacccacugugacccugaacuucucacuccuccaucuucacacagcuauuuuuuccucugccuuaagugcucuccgcaucacaacccccugggcuuggcaggacucugcugauccuuuaaggcccaauuccaguguuacuuugugguccuaccccuacagcucucugcccacccugccaggagagcccuuuucacauugcaguaggcauacccgaugaccacccuuaccccugcccccaggagagugugagggcuucgugguuaucuuggcaaccagcucagugccaugcaagggaucuggaacuuaggaaguauucauuauugagggaaggaggagggaggaagcgaaggaggucagugaauacgguucuggcaauaagugucaagaaacuaauugggagaacugguuuaggguuggaauagcuuguuaaaacacgaugguuaguuucacccgcucagggagucuccucugcccggaggagcccagggcucucugcugucuggcccaggccuucccaccucagcagaacuuccucuccucuaguccgugacccuuccaaaggagagcucacaugcucaccuggccaggcacugguggguuguauggagaccuggcgugcggguaucauaggaagcgcuugacacuuuaacaggacccucugggccgccaugcccuugugugcagaagagugacgguggaaggaucgggcgucaggguugcucagggcguguccaggggccggcugaucccaaaacacuggcagccgcccacauggaccuaagagaaaugacaaaugccgaagggauucuuaaaagccagauuccacagugcucauuuucgccgaaugcuagccauagcgccuuuacuugaucucuaaauaaagucagcguguggccaacgggaguaacacuaggauucccugagggcacucagcuauucuguucuuuuuaucaugucuggcauguuuacccaggcgggggaagaacaccgcaccgucuguugcagccucagggagaacuuuccuuuucuggucuggggguacuugucagccagucgaaucagcaagguacagcaaauccuuaucaagggccuacugugugaaaguccugacagaaaaacaacgugcaggaaauuuccuaaugugcgaugcacccaacacagggucaccugcaaguagauguucguaagugaucagacuagaccuuuguguuuauaugggacuagaaacuaugaauacugcucguacguacgugauccgugaucauacucaguccccaugacaggugacagcugugugaggucaaugggacaggcauuuucauuccuauuuggaaagugaaggcgcucagguuuggagacaugcaagagcucaccuaaagucgcacagaggcagagccagguguauuuguucaauuuaauucaacauggugaucaaauacuucuacuacuuugaauaagacucaggcugggcgcgguggcucacaucuauaaucccagcacuuugggaggcugaggcaggaggaucaccugaggucagggguucaagaccagucuggccaacauggugaaaucccgucucuacaaaaauacaaaaauuagcugagcaugauaacgggugccugaaauccuagcugcucaggaggcugaggugagagaaucgcuuuaacccaggcggcagagguuacagugagccaagauugcaccauugcacuccagccugggcgacagagugagacugucucaaaaaaaaaaaaaaaaaaagacucaauaugguguguacaauuuaauggaggagauagacauguacaagucauuaaauccaggccagaaaccaaggcucugcucuuuuccucuagacugguccaguuaaauagaugaggcucucuaguaagaucagugugcagaaaucccuuaagaucuaaccgaacccaugaugccaacucagggaaaaauaugggagagaaaucagagaagauuuagauugcuucuuaugugaagcuuuagucauugcuauugcauacagaacuucugaaggagacaucuaauacccucaacuauaaggacaagccugaacaaacccagacagacaucucgcuauggauuuucaggauaauguggccugggcugaugguacugaccaucaccagcccuucagaugacccucuuacugcccuuuacaucccucaugcccaggucuguucugcugcccucacacccuucugaugagguugcaucgccucuuucagaagcuucucuucguaaucauguuagcuuuuccuauucuugguaccaaggugaagcucaggcauacacccugauagaugccaaaugaaagguauucugggagcagcaucagauuaucugucaugaggccugggguuaaaugguggccuuacccaaacuugcugugugucucuacaaaagucauugagucucuugccaaggucugaugaucaaccaaggagcaaacaugcacuccuggcagaguuguagaaagagugcaaggauuuagagucaguagguucagguuccagucccaccauuugcguuaaucucugaauauaauuucauuuguaaaaggaagcugauagcuaucccauagacuuguuuugaggaguaagcgaggcaaugcgggagagugugcuugccaaucucaagcauucugaaacuauuaaagauggguauuguuacaggaacucuuguucugaucacucucccacuagcuggucuguucaguacuuguguuuguaguuugggguacacggugguuccucuggugaacaauuauguucuaugacugcuccccagcaguguuuugcuccccaaggugagugggaaucccucaagggaccuuacauuccuuuugugucuucuggugccaccuaacauagacacacaugcccccaauacggcaaguucuguuaaauacaugcuugaaugaauggauuuuuuuaauggauagaagucuuuaaaagccucccccugggccugcugguuagcuguuuacaguuaauggaccagaucuucucaugaccuuugcugagcauuugcuagcagagggauggccugaauguauccaucccuaggaaagcucacgugaccugugagucuagaagcaggucaguuucuuccugaagaaagucuuucuuuccugagcuuucucaggacucggguaaccuggagagggaaaagggaggcuauacucuuugccuuuugaaacugaugucaucuucagacgggcacccucgggaugcucuuucuugucuuagaaacccuggaaauaauggaaugaaaucacuugaauaagguuuuugaagacugaguuugaauagaaaucagaggagcuucagaaacagaaauuuauuacagauucaguuaggcuccagccuccuccaggaaaggaauccacuuagcccagcucugauuugguuuagucuuccauuuccacugggcucagcugaaauucuugugauugcugccacaggacaguccuggggucccuucccagugcuucccuccugcccucuccugucacuaaucuacuuuuauuucuuuccauuuauuucuuagaaggcuuuuguuugcuacuaauuugacuucuuggaccucaaggacaacccaucugggcugucuuguuaaucagaguuguuuuuuuuccugugaacccugcaugcugcaggcucccucacccuggcccuaguguaguugcuuuucagcaaaaaucugguugcaaaaguuagacuucuuuccccucggcauccauuuuuuuaaaaaaaucuguauuuaaacuuuuuguauuacaauuuuucccuucucauuugauuuuauugcaguauuuuacccauugagcaucuuuuuagcuuuuucugcaucucaacagacagcaccaggccgcaaguccuagagauugcuccuuguauuccugcaucggcugcccugauuuucagccccagcaauggcugauuuagagcaugcaguucuguuguucccaugucuuaauccgcuacagugauucuuaaccucuuugguugugucccuauuuaggaaucugaugagggccacugacuaaccagagaaaaguuaaauauacacaaccuuuuguauauuugguggggauggcagcuucagaggcucccugaagcccuuccauggacuuaguauccauggugccuagguuaaaaagcccuccucuaaacacuuaacaucauacguuaccguguggggaggugggagggaaagagggggaguaagagggcaugcggaaggaugucccguaauugucacuaauaccuucaaagaguuguuuggaagccccuggcucuaauauuuaugagugauuccuacugaccuccaaauagagaauaauaguuccaagaguguguuuuugaaccaaaaaagagaaaagauaagaaaauaauggauaaaaugcaaacacagugauuaagucguauuaugggaaauaagcagaaauuuaccuuccaggaaguaugaguucaguaguaacaaggagccagauagggaaccugaacuuguacucccgccuggcaguaacagggugucaucacuucauucucuugcuggagugaugucagagaaagccggcuaaagcagguugagguaaaauucagagucucauaacagaauacucaaaauguuugugcuucaguuaaaaaucacucacuaugccaagaaccaggaauaucucaaucuuaaugaaaauaaaagcaaucaguagaugccaauuccaagauaacagagauguuagaauagucugacagauuuuaaagcagccaugauaaaaaugcuucaucaaggaauuacaaacacccucaaaauaaauggaaaaaauagaaaaucucaguuaagaaguagaagccguaaagaagacacaaauagaaauuuaacaacugauaaauauaauaaucaaaauaaacagaagggagcuccacaacagaauggaggaaacagaggaaugaauuggugaaugugaagauaagacaauugaaacugcccaagcugaaaaacagaaaaaaauacugaagaaaaaguaaaauugaacagugccucaggggaccuaugaaucaguaacaaaagaucuaacauuggagucccagaaagaaaagaaaaagagggugagguggaaaaagugcuugaagaaauaaugguggaggcauccaaauuggaaaggaagaaauaaaauuaucucuauauacagaugacaugaucucauauggagaaagcucugaagauuacacacacacaccaaaaaauguuagaacuaauaagugaauuaagcaagguagcaggauacagaucaacacacaaaaaucaguuguauuucuaaacgcuaaaaaugaacaauucaaaaacaaaauuaagagaauaaugcuauuugcaauaacacaaaaccaaguaaguuauuaucugagaauaacugaauaaguuauucuccaugaagaaggcauaaauaaggagaaugacaucucauguucauagguucgaagacuuaguauuauuaagaugucaauauuacccaaaauaaucuucagauucaaugcaaucucuaucaaaaucccaauggcuuuuuuggggaagaaguagaaaaauacaucuugaaauauauauggaaccucaaggaaucccaaauagccaaaagcagucuugaaaaagaagaagaaauauggagaacucacaguucuugauuuuaaaauuuacgagaaagcuacaguagucaaaacagggugauacuggaauagauggacauauagaccaauggaauagaauagagagcccagaaauaaacccucgcauauaugaucaaaugauuuucaacauggaugccaagaccacucaauggaaaaaugacagucucuucaacaaauaguguuggggaagcugcauauccacaugcaaaagaauaaaguuagacccuuucuuaacaccauauaaaguaacucaaaauggaucaaagaccuaaacauaugagcaaaagcuucuacuagacucuuagaagaacacauuaaggaaaaagccucaugacauugggcauagugaugauuucuuggauauggcaccaaagcuacaggcaacaaaagaaaauauaaacaaauuggacuucaccaaaauuaaacacuuuugggcaucaaaggauaccaucaacaaaauaaaaagcaacccauagaaugggauauauacauacaagggaauauuauucagccuuaaaaaggaauaaaauugugacacaugcuacacauaaaugaaccuugaaggcauuaugcaaagugaaauaagccugacagagaagaacaaauaucauauuauuccacuuauaugagguaccuagaauagugaaauaccuagagacagaaguagaacagugguuaccagagugugaagggaggaggggaugggaagcuauuguuuaauggguacacaguuucaguacaagaugaugcaaaaguuauggcuauauggauaguaguaaugguugcacaacaaugugaauguacuuaaugcuacucaagaguuaaaaauaguuaaaaugguaacuauuaguguuuuguguacuuuaccauauuguuuuuaaaaaaagaauuaauaguggaaaacuuugcaaauuuggcaggcgacauaaaccuguagauuuaagaagcuaagcaaaccccgaacaguauaaaccgaaagcaguucacaccaagacuguggaucauacucaaacuucugaaaacuaaagacaaaaaaaaaaaaaguccuaaaagcagcaagagaaaaaugacaacuuaccuguacaggaaaaacaauuugaaugacagugauuuucucaucagaaaccacagaagccagaugaaaguagcauauuuuuuucaaguacugaaagaaaagaacuguuaacccaaagcuuggguugcccuuagaauguauguuguccagcaagaauauccuucaggaaugaagaagaaaucaagacauuuucagaugaaggaaaacuaaaagaacuuaucgcuagcagacuuacuguaaaagaauggcuaaagaaguucucuaaacagaaagaaaaugauaaaagaaagcucuuggaacaucaggaaagaagaaagaauauggucagcaaaaguguggguaaguaaaaugaucuuuccuucuccccuugaguuuucuagauuguuugauaguugaagcaaaaauuauaacacuaucugauaugauucuaaauguauguaguagaaauauuuagggcaauuguauuacaaaugggggagugggggaggguaaaauguaaagggaagguuucuacacuugaguucaauggguaaaaugaugacacuaguaaaguaugauaaguuauauacauauauaucuguauauauacauauauaauaugcauacacauguauauuauauacaaguuauauauacauauauauguguguguauauauauauaaaauauauauaaauaauaagacguggagcaaccacaaaacuauauaaaguaauacacucaaaagcacuagagaaugaaauucuaaaaaaaaguuuaacccacagaaaggcaggaaaaagaaagaaaaagagagcaaacagaaaacaaaaaauuaaauggcagauuuaagcccugauguauuaauaauaacauuguaaauuaugucaguagucuauguaaaagauguaaauugccuaaauauaccaauuaaaagacagagauuaguagaacagauuuuuaacaaaugacucaagcauauguugucuguaagaauucuuuuuaaauagaaugauacaaauagguugaaagcaaaaugauggaaaaagauacauuauaaaaacacaaucaaaagaaagcuggaguagcuauaucaauauuaaguaaaguagacuucagagcaaagaaaauguuaugagagacagagagggacauuguauaaugaaaaaaaggucagucuaccaaaaagacauaguaguacuaaauauguaugcaccaaacaacacaguugcaaaacaugagaaacaaaaacugauagaacugaaaggagaaaugagcaaauagacaagcacagcugggaacaucagaccuccucugucaacaguugguagaacaacuagacagaaacugaggagggauacaaaauaauuccauaacaccaucaaccaaugggaccugacauuuagaaaacacuucacccagcaauaacagaaugcacauuuuuaaguaacuauaauaccaaaagagaccauuuuaugccacaaaacagauaucaauaaacauaaaaagauucaaguuaauacaaaguaaauuaucugaccacaauggaauuaaauuagaaaucaguaacaauauuuggaaacaaaaccaaauccacgccuuguagcugugucuggcauggcacauuguacaacacauugggacuuggguugcccuuagaauuuauauuguccagucucauuauuuagcugaggaaacauaacuucuucagagucucucagaguucaauuaauauguacugauugauugauuaaacagugauacaacagccaugcuuuuucuggaauggcuacuaccacuggaaagcacagaccugagcucaccacaucuguaaccccuccugagggugccguggggccaccugguuccuccuuccucugggcgccccagcacuuugcaucucuguugaacacacacuguuccacugcaaugaucugguauuuacauucugucccucugacuaugccagagcuucucccagggcaagggccaaguuuuauucauuaaagcugcucagacaguauugagugaaugaauggguagauguuaucucuaaggaaauucugccucccaaaaggacauauuccuccagcggaauacacacuugaaguuauccaagauguagaguggaguggggucuccaggggugcugcugagcugagguggaucaucaaagucuuugggauucucugcuguccuugcaaagggcuuuuugugccuccagagcugcuuaauguguuguaccucuugcuucuugcauuuccuccuuugaaugccccagaccagcuuccuccucccugugccccacccucugcuuuucuuucauucugaguugggcagaauaagaaaaccugcuuuauuuuuucccgucgugauuugauuccagggguucuuaucaugcauacauuucuuuucccucugauuuuauauccauauuuaaaucauacuugggaagucacuuacuagauuccucaagcucaugguagaaacuguuugagauccuugauaagcuuaauauauucauauuaaaauuaauaggagagguauauuguuuccaacuuuaugauuugauuuaaauucauuuuauuuaauauaugaccacaauucuaaaauuacuuaaaaaaacagaugagauugaaaucaauucuggggacccuuucucuauuacugaguuaacuguaugccuguaauguggcagacaagcuaugcugcuuuucucaugugacauuucgagucuggauguggguguagcaggcacccuccuuggaggcuucaaaugagugcucugugaaagauuaugugcaggcucuuuuuaaaugcuaccauuaaaaaaaauaaaauuuaauggaaagagauaagcuuuucccaacaccagccugcuccaauuuuauauuuccuuaaucuguuuuauaugcuacugcaggaaauuaaaccagaauuguccucucugacaugcgcaugggugacagaugggagugguaggagaagggagacacagagcuacuugaaacaauugcucucguuugucagaaauuuauuguaacuuuuuugggggaugguaaugugaggggaagcccuccucaucuuccugcuguacugaagggcugugcccagggccacacagggcccucuccguacaucguugaggacugucugccccagcucacccagugcugaagggcugugcccagggccacacagggcccucuccguacauuguugaggacugucugccccagcucacccauaggcccaggugauguucaagacaaggaccagauguccucaucaccaggugugaauugcagcuuccugcugaccugugucacaccauucauccacgcacacauccgcacacacagucacuaacauauuuugcacauuacugaauccuacuucuuucuucucguuuuucucucccuuucucaucuacaucugcccaucuuucagagaaaaguauguuugcuugugaauuaaucaaaucuauauggcguuuuacuuucuagacagaugauguaguuucuuuuuuuuuuuuuucaguugcuucagauuaguucucugccccuacccauacccauuuccucucuguuucuagccacccuauggacgagauccucuaaacuuaguaucucagacucuacacacacauuccugaggguugccccuguuccccuuugcuacuggugaugcauucagcaucaaguaagagaacacagaacaugaccagcagcaucuugacaaggaaggcaccuguguccccucaggguaucucugcagccauguccaggagagccucugcuccucuccuuggucacugcagucuguucauacggggaggcugcacaaugcagucauggaauggacacacuggguugaguccugagagccgagaggucauccuuagucuaacucucaagccaggugaccucaggaagcacuuccuuccauaacaugaggguauuggacuagaugauccuucuggucuuuccucaaggaagcaggcugugagguguggaugugaagcuggaggaaggccaggaaacucccccuuccuggcuguggcucuaauuccagaauggcugaagaacuggaaguaguuaccguacugugggaugggcaggucugccccuuccaugaacaggaauauacuggaucaguggggaguagaccuuacucuuaaagcugcaaaagaggagaaagugaaacucaccacuggaacuggaagaaaagagcgaggaaggaagccuggagccuguaguauguucaaagcaugccagugaacuuauguuguugaagugacaagaagauggcuuugucauuuagccucugagucaagucagagagaagcacagaucauucuucagauggggaaccuggggaauguaaccaggagggcaaaaaagaggcuggucuggaaauucugagcaacaaggccaggcccucacccagccgagggccucugugagggcagggagggaggcgaggccgagcagguuaggucuggccuuuuucaggacggaggguuacgucccucucugcaaagaucuuuccaggcagugauucugccccauucaucuuccuuugccagaucacaagcacucuggcucuuuguugaguaaaagggaagagaacaucuaagagugcuuucaaguaagaaaauuucccaugaaggcucucugaucugagaaaccuucucuuuccgcaaucgugcugucacacaggucucugccucagaccucaagauguccagagcagcggaggauccagggcaguguggagaaaagagaauaaaacacgaggcaugugcuccaugaaugccaucaaacauuuguuuuuaaucuucugcccaggggaaucucauagagcugggcugcuugcaaggugggggcuggucccaacuccuccccugcacuccggacagcccccugccuagggauuugcuggcagaugcugugcacccacagagcagacuugcucgcaugaauaggaagucaauucccaccgccagcaucucagcuccagccaccuucugggcuuugcagcuggagugucacagggugaggggccagacugccagugcggggucacaacuggacucagagcagagcugucuuccaggcugagaggccagggucugaggcgcuggcccuuucucucucucucucuuuuucucucucucuuucucucucucucuuucucucucucucucuuucucuuucucucugucucucugucucucucucucuuucucucucuuucucucucucucagcagcaaaucuagacccccucugucugccuguuuuccuuccagccuaaagggaacauucaagaggugaaaaaagaagccagaaacagagguugaaauuacccaucccccugaaaugcuuuguuucucgaagcuucagcguuuuuccaacguagaauggaaaguuuuccugcaugcagaauugcaaaaugcaggcgucucaccacaugaccaccaaggucugaaaucucugugguuuucaagauguucaugcucaagaauuccaccccuagcaauugcucuuaaauauccaagaaaggcaaaaaaucuauucuggaaggucugcaucauauccuaauaaacaauuggaggugaucuaaauuuccaggaguagcuuaguaaauaaugguuuauaagcaugauggcauucauuauauacaacaauuaaaaugguaauucuucuggcuauaaauuaacacugaaucaugaguaguugauguuauuuguugagaguuugcucuaucaguuguuuucaaccuugagaacauguuggaaucuccuggggccuaggccucauuccuggagagcaggcuucagcuguugaugugcagggucuggcccucggugucucuuuugaagcucccugguugauccugcuguguagcuaaggcugagagccucagugccacuuccagguacuuugggugcauaacagccaccagagucauaucuuuacaagucuccugggcacauuuacaucaaaugcagugguucuggugucccucccuucuccccaguccaccccaccccaccccacccccccauuugggcagggcaggauaauauugcuuaucucuuauuuauuacaaaaauauuuucaaggauacucugguuguuuguuguuccauaaccaucccaaaacugaauggaguaaacaacggcaaaauuauugcacaaaugcugugugucaggaauuggcacacagcauaagaauggcuuucuucuuuucuacaaugucugguguuucaucugggaagacagaucuggcagucuucagcugggugcuggaaucgucugaagguuuauuuauguacaugucuggugccuugucuagaaugacuugaaagaugagcuuggcuaagacugccagccagagugccuguacacggccucccucuauguggcuugggcuuccuugcagcauggagucucuugguucugggagcaaacauacugaccaguaaacaacacagaggccuuuuugaccuagucucacaagucaguugcuuuacuucuauuauacucuauuauugaaguacucauaagcccacacagauuucagaaauauuuugaagauaagaguugacaagauuuaauaauggaccaaauaugagcagugaaggagaggacuguugaaaugccagugcuauaauaugauaugaaaaaaaaugugagaauacauguauauaauaauccuggugcauauagaugagaauugaauggagugugcaauaaagaaaaauuuuaaggugguagcagcauggucuuucauaugacucaaucauuuugguaacucuucuuaucccugugacuacccaccaaaccugugcacugacagucuuugaagaucaucgauugucacugggccccagcaugacucgaauagugagucugcuuuccaaauaccacauucagaaaucacccuuuucaugugacuuuccagcugggagaaccacagugcuguaagccuguuaaagacuguucacccuguaaaccugugggguucaccaggccccuggcaucaugggguaaagguggggaauggccugagcucaccuauuuuggggucuaaucucucuuccguccuuucucuuuaggcuuuugauauuaugagagugacacauggcagagaacacagccugauugaagauuugauucuacuuuuagaagaaugcgacgccaacaucagagcauccuaagggaacgcagucagagggaaauacggcgugugucuuuguugaaugccuuauugaggucacacacucuaugcuuuguuagcugugugaaccucuccuauuggaaauucuguuccguguuuguguagguaaauaaaggcagacaugguuugcaaaccacaagaaucauuaguuguagagaagcacgauuauaauaaauucaaaacauuugguugaggaugccaucugguaauugucuuauuugcuuacucauuggcgauuuuaauguuuaaaauaccaacauucaagacagaaaaucauauuaaaagcaugacaaauaaguuauaacuuucucuuuggauauauguagggauaauuagauaaaagucacuauuuucacauuugcuuccaagcaaaaacuuaauguccauuuuggcaagaagcagaauuuugagaugucaucuuuugcucuuugugauaaaugauguuuguguuuguuauuuacuuccaaauacuucuccaacacaagaaguuuuauccuaaaugcuaggaagaagccauuuuagauauuacuagaaaaggauaggaagucuuaaugccaaaaaccaguuuuucgaaugucucacagcucuuuguguaaaccuuucucaucagcauuuuauaacuccuuguguaugucuuuuuuuuuuccuugaaauuuuuucuguaauuagccaaaugugugguucagcaugugagugugugagugugguaugcacgguguaaagcuccauuauccugcagcaagcaagguucucgcaucccagcucaaaucagacuugcuugcuugcuuuuuccucuuuauuauuuccuaauucuuuggccuguucuucugccuuucuacuuuagacaaauacagaaaaccuuuucuuuuccacuucuaaaaaug

SEQ ID NO: 12991 - RNA, 1533 nt, Homo sapiens
aaaagauuaggcuaggcugcgcgagcauuuuuggccaugaaagcacaggaggaugcuagaaaaaacagcaccguggaaaaagcguuuccccagaagucugggagcccaccuuuggcaugaaaagcgggagcacagguuguagugagccaagaucgugccacagcacuccagccugggcaacagagcaagacuccgucuccaaaaaaaagaaaaagaaaaaaagaaaagugggagcacagaacagaaaauacagaaugcaagcugccaauuaugggagaaagauuaucacucggcccccagcuggcagggccacacgauuacgugacaagagaguccgccugcaaucgcagcaggcggcuggcagagcccggcgcgacccccagcgaagacuaccacucccaacugcgcacggggcgcgccgccggggccgccagggcggcuucacgcgcaaggcacugugggacucguagucuuucuccccaccagcuccucggaggcggagagacccgauuuuuuuguaaaugauccgcccuuccaggcccugcuucucuuuccucccuuucccucccaccuccuucuuucaccgagaguuugaaaauucccgcggagccggcgcuagagcgcggaaccaucgcgagaacucuggucccugcagccgcgaucucccgccgguucuccccucccucuccgcccuuuccucugcucccucccuuccggggcguguggaacucgguuuugucggcgcaggguaaugcgcagagcggggccggcgcuguccgaggcgagcaggcagcguugcaaggggaaggacccagaagcgcggcgggagcagcgacugcguuuuagccgcugagcggucugcaggccuacagcccgcgaaggcacucucgggggcguguggcucugagguggccggggaggucgcaggcggcggccggagcgcagaggagcggcuucagccgggcggaggggugugagcccggcccguggcggccacgucucccgggagaugcugugacggacccgcacgggaggagcucgcgccuggccuggcgacccgguggacucggcccgcggcggcgcgcucacccgccccguucagguagggggaagggagggaggggguugggcccgcgcggcggagggcgggucgcgcggccuggacccgcggcggcggcggcggcggcggcggcggcggcggggcuucugccccgcgagcgccgggccuaggccgggcgugcgcggggccaacggauggggcucgagggggcgagcgguggcgguggcggguacggcaggcucgcgggcgccgggcuucguuacauaaucucggaccggaggagcggcggcacauggcggcggagcggcgcuggugguucgcguccugcgccggcagucgggucccuuuacggacggccggggccgcgacccuuucccacuguucucccacgcgauggacucguuggcgggccuuuccccgagggaagcggccggcgugcugagccuguccuguguuggcguguguuccacaug

SEQ ID NO: 12992 - RNA, 3972 nt, Homo sapiens
aucuagauggguagauauuuauaauugcuuauuuuaccccuucaagaaauauuaagacauaauaaauuauugaauacuuuuuuuuuuuuuugagagauggagucuugcucugucacccaggauagaguacagugguaucgucacagcccacugcagccuccaacucuuacacugaagcaguccuccuacuucagccucccgaguagcugggacagcaggugcacaccaccacacccagcuuauguuuuuauuuuuuguuuuuguagagauggucucauuaguuguucaggcuggucucaaauucuuguccucaagcaauccucccaacuuggcuucccaaagcacugagauuauaggcuugacucaccacacccagacucauugaauacuuuuaauuauagaauacuuugguuauugaaaauaauccaauuauuauugaauaugugccauugaauaugaguuaacagcaaugaguaaaauagauacagucuuaaccccacagagcauggggugcaguggaaaagauucgugauaaagcaaguaguugcaguagaguguaagugcuaugauagcagaaguagagaguucuguagaagcacauagaaguauuucauccaaacuguuuuguuuuuaaugaaaaauacuugagcauguuaaaaugcugaagggaaaaaaaacccuagggaacuacauggaaaaguugucuauaugggaaauagaguaagaccgccaagaaggccagagaggacaaaauucagaagacaggugcaagaauuacuugggggcaggaggaguaaaaccucuucauuuguaacaagguaggaggaggagugauggguaugggucuagucaaguuuaaagguucagugcgagaaaguuugggagggcaacccaugcucauuacagaaaaaucagaaagucugcgugaacaggacaaaagaaaaauaccucuaguucuacccauccagacuuuuuuuucccccacccuccauccugggaugaacgacuuaacuauuuuuuguuguuauuguuguuguuuuuugucuuuccagcuuuucaacugcagaucuugggaauuaacuauuuuuaauauuuuguuucuucugaaaaauauggucuuaggugggcacaguggcuuacaccuguaaucccagcacuucaggaggcugaggcaggaggaucgcuugaggccagaaguucgaggccaacuugggcaacauagcgagaaccugucucuauaaaaaauuuucuuuaauuagccagguguagugguugcaugccuguugucccaacuacccaagaggcugagguaggaggaucacuugagcuaugaucaugccauugcacuccagccuaggcaauacagugagaccuuaucucuaaaaacacaaacccacacacacucucauacucaucaguggaauaaaugcugucuuguaacugaaucagauaauaauuaugauuauucuaauguagagucagaguuggaaugucugacuuuuuuguguagcucuuucaauaauucccuuuguaaccuuaguuuaaguaaaccauugaaucuuucuuugcuugugucaccauuuguugauauucauucuuucaacaaguguauauugagcaucuacccuauucauguaacugugcuacagugcuuuauuauacauucuuaacagggacuagaacacuuaccugaagauuucucugcuuucuaaguuugauucacugucaauaacuuaacuacuuuuaggaaucaaauaguucaaauauaaugaaauuccuuuauagaacucauguugggcaaagaaauaguauaccccugguguuuacagaauccgucuauauuauaacggcuauauaaucugaaucaugguauaccaguuccucauuuacgauauauguucuguuugcuucaaaaauguuuugauuuggcuacuauaugauagccccauaggauuugggugggauuccacucuacaguuauuuaguguagaccuuucaaaauauuugggguuuaauaguuaaaaguaauccgcaagcugcccccccuucccuucucccagguuacaaugcaccauaucucucgguguacagugaaaaugcaguugauaucuuugaugugaacuccauggaauggauucagacucuuccucucaaaaagguaauuuaacauuaaaaugugggcuaagccaacugaguauaagugaaaacacuaaauuacuacauaguaauuuuuuuuuuauuaauucaacauuuucuggaauguguaauuggcaguuugggacuuagcuaagagugagaaaauagaaacagaaauaaaguugguuaauuuccuuaugccucacuaaaaccauacuaauuuuacuauauuugguuuaugcaaaguaugauuguuauuauuaugaacaacuagaauauauccuacaacuuaaaaugucaguguuaucuucuacuuuuggauuaaggagcucugagagaguacaugauuauuaugaauuauaacugucauucacccaguguuuaauccugugaggacagauuuaaaaggcuagaaaaguaauuaaacuuagaaccaaaacuguuuaaguguccauaauugaaaaauaaauauuucauauauuccuaauaaaacauaauauuuuucuuaauauauaauccuguuuccauaacaaagagaauuuuuacaauuauagaacugcuaguuugcaaaaaugaagagcaauaguuucauauagauagaugugauauauauauagcauguaugauuaguugggggacaggguuuagagaauaugugaaaguagcuuagaucauauuucaaaauuagcacccauuuaaaaucauaauagcaguuuaaaaagcucuuguaaauacugccagauuaucuaaagcaacuaaaauauacucuaguuuguaaauuuggauuggucauuauuacuuuucuguggauuuuuuuguuuuguuuuuguuuuugagacagggucucgcucugucauccaaccuggagugcagugacaugauaucagcucacugcagccuccaucuccuggguucaagcaauucucccaccucugccuccagaguagcugggacuacagguguacaccaccaugcccugcuaauuuuuguguuuuuaguagagacaggguuucaccauguuggccaggcuggccucgaacuucuuaccucaagugaucugcccgccucggccucccacggugcuggaauuacaggcaugauccacugcacucagcccuauuugauuuuuaucauguaauuuuugcaauguaugugaaagaauagauauauggccuuugugaaagauaauaauaaacugaucacucaugaaccuaccuccuaaccugagaaucagaacaucacucauauaacugcaaacugcgucauguugugcuuaucauuccuuugcuuuucuuaaaauacagaauuuuugcauauuuaaguaucccuaaauaauauaucuuucaguuuugcuugguuuugagcuuuaugaaaauguuauaauauauagucauuuucuaucuugcuuucuuuacucauccacugagucucauucguucauguuguuauauauaccauauaguuuauugcuuucaguacuauaaaauauucuguugggugaacuuagcacuacugucuguucccugacugggggacauugaauuauuuacuagcuuuuugcaauugugauguugcugcaucuguuuuuuggaauaguuuucaggaguuugagucauauaccuaggagcagaauugaugggacauagggaguucagucagcuuuaugagauagugucauauuauuuuccaaaguaauuguaccaaccaauacucccaucaacagcauaaaggaauucuuaucaacauccuaguacuuuccauugucaggauucauagguuuuguaaaugguuacaaaguaguauuucauugaaguuucaguuugcauguugcuaauu

SEQ ID NO: 12993 - RNA, 2088 nt, Homo sapiens
gcccuguucuaucucuggggcaaacccaguuuacaaaucuuccuuggaucugggccuuguuuaguaacaauuuccauccagcaggcaggggggccugugggacccuggcuagcaaguuugccucagcugagaugcugggagcagaauccucacccaggugccuggcacuggcucuagcucugggcacugaggagcuagggaggcgagaggcugcaggaggauucaggcccaguugcaccccugacagccagguauaacccagguagucuacuuagguauuuuucaguuauccaaacacgcuucuauccacaaggacucacuuugacguucacagugcugggagauggcgaagacauagucauaccccuguuccagaugagcacaugguggagagaggauuuuaaagccauuuacucaaggucaggcucagaccagaguggcagugugaaaacauacccugggaguccagcugcaccaagugccuugaggcacacacucaccugcucccccagcucuacuuucucuccucuacccuccccuucucugaagucuugguuuuuccagcaggucuagccuggugcaccuccccugggcuggaggggggccucagugcacagcuggagacccuggacccaggcccggcuccuccucacugcuccuuggaccguggcccucacacagccucccacagagucccaaaaggccaggggcccuucgacaccuccagagugggcacaaccggccugcccccgaccaugggaccggggccagcagggagggagggucucaccucggaagcucuggcugaaccucuuuccgcgggagcgguccccguggcugcgccgcagcaggacuacauacugggcccucacgugggcggggaugaccagcuucuccaugucggcccuguccaguacgggcaccucgcugagcugcagcugccgcagcaggcugcccaggagcugcuccucggucagggccgccccggggccagccaggggcagcacccagagugcccagcagagccacaggggccacauggugcugcccugggggagcaggaggcagaguggggcuguccucuagggagguugaaggagggucucaggcagcugggugugcugagagccaggcugggccagcuuuauagcuggcccugggcuggccuggggugaagggaagagggagggagggagggagggaggucacaccccugggaccuccugggagcucacagccagacaggucccugagccuggaggagggggcugucuagaaaggacagggcugucuggaugccacccaggccuggggccucuggcugugcugucagcagcuugacaauauuuuuagugccuguugaauuuuccuggccuuaccccagcccuguucuaugaaaaagugagucuauucugugaaaaacaaaguccugcuagccagcugcuuaaaucucuuuaagucucuucuggaggcugggcuggguccaggucugcaaaucauaaaggaagggcgggaaggauucugccuuccugcugguucuggccacauucacagaagccccuuggucaucucccuccaaccuacacuccuugcacacccccugccucuccccacaccaggggucccucaggguugucgcaccguccuugcccuccccccaugacauccucugucuagacacggucaggacacaaaucuggcagcucuacugucuuuaggagucccaggaacagcaauuucagcaagugccuuugcagucacgugaccacagcacaggaguccucccuucagacagcagaauuauucuggggugugcucuccccagugagcuggcuggccgguucaugccaccagcacucagcuggagcccaggucauuuccagacacagacaagggacagggacuuagaaagcagaggccagagcugcccaaaggcauggccuguccaaagccacagguacugggggcagauugaggugggagccccccugugucucuucaaacacacauuuuagacuggccacguucaaauaugagaacugccaucugcuaacuguuugaccugcuagcaagugaguuaacuucuca

SEQ ID NO: 12994 - RNA, 4400 nt, Homo sapiens
cuuagcauuaaauaacacucuuuaaaugguacaccuaugaagcaagaguuaaauauaaacccagucuaauccuguacacuugugauuaauugugacaaucuuaaguugcucacuucuuucccauuuaccaauucagagaaagcccguuuccuguuuucuccucaccacuuugccuuggcaucacaccaacccugccucgggcuucagcugcagauccuccccagccccuccucccagcugggcugacuccagucccagccccagucuccaccaacugagcagcguacgcaggguugugucuggcuuccagcaucuaccaccccuucagagcaacuuccaacaugggacaggagaggaagcucgcauugcuuggucugaacagauuuaaggagguuuuaucacaaggaccugaaaacuuccuaagcaugcuuucuccuugcacagcugaggaggggcaauggugggagcggggcagggggguggcaggggcggcaggggcucucaacuaagggcucugaaucacagaggggacagaugcugccuuaguccuucuugccucccagggccaggcuucuugugaggagcuucccugggcuggagggggucaguguggagacugugggggauuccagcuucacucugucuaagagggucuucuuaagggcagcuggggagaucuuuucuuggucggccauggacuguagcucucugcagacaaaaccccagaaggauuaaaggaaggcaauaaacccuggggccagagcuuugagucuccacuauccacacaacccucaagcuuguugaugugacaccaccaaaaauuagagccccaagacaaacgcuucccaacuaguacuucccaacuaguacuucuaagaaguauuaguuaccuaaguuaggguuugcuuauuuaucucauuugaucagagccccaagugguaucugugaucacacgggaagagugacaggcuuuggagucauagauucaaauuagaauccugucuccaucacuuuuuaacuguuugaccuugggaaaauuaucucugagccucaacuucccaucuacaagucaaaguuaauccugguuaucugaaaugcagugagaauuaagugaaguaaggcuugcaaacucuuagguaaacaaaaucuacuaaguugugguuauuaacagagcacagacuccaacacugcuaaaugggacccaagacagcagguuccgcaaauggugcucaacccagcccagggaccaaccaggacugaagggucugggacagaaguccgcgggauggacucaccguguucggauacaggaggccucaacugcauugaugagcagagagcggaagcccccacucucuagaaagugcagggcguggaugguggcucccccaggggagcagacauuguccuuaagcuggcauggaugcugcuccgaguccagcagcaucuuggcagcucccuauggggaagggcacauuaggagaaaguugcuggugugcguuggaacaggcuucccauacccacugcuccugcccaacugcuaccccagcuucccaaccaacucccaccucaguucagugaugcacaagaacccccauucuacacccugguccugaacaugcgggggaaagauacugaccagcaaagccugggccccgaguuggauugccaggcgccguggcaaacccaucuucaccccaccaucagccaaugcguccagagccaugaaugccuguggagacacucacuaagccccaggccauaggcacugaagggccuuuccuuaggucugcuuucugaugacuagaacuagcuccaagggucagcauccuguaccagccagcugugcccaagaggugggcgccacccccaguccaagccugccugccagcccaucuugcugccuggguuccuagaaggcugagcgagcaaaugagggccucacauaggcaggcccgcugccacugagccccgugacggcaucgaugagguccucuuccaccucagugcagaagcccacgcugcucaugagcugcuccaggagcugcccauccuccaccagggcaugggugcccguggcguacacuguagcgccuuccugcacuaccacagguguguuggucaugcagcgaaucacuuugggggcuggcuggaaugccaucagcuucuagggugagggagagagccgaaugaguggccagggcacggcucccaccagcacccacccauuagcugccauucgugggucaacccuccccucacacaaggggcaucagggcugagaugggcaccuucuccacagagcugauggugacaccagccgcacaggagaccacgaugugucuggcuugcacgucggccccaaucucauccaggaugaaggggaugauauguggcuucacagccagaaacaggacgucgcugugcuucaccgucuccuuguugcugcgugucagguucacacccaucuucugcaagaggagacucccagcucacagugcuggagcagccuggcuaugccaaggccucccagggagcagcugaaccccugccaaaccgauucugccagaugcagccuggaauucuuagcuuuaugcccucaggguucuaccccuaccccaaauaauacaguuucccauuguugcuacuggacaaguaagcacaggcuuggagcaugacaagcuucuccaugguaaccaggaaguggcugcccuucuucccugccaaucuucugguaucuaaggcacuccucugccagguaagaaggcccuauggugaaaguggcagggcaaagggaaaugcuaauaccuggucguuaaaagcacagcugagucaggcccuauccuaacccuggccgcuuguucguggggaccgcacagucuccaugugguccagggcuaggcuggaagccauccaucccucuaugacuccaaacugagaagcaggacccuccagugcuagggacaucagcccacccuaggcacagacacugccugucaccugccucaucagccauccucucccacagagcacagguuuugggugaagacuuggaauauguuuuuggagaacagaacaacuaacucaccagauucuucccaauaugcucauucacgacucagaauaacagcaaaguggccacuguuguaaaugaggaaauagccucaaaguggcugaguacuuuaaggucauacaacucgucuauuaagaaaaauggcugagcgcaguggcucaccccuguaaucccagcacuuugggaggccaaggcgggcagaucacuugaggccaggaguucgagaccagccuggccaacaguauucucuaccaaaaauacaaaaauuagcugcgcgugguggaugccuguaauuccagcuacucgggaggcugaggugggaggcugaggugggaggcggagguuacagugagcugagaucgcgccacugcacuccagcuugggcgacagaguaagacccugucugaaaaaaaauuuaaaaaaugaguauuuauuagguaccuacuaugugccaggugcuuucaucacauaaucaccucaguuaauccucuaccacuccagugucuggaucugacccccaguuaugucucccuggguguucccaccacauugagcugcccaagagaagguggaaagauugucacguuccuggaguaaaggucaccgccggccaaagaccagcacuugggcgcaggggccggccagacucacuucaucucaggucauccuuuuccugggccuccacccgcuucccacuccgcccggcuccaccuacccugagcgcggacaccgugggcagguucauuucuggggagcuggcuauuaucuugugagccgacaggaugccugcagaagacagagcuuuucaacuaggggucgcggcccagcccguuaccacgcuuucccuggcucuaaaacccagagccguccuaacagugccagucucccucucccccucaacccucuacgaggacagaagacgcacuugcugcucaaccagagucucaucuaccccaccggacgcaaacuccccuuucauucgcucaugcuggugggacggaggcccccucgggccucgggaccgcccgcgaagccgccucccgccuccacgcgcuugccugcggccgugaagccccgcgccagagcauaggccagcuggccggccccgaugaagcccacgcucaugguccgcgguucacgccuccugggagccgcacgaacccccucagcgagggaccggaaguaacgcuaggggaagggcggacagcgcaggggcgaacgggcggcgugccgaggaccggcgagcuaacagcagcuucugggauggugcaacccuauucucccccggcggauaucucccgggcggcugauggcgccuuaggccacg

SEQ ID NO: 12995 - RNA, 2884 nt, Homo sapiens
aggcuuggcucucagcacauccagcugccugagacccuccugcagccuucucaagggacagccccacucugccucuugcuccuccagggcagcaccaugcagccccuguggcucugcugggcacucuggguguugccccuggccagccccggggccgcccugaccggggagcagcuccugggcagccugcugcggcagcugcagcucaaagaggugcccacccuggacagggccgacauggaggagcuggucauccccacccacgugagggcccaguacguggcccugcugcagcgcagccacggggaccgcucccgcggaaagagguucagccagagcuuccgaggugaggcccucccucccugcugccccuggucccauggggcaggucagaugugcccacuccgguggugucaaagggcuccuggccuugcagaggucugugggaggcugagugagggccacggucuaaggggcagugagguggggccgggccugugaggauggcggggccucagcaugcagcggugcaugcagucaggacuccgggggucuguuuucguacugccacucuggucugaguucuacuuggagcauauugcuuuaaaaucaucucacaaccauuugcucacauggaacugggguauaacuaugucuugcccaucuuccagcauugugaacaucaaaaugagucauuguaaauagaagcguguuuggguaacugaaaaauacugcacuugaguagacaaccuggguuauaccuggcugucaggggugcagcgggccugaauccuccugcagccggccugaauccuccugcagccucucgccucccuagcuccucagugcccagagcuagacccaaugccaggcaccugggugaggauucugcucccagcaucucagcugaggcaaacuugcuagccagggucccacaggcgccccugccugcuggauggaaauuguuacuaaacaaggcccagauccaaggaagauuuguaaacuggguuugccccagaaauagaacagggccggugucuccuggccuggcugccagcucaguggcccugccauccucagagcuccccuggagucgggggaggcccugcugacccugcucuuguccccagagguggccggcagguuccuggcguuggaggccagcacacaccugcugguguucggcauggagcagcggcugccgcccaacagcgagcuggugcaggccgugcugcggcucuuccaggagccgguccccaaggccgcgcugcacaggcacgggcggcuguccccgcgcagcgcccgggcccgggugaccgucgaguggcugcgcguccgcgacgacggcuccaaccgcaccucccucaucgacuccaggugggggucgcgggggcgcgcaggguagggggagggcgcugcuaggcccggcuugggggcggggacgcgggggggcggugcgggguccucggggcccgucccaguccccgcccucaagcggcgcugggucucugugucaugucucaggcugguguccguccacgagagcggcuggaaggccuucgacgugaccgaggccgugaacuucuggcagcagcugagccggccccggcagccgcugcugcuacaggugucggugcagagggagcaucugggcccgcuggcguccggcgcccacaagcugguccgcuuugccucgcagggggcgccagccgggcuuggggagccccagcuggagcugcacacccuggaccuuggggacuauggguaggugcugagggucaaacugguaagccggaauaaagagacaggcaauuacauuuauuuugaaauggacaacuuuucagagugcugugggaaugaaugagacaauguauacaauucuuccucugacucuuaggagauccucaguaaauaucgguuauuaauuuucaaguuauuucuagcuguccauccuauaucacaaacauccagcuuuuugaaguugagagguggaucauaaaucuccaucccagacgcccucugaccucagcccucccagcugaccgcugacccugcucucuuugcccacacagagcucagggcgacugugacccugaagcaccaaugaccgagggcacccgcugcugccgccaggagauguacauugaccugcaggggaugaagugggccgagaacugggugcuggagcccccgggcuuccuggcuuaugagugugugggcaccugccggcagcccccggaggcccuggccuucaaguggccguuucuggggccucgacagugcaucgccucggagacugacucgcugcccaugaucgucagcaucaaggagggaggcaggaccaggccccagguggucagccugcccaacaugagggugcagaagugcagcugugccucggauggugcgcucgugccaaggaggcuccagccauaggcgccuaguguagccaucgagggacuugacuuguguguguuucugaaguguucgaggguaccaggagagcuggcgaugacugaacugcugauggacaaaugcucugugcucucuagugagcccugaauuugcuuccucugacaaguuaccucaccuaauuuuugcuucucaggaaugagaaucuuuggccacuggagagcccuugcucaguuuucucuauucuuauuauucacugcacuauauucuaagcacuuacauguggagauacuguaaccugagggcagaaagcccaaugugucauuguuuacuuguccugucacuggaucugggcuaaaguccuccaccaccacucuggaccuaagaccugggguuaaguguggguugugcauccccaauccagauaauaaagacuuuguaaaacaugaauaaaacacauuuuauucuauaa

SEQ ID NO: 12996 - RNA, 2884 nt, Homo sapiens
uuauagaauaaaauguguuuuauucauguuuuacaaagucuuuauuaucuggauuggggaugcacaacccacacuuaaccccaggucuuagguccagaguggugguggaggacuuuagcccagauccagugacaggacaaguaaacaaugacacauugggcuuucugcccucagguuacaguaucuccacauguaagugcuuagaauauagugcagugaauaauaagaauagagaaaacugagcaagggcucuccaguggccaaagauucucauuccugagaagcaaaaauuaggugagguaacuugucagaggaagcaaauucagggcucacuagagagcacagagcauuuguccaucagcaguucagucaucgccagcucuccugguacccucgaacacuucagaaacacacacaagucaagucccucgauggcuacacuaggcgccuauggcuggagccuccuuggcacgagcgcaccauccgaggcacagcugcacuucugcacccucauguugggcaggcugaccaccuggggccugguccugccucccuccuugaugcugacgaucaugggcagcgagucagucuccgaggcgaugcacugucgaggccccagaaacggccacuugaaggccagggccuccgggggcugccggcaggugcccacacacucauaagccaggaagcccgggggcuccagcacccaguucucggcccacuucauccccugcaggucaauguacaucuccuggcggcagcagcgggugcccucggucauuggugcuucagggucacagucgcccugagcucugugugggcaaagagagcagggucagcggucagcugggagggcugaggucagagggcgucugggauggagauuuaugauccaccucucaacuucaaaaagcuggauguuugugauauaggauggacagcuagaaauaacuugaaaauuaauaaccgauauuuacugaggaucuccuaagagucagaggaagaauuguauacauugucucauucauucccacagcacucugaaaaguuguccauuucaaaauaaauguaauugccugucucuuuauuccggcuuaccaguuugacccucagcaccuacccauaguccccaagguccagggugugcagcuccagcuggggcuccccaagcccggcuggcgcccccugcgaggcaaagcggaccagcuugugggcgccggacgccagcgggcccagaugcucccucugcaccgacaccuguagcagcagcggcugccggggccggcucagcugcugccagaaguucacggccucggucacgucgaaggccuuccagccgcucucguggacggacaccagccugagacaugacacagagacccagcgccgcuugagggcggggacugggacgggccccgaggaccccgcaccgcccccccgcguccccgcccccaagccgggccuagcagcgcccucccccuacccugcgcgcccccgcgacccccaccuggagucgaugagggaggugcgguuggagccgucgucgcggacgcgcagccacucgacggucacccgggcccgggcgcugcgcggggacagccgcccgugccugugcagcgcggccuuggggaccggcuccuggaagagccgcagcacggccugcaccagcucgcuguugggcggcagccgcugcuccaugccgaacaccagcaggugugugcuggccuccaacgccaggaaccugccggccaccucuggggacaagagcagggucagcagggccucccccgacuccaggggagcucugaggauggcagggccacugagcuggcagccaggccaggagacaccggcccuguucuauuucuggggcaaacccaguuuacaaaucuuccuuggaucugggccuuguuuaguaacaauuuccauccagcaggcaggggcgccugugggacccuggcuagcaaguuugccucagcugagaugcugggagcagaauccucacccaggugccuggcauugggucuagcucugggcacugaggagcuagggaggcgagaggcugcaggaggauucaggccggcugcaggaggauucaggcccgcugcaccccugacagccagguauaacccagguugucuacucaagugcaguauuuuucaguuacccaaacacgcuucuauuuacaaugacucauuuugauguucacaaugcuggaagaugggcaagacauaguuauaccccaguuccaugugagcaaaugguugugagaugauuuuaaagcaauaugcuccaaguagaacucagaccagaguggcaguacgaaaacagacccccggaguccugacugcaugcaccgcugcaugcugaggccccgccauccucacaggcccggccccaccucacugccccuuagaccguggcccucacucagccucccacagaccucugcaaggccaggagcccuuugacaccaccggagugggcacaucugaccugccccaugggaccaggggcagcagggagggagggccucaccucggaagcucuggcugaaccucuuuccgcgggagcgguccccguggcugcgcugcagcagggccacguacugggcccucacguggguggggaugaccagcuccuccaugucggcccuguccagggugggcaccucuuugagcugcagcugccgcagcaggcugcccaggagcugcuccccggucagggcggccccggggcuggccaggggcaacacccagagugcccagcagagccacaggggcugcauggugcugcccuggaggagcaagaggcagaguggggcugucccuugagaaggcugcaggagggucucaggcagcuggaugugcugagagccaagccu

SEQ ID NO: 12997 - RNA, 36215 nt, Homo sapiens
cgccgagggccaccgcgggaggcgcagucagcugcguacaggcuugcgccgccgcgggccaagacuccaaauugggaaagggguggccgcagcucugcgcaugugcaggaggcgccggaguuucacuuuguaacuuuuaaguggucggaacacgccccgcgcugcugggucccgccagacacgccgccgccgcagguacaggggacagggggcgugaggaggggcaaugcacccuccgccuuucccgggacgugcgcgccagguguccgguuccggaacggcucccagccuacgcagaccccagagcccccgaccccaagcagggggugacgacgcgggauugggugggaggagaggguccgggcagcgccuccauuccagcccugcgcuccuugggaauuccuggcggcuuuucaggacuuuccucuccggcuuuucgcuuucagggcugguaucuccuucuuccccaccccucucuuugggauuugucggcggaguccgaccucccaccuaacuaggagugcagcuaugggcuccucggacccuauacgaggccgggcugggaaagggccaagcguccgacucuccugacgccaggaaggcagaggccaccccucgggcuguuccugggugaccacuuccugcagccuuggcggaguccugaggagggaggcuggggacucggggacuggggggaagggcgggggcggaaagggugaggcgagcucugcuaagaaaccaaauccgcaaagguuccagcaccugauaagacuagcuaccugaggcccuggaggggccuuggucauucagccccaggcaggugguguccucuucaagggcagggguggacagcguggcggacccacugacccucccuugacaccucucaggucauccucaagucugcugugccuucaagggggauaugaacggaagccgaggcuccuuuucccuucacacgccccucuccuuuguuuagugugggggcaaaggucucuccuagcuguucguugggcucuaacagagaagacgucaggugggauccugcccuuguguuucccauuagcuggaggggcgacuuaaaauaaaggcagacagcuucuaauugcuugcuagggccggguccugggcuaagugcuuuacagguguuguuugggaucugugccucccaacagcuccgugagagaaagucaucacucgcauuuccuggcgaaggaagccaaggcacagagugguuaggcugcuugucugaacugcguggugcugagacccuaacuccagagccugcucacauaaucccugagccacacugccucugguuucagccaggggcugugucauuuccuuugugcuccaggguaggagguaaacaguuguccagguuacuggguccuguuugguguugccauaaggagaaguuuguacuuuacuuugcaaccuuauucugcaucugaaagaccagaguuagcuccugaggcagaaggccuggagcugcuuguaguuucgcuauugucaucacaggauugaaagauuuggugaugauaaaauuacccugaauuuguacgggccuucuugcaagaacgaacaauauccauauacuuccugcaacauucugcugguauuucuagagcuugucaaguugaccaccaggccaguccuugcugccaauggagacuggcaguggauuagcauagguaguuuacuuuggcaaauuuagaccagcuguuggauuuagcccucucccacuggccacaaucagacgcuugccugcacauggguugaacuuuggguugggagcgugaagucaccugcugcccacucuggcucuugggccucagcaguaauucuuggcuuuccuacccucggcauauugaguaggaauaaggggaugaauggagaauuucuggaaggcacagguaagugcuaggcauucacauacaucuaggaugacugaauauugccagggguucucagccaggcagugccacuucaaccacagugccuagcugcugguuuggccuccucuauacagcugccagcugggugcuccccucccccugccuucuccucagccuggcagcacugucccauggugucuguguucccagcugccugcucagagcgugccuguuugugaaaaugcagaggagcugucccauggagagccagagggacggagcuguuucagggggaucuggacuuuaugugucuaaugggcagggacaggcugggacugagcugaaaggucugagagagauuguggguccccagagcucuacccuaaccugggugcucaucggagagggcagacaggacuggccaccugaccuuaccuccgucucaggcugauaguauuugcuagccaccucccugaguucauaucaaacuuugucaaaccacccugggaagccuauuuggcaagagacaaguaacuuagaggcaugacuggggcuggagggagggggaagaggagccgcagguguuucccuccgcagaggccucucuccucugcagcacuggcgaggguaugccacucccagcaccaccacagcacccuccccuuuccagggacaaugcucucucugugagcauuuuauggggauguuuuuucuuuccacuucacauuucaagccuuccuuguucaugcugcuguguucccuuuuccugauucuagcucuuggggaacccuggggagccuccccaguagcauuggcccuuggggcccaggugaaguccuuugcuuggggcccuaccgugagcccacaaccuccaggguuucugugggagagggcugcuccccuagacccagcaggucccugagccauuggcaaagaggagagaggcuggggccacagguggugcuggccgaggaaggaggaguagggucgcacagaggagcacugauggauggagaaccaguucugggaguuuggggagagaucaaggcaggagggagcccacugggcagaaccuaaagguccauaugggcagcaugcauacacaggugugugcuggaggguuuccauccagaccccuacacuggaaaaggguggcucccaugugaugcuuggugucugugauccuucaggaaagucuacaguuugguaccccaggacucgcuggucaggaaagcccugcaggacaugaguguuaggcccgacgccuggcccuuggcagcuugggagguggcuggggcugcuuuugccuuugccagagacagcuccaacugaggaccucuccaacgggcccauccacaguccuuccuuccccuagugucugguaaguguggggacaggaaggaggagggguaggugguggccuugaaguguugggcugguguguuccauuggguggugccacugggggauuuuaaagggaagccaagaacaucuguguuccagaggucacucuugugacacucuguucagagucagcagccccaugacucuggcaucacaacccccacuaccuccagccauugccaagucucuuagaagguugagaaagucacuuggcugucugugggaugcucccauguucuugggcuuuccacucauucaugcuuccugugcuucguguguguguguguguguguguguguguguguguguguagguagguagguagguagguagguguccaugugugauuguccccagcacucuaggccuagggguuacccaacauacacaccucaccagcacuacugguauccaaacaucuguuuggguucucuauaucuuuucuucuuguucucaagaucuuugucccuguaacagcuagaagcaccagacuuagcagaaaaauccccugggaauucuagauuuaccagauuugggcagguaggaucuuaagcaaguccaggcugaauauguguucuggcccuucagccacagcaugagaacuuggacacuaacucccgguccucuggugucaggggacagacacuggagauuucuauuagcuucaccaggggcgccaggagccucaggaaggaaaggucaacaacccagccuggagcaguguuugcuuuggaaaugcugggccuugcaguuagacugaugguacccaggagggguaugugugugugaaagcgcagagcuaggggacccagaggucccugaggaggcccugggacuccugacucccuccccgucccuacccuagaccacccccuuuacuuucuccucuguggcaaaguaaaaagagaaguggcaucugagagucaggauauuggguuugggauucaauucugcccugaccagcuccuuaaccuuaacuuuggggcaaguuauuaaaccucugaggcuugguuuccaaguauagcagauggacccaucucugaggucccagcucugacauucugugagcagugggagugagguguugucuguggcucguggauggaccaucgugaauacuuggauguucccuucuucccugguuguuuaucccgguguuuuccucuuccugccuuugugugccuuucucccucuccucugccuguacucuagauccgccaguggcuucugcaggagugacuuucccaacacgaguccucgaggcuagaggaacuuuaggacuucuuaagacagcagcugcagcaacucugucccuccuuugcuccaugucgcccccucuggggaucugcccacuguguccuggaugagccauccacucugaccaucugauccccugagauugucccacaaugcagccauucucuguggacacugccaggcacgcagagguccaaugucuggcucucccggacuccuugcugcuggcucacugcccgaucagucccugggaaacgccugccuuuggcucugccagcacuggugggaaccugcaagaaauuugagcccugaacgucugccuuguccuguuguccugugcuccagggaagacaggcgcgaugauggacuccccguuccuggagcuguggcaguccaaggcaguguccaucagggagcagcugggacucggggaccggcccaacgacuccuauugcuacaacucggccaaaaacagcaccgugcuccagggggucaccuuugguggcauccccacuguccugcucauagacgucagcugcuuccuggugagagcccucaugagucgugucccacugccucaguuauuuguuuaaaugccccacccagggccuucugggaaacuuagaugagaagucagacauagcuggguuuaaaucucaacucugcugcuuaccagcucugugacuuaggcguguuacuuagcuucugugcaccuccccuuucugcuccggaaauggagaucauaauuccuaucucagagaauuuuggaauuuggauaaggccagaauacucauauagcuaugccugugauuacuaccgugauugcagagcucucagccugucguaucuuuaaggcccuugggaagggucaucucaagggguugagacaugugacuggagaguacggacuagaauagagcagcugcaguucccaagugucaccuccuguuccccucuggcaucccugggguuuuuaaagaaucagaagcugggccagguacgguggcucaugccuguaaucucagcacuuugggaggcugaggcgaguagauugccugaggucaggaguucgagaccagccuggcuaacauggugaaacccugucucuacuaaaaauacaaaaaauuagccgggugugguggucggcgccuguaaucccggcuacucuggaggccgaggcaggagaauugcuugaaccugggaggcagaguugcaaugagccgagaucacgccacugcacuccagccugugcaacaagagcgagacgcugucucaaaaaaaaccaaaaaaacaaaaaaaagaauuagaagcugauucuuagagcguaccuucagcagguggccuuucuuuaacguagaucuccuuguucacaaagaugccccauggcauuguucuuccuuaugcagacucaacguuggcuggcugagauuuauugggguuaaagugccccuucuuuucacaaaugccaugggcuggccagugccucuugauacugucuccuaacauguggcagagaccaucugagugaagggggcagauggcucugauggaguaaacauccuuggacugcuuggagcuggagacuaggcucggguggggaacauggggaggguggcuuaggguagcaaggaggagugggcagggguguggggguggauuucagaauuggugggauuagaggaggguggccuugggucuucaggguggggagaguuuggccaaggugaggaguacagagagggggaccugggcagggacccuagcugggcuggguggguauuguugcaacaguguuggcugagaagagagucacccucuauugugcugcugaaggugaauuuuuuuuuuuuuuuuuuuuuuuuuuuuuuuuuuuuuugagacaaggucucacugucacccaggcugaaguacaguggcauaaucacaauucacugcgacuuccuccuccugggcucaagcaauccucccaccucagccuccugcauagcugggacuacaagcacaugccaccgugucuggguuauuuuuguauuuuugguagagaugggauuucacaccauguugccuaggcuggucucaaacuccugagcucaagcgauucaccagccuuggccucccaaagugcugggauuacaggagugagccauggugcccggccagggguggauuuuuauugcaguaaguuuugggggugggggaggggggacacauaagagccagagggcccuggagagcauggguuugugggaagugucugcacugcacaggccagggcggcagccgcuguggacagagagggcaggcaccugcugagcagguuucgugguuuuccuacaacaugacucaccugccuuugaaaauaugucaccaacuuccugauucaccugaagaaaauuccacgagaacucagugccucugggguucaggucuucuggauuuccuuuaggaaaacaaagccuaccuucaaaacccccguuucugaucagagcaggcagggaugugcuuacuaagauguauuucucuaccucccugaaccucaaagagagggacccugucuagggagggaagagaggcaggaacauggcauggagccugccaagguggacuguggggagugaggacagucuagaguguacagaugucuagagcuaagcggcuuaguccagcccugagguugccauuggacacaagcuugcugaggugucccagcuuacggaggccaagccagcccgagcacagguucucguggugccuugcugccugcaugcaugcucucugcugggggauugcagggccugcggggccugccuucaggggaaucaaacucagaggaaaaaacugaccguuucuggcucagccugaggaggcucugcuaccuugguucuguaauuuaaaaugaaauuuucuggccagcaugguggcucacgccuguaaucccagcacuuugggaggcugaggcagguggaucaccugaggucaggaguucgagaccagccugaccaauauggugaaacccugucucuacuaaaauacaaaaauuagcugggugugguggcgggcaccuguagucccagcuacucuggaggcugaggcacaagaauugcuugaacccgggaggggaaguugcagugagccgaaagaaaaaaauuuucuguaaagugaagaaggaugcugguuccuggggcugcucuggggccagaccuuacccuccugcucggggccacugaaggcagagcagggcccgagacugggccuugugguguuaccgcugccuugagagcaagagacagggcugacgugcagaacuaggcaggcuccaggcaagcuuggcgucagcgcuggcagccuugguggcgugggcacaggugacaggagccuggugaagggggugagcaaagcauccgggcuacugagcugcauggccuugggcacuucagugcccucucugggccuggguguuuuccuucuagcccugcugagugcgggcaggugggcuuuaccccugagaccgcugugucuucuaaugagaagccauccaauaugcuuuuacuugguuucuuuucuguuuuuaguucuuaaucuugguguuuucuauuauaagaagaagauucugggacuauggccgcauugcccuggugucagaagcagacagguaaagacauaucgccuaggcugugagcaugcgugugcguacgugugaguguguauaugugcgugaguguguauaugugcgugugugcauauauguguguauagugugugugugugugucccuggaaugggcuaggggcuuaugaagcccuccaugugggcaggacccacacaugacacugcuaugagauuguguucauuaaguguaucuaccuggccuguaccaauagcuguucucuuugcucuucaccacagacccaugaggucagccucgcuacccucauugugcucacaaaacaaaaaacaaaaacaaaaacccaggcucagaugcucagcucccucagggcuucuguugggccaaggcuaugaaccuuguuggcuucagacugguugcuuuagauacugagggcuuucgucauccucugaagaggaugcccauuuucuuucucaccuugaguauuuuuaagugaucaucuuugaaauuaauuagcuuggggccagggcugagugaggaucaagggcagcagagccaucagggaacugccccacccuccugccaggucagcgccggguuuggaugagucuguuacaaagcacaggcucccucggccaggcuucagguccuuccaguucugcguggggcuccaggauucucuguucaugucgccugaagggugacagugaauucuggaucugcacaaccugacguuccagcuccagcuggcuguuugcacccaggaucuugugucagaugugguaauaggaagugagugaugaaaacucagggacuggccccagcugccacccagagccccagaggggcucuggcagacccuccacucucgggcgccuccugacauguggccugugcggcaggguccuuugaacugggaagaggagguguaccugaaaaugcaccaucuuuccccgugaucccugcucugggauuugcuaaagccugaggugaugaugaccuuggacuguuggagagaaacuuuugggacaucugaugccuuuacggcacauucagcuggaaguggggccauguacucugguugaaaagaccaccuggggaucagagggcccugcuguaucccuggcugugcgaccuuggucaaggccccaaacuuaauagggucggucuccuucuguccucucuuccccaugaggucacggugaaggucaaaagggacagugucucugcaaaggcuuuuaaaguuaaguuucgucauguguuuugucuuuaguaggggggcaguagaaccaggaauaggagacuagagaaaaggagucacagccaggcauguuggcucacaccuauaaucccagcacuuugggaggccgaggcggggguggaucaugaggucaggaguucaagaccagccuggccaagaugaugaaaccccaucucuauuaaaaauacaaaaauuagccaggcaugguggcgggugccuguaagcccagcuacucgggagacugaggcagagaauugcuugaacccggguggcagagcuugcagugagccaagaucaccccacugcacuuccagcuugggugacagagccagacucugucucaaaaaaaaaaaaaaaaaaaaaagaagaaaagcagucacauauacguauugcaaacaccucagauuuauagcgcaugggguguuuuuauggggguacucgcaagaaaggaucugauuaaaaugccacaauauaaagugccaucauuuguccacucuaaaacauauguuuugacauuuucucaucucugaaauuggaaggcaucuuguuauugauggguggucauaguuuauuuggcagcauuuuuucuuuaguguuucauaaaauaauugugcaaauuacaaccagugguaucuuagauuugauaaaauguaguauuuauuccaaguuuuauuugauaauauagggaaauaugcuauaaauaggcaacacuuugaagucaguuuagcuagacgagucacaguggugugguuucuggguguugaccccuugcuauucaucccguauaacauagaguuuuauaccaugccugggaauggucauuguccuugucucuaucuuucacagagugaguuauauuuugucccagccaucgagggcugguagcuuugguucugagcuccaagaggcagcaaaauacuggaugugaucuuuuugacuuguuuggcuuuuuuuuuuuucuaagaauuaucugucauuuuuuuucuuuuugugucucuagcgaguccagauuucagagauugucaucgacuuccuccucaggucaacaagacuuugaaaaugagcugguugguaucuaaggcccaguuguggucauggccaggggguggggacuggcagucaugguuuuggggagggagcagggcggaucuugagcggcaagugcuggagaaagugcuuuucugcaucgacgaaggcaccugaacuugggaaauaccacaggagggauggcagcuggaugacccgggaccuugagacuggaugaauuugcaggcaggaagggguacggaaucccuugggcuuccccagcacuucucucucuuacaccuauggcuuuguaugacaguuaauuauggacuugcuggcuggauuaugagccagaugugggcaggagcccugcccucuccagcccuguuucccagcgccugaugcauaguagguguuuagucauuguugaaugaauuauugaacaaauauuugucuuuccuagcuggauaacagcccagcuuuagggguauuaaguuuaagagaugugaaggacaauaaaaccugcagacacccuuucccccuaacacccacuccagcggaccguccaauccauuaggcuuguuuccucucuuuugccucaccucuuggucagugauuguaaacaaucaaacagcagcccacaucacuuugcccagagcugcccugagcuuucaucagcuuuugaucuaaguuuugugauuugaccacgaaguugucaggagauuuuagcaagaguuccaggcaugugguguauauugugaaguacugggcucaugcuugcugaauaugggauaaaagcacuguuuuuuauacaacaggagguuaaaugguuauuuaaugucaaagacaaugguuacaucugccucucaaagacacaaauguuggaagcuaaucccuguucucuccguuuccagggaugcugucccuggcugacugccaucuuccgucugcagugaguacacccgggggcagcugcuggggggccuuugggcugguuuuuuuggguguuuggccagucaagaggcaagagccaagaugcuugaucuuaagauggugucucuuagauacuuuuuaguuaauguccaaagcaguaugugagggcugagaaucaaggugaccaggcagccccuggggucaggggcagaggaaggaggccuguaggauuggagccuccaugcuggagggcacacagugccugcuggagccuggggcuucccaaauugagcuggaucccaagaguucuugaagauagagaugaacuuuauuuauuucaacauauucaguggaaaucauauguucaucucucauaauacugcacaaacuaauuaaagcuauuuuuuugcuuuaauuauucaacuuaauauuuaacaccaauuagaugucaauggacgcucucauaggcagguuugcaugucuuugaauuagugaaaagugaagaaauauaauacauucaauucauuugguuacaaguuuucuuuuuuucaauggggcccauggagagaaagcuaaaagauuauuaaaggugauuaagagccaguuaguuaccucucaugugguguagggagccaggaggcgggggggggcggggacugaugugagucuugguucucaccugcugccauauuccauugaaucuaagaaguuauuguuguaagaugcauguuuuuuuuuuuuucagaccgaguuucgcucuugucgcccaggcuggagugcaauggcacgaucucggcucaccgcagccuccgccucccggguucaagcaauucuccugccucagccuccagaguagcugagauuacaggcaugcgccaccaugcccagcuaauauuuuuguauuuuuaguagagacaggguuucuccauguuggucacgcggaucuccaacucccgaccucaggugaucugccugccucggccucccaaagugcugggauuauaggcaugagccaccgcgcccggcccaggugcauguuauuuuauauagcacuaagaacaagaaaauguugucagcuaagcuaccaucaacuauaacgauagcguacaccucauuucagaggaguugaaauauggccggcugcgguggcugacgccuguaaucccaacgcuuugggaggcugaggcaggcagaucacgaggucaggaguucaagaccagccuggccaacauggugaaacuccgucucuacuaaaaauacaaaaauuagccaggcuugguggcgggugccuguaaucccagcuacucgggaggcugaggcaggagaaucgcuugaaaccggaaggcggaggucgcagugagccaagaucaccccacugcaacuccagccugagugaaagagcaaaacugucucaaaaaaaaaaaaaaagaaaagaaaagaaauaugaaaaugauaucuuagaauugaugaaauguggugguuauauaaugaaauauggugguuauaaggaugaaauguucugggccucaguuuucccaacuguaaaaggaggcugaggauaacauaugcucagccuaauucaaaggaaugaauacaugugagagcauguuguaaauguucgguuugguaggaguuguucccaggggaacuggcaggagacagagccccaugggagacagucaacucuggucuggaacaggaggaagcaggaggcgaguuaguuuauuuagaaaugagaacaauguaguuaauugcaaagcuuuguccucuagauaaauaguaaucaggacucauaugaacaggcauauuucugagcaucugcugauaccacguacaggacuagguguuugaugcuuauuaucucuugagccccugcuaagcugaugagguaggcagugggcaguuuccuugcucgaggucagaggcggguaagcuccaugaccugcccucagguggaggccgcugcgcuggauuacacuguggucugacugcaaagcccacgcugacaucuuucacaucugccuuuuuaugaugcagcccuugccccccugagcucuucccaaagcacugcuuucccagccuagaaguagcgccuucagggagugggaaagagcagagugcccugccccuucucccucuguagcacagaagucuggcuugugugaaccuggaaauuucugaguccccaguggacccagagccuccaaguguagcacuccaagggugggaaaggguggagcaagucaccuccccaucucuggggacacagggaggaggccagggugguaggauggacugggacucuuggcuccaccucaggucuccaucugagggggagacaggaaacaggugggggccuggggccugggcauauucccaacuuuauucuuuuuuuuuuuuucuuuuuugagauggagucucacugugucacccaggcugaaguugcaguagugggaucucgacucacugcaaccuccaccucccagguucaagcaauucuccugccucagccuccugaguugcugggauuauaggcaugugccaccacacuuggcuaauuuuuuuuuuuuuuuaguauuuuuuaguagagacaguuucaccguguuggccaggcuggucucgaacuccugaccucaggugauccaccugccucagccucccaaagugcugggauuacaggugugagccacugcgcccagcccuaacuuuauucugaaugugauuucuuagaagcaggacagggcugugagaugacuguauuuacguaccuuucccacacacguaacuugggcacaaauguuucuagcaacaucagauggagugcugguauuccuuuaccucgaguaugguacaggggcuaagacgggcucuggaauuuauaucaugugagauccugaaaguuaugcaaauuuccugugccuuuauuuccucauaugugaacaaaaauguggggauagcgaucgaaccaucucauaagaguguggugaggaugauaugagacacuucaugcagagccccgaggccuguuccacugcucauuaagauuccucugugucuuggccagugaugaccagauccuggaaugguguggggaggacgccauccacuaccuguccuuccagaggcacaucaucuuccuguuggugguggucagcuuuuugucccugugugucauccugccugucaaccucucaggggacuugcuggguaaugacccuccucacccuugucuauguuguaauggggcagaguggcaguccuagggaaagggcucacugugguagaccagaaccccaggagucaugccccacuucagauguaagauggucucagggugacucugaacauuucuaucugauuaaagaucuggagcaaaccuaggcuaaaacuggggccccaauaucaaugucugguucuauuuaaauagggaaaaaagccccccaagauuuacagaaucaggggcuaucagagagucuuuuauacuuuccugcccucacccaaauuaggaggucacaauuaauggacccagaagauauccaugauacuuaauuaaaaucaggguguggcauuauaucuaagggcaacugcaagaauccaccuuccaaaaugccaccaugaauccacuuaggauacccagugguucccaacguugguuuuguaacaacauaggauguuuuuaguuuucucaaaacaaaaugaauucacauuaugccuuuaccugcaauggaagguugagaaguuaucagggagcauuuugguuucaagcagaggccuugaugguguagcucuggaaagaccagucagacguugucuuccugcugguccagacaugcuccuccuccccagagcuccacaaaccaaggcugauugguuacgcccccuccugcuuccccacaugacccuggaacuaaguaucugugcuucucugcagacaaagacccguauaguuuugggaggacaacaauagcaaaccuacagacugagugaguauggagcccguggggauaggugcugaugggugagaucaaggagaaggcaggucaggagcccggggcaggccagagguacuccaaagggggccggcugguaucugaaggccccuugcagcuagugaguuguugagcugugggcaugaacacgccacaggcagacacuguuuugccaggguuuuaagaaacacggaggguccuguggaucuggaguucauuugucaggacagggauggggaccccucugaaguauucacugugggcugaggggugcuggccacacaaccucugugggaggcaucucuugcagugaagcuguugguccucaguucagugcccacugaggguaaccaggccccagcucugcacccccagcucccugccugggaucccagcccugauggcaggugguuucccucucagcaaugaccuccuuuggcugcacaccaucuuugcugucauuuaccucuuccucacuguggguuucaugcggcaccacacucaguccauuaaguacaaagaggagaaccuggugagugaggcgggacuuagggacaugugcugggagggacucaggugggagucggaguggaagggccucccaggcucugccacaggcccugacugcaaugagcucugggagggccucaggagccccgcuugcuuauucuugcucacacuuggcaccaucuuuaaaaaaaacaguuuccugguggauuguuucaagauuuggacaguuacuggugcuaaguaaagaaauuuggguugagagcagcccuuucucuuugccgcccacagcuucacaggggaggggagcuucuguggcuugguuccaggccuggguccuccucugaucugcugugugaccgcauuugagucacuuccccucuuucucagucuccugccaugcaaagaaggcucauagaguugcuuuggaaguggauucuuuguacagccuggaagaagacgcuguguaaaugacaugcuuugggggcucccccggccacagaaggagaaaacuggagccuucugauuuccuguuguuuacuuuccagaggcuggaguuggguaggaaaccugagcauaccggcacacuggcuugugggugacuucucucccugcuguauuucccggacaggugaggcggacccuguucaucacaggacuccccagagaugccaggaaggagacuguggagagccacuuccgguaagcagguggggugggaggggagcugagcccccuccacguaggaccaacacagccccacccgcagggcgagcaccuuaggugagcgccuucugucucucgcuuggguauccaggugagaucugagaaggaccuggcccugccacacguguauggaguggcuccugugugccagcccugcuggugcugugcagugaauagcgcccugguggccuauccucuucaagcagccugugcacaguguccagagcacagaccaggguguaggugcgaauaaacgucuugagagcauacgggggaaaaaauuguugaccccgggguucuuagcaucaccuuugcagaauaagagagacgugagcugagcauuuguauggacccacagggcuagggucucacagguggaaggaccucggggccaucucugcguuuguucguuuguccacccacugagcgggugucuguugagugagcacugugucugaguccaggcucucccugguagaaccuccuuuccagcggcucccuuugaguaucugcaccaccaauuccugcagauggaggcuggaggaaagucuuuccugugaggagauuacgugugcagccagggaugcggggaaaggcccagagcaucaggaaagguggcgguggggugcaggggggcagggcaagcaguccgggaaggcucccaggaccccaugcuggaggaccugaaggcugggcugaggagcugacauuuuauucuuucuucauuccuuuuuuuguaaucuuauuuuuuuagagacagggucuugcucuguugcccaggcuagaguucaguagugcaauaauagcuuacugcggccucaacuccuggacuuaaggcaucuuccugccucagccucccaaguagcugggacugcagacacauggcaccacacccagcuaauuuuuaaauuuuuuauggagauagagucuugcuauguugcccaggcuggucucgaauugcugggcucaagugauccuccugccuugcccucccaaagugcugggauuacaggcgugagccaccaugcccggccucucuucauuccuuaucaauacagcagccacuaauuuguugcauggacuaggaguuggcugcacuuuaacuuugcacuauuugugaagaaagcacuugcuaagcaaauugcuagacaggaucguaaacugaauguuuaaaauuugaaaaacuucuucagaaacucuaaguauuuuagaaauauuuacuaauauguaaauacucaauaccagaaucauuuuucuguauuuccuugaagcaacuccucaaaguugccugcuaggcaacaccuggaaacaguaauuccacuuaauguauaacuuuaaagagaaaaaaaaagucuccucauucucauacaaacauugcaugacucaugcuuuccccuauuuuaagaggccuuuuuagugaaugcuguugcaguccguggggauugauguaugaauuugccuuucaagcagggaugcuuaaauugcaguuuucuuccucacagcucuuauugagaccagaaauuguccuacuguuuaauuucaugauugauauaccuaugggcugucucucucacuaaaauguaagcacauccaggcccuguuaccagcaccuagaacagugccuggcaggugguagguggggauuuacaugguucuggaauccccuggaauuguauguauaauuuugcguguauggugaggggguauugcaugguggccaugagcauugaccuuggagccagguugccuguauucaccuccuggcucagacacucacuagcugugugaucuugggcacaagccacuuaccucugucggccucaguuuacucaucuguaaaauggggacaaaaccucacagguuaugaugaggauuaaauaaauaaauauauguaacaauaccuggucaauagugaguauguauuuugcuggguuuuuuuuuuuuuuuuuuuuuuuuuugagacggagucucacucuguugcccaggcuggagugcaguggggcaaucuugcucacugcaaccucugccucccagguucaagugauucucgugccccagccucccaaguagcuggauuacaggugugugccaccacaccuggcuaauuuuuguauuuuuaguagagacagcguuucaccacauuggccaggcuggucgcaaacuccugaccucaagugauccacccggcucagccucccgaagugcugggauuacaggcaugagccaccgcaccuggccuugcugguuguuaauauguguguagauauuuucuggucugaggguccuuugcuuucauuagacccucugaaaggucugugaccuuaaaaaaggcuaccugaauaggauuucagugauggcucaagguagauacugaccuagcacaaacaauaaaucuguuccuuugggucuuuagaggggauagugauguguucauuuuuccccaggagaagugccagcugauuccaagccaaguggguauaaacuugucaguuccaggcaguuagcuucauacuacuaaaaaaggcuagcggggugcagugacucacgccuacaaucccagcacuuugggagggugagacaggaggagugcuugaggccagaaguucgaaaucagccugggcaacauagcgagaccccgucucuacaaaaaauaaaaaucagccugguggcaugugccuguagccccagcuacucaggaggcugaggugggaggauugauugagcccagaagguugaggcuacagugagccaugauugugccacuguacagcagccugggugacagagugagacccugucucuaaacaaaacaaaacaaaacaaaagcccucuuuguauuaaauuucaaaauuucccccuuuuggaggauaaaagacaaagagaagagaggucuccgcuggcacagaaaccagcagcgagaucacucugccauccuuucccuuggauccgugggcacgucuccugcuugggguguuuucuuuuccaacggugucuuuugccuccuucucucccuggccacagggacgcguaucccacgugugaggugguugaugugcagcugugcuacaacguggccaaacugaucuaccugugcaaggagaagugaguggugggcgggccuugcaagaugcccccuccuuccuugcuggccucgcaucucccagcuaggaagggaggcgggaggcccuggaccccuccuucuccccuggcguucgaugguugaacuguggguaugggggucccugccacaggauucuaaaucugagguuugugcccccgcucccaccccuacagaaagaagacugagaagagccugaccuauuacacaaaccugcaggugaagacaggccagcggacccucaucaaccccaagcccuguggccaguuuugcugcugugaagugcugggcugugaguggguaagggucccaccccccggcugggagcagaggcauuggcaucggggugccccagauaccagcauggggccacgucaucccaaugggaugugucuuguggcaggaagacgccaucucuuacuacacacggaugaaggacaggcugcuggagaggaucacagaggaagaacgccacguccaggaccagccccugggaauggccuucgucaccuuccaggagaaguccauggccaccuagugaguguaggcacauccagaccccuucuuggcugacucccuguuccccuccagauaacucacugucccucucgaguggagaugguacugcugacccaccaucccugggauuuaucugugguguuuccuucuccucccucagcuacccacacucacuuucagccagcccagcccauguuuguguaacaggcggugggggugugggcagcagccacggagugggugauucuggcugacccccucgagcugauguggccuggccccacugcugggcucuucccugcugcccuggacccauccuguuggcuucaugugccagccuugccccaggggagauggaggcacccuccuuucagacaucugcucugggccacagauccuucugucuguggcuccccaccuucccacaaaugcaaagcuguggggaagaccccuggggcacgcuggggcgcucacugcaguggggagcuugacccuggggaguggcuuuucacaguggcccuuggcaugggacucuaggcucucaugccuguggucucagugucaucucgccuuaggagcagcacagggugggucgggagagggguguggaaagguguccagccacugccccaggcauugugacacuaggaauggacucacacaggacuuccugccuccuugcagacacuggggcaggaggaaaggggaaggcaucugaggcaggaguagaggggcugcugggcuccuuacgggagguuaaaggaggaaaagcugugaccuguugagauggugagggucgaggugggagcccugaggagggaagcuugggaacaggcaauguguaacguggucuauugcuacacuugggccuggggaaaaagugacagaaugaaaaguugagccacuggccuggcaguagcacugaucagagcuccagcuuaacaggcaggguggagggggauggcccuauggaagagcaguguguugcccucaguuuccuuaucuguaaaaugggaaucguacucccuuuguugcuggugguugcgaggauuaaacaaaauucuccacacacugugcuagcguggcaccucuuacauagcguuacucauaauacacuaaucacaacaaagcaaagguccuaugccacugccucccacuccuacucaguccccacuugccacaugugugcuugguaaccugaguagccugggccuggcuguugcuacauuuccuugcagcauccugaaagauuucaaugccugcaagugucagagccuucagugcaaaggugagccccagccguccucccauagcagggagcucuauaccuccaaguggacagucaccuuugcugcugacccugaggacaucugcugguaagcuccuagaccaaggagaggugggagagaggccuggguuccuggugggagcugcccaucaccuggagcacaggugugaccuggcagucaauggagaucuccacacaucugcaauucugugggcugugaugcugugaugugcucgguguggcccaacugggguaucugcccagcccuucccuccaguguuccucccuagcauucaagugcuacccagcagaaauauaaugccaguucugcaucuaauuuuaaauuuccuaauagccaugcuaaaaaaguaaaaagaaacaguugaaauuaauuuuaauaauguaucucgcccaauauauccaaacuguuauuucaacaugcaauuuuugaaaaaugugagauguuuuacauucucuuuuucacacuuagucuucaauaucugguguguauuuuacacuucuagcaccucucaauucacaccagccacauuuaaaaugcucaguagccgcaugcagcuugugcagccuuacuuagguccagugucagccuggggccgugcuggggagcugagcuguguccaugggggcccuggugagccuccagugcugugcugaggguaagggcacccagcgcaagccccagcgcagcugccuguccagcccugccucagcuccuugcacagaaugagcuugaagugcuccccucugcucgguucuaguucugccucugacaguuuugcucuuugguucacaaggcuuccuaaacucaggauugcuuugugggucuguucuuugggaugagaggccagggcaggugcaagcuaugccuucacuccuuugucccugccuuccuccuuccuguaccccagcuacagccccguugggaagaaugugucguuagucacaaagcauugcagaugugucuaagaaaugccacgcuggggccgggcguggugcucacaccuguaaucccagcacuucgagaggcugaggcaggcggauugccugagcucaggauuucaagaccacccuggguaacauggugaaacccugucucuacuaaaaauacaaaaaaauuagcuggguguggugguacacgccuauagucccagcuacaugggaggcugagcaggagaauugcuugaaccugggaggcagagguugcagugagccgagaucacaccacugcacucuagccugggugacugagcaagacucugucuccaaaaaaaaaaaaacagaaaaagaaaaaauaaaugccaugcuggagccuuguuuggccugcuugggugcucaugccaucucuuuggguagguucuggcccccagacuuuagcuggggagccacaucugagagaauaauuguucccucugagcucuuggggaccuaagauuuggucuuucuguaguugaaggucagugcagagaacuugcccccaggcuagucucuuggucugccuaaaucugaccuucugacccaccuaagccacgagcacugggagacaagccucgagaccuguauccccucucccgcugcaggaagaaccucucuauccagggccuccgcugguggcuacaguggcugggcaucaacuucacccucuuccuggggcuauuuuuccugaccacacccuccaucauccuguccaccauggacaaguuuaaugucaccaaacccauccaugcgcugaaugugaguaacuguucugcaaggccccucccaggauagcuggugagaagagggcuugguggguggggaaggaguggggacaggaguggggugugugcggggaacuaaaccagugggucauguugcucagcucacauccuugcuuuuaagcccugagcaggcauggccacauuuauuacaaaguccuuauaguaaugccauacacacacacacacacacacacacacacacacacacacacacacacacauuauauguauauauacacacacaugcauacauauauauuuuaauagacuaucuaaauacugaaugguagggaucauuugaguugaaugugguauauucagguugguagacuaucaagcauccauucaaaauuguauagauuuuguggcacccaugcagggcuccugacagaagcagggauguaccagugaggcaugucuaucauggacacuacggggaggggccaggaaggaaggaaaaaagcuucguugauugggguggcaggaucacaaauuauuucuuuuacauuuugguugcuaaugaccuuguuauaaaacuauuuuggggccgggcacgguagcucacgccuguaaucccagcauuuugggaggccaaggugggcggaucaccugaggucaggaguucgagacuagccuggccaacauggcacaaccccaucucuacugaaaauacaaaaauuagcugggcguguuggugggcgcuuauaaucccagauagucaggaggcugaggcaggagaaucgcuugaaccgggagguggagguugcaguaagccgagauugcaccacugcacuccagccugggcgacaagagcgaaacuccaucucaaaaaaaaaaaaaaaaaaaaaaaacaaacuauucuguauagguaaugaacgauuuucaaaaaucuuagaugaaucaaugagauaacagccaaacacucacucaacuggcaucuacucaaaaagcuauugguuucucaugauuagcuuugccaaaccaucucccuagauuauuuuucuuuuuaaauuucacuuugcauuugguuaaucauucccugggaaagcacacggggcaggugggccuccuugucuucacuuugccauucccuaucugaugaauucugaaccucaguuuuucauccaagaacuggaguuaaaacaccugcacuauuauacagggcgugaggcuguugucaugauaaucaaugagcugaugugugguugaagcucuuaucugacuccauagauaguuuuaaacuaccuaaguauaaauucagcagcuuugcuuaagauuuaaagcagguauuauaaauaugcauuccuuugccaaucuuuuaauagaaggacaggccuauucuuuugaagauggaucugcugaugagagcuccccuuugucuacuuuacaucaaccacacccuuauuucauuguuuugugauuccaguguugguuucuuuaaaguaaaggaagaauuuagauauuugccgagccauucugaauauagaaacuuccuagaucgcauaucccuugaucuuuuaucguuaauuuacucucaucuaauuaacagcguuuuguuuuuuuuuuuagaaauugacuuuuauuaagucuuuccaaaguagccaacuuaguuuucaaagaaaauuucucucuauuuuuauguucaucuaaucagugacaguaauaagucaaucagcucauguaaucccaguaacaaacagcaggauuguggacacacacaguggagcccugauaugcugcagcuggacagugggagcugagcaggcagggcacccccccccccccgccccgccggccaggacuccaggccuucgguguucagucuugccauggcaucagucauugguuuuguauagggagcagagaagguuauuuaaucugguuagucagauaaguggaguuuacucguaugugaaauugcuuucuuugcugugcugugaggagcuguacaaauauaaggugcuguuacugauuauucagccaacauuuauggacuaccaacucuguaccuggcacaguuuugguucuggggucagagaugacaaacuccuacccugggaguccacugagcgaccauaccaauaggucauggccucagagccgcguggcccacggccccugugacucucucugcuguggaccuuucuccuagaacccgaucaucagccaguucuuccccacccuccugcucugguccuucucggcccugcuccccuccauugucuacuacucuacacugcuggagucucacuggaccaagugagugcccgggagccccgaggcccugccccuaagaaggauaucucugaccgcucccuuguccacacccuaaccccccagcugcucaggcagugggcacauggcaggggccucacuggggcacauagagcauuugggggacugcgagugcucaccuuugacuuccugcaggucgggggaaaaccagaucaugaugaccaaagucuacauauucuugaucuucauggugcugauccugcccucccugggucucaccagguauaugccaccaccuucugcucuaaauucagaauaagagucacaucaggagagcacuguccccaggagaaugcaaacgguuuggcagcagaagcaaaccucuaacaauaucuaagccugucgcaaccacucggcgugcaguagggcugggucauugauucuucuggcaauaugauugauuguucuucuuuaaaaaagaaaaaaacaccauauuggucaggcuguucuugagcuccugaccucaggugauccacccgccucggccucccaaagugcugggauuacaggcgugagacucugucucaaaaaaaaaaaaaaaaaaaaccagcuugaaaauuuuguggccaggcacaguggcucacgccuguaauccuagcauuuugggaggccgaggugggcagauugcuugagcccaggaguuccagccugggcagucuggcgaaaccccaucucuacaaaagagaaaagaaaaugaaacuuaucaaggaccuuccacuuagggaaggccucaucauggcuuuauuuaucucaaggaaggaaguuucuguuaaagcagacugugacaggucaugccguaguaaguggcaucguugagaacaaaagucaaucucgagcuuuggccuguuuuuagagcaaaagaaaaugaaagcauguguagugacaauauggaaugcuggaaauaaacucuuaggggguuccuuuguuuuucagucuagauuuuuucuuccgguggcucuuugacaaaacuuccucggaggccuccaucagguuggagugaguauugccaaguugaguucuggagccauggcccugggugaaagucccacaggggcuggggcugcagugggaugggugggggcggucguagccuaugcuucugaacaggcaucuuccuccccagacagcagggcuuggggccucaccuccacccugccagguuucugguagacacugugggagcugacccacuuugugcuaugcuugcagaaaugugguuaauuuuuuaggccagaacucaauuagcagcugucucauucauugaaacuuacugagcacagagucacauggggagaaggaauugcugggucucaguggugccagggaguggggaaaggagaauaauaauuaaagauggcagccaggaugccucugggcucuggggauuauuuuugccagaauagaauuaaauuuauuacugauguauccuuguuaguauuuuaaacuuauaccaugccacuuaauaguaauagcuauuguuuaagaaggcacuaugcuaaaugcuuuaugcaucuuuuucucacuguaucuuuacaaugagcuaugaggaagauacuauuauucucuccauuuuacagaugaggagacugagguuuggagacguugaauaacuugcccaaguuuauccagcugguuaaggaacagagcugggauucaaccccagccccuacagacuauacauuaggucuuaauauagguccagaggcuuggcauugacuuuccuaaaagaaugugcuuaccuguaaggauggggcgaguuauuuuaaaugaguucuugcugaguaagcugaugaguugggagcugaugacugugacagacacacauacauacagccagcaauagucuagguugacagugacuuucagauugacaaguccagugaccagcucaauccucaucuuaugaucuaucagcgacaucugacacauuuauccgagccuuccuccucgaagcucggccuugggucucucaucucgcagcauccucuugucacccuccuugguggguucucucccaucuccccaacucuagauuuuggcugccugaaggcucagcccccaguucuggguccacacugccucucuaggugacuucagcugaacccacggcuuccaugccaugauacugcuccugaauuaacuuaugcggacaacauccacauuuaugccucuagccugcaccuccaggcugguaacccaacugcccaccucaaacucuagcuggaguuuuacuggguaccacggauguuaccugcccaaaaccaaacucucgacuuuuacccucaaaucugcuacucuacaacuuuccccauuccauauuguuuuucuacuuguuuuggcaaaaaaccucaaaguucaccuuguuuccuuucuaucccucccaugccauacccagccuaccagaaaauccugacaacucucucuaaaguagauccagaaucccuucauaucucaccaccuccaucacaaccgcccucaucccacauggggaugacacaguggccaucuguguagucucccugaccccauuggaacagaucccuuguccugggcuggcccccagccccuuucagccuugucuucugccuccccucgcccacugcuguccagccccuggaugugcagcagacgaggacauccucaggugucuuguauguuguucccuuucccuggaauccugucuucccagguuuggggaugacuugcuccuucaccucuucacauuucugcacgaauaucaccucguuagaaaggcuccuccaaccccuguaugacauaggaacccucccugcuuuguuuuccucuagugcucaccguccccagcagauggaauauuuguuugucugcuuguuugugcccccagcuagaaugugaacuucaagagaguggcgcaggggcuuuguucuauucucagugccuagaaaggugcuuggcacacagauguguuucccaaauaugugcugaaugaacggaagaguauacagcccucccaggggcuuucugcuccugcccagccuaggggccccuccucucccuccaagagcggcucucagcucacagaccugggcccugguuuccccaggugcgucuuccugccugaccagggugccuucuuugugaacuaugucaucgccucggccuucaucggcaauggcauggagcugcugcggcugccaggucucauccucuauaccuuccgcaugaucauggccaagacggcugcugaccgcaggaaugucaagcaggugccauccccugggcccagggcugugccucugacucccucccaugucccccuucacugacccgagggccucucacccccacuacccccacuaguggguagcauuuaccugacuacccacuagugcaggcacugggcuaagugcuucucaaacccggguccaggcaggcguggccuccuccagccuccucucuagcucacaggcuggaggagagagcuugggacuuuggcauuugaaacgguuugaucgcacacauacauacauacaacucaaaccaacagacucuuuuucuguaggcacccauuugcauaaauucuuagccaaaccccagaugucaaaggcauuuucggcuuguggcauuuauuccaggauucccugaacuggaggguguggcuuucucuuuuauucuccucugccauggugggcacugugcgaggaaagugggagaagugcugcauuccuucauuucauucucagcccccuuaugagcugggcacugcuaguaucccgauuucacagaggcaugaacuaagcuggcccaggauccccugcuagaagggcuggagucacucuacaccucuucccugaccaccucuucccuccaggggcucacaugccuguuggguggaacgaagggagcacuagcaaacacgcaucaccaugccucgggagggcugggugcacugagugaagcagggcaggcugggagggaugggaaggaccuugggaggcggggagccacgcaucuccuauuuccaaaguccuccuccacccugcucucccaucaccacuuagagagcacaaaaggguguuugagguggaacaaguccaugagcuccucaccaccuccuccucccagaaccaggccuuccaguacgaguuuggagccauguaugcauggaugcugugugucuucacugucaucguggccuacagcaucacuugucccaucaucgcgccauuuggugaguggcccuggagccugucccaggguacauggguacauggacggcugauugcaccaaaccucucggggacagcuaucaccagggcacaauggaguucccaaaaccacagccacaagagccacaagcugcuaaagacucacgugacaccagauuucacucauuucuuucuuuuuuuguuuugagacagggucucaugcugaugcccaggcuggaguggcaugaucuuggcuuacugcaacccccaccuccugggcucaagccauccucccaucucagccuccugaguagcugggauuacaggugcccgccaccaugccugccuaacuuuuuguauuuuuaguagagaugggguuucaccauguuggccagccuggucuugaacuccugaccucaggugauccacccgccucagccucccaaagugcugggauuauaggcaugagccacagcacccggccucauucauuuuuaaaugaauuccucccacuggcccucagcuaggaccucucuuaguauuucuggucugagguucucugcccacugacuaugucguucaugguugauuucuuuagcagcaaguaagacagugccagagucacaaucaaagcucucgugcugcuuucacucuggcagaugccugccuccacguggauuaccacauuucucaccucauccuacaaggcaguuccuguuucuauucccccuucacacaaaauaacuucguauguuguuaguaagcaggagaaccagccuuugaacucaggacuguuuaaagaccaagguccuggccacugaaauaaaacaucugcaacuggcagauuaaugaaaggcucuagaaggaaacaaaaaacccaagagacugcuggcagugauagcugaguuuuagggggaaaaguuguuuuaguuuucccuguauacuuucuuguguaguuuuaaaaaucuacaguauuuacacuuucaaaacaaaauuuauuuuuuaaaaaagaaccuggggcugggcacgauggcuuaugccuguaaucccagcacuuugggaggccuaggcagugcaucaccugaggucaaaaguucaagaacaaccuggccaauaugaugaaacccugucccuacuaaaaauacaaaaauuaacugggcaugguggcaggcgccuguaaucccagcuacucgggaggcugagguaggagaaucacuugaacucaggaggcagagguugcagugagccaagauugcaccagugcacuccagccugaccaaugagcgagacuccaucucaaaaaaaauaaaaaauaaaaaaacaaaagaaccuggcauaauagaaaaggcagcacccacuuucuguugguccccugugugcuccugugccaccccugggguaagacccuugggccucauucucuguugacugugaugagggcagggaucagccgggugggagaaggccaggggugugggagcacugacauacaggggcucagcaugggaagggcuggggaggaauugaggccaggcauccaacugugaaacagccucuuuccaagaugauucuggaauguuaguguucuguggggacaggaucacagacacugugacucccuuggugcagggucugucccacagacccugacccagcgacggaugaaagacauacacugccgggugcgguggcucucgccuguaaucccagcacuuugggaggcaaaggugggcggaucacgaggucaggagaucgagaccauccugguuaacauggugaaacccuaucucuacuaaaaauauaaaaaauuagccgggcauggugucaggcgcccguagucccagcuacuugagaggcugaggcagaagaauggcaugaacccaggaggcggagcuugcagugagccgagaucgcaccacugcacuccagccugggcaacagagacucugucucaaaaaaacagacagacagacauacacugacagauauuuugccugucagugcggcuaaggggcucugcagccugagucugcaguguaguccucaaugccaggcgaaguucgcauuuauuuaguacagacuaaaugacaaaggucucgaguaaacaccacuagaggguaauuaacauugccgacccccugaauagcgagcaaucaugcaccaguggaugaucaaagguuggucuuaggaccacaugaguaaacaagcuauuuagguaaacucccccacauuccuauguaucugcacccuaagcuuuuaagagaauucagcugccuucagccaaacccuuuacugaagcuaugcaaaccucucggcuuuccaagaagguuugugucuauuuccuauaacuuuaucuuaaauuuucucccaccacccugaccgauccccuacaccuuggggucacagauaagugaggaaguggguaggagagagaaagugaaaaaaaacuaguagccagaggugcaggaugccucauuuuguguucaggcaguagagcagcagccccagcccuggcuccuugccaaaauagccgccccggagaggaagaggacagaggugucuguguggcccugcgaggucuccagcucacagccccauccccugcaggccucaucuacauccugcucaagcacaugguggaccggcacaaccucuacuucgucuaccucccagccaagcuggagaaggggauccacuuugccgcugugaaccaggccuuggcagcccccauccugugccucuucuggcucuacuucuuuuccuuccugcgccugggugagcagcccuucugaccuggggccagcccuuggccucccagcccugcauccccaccagccagucagaucccucauugcuuucacagcaucagcauggcauccagucagaauguggugcccagagugagggcugguuaggugucccaucagaacgugguacccagaaugaggguugguuacaugucuagucagaauguggugcccagagugaggacugguuagguguccaaucaaaacaugauacccagggugaggggcugguugggugugguguugacagccuggcuccuaagcuagcccgagugcagguguaacccuugugaaggccuggucaauugucccauacaucccuggagagaagauagugccuuuaucagcugugcagggacugaaccagaggaaauggggaagcugauccagauuugcccuuugaggcuggugguugggcccagcuccuuguaccuccuggcauggaagagguggggacguggaggagagaaaacugacacuccugggggaaagacacgucugccccggucagacugggggugugggaggguccauccucucuagcccagggcacuggagacuggagggaacggaccagcaaggaggcugaagaauugccauugacuuggcaccccagugccugaaaucugaccagggaugaugccagucauucagugggucccucuguguguuccuggcugugaagacaccauccuugcugcuggaguugaggggugggggugggggguuaggccuuaccuuuauuuucugccugagggagaagucacgggcaguuuccacaccaggugcggccccuuccucagcagggugaggguaggugguggccccucccugcccaccccaaggcuagccacccucuaucaccagguaugaaggcccccgccacucuguucaccuuccuggugcugcugcucaccauccuggucugccuggcucacaccugcuuuggaugcuucaagcaccucagcccucugaacuacaaaguaaaggcccccgaccccacugcccggucaagcccugggaggaacagauggugggacgggcucgcugucaaccccgcccacccuugucuguaucaacacagcagcagccuucuccagauucugcuucuccaugggaaaggcgugggugguugggugccauguguagcuucccuuccuccccucaucccugcacucccccaccccauccucucucgggcugcuggggagcuuggugccagcugguacuauuauuccggguguuaauagucuguguguuuggaggguguuuguucacagagaucaguuuuguuuaucaucgcaaguuuuugcuguuaucugcagacagaagagccugcaagugacaaaggaagugaggcagaggcccacaugcccccaccguucacaguaagcugugccccucagccucugagcuugucgcccuuuuuuuugcuuugguuguaacagucccaaccagaugggccccggcaaaucuuugaucaucucuugcuaagaucacauggcaggcaaguuugugaauuaauggcagagaaggaauccuggucccccuggguauuuuaaccugcauauuugaaacuguugaggagauagagucuugucucgauucauggccaucccccuugguuucaguucccugcucucuuuccuucucugcauauuuaaugccuggugaguuuggggcuuuagugaaggcacaugguaaggcgcuaggguuugacaaagguuugucaucagcgaugcaccugccugugcgagguccuccacuaggcuccaagagggugucaggcagacuucccuuugaauucaagaaaugaacauugcaccugcuucagaggaagaccccaugguagagagacacagggcuccuugccuuccuaguucucucugcacacagccuccaggguccugcuccuaggguggggcugggaagggaaagcagagccccaggguuccagagcuguagucaccagccuuccugacagccguggccaggacagagccgaccucaucugcaggguucuuucugguggcugccucccaggugucaggcucucuuaucggugucuguccuuggacaaguuccaaacaagggagggccucagaaggacucauuacccagcgacacaccuguggcuaugcuggccaagcagggaacaugcaggacagguggaugaugucaagcccucacagccagggucucaggaggaguauggcagggcucugugccuggggucaguggcuggagccugggauugggaggaaaugagacucaaaaugagacucacacagauauguugagcaucccaggggucccagggcagcguucuaagccccccuauauagguagacuuguuucuucuacaaagugagaaauccuccuaggauccagggcuaggaaguuuaguuuccucugagaacugcucucuugugcuuccuucugugaucaugagaacuguauaacugugcuuucucuuuugcccuggcugcuaggaaauucugcaggugucauauuuucggucuuaauguccuaaauggaugucgguguuucuucauauguccuuuauggccacugucuguguccuguugggagaagggcaggaggggagggaugcaguguggaagcucaugccuguccaggccaagcacaaauccauuugcugacagcccuacgugccucggauucugaacggcuuggccucggagaggacagcacugucuccgcagcagcagcagcagcagaccuauggugccauccacaacaucagcgggacuaucccuggacagugcuuggcgcagagcgccacgggcaguguggcugcugccccccaggaggccugaggcugggugagcugcuggcugggccaggcucaggggagccuguggggugagaagacaggugaagcggccugacucccaaguucaugacuucuucccaucuguuuuaggucucacugcucugaaaagacacaaccagaauggccuggggcucaggcccuuggcugagugggaaugcguugggacugcccagcugagcuaucaggugcccaucuuuucuggucccagcaguggugaggagagcacaggcaggccucgccccucccuugcucacccaguuuccccuccggcacaagcuuccagcucugcagcuggggugacauccccagugguuugucgccaagaccaugugguggacuuuucgccccccaaacugaugaguccgggagaauauauggagagagagauguaacaaggggaaggccuccucccuucugagcacacacacaaccgauaaccaaagagaugcugcaguccaggucugaggucccgcuggcauccagcucccugcuccauggccagucccuccccagcccagcagucccuccaggcuacauccaggaguaagcuauggggaacagguugggagguggccagugcuccugccagcugugcacacaucucuguaucccgcuagaguucuguguuuuuguaucauguugucagggacgcuagcugggucaggguuaccccauagcaggcagggacaaggaccacucauaauaugcccauuggaccacaguuaagauccagccucucu

SEQ ID NO: 12998 - RNA, 6365 nt, Homo sapiens
gaucuuuuugacuuguuuggcuuuuuuuuuuuucuaagaauuaucugucauuuuuuuucuuuuugugucucuagcgaguccagauuucagagauugucaucgacuuccuccucaggucaacaagacuuugaaaaugagcugguugguaucuaaggcccaguuguggucauggccaggggguggggacuggcagucaugguuuuggggagggagcagggcggaucuugagcggcaagugcuggagaaagugcuuuucugcaucgacgaaggcaccugaacuugggaaauaccacaggagggauggcagcuggaugacccgggaccuugagacuggaugaauuugcaggcaggaagggguacggaaucccuugggcuuccccagcacuucucucucuuacaccuauggcuuuguaugacaguuaauuauggacuugcuggcuggauuaugagccagaugugggcaggagcccugcccucuccagcccuguuucccagcgccugaugcauaguagguguuuagucauuguugaaugaauuauugaacaaauauuugucuuuccuagcuggauaacagcccagcuuuagggguauuaaguuuaagagaugugaaggacaauaaaaccugcagacacccuuucccccuaacacccacuccagcggaccguccaauccauuaggcuuguuuccucucuuuugccucaccucuuggucagugauuguaaacaaucaaacagcagcccacaucacuuugcccagagcugcccugagcuuucaucagcuuuugaucuaaguuuugugauuugaccacgaaguugucaggagauuuuagcaagaguuccaggcaugugguguauauugugaaguacugggcucaugcuugcugaauaugggauaaaagcacuguuuuuuauacaacaggagguuaaaugguuauuuaaugucaaagacaaugguuacaucugccucucaaagacacaaauguuggaagcuaaucccuguucucuccguuuccagggaugcugucccuggcugacugccaucuuccgucugcagugaguacacccgggggcagcugcuggggggccuuugggcugguuuuuuuggguguuuggccagucaagaggcaagagccaagaugcuugaucuuaagauggugucucuuagauacuuuuuaguuaauguccaaagcaguaugugagggcugagaaucaaggugaccaggcagccccuggggucaggggcagaggaaggaggccuguaggauuggagccuccaugcuggagggcacacagugccugcuggagccuggggcuucccaaauugagcuggaucccaagaguucuugaagauagagaugaacuuuauuuauuucaacauauucaguggaaaucauauguucaucucucauaauacugcacaaacuaauuaaagcuauuuuuuugcuuuaauuauucaacuuaauauuuaacaccaauuagaugucaauggacgcucucauaggcagguuugcaugucuuugaauuagugaaaagugaagaaauauaauacauucaauucauuugguuacaaguuuucuuuuuuucaauggggcccauggagagaaagcuaaaagauuauuaaaggugauuaagagccaguuaguuaccucucaugugguguagggagccaggaggcgggggggggcggggacugaugugagucuugguucucaccugcugccauauuccauugaaucuaagaaguuauuguuguaagaugcauguuuuuuuuuuuuucagaccgaguuucgcucuugucgcccaggcuggagugcaauggcacgaucucggcucaccgcagccuccgccucccggguucaagcaauucuccugccucagccuccagaguagcugagauuacaggcaugcgccaccaugcccagcuaauauuuuuguauuuuuaguagagacaggguuucuccauguuggucacgcggaucuccaacucccgaccucaggugaucugccugccucggccucccaaagugcugggauuauaggcaugagccaccgcgcccggcccaggugcauguuauuuuauauagcacuaagaacaagaaaauguugucagcuaagcuaccaucaacuauaacgauagcguacaccucauuucagaggaguugaaauauggccggcugcgguggcugacgccuguaaucccaacgcuuugggaggcugaggcaggcagaucacgaggucaggaguucaagaccagccuggccaacauggugaaacuccgucucuacuaaaaauacaaaaauuagccaggcuugguggcgggugccuguaaucccagcuacucgggaggcugaggcaggagaaucgcuugaaaccggaaggcggaggucgcagugagccaagaucaccccacugcaacuccagccugagugaaagagcaaaacugucucaaaaaaaaaaaaaaagaaaagaaaagaaauaugaaaaugauaucuuagaauugaugaaauguggugguuauauaaugaaauauggugguuauaaggaugaaauguucugggccucaguuuucccaacuguaaaaggaggcugaggauaacauaugcucagccuaauucaaaggaaugaauacaugugagagcauguuguaaauguucgguuugguaggaguuguucccaggggaacuggcaggagacagagccccaugggagacagucaacucuggucuggaacaggaggaagcaggaggcgaguuaguuuauuuagaaaugagaacaauguaguuaauugcaaagcuuuguccucuagauaaauaguaaucaggacucauaugaacaggcauauuucugagcaucugcugauaccacguacaggacuagguguuugaugcuuauuaucucuugagccccugcuaagcugaugagguaggcagugggcaguuuccuugcucgaggucagaggcggguaagcuccaugaccugcccucagguggaggccgcugcgcuggauuacacuguggucugacugcaaagcccacgcugacaucuuucacaucugccuuuuuaugaugcagcccuugccccccugagcucuucccaaagcacugcuuucccagccuagaaguagcgccuucagggagugggaaagagcagagugcccugccccuucucccucuguagcacagaagucuggcuugugugaaccuggaaauuucugaguccccaguggacccagagccuccaaguguagcacuccaagggugggaaaggguggagcaagucaccuccccaucucuggggacacagggaggaggccagggugguaggauggacugggacucuuggcuccaccucaggucuccaucugagggggagacaggaaacaggugggggccuggggccugggcauauucccaacuuuauucuuuuuuuuuuuuucuuuuuugagauggagucucacugugucacccaggcugaaguugcaguagugggaucucgacucacugcaaccuccaccucccagguucaagcaauucuccugccucagccuccugaguugcugggauuauaggcaugugccaccacacuuggcuaauuuuuuuuuuuuuuuaguauuuuuuaguagagacaguuucaccguguuggccaggcuggucucgaacuccugaccucaggugauccaccugccucagccucccaaagugcugggauuacaggugugagccacugcgcccagcccuaacuuuauucugaaugugauuucuuagaagcaggacagggcugugagaugacuguauuuacguaccuuucccacacacguaacuugggcacaaauguuucuagcaacaucagauggagugcugguauuccuuuaccucgaguaugguacaggggcuaagacgggcucuggaauuuauaucaugugagauccugaaaguuaugcaaauuuccugugccuuuauuuccucauaugugaacaaaaauguggggauagcgaucgaaccaucucauaagaguguggugaggaugauaugagacacuucaugcagagccccgaggccuguuccacugcucauuaagauuccucugugucuuggccagugaugaccagauccuggaaugguguggggaggacgccauccacuaccuguccuuccagaggcacaucaucuuccuguuggugguggucagcuuuuugucccugugugucauccugccugucaaccucucaggggacuugcuggguaaugacccuccucacccuugucuauguuguaauggggcagaguggcaguccuagggaaagggcucacugugguagaccagaaccccaggagucaugccccacuucagauguaagauggucucagggugacucugaacauuucuaucugauuaaagaucuggagcaaaccuaggcuaaaacuggggccccaauaucaaugucugguucuauuuaaauagggaaaaaagccccccaagauuuacagaaucaggggcuaucagagagucuuuuauacuuuccugcccucacccaaauuaggaggucacaauuaauggacccagaagauauccaugauacuuaauuaaaaucaggguguggcauuauaucuaagggcaacugcaagaauccaccuuccaaaaugccaccaugaauccacuuaggauacccagugguucccaacguugguuuuguaacaacauaggauguuuuuaguuuucucaaaacaaaaugaauucacauuaugccuuuaccugcaauggaagguugagaaguuaucagggagcauuuugguuucaagcagaggccuugaugguguagcucuggaaagaccagucagacguugucuuccugcugguccagacaugcuccuccuccccagagcuccacaaaccaaggcugauugguuacgcccccuccugcuuccccacaugacccuggaacuaaguaucugugcuucucugcagacaaagacccguauaguuuugggaggacaacaauagcaaaccuacagacugagugaguauggagcccguggggauaggugcugaugggugagaucaaggagaaggcaggucaggagcccggggcaggccagagguacuccaaagggggccggcugguaucugaaggccccuugcagcuagugaguuguugagcugugggcaugaacacgccacaggcagacacuguuuugccaggguuuuaagaaacacggaggguccuguggaucuggaguucauuugucaggacagggauggggaccccucugaaguauucacugugggcugaggggugcuggccacacaaccucugugggaggcaucucuugcagugaagcuguugguccucaguucagugcccacugaggguaaccaggccccagcucugcacccccagcucccugccugggaucccagcccugauggcaggugguuucccucucagcaaugaccuccuuuggcugcacaccaucuuugcugucauuuaccucuuccucacuguggguuucaugcggcaccacacucaguccauuaaguacaaagaggagaaccuggugagugaggcgggacuuagggacaugugcugggagggacucaggugggagucggaguggaagggccucccaggcucugccacaggcccugacugcaaugagcucugggagggccucaggagccccgcuugcuuauucuugcucacacuuggcaccaucuuuaaaaaaaacaguuuccugguggauuguuucaagauuuggacaguuacuggugcuaaguaaagaaauuuggguugagagcagcccuuucucuuugccgcccacagcuucacaggggaggggagcuucuguggcuugguuccaggccuggguccuccucugaucugcugugugaccgcauuugagucacuuccccucuuucucagucuccugccaugcaaagaaggcucauagaguugcuuuggaaguggauucuuuguacagccuggaagaagacgcuguguaaaugacaugcuuugggggcucccccggccacagaaggagaaaacuggagccuucugauuuccuguuguuuacuuuccagaggcuggaguuggguaggaaaccugagcauaccggcacacuggcuugugggugacuucucucccugcuguauuucccggacaggugaggcggacccuguucaucacaggacuccccagagaugccaggaaggagacuguggagagccacuuccgguaagcagguggggugggaggggagcugagcccccuccacguaggaccaacacagccccacccgcagggcgagcaccuuaggugagcgccuucugucucucgcuuggguauccaggugagaucugagaaggacc

SEQ ID NO: 12999 - RNA, 3101 nt, Homo sapiens
aaauauuaacccauuuaaucaucacaagcaccuccacaagguaggcuagagguuaguuaaugaaaauaauaacauuauuauuguuuuuacaaggguagaaacuaaggcacagaggggcuacauaauuugcccagggucacacagcucgucaagggcaaagccaggauuccaaccuaagcuggcagucacuagagcccaugcuguuaacauuauauagucuuucaaguggcagcagcagaugggggcuggaggaggagaaaauggauaaacucagccaggcaugguggcggaugccugcagucccagcugcuugggaggcugaagugggaggauugcuugagcccaggagguugaggcugcaaugagcugugaucgugccacuguacuccagccuggacgacagagcaagauccugucucccaaaaaacacacaaaaaaaaucagaaauaaacuggagauccucacagagcaucuugauagauagcugacuguacuugcuuuugaguaccugugagaugucccuugaggacugucagaauuaucuuggaauggaaguggggcuacuuuggaagaggcugggguuaaauuagcaauuaaagucaagaaaaauggaacaggggagguaauuauaauuugaucuuuagaucagauucagacuuaagaaacauuacauucauugauguuuucaaguuugucaccuuaaaguuuucuuggaguaagugggaucaugacuucugaucuguucuuucucugaggugacaggcacaucuauauuuagaccaauagucaugcguccauggugauggaucagugugugccucccaaaauggccgugcagugcaaucccacguguaucguuaugaacagauaaaucaccagcacugcacauuucauguacccacaccagagggacuucuguacgcauuuacuuauucagcagauaaacucauauuuaugcuaggaccauagauagccacuugggcaaguauccaugagcucaugcaagcaagccaacucagauucagucaccucacaggcagagugaauuuagagcuccagaggccucgugccugccugagagcuauucauuuccaugaagaaugucacaauuucucccacugacacgaaucagaagcugggauucuuuuuuuuuuuuuuuuuuuugagauggaguuucguucuuuuugcccaggcuggagugcaauggcaugaucuuggcucacugcaaccuccgccucucagguucaagugauucuccugccucagccucccaaguagcugggauuacaggugccugccaccaugaccggcuaauuuuuuguauuuuuaguagagaugggguuucaccauauuggccaggauggucucgaucucuugaccuugugauccgccugccucggccucccaaagugcugggauuacaggugugagccaccgcacccggccagaaacugggauucucuuuaaccccauccauucuuucaccucccgcaucuccugugucacuaaacucuauugauccuacccuuuucauagcuuuuaaucugucuccucucuuccaucuccauugccacuaauaguuuggguuuacaucuuuuuauucuaccuggauuagacaguagccuccuaaauguuuuguuccuuucucuaauuuguugccgucacugcuaccaaaauuacuauuauuuuuuuccaagagagggggucuugccgugucacccaggcuggagugcaguggggcaaucauagcucacugcuggcuugaauucccaggcucaagugauccucccaccucagccuccugagcugggacuacaggcacacaccaccacccccggcuacaaaauuuucuuuauaaagcaugaaaccauuaugucacuucccuacuuaaaacuauguaaaaugauuucaguggcccucauugcuuacaugauaaaaucuaauguccagguacuggucugcauggcuucuuaagaacuggccaauaccugucuuuggaggcccagucucccucaagucccucaccuguggcuccagucacaccagaccucuuggggcuucuggaaccuguggccugcuuucaguuguggauauuugcugaauggauucuuccauucauccaaaccauccauucauucuuucaacacacacacacacguauauauacacauacacacauuauacacgcacacacacacacacacacgcacacacauacauauauguauauauuauugggaagcccccugagccagaauagguucagagacucccucaacaaauauuuuuugagcacuugcuauaugcaagacacuucaaggugcuagaaauaugcagugaacaagacacaaaaucuuuacuuccauggagcuuauauucuuauaagcuuacacaaacuuauauucuagucuuguauugugucuccuagggaagaccagcaaaaagaaauaaauaaacaggaaaugcaucaaaaagaaagaaacaggaaauguaucagguggugugacgguaugaugguaugacgugcuaggcagagaauuaaagaaggaccacaugacauagugcgugggaagacccugucuacugaauggccagggagggccucucucagggguacccuugaggcugagaucugaaugaacuacucucgugaagaucaggguaaagagcauuccaggcagagggaacagauaauacaaaggacuuaggguaagaacgaacugacuuuuagaauaaacacccugguuagcuaaagccaaggcauuaaaaggacacaaugaagaaaaugccucuaagggagauagaaccgaagggagaucauagcugguuguggagccaaagguaaauuauucuuuaagauguacuagauacuuauuggcagcugcuaauagcaaaauaaaaaagguccuguuguucacaacugaggcacaaaaguacuuaggaauguagggagcagacacccccuccacauuucacuuggagccaugcggucugugucaagauggccugugugaagagccaccaguuauaguucauguggguuuccauuauucuuugggccuucacuuugcccaaggcacacaguuaauauaaccacaaga

SEQ ID NO: 13000 - RNA, 450 nt, Homo sapiens
ccugcugcugaaauuugggggcaaauaacuggaguaggccugcugggaacaggacuuguuaaaagaacuaugucuggaaggcugugguccaaggccauuuuugccggcuauaaguggggucuccgggacuaaagggagcacacagcucuucuuaaaacugaagguguuuaugcccuagaugaaacagaauucuauuugggcaagagaugcacuuauguauacaaagcaaagaacaacacagugacuccuggaggcaaaccaaacaaaaccagaguaaucuggggaaagguaacuugggcccauggaaacaguggcaugguucaugccaaauucugaugcaaucuuccugcuaaggcgauuggacacagaaucugagugaugcuguaccccucaauaaacuaaugaaaagucaauaaauaaauguggauuugugcucuuguuaaaaaaaaa

SEQ ID NO: 13001 - RNA, 28237 nt, Homo sapiens
ucuucuauuucacaaguggaaaucauccaggaaaugugcaccucaagggaaauccagugaaaucuugauucuggguagaacauaugagaaaagaauaguguagcacucacugcuuggcuauuugggauaggaucugucuuagguccccauaagcgcuuuuauuucuguguaauuuacugcaaaacucuaugagguaggacuaauauuaucuuaugucaaggguuaagacaauugagacuuggggguuugucaaaaauaaaagauuuucugacuuuggagugcgaugugcauuucuguugcacagaucuccaccaagggcaaauucgauggcaaugacaauuugaugucagaacuucucaggaaaggcucugaugaacucauucacacugcaugugaaugacugagaaaacucgauguauuuucacuuuuuuuuuuuuaagaaguaaaccuggguguuuuguaguucuaugagaaaaugaaagcugaagcuaggcuauagaugaaaaguucuauucauuauuacaauuuaauaaugcuuccaaaauagcaauucacuuaaauauaccuaguuaggguguuaagaaauacuuugauuaaaaccacacugcaaaauagggaacuucaauggacugcuuuaaacucucgaccucaaaggaaggaaaucaacuaaccgauaaugaaaacuagcagaaaaaaaaaagcuuaggauccguaacagauucggagucaacaaugacaugacucagcauuuugggguucaauuaaaaccaggcuuguagguugcaggucaaguuguguuucgguguguaacgcauaaaacuucuuguuccacgcuccgcgguguuggggauuuucuacugcaucucgacagcaucucggguaacaaccgagccccuccucgcagcguaagucguaggagcccucggccauucuucccccucccucccgccgccggucccagcaucgguccggguucgcuucuacgcagguucagcggccgcggacacaaaagcgccccugcucgccuucgaugccgcugcuugguccaggggcuucugugggauuuuaacacgcuaaggagggcacucauaguguuuuaccgagaaacgcuuucgagcucggaucuuuggugaucacuucaagaauguauuaguuuucuuuguagcuuaaaaaaaaaucucguucgccaagccaccuggcaccccaaacacugcugcgagcgcugggagggaaagggcgggagcgcgcgggcuccgugugcugcgagggcgccugggcggcugagauaaggcgguggcaaacgucgcgcuccgggccgccccgccagacucgguuucccccgcucaccggccuccccgcccccaggcaggguggggcggggcggacgcgccacggcgcgcgaccaaucgacagcgccggggaugauucaaaaggucgaggagccaaugggagccccgggcggccucgccgguggggaggggaggcgaggggaggggagaagcgccgcgaggcggggccggggaggcgcgcgcccggcuugcgggacugcggggcgcgagagcgcggccggguagcgucgcgcgcguggaucugccgccggguugcugugcgacuauucuccgggagccguccgugucaccgccggaaccuggcgcaggugagugcuuccacccccgcccugcucccagcuccccgcggcgcguucuucgaggggccgcugggggaggaagcccgaggccggcgcagcggccgggccggggacccugggcgcggggccuggcgcggcggccuuccccuccucuccucgccuccucgucuccuccccuccucgccuuuucuggcccagucggguggucggggcggcggcgggcgaggcuggagcucgcccgagccgggcccgcugcggaaauggagcuggggguuuuaaacugcggacguuucccuccauguuggcggcgcggcgcggcuguggagcggcggcggcagggaggguucgugggcgccuuuguccugccccaccgcagccuggcucccggccccuccgagcgcccgucugacagaugagcaggcggccccgcgguccugcaguaggaggcugacagggcgcggcggccuggcgggacggggaagggucugcggccgaggugggcuuagauucgcgcugcuugucacuggcuuugagggucguggucgucgcgguuuggugauucuccaggcacacugcauggcugcucgcuccuaugcguugaauuccuucgcccggacagucucaaaaaucggguauuuaggcgggugugcguguuccugcuaaagcacgguccugcuuuuucaccuuuuugaggguucagaaaaauguucuaaugacagccagccucgcacugccaguagccucaaggggcacuuaguaaagcacuugcuuucggagggcuuuguugaaggcgcuuucccagagugauuacggggcccggucggguguucacacgagggcgcgguagauaccgugguccgcgcguggacaccugcagcgcgaggcgcggcgccugggcagugccagggugaacaggcccccggggaccuugcacguaaacacguguagaucuguaguuacgcauuguaguaacuggugugugggagaagauggagcuacggagaagagcagagggauccuaauuuagauuaggcaacaaguccaguuuaaguuuuguuucucaggcugccugggaagagggagaagaacgagcaggaggggaaugaugagcugcccaaggauguuuauggggaagaaggcgcuucugccuuuacagccaggaagguggccuuucuguugcuucaugaagcaaagggcgcggagcaaggcccgggguuccuguuugcauuuugccuaguggggcuaccggggcucaggugugaaaaggaagcuguccaacgucauucgagcgucuugcucuaugccacguuuagaugaauuuggagaagugaaggaaagauggcuggagaccccuguaauguuaaugagcagagaauuguuguguucacaaacaguaacauaccggagcuggaaugugugaggauugcagugccaguugacucugaaguuagcgggcaucuggcuuaauagagaaaaaccugagggucuccguguuuuuccuguuuauggcgaaugaggacauugggugcagugaacaaaauuuuucuuuacaaacacacuugccuaaaacaucucuuguaagaaaauccuguguguaucuugacuccuguaggugagugcauagugagugacacgaacaaauguggggcuuuugugugccauccuggcuauuucacuccugugggggaauauauuaggaugugauugcacuguauccucacguuugacaauuguguguggaucuuguguaaagugggggugcacaucauguuguuggcuucaucuuuuggaacauuuguguauaagauaauggucuucuaagaagaaugccgguucauuuuguuuguuuuucaagcaaaucuuaauucuucuuuuaaaaaguaagcuuuagagaccuaacagguauccaccauauguguuaacuuguuuaacccagaauaauugauaagaaucuuuuuggcacuggccugcguuuauauuacacagauacuguguaugugguguguaagugcaauggaaagaugccaguaaauaaguuuuuaagaacacgcagaaacuguucaagggucuuuuaaaaccucaaguagccccugcguccugaagggcuuguguuucaaaaguuuauaaagaguuuuuugcaacuugagcaucuuccuguaggaagacauaauugccuucuuuuaacucuggcugaccaguguaggagagcuaguacuaguaagagugguuugauuuuggggggccuagggaggaggagggggcucaagagaagagagaaggaggguacauuuccuuccucuuucuuuguacuuggaggcucugagcuaaauguugaaauaggcaaagcuggauguugucaccuuccguuuuuaugccccugcucaugcagagguguucacugccccccugcucccuaagugccccucgggugacucagccaggccugacuucaucccgaaaacuugugggcuccuccccacuacuccaagcccaaacccauucauuaccccagugaugcccaaucucagguagguguagggaagaaagcugccucucuuaccuaauguguuaauugacugacauccucuaaucaccagauaaguacuuguguuuucuuucaucuaccaaccuagcugccaucucuguaaacuaguagagcuuguuaaguuuuuucacagacgauuaacagugaaaaaauguggugguuaagaaaggccucccucaccccgccuccccccccacucucccacuacucccuugggguagguaauucaacuuucuccuuaauuccagagucuucaaagguuccuaaauguugcuuuuauuguaucaucagcucuuaacaggagccagugaggaauguacauugauaggcuuggacaauacaucaagaagugcuuaguuggugaaaugaaggugauuugggagacagcucauaucuguccuacuggcugccccuuggacguggccccagcuaguucaugugguacuggggaaggucggcagcccugguuuuguuguguggaaaugugauuccgcuggucagccgauggagcggcauuacugucuggcagcuggaaguacccagcuaucaauugauauuucaaaaaggguggcagacaggccucacguaaguggcaguucuugcagauugcuuguggauuccuagaguauuguggggcuugugggccauguuuugaaucagaggaaaagaauguuauaauuggggguugauggcugcuguaggcuugagagaagugagcuuggaugaaggcaaccacccuggcuuaggugggugguuggcagaguuacuugguaugcauuuguacuuuagcuguaagaguugaaagcuaaauaacccccaaauuuauucauuacagacuuggaauuauuuuucuuccuauuguuggguuauagucauguuaauuguacauccuugauuuucccagucugguuuauaguuugcuguuuuuaauaaaggcaauuuguuaaaaauacaauuaaaugcauuuuuaaagccauuguaaauugauacgcaaauuuacaaaugagaaaauguguucuuugugagauugugccucauuuuuugauuagcgagaacugugaucacgguagguggguaacauuuuacauagugugaacuuauggcgccuauauacauuguuauaauuaaucuuuagugucacauagauaacgcaguggcuaaaucauccucucaaaugauuccaaaugagauugaauguagccuuucuggcccuaaaauccugaccagucaauucuggaaaguuguauuuuagugaucagccuguggaaaaagacgaauacauaaauguguauguauugacucaaauuuuuuucuuuaaaacuauucagguuaauuauagaaaaugccaaguaggaaauuugccgauggugaagugguaagaggucgauggccugggaguucacuuuauuaugaaguagaaauucugagccacgacagcaccucccagcuuuacacugugaaguauaaagauggaacagagcuugaauugaaagagaaugauauuaagguaagagcuccuuugguuuaucagaguguguuuacaguaagugggaaauaacucuaaguaugguuucuaagcucaggauagucaguucagcucgguuugaaggcagaggauugagcucuugcuuugggucacauacuguuuuuggcucugggaauguaugaaugaggcauaguccuuguucccaagaagcucacacuuacugggaaagacagccauuugcaucuguugguccccuggguuuacuacguucugugucuggaguuugcugugggugguguugaguguaucaaggguagagaagagcccugggcuucaggggaggcuuucagaggcagugacaccuagccaagugcugagaacaaacaggaaaaacagcaguugauggggcuguuucugcagagagggcaguaugccaaagucaggggucugggggacacagucagccaagugcuggaagggggugguaggggagggcuaagcaggagccaggcugggggggcuuuuauauuccaugcccaaggguuugggcuucauccugaacaccaaggauuuaaucaggagagugacauuaauuagauucgagucuagcccagggcuuuucaaccugucuggugagggccuggguuuuaagauaucugauccguaguauacaaacauuuauauaaaaugccauaaaaaugaguuacuagaaaaauaaagacauacacaauagacgacucacaguuuuacuaucagauucgauagauaugagauuacuuugucaaaaugcuauaaacauuuccauacaccuauuucucaauuuugguacuugcacagauuaguaacgagcauuucuaggacccauggcugaggaugacacuucgagugcucuagaccaggaauaaagcacagaaaguaaauauuuuagacuuuaugggagcggcuccaggcaguauggaagggagcagacauggcaguguuccaguacaacuuuauggacagugaaauuugaauuuuggauaauuuucacacuucaggaaauacuguucuuuugauuuuguuuguaaucauuuaagaauguaaaagccauucuuaguaggaaggccacacaaaaauuggggugagggacuuggccuggggcguaauuugucuacaucccuagaagcaacauaaggagauucggaguagguggggacacagugaaacaguucccagucauccaagcucauguuuuauuuucaagaucugcuuauguguuuuguucagagugaaacugugguacuguuuuuuuuuuuuuggucugugugcuuauuuauuuuguccugucgucucaguuuuaauccauguuaauuauuacccuucuugcauaugguguuggaaauaaguacagcuaauugguuuagauacauucguuucauggaaauaccuucaaagaacaggaauggaaaggcugcauuugucucaugaaagauggaucauuaugaaagcauuuuccauuggcuucaucugauccauucucagauccuaacauuucccgugcugauuuuagaguuaaugguagcaguuccugccuuuguuauccucuucuagugugggucugucuguauguguuaugauuugugguaaagcucuuugccuucuucccccuuucuagccuuuaacuuccuuuaggcaaaggaaagguggcucaacuuccaguuccccuuccagacgccgagggagucgaucaaggucacgcucccgauccccuggucgaccaccuaaaagugcccgccgaucugcuucugcuucccaccaggccgacauuaaggaagcaaggagggaaguggaaguuaaauugacuccgcugauucugguacuuguguuuauccuuauacagccuuuugucuuccgcuuuauguauauauuuacucaaguuacuugcaguuaauaauauuaaaaugucacugaaacaucaaaucuaaguugaugacuuugggaguuuucauauaaaacaaauguuuggaauagaaaguuuuaaauaucaauggaaaagaauguccuucaguuaccagaaaugcuauuuaauauuuuaguuuuuaaaaaagcagcguucaaauuugaaauagauguagcuuguagauugaacugcguaagguuuuuacaguguauaaaaguucauaucauguaugaaaugguaagacaaaccuguauuacggaaacauucuuacucuuagcaucauuauacuuuaucacuuuaccuauucaaagaugauuuuaguggaauuacuuucaagauguaagcuuugaaauaucagggugcauggagccuguagaucuuguacaaauaguauuuuagauaguagaccaaagacaaaguauguuaaguaaaaagaauaaaaguaaucuucuauucacuuaauguuaaccucuuuucuggauagaaggcacacagacuuugagacagagucuugcucugucacccaggcuggagcgcaguggcgcaaucucagcucacugcaagcuccgccuccuggguucacgccauucuccugccucagccuaccgaguagcugggacuacaggcgcccaccaccaugccuggcugauuuuuuguauuuuuaguagagacaggguuucaccguguuagccaggauggucucgauuuccugaccucgugauccacccgccucggccucccaaagugcugggauuacaggcgugagccacugcgcccggcaacagacuuuuaauaaacuuuaaaaacuggauuauauacauacugcucaguagucagcuuuaagacauuuuaaaauauugggauaaccuuucagaguguauuuuucuacaucauuuuuguuguuguauucuauaguauggauauaugguaaauuguauacauguaacuuaaucguuaaagucagcucugucaaugauagacauuuaguguuuuuccuuccauauuuucacuauuacaaacaaguauuuuuauguaacaucugauuauuuccuuaggauggauucuuacaaguggaacugcuaggucagcuguauggugcagauuugaggcuuuuaauacauauugccagauugcaucaagaaaguuuauaguaguaucaguguaugaaugcucaguuucucauucugaguauuauaauuuuuuuuuuuuuuuuuggagaauguggcugucagacauuuucaacuuacuguucuaacuuauauuuugaauuagaacauuuuaacuauuaguggcucucuuuaccaccccgggacuccaggaacagaugcugugugauacuuuguuauccuuucauuuuuaauauuuagugacugcuauauuuuuacaguguaaucuuacaguccuggugucacaagaaccacagaagcuuugccucuuaccugguagugccuugggccuacuguguguugcauaaguacccacuauuucuuaguuuuccauuaugggcuauuuuggagcagugaaugucuuuuugaaugucuuuuguuuuuuauccaguuaaugaacuaauuuaccaauuuuuacuuucucugccuuucauaguaaauaccccuaaaaucuaucaaugaaauuaugacauucagucugauuacgugaaagaucaaaguuguuuuuuuuuuuuuugaggcggaguuucauucuuguugcccaggcuggagugcaauggcgcggucuuggcucaaugcaaccuccgucuccggguucaagagauuuuccugccucagcuuccgaaguagcuggaauuacaggugcccgcuaccgugcguggcuaauuuuuuuguauuuuuaguagagacaggguuucaccauguuggccaggcuggucuugaacuccugaccucaggugauccacccgccuuggccucccaaagugcugggauuacaggugugagccaccgugccuggccagaugaaagauuuuauguagaaaucuauccaauauuucagagacugggaaauucuagucaguuuuauuccuuuucauuuuuaacaaaaugaggguuaaauucgucagaauuaaggcugugaaaaaucuguuuuauugcuugauuccaaaacaguaaguuuuuaccaucauguuucuuuuuaauaaguuacaguucuuuugauuaaauguuuauauucuucaauuuagaagccauuuggaaauagcaucagcagauauaauggggagccugagcauauugagagaaaugacgcaccucauaaaaauacacaggugggaaaguguucccuuucaucuugguuguuuuuuuuuuucuuuuuuuugguuaaaagugacucucccuugagaagcacauugaaaauuguaauauuuuauaaccuguucuaaaauucuguccuuaaauuaagacugaauauaauuucacaaauuuauucuuacuaguguauagcuguauugagaugcugaaauaguuaaugcaguagcauuaaugguaauuguucacugcagauauuuaauuuuuaaauuuuucauuuaggaaaaauucaguuugucacaagaaagcaguuacauagcaacacaguauagccuucguccaagaagagaagaagucaaauuaaaagaaauagauucuaaggaagaaaaauacguugcaaaagaacuggcagugagaaccuuugaagugacccccauccgggcaaaggacuuggaguuuggaggaguaccugguaggccucagagcugggcccagagagggcagguggggugagcuaggggugguugccacaaggugaacuggaaaggccucucugaagacaucugaggcaggcaagguaaugagccuggugggaaccuguggaagagccuuccagagaaggaacagugggugcaaaggcuugaggugggagcauuuugagggauuauggaguagaaaggaugccauuguagcuguguuuaaaacuuuuagcagucuguucagagguuuugagcacagaaguacaaagaagugauaaaggaagguugaucugggaguuuguauagcauagaugguuacuuaucagggacagagagcucugcuaauagucagaccugaggcggcaggggccagcagugggccucagcugccugcauaaaaugggaucccggaggcugcccuaccugcuaggcggguugauugugagggucaaagaucugaagugugcagaguuuuggaguuacuaaguggguggaacugaugaaauuuuaugagcuaguaaaagaaaagacuucuugucuaaauggcucaaaauccugcauggcuuaauugcuuuguauuuuguuauaaccuuuggcuagcuggccuguuacagaugcuguccagcaucacuuaaaaucugcacacauuacaugaacgugacacuauuuuaauuguuagaaacugaggaauauaaaguuuuuuguuaagauuaggcugauaauuuuuagauguucugaucuucaguuugcuggaguuucaacacauucgcuccuuagugguuggaggucaaauguuuuagagcuugguuucugagguggguguagcuauucaauguuggaccucuuucuuuuuuuuuuuauuuuuauuuauuuauuuuuuuuacuacuuugaugcccaugguugccaggccaccagaggugacagguagagaugggaguuuuugaugguacauuagaaauugguuucagacaguuagccagauaacgaguucugaucuuaacaaaucuaacaugauucuuaaauaaauaaaccagauugaaauuugagccucgaauguucaugaauuguuugcagguguguuucucaucauguuuggccugccuguguuccucuuccuguugcuguugauguguaaacagaaagaucccagucuucugaauuucccuccuccuuugccagcuuuguaugaguuaugggaaaccagaguauuuggggucuaccuccugugguuuuugauucaaguccuguucuaccuacugccaauuggaaagguacguuuaugguaauucuguuuuguuuuaauaagaugaggucucacuauauuguccaggcgggucuccaauuucugggaucaagugauccucuugccgcagccuccugagucgcugggaccacaggccugugccaugcugcccagccuuagaguaguuuaaagguuaaaggcuguuguuggucauaauucccaaaacuuaguucaugaagccauuucucuugugcugucuguauaacacuugcuuauuaggaggaacuuaaaaaaaaaucugauugagauuucuuguguaacuuuucaaaccaaauagaaaagaauaggcuauuuugcaaaguagccgacucucaguggagguugcuauggaaaaaaaauucacucuuaguaugugucauuucagaugcagcauuuuaaaugauuaauugauaggcuacugggcucgauggacuuuagucuacaucuuuuacuuuaaaaaaguaugaaaaguuucuaauuuucaucucuuucagaagcuuguugucaagaacauuuuacguuguuuucagauuccugcaauaucuuuaaaauuugucucuccauugcuaaguguaguuuuuucuucuuucaguagaauccuuuacuuggauauauuuaaagaaacaugagauucccuaaguaauaaauaauuuauuuaaagaucuuauucuuagggcuuugcaaguuugccaacugucuguaaaccaaaggaucgguuuuacuggugaaugccagugauaggaggguagagcugcaggcuuaauacuguggagugagaccauaacuuuaguggcucuagcaaggauuuuugugauaaagaccuucagucauuucuacaguaagccucuacaguuaaauucagauucauuuaggguaaggugauuucagaguaucaaggaaagcaguuuugguguuuaaagucauauauguauauacucauagacuaaagugacuaaaagcauauauauuaaaauauauauuaauauuaugcagucaucccuugauauccuuggggagugguuccaggaccuccuguacauaccaaaaucugaggaugcugaaggcccugauaagaaauaguauaguauuugcauauaaccugugugcaucuuccuuguauacuuuguugccuuuagguugcuuauaauaccuaauacaacguaagugccauguaaauaguuaucauacuguauuagggaauaaggacaagaaaaagaagucuguacauauucagcucagaugcaauuuuuuccgaaauauuuuggaucugguugguugaauccauggauguggaucccgucgauacggagggcugacuguauauuuggaucuauauauucacagauuaaagccuaacacagcauuuacuagacuccuuuaauagauaaggaucaucugaaauuagcauguggcauuuuacuaauccugugaucucaaacagcuuuuacguuucucuugggagaggaggaaugcuagcuaaugaaaucuguagcuaaugauaagauaaaguaguuuagcccagagcaaaugauacuauauuuauauuuuacaguuugaaaugaauugcuacauuucugaauaguuauuuugugggguaaaacguggcugcauugagcaaguggacuuuuuacugagccaguucuauuggguaccaugccuguggguaucucugugcugaaugcugugagugaugccgaaugaagagaggagaugguucugaugcaugaugcgugcucacagucucucucucucucucucuuuuuuuuuuuuuuucuugagacagggucuugcucuguugcccaggcuggagugcaguggugcaaucugcaaccuccuccugggcugaagucaucuucccacuucagccucccgaguagcugggaccacaggcgcgugccaccaggcuuggcuaguuuuuguauuuuguauuuuuguagagaggggauuucaccauguugcccaggcuggucuccaacuccuggacucaagugauccucccaccuugaccucucaaagugcugggauuacaggcaugagucaccacaccugguuucucacagucucuuauugcagauaaaagaaucacaugaaaugguuaaauaacuggaugggcaauauauauauaauauauagcagagcaaguaagcauaugaguaugcgucaucaaauagcacuugggucauaguagaguggauaaacaggguagagcccaauugaaaaggaccccacaaauggaagacaauggaaucauacuguuacuuuguaagaguaugguagccauugguagauguuugagcuagggauccacuagauauaaagguauuuaagcacauuuagucuugagguggugguacacaggaguguggcagggagcguggcuguugcaguugcuugguccuacacuaggaagucauuacugaauuuguauuuaagauaaauuccugaagguggaauugcgucauuaaagggcuugccacuaggguuuuugaaacauauuacuaaauuuccauguuacaagauaucuuccuucuugggcguguugaaaauuaagugauacuagaauauauauauguguguguguauauauguauauaugauggugaugugcuuaguaaauuuguaaauuuuuuuucuuuuaagguuguagaaggaacgccucuuauugauggaagaagacucaaguauagauuaaauggugauuuucuuuuuuuaagacucaaauugaugauuugauagcuuaaacuucuaaguguuaaacucuuuguuaaagcugauuagaccagaguaguaagugauaaauuauuucuuaguaguuggaagagcaacuguuuauaccuguagccaacuuguauaaauuaugccauuaaaguaacauagccucuuagucacucuuguccacucuccaguuuuauuuucuuaauagugcucaucacuguuagaaaucauugcacuugucuaggauuuuaucaccugagguguuacacggaugugggcauccaggccacuccugcugcgugagcugcucuuguccuugcucauguccucuggguugucccuugaauauucgucacacacacuuccugggccuuugccuggagaacuuacccccaaacgucugacaccugcaucuucaccuccaucugucuucugcugagagaagccuucaggucccuuucucuccccugcucuguuuuguuuuucugucugacauuugugccuccacacaucaguguauuugucucuucauuagggucucuccacuagaauguggcuucaugggcuaggacuuggcuauguucauugugacacucuuggugcuaggaagaugggcauguagugggugcucauucauaugugagugcuggauggaugaguugugagcuugcugggcagcucaauaaauggauagaccuugcucccuguggguccggcaucucgcacuguaagagcaugugcugagugcuucaguccagcuuugucauuugaagacuuuggcaaaguacagaucuauuuuguagucauccuugaaugauuuuccauuugacaagacggaguagaguguuuuccuuuucuugagaauuacauuauguauuguaaugguugaacuuuuuauccuuucaauucuucauuuuuuaacuuuggauacuuuguuuagagacuuacgcagcaucuacucugucugcagucacuccacuggguucuaaaggggaagccaaagauaguuuagacaccuucugccuuuuagugccagucaugugauaaaacgucucccccagcuccagagucugaccccuggugggugcuuaauacuuaucauugguauuguuagacuuuuuguugcuuuuaccaaauucuuugcugauggagcaaguuuuagaaccuuuggcacccucccucccucuggugguucacuuaccacaccagggaaggugagucuggggugagguggguuguugacuuugccgccagguccuuugauuucaguguuuuguguguuucucuguagguaccaauucuuuucuaaguagucuuguguuauauuuucacuucccucugaggggugugguacauucagagacugagcacagcacuuggacauggagcucuuggagccagugggggaguggcuggccaaguugcuugauccuuuuuaaaaauuuccucaucuaauuacucugguucaaguauugagauuucuuuucgagauuuuacgauuauuaacuaaggagguuccuaagacauuuuggaugauuauuuuuaauccacauaggcuagagagcaaaagacugcuuuaucuaaccauucuuuuuuaaaauuacauuuuaugaaagguaaaugaauauuuucaaaagucagaauuuagaaguuauuguuuggaguauuuguggaaaauguggauucagauaauuugagacaacuauuuuacuuuacaaaagguuugguuuuagaauucucauauaaauaacagcuaccucuuuuuugcuuuugaccguuuauccaaauggauuugaugacuuuuuaggaucacagcucuuugaggcacucagcuccuuugaaagcaaaacuauuucuuuagccaaaagaaaaaaauuggaucuuccagugagccuuucuguguggcugcaggacuagcccggaacgagaguucuguggagcgucacagggcgggugcuuuuuaacuuggcauugcacgugaauguccccgccugcugucccuaccccccagguacucgcaguccccugccuagccucgggcauuuguguuguggcaucuuuucugcggguggcauguuaagaucucuguucuggaugauagaguuuuacuagaaucuuuugaaaccauuauuggcaacuugguuaaguauaaauauuuauaauuuuguaacuaccaaccuggcucggugccugaccccugguaggugcauaauacccuccccuuagguaauggcauuagacuuuaaaauauguguuuggcccagcucuguuaauaauuagccauuugacuuugugccugagaguuuggauugugggaauuuucagguugcacuucuugucuguuuucccuuaauuaaaagcaaauaaugaccauuugaacugaaaaagaaucaauauguuaaacuauuuggaaaguucuacaagagauaaugguauguauauugaaaauuauaccucagacauugcuuauuugcauauuuguguguauuuagucugaauaaugaaauuaagacuuuaaaaaugaacauugcauuguuucauaguggcguaaguuucaugugagccuuggguuaauauuaauuuuccacuuccuuuuuuuuuuuuuuuuaaaggauucuaugcuuuuauccugacaucugcagucaucggaacaucucucuuccagggcguagaguuucauuacguguacagucauuuucuucaguuugcacuugcggccacuguuuuuuguguggucuugaguguguaucucuacaugcgcucuuugaaagcgccccggaaugaccugucgccugccagcucuggugagcagugaugaauugcauguuggaugaaugcgucccagagcccuccagcagccauuuccagauuugaauagauugcuuuuuuucuaacuucauuuuugggaaaugaagagaaguaagaaaaaaugaaaagaugaagaaaaacguuaaagagauaugaauuuaaaggaagaaaauauuuuuguuuuaccuucauacuuucuuacucauuucuuuuuuuugcaguugcuugaugacaguaagacguuuaguaaacuuacaggcauuuugacuuaugacaaauauuauuucuuuguccaaaauaguaaacacucuuuaaaaaacaaaaaacaacagagguuacuggccgggugagguggcucaugccuguaaucccagcacuucgggaggccaaggcggguggaucaccugaggucaggaguuugagaccagccuggccaauauggugaaaccccaucucuacuaaaaauacaaaaaucagcugggcgugguggugcacaccuauaaucccaucuacucgggaggcugaggcaagagaaucgcuugagcgugggaggcggagguugcagugagccgagacugugccacugcacuguagccugggccacagagcgaggcuccaucucaaaacaaaacaaacaaaaaacaagagaaacgagagguuacaaauugguugaugcugaccugaaguauuucaauauaaaaaaaugucgccuaucuaaaaaaaauggaguguaaaguccuuugggggggcccccaugauuuugguuaacuuuuuuaagaaaccugggcccccggcucccccaaaggcuggagcaacugccuuuucagucgggcaggcaucuccugguuccgcucgucugugccguccugucugccucucaccaccagagcccugcucagggucuugcaggcaguggaauugugagccuggauagugggcggcagugccguuguaaagccuccugacuggguuuggaaugcuguuuggguaaacacuuuuccuuucucaggaaaugcugucuaugauuucuucauuggccgugaauuaaacccucgaauugguacuuuugaucucaaauacuuuugugaauugcgccccggauugauuggauggguaugucugguuuuuuuucuucuaaauuucaauucaauaggucuaauuaacugcuagaaagaaauguagaccauucaaaaauaagcagugggugguauauuuuuagggauaauuauggcuuuccauaaaucuaucaaaauacuuucuuguaaguauuuuccagagguuuaagaugcccuguuacagguuaugacaaauuaaauaacuuuucuuugcuuuauuuuuauuauaucaguuuauauuuauguaggaaagugauaguguggaugaauuaauguaagaaaaaaugcauuuuccuccuuuuuaaauuuuaccuaguuuuaggcuuggaguugcagauagagagcaaagaguucccuuccacccuucauucuguuucucacaacauuaaccuuggaggaaaccguaguguagugaugaagaacagcagauuaacauagugacagcauugguuaccaaguccacaggccucagucgaguucaccaguuuuuccgcuguuguccuuuuucuguuccaggaaccucgacaggacuccacaauacauuuaguuguuauuccuucuuagucuucucuagucuaauaguuguuuaggcuuuccuugucucucaugaccuugauacuuuuuggaagguacugguugguuauuuuguaagugucccucaguuugggucauuccaguguucucuuugauugcgguaaaguuacccacugugacaggaacacagaaaugauagcuguguccuucucagugcauuggguccaggggcccauggugcugagaugucuuauuccugguggcggguaggaguuacgguggcgucugccaggugucucagcugugaagcucacucaugccuuuguagugcuaaggucucuggggaggugcuuugaggcuauauacuuuccccuuuuguuucaggugguuauuaacuuggugaugcuuuuggcugaaaugaaaauacaggaccgcgcuguuccauccuuggccaugauuuuaguuaauaguuuccagcuucucuaugugguggaugcucucuggaaugagguaauuaauuuuaagagccgaggccuuggagucagauggcuuugagugggugagugaccugucagagccucggcuucuugcacacaaagugaggggagcauggccugccuccaaggcugcuugagaggaggacgaggccauccaugugaagcugacgagggagcacugacaggugggaaguuucuaggcauuugggagugcuucaguguuuaucagcuguucuuguguuuaaaaguaauauucuaaauauuuaagauugguggaucuugguuuuguuuuuguggguggugguaauuaugguaucacaugaaaauggauggauuauuacuaaauuagaaugguguuucuuggacugucaagagucaccuaguuuuuaaauaaugggggagauguuuuauuguuaauguuuuaaaauacaaagacuagcucuaauuagaugaauguaaaaucagaaaucaagaugcauugaggaaaccaguugaaauaaggcuaaguuuccaucuugugucuuuuuucauacauugauuagucuuucuacuaguugaagacugguaaauguuuuguuuguuuucucugucucagccagcauauuccuuuuaaaaauuuugucuuccucaggcuuauuuuacaaguauuuuaucguauuuacuguuaucuuuguaauuaucuccaaauuccaacucuaguuuucuuuccauauuaaaaacaaaucuggcagcuguacaucauaauguuccaaaacaaguuuuagugacagucuguugagacaaucugcugacauuuugagagaagaccuuuucucuuugagccuggaacauuaaaaaaaauuauauuauuuggucaucaauacuauguaucucccccaccccugcuggcuggucuuuaauuuuggccuucuaugcaaaauugcagagaacauuuagucagaacaacuucgcaaguuugauauugguguuucgaugaucuccuuguuauuuaggaagauuagggccacuuugagguaaaccucaauuacaagcggugggauuagugcuauccgcuaauuacggguuccuguugcgcuccuaccacuucacagacccuggcucagagcuugggaagcugugaagguggugauaacacuucaaauugacuuuaaaaauuccacgucgacccaaaauuaaacauguuuuugaaauuaaaaaacaacuguuuuguaaaugcacuuacuguuaccaguguagcuuuguuugcuguuauagaaugaaucgccaaaagagcauauagguuacaguuugcaaaucaaaugauauuucacaguugugcucaccucagaggcuucuuuaaaccuuccuuucuaguagcuuuccacugaucagugauuauuucuucugguuucuucuauuacuagcuuucugccauguugugguugucacuuuuuaauuggcuuagaaguugauauuuucuauagauuuagccaaacauugacuuguguuaaaagaaaauuuuuugcaucuuaaggcaaaacgcuuaaugcaauauuaacauagccccagggguagagaacuagaguuaggaaauuguuuucugucuguucucaguaucucagccagaugauaauaagcuucuugaggaaagauuguauuuuaugauuucuucagcauucuggcaugccacugggcaauuagcagaugcuuaauaacuucugucaggucacuugauagaaaucccucuguauucaagaaugugcuauaccuuaagaaaacugagacuaccuguuuaaauaugcaugacccuuccucugagccguccugugaaagccuuggggcucaggagcugguggggcuaagguccucccccuacccggcauugggugcuuacccuuugcccucucacugccacucaccacaccugcuuuuaucugcucccaccaauuugucaccuuuauccucuuuuggaccaggaaucagaucacaggccuugagagagaagaauaagacacucuuggggacagaaaguuaaaacaccguguguccucacuuauaugugggcgcuaaaaaaguugaugucauagaaguauaaaguagaacagaggauaugggaaggugggaaggguagggggaagggaaggauagggagagguuuguuaaaggauacaaaauuaccacucgauaggaggaguaaguucuaaguucuaguauucuauaccacuguaggaugacuauaguuaacagugauacauaguuucaaauagcuagaaggauauugaauauuccuaacacaaagaaagaauguguuugagaugauggauaugcuaauuaccuugauuggauuacuauauauuacauguauugcaacaucacuguguaccccauaaauauguacgauuauuacaugucaauuuuuuuuuuuaaagagaauaaaguacucugguuaacuaaagaguauaagccuaaggagcuagauuuugugagauugguuuuucuguuucaugugacaucuguuuuucuguuccauggccuauuugcuuucuuuucuggaaaaaaaugcuauuuagagguaccacucuuuuucuuuaaccuagaacuuugauucuccaacagagcuuauacuggcuaauauuucuacaucaguggucuguacugagguucuggguaguuuagagauucccuuaggccagaccuucagaguguugaccuugguggugguuccguauucuagagucuggccugcccguauccugggccagaggcgaucuggcucaugcuaaccaaaucaccagggaguaaugcacuuuuauuaauuuacaugagaagcgaagcugucaguucaccauguugccaggcagcuuaauuucuucuguggaaaaugcacaugaaaugccagauuaugaacagaaauuagauugguccauguggaauugaaacaaaaagaguuggugaucuuauuccuucagcaagcauauuuugaacacuucucuccauggcgggcacugugcuagguacugggguggcaaaggugaaaacacacagccucugucuuuuagaggcuuuuaguguagugaagagugacuagacaaguacaguaacccaauuacugcagccuacugguggguggugauaucugagaagugcccaggucugagcagcaggucaggagggcagcagaggguguagggccuauguggagguuggaggagggguugucagcagaggggagggccugggcaugggggcaugggagaugcuuuagagaucuguuaucuccagagcaugagcgagaggcuggcgugacgggagaaugugacagcagaaagaccuagcaggccaggggaaccagaucucucuccccuuuaacaaaaaaauguugauuguggacccgcccauagcacuuuuuacauuugccuguaaacuaguacuuuauuugaauacuuuaaacacagaagcuccuucucccuuuccccgucuguauccuuauaggaagcguuguugacgaccauggacaucauccacgauggauuuggauucaugcuggcuuuuggagacuugguguggguucccuuuauuuacagcuuccaagccuuuuauuuagucagucauccaaaugaagugucuuggccaauggcuucucuaauuauuguucugaaacgugaguauuaauuuuagucucaguuuaauuuauuaaauauuauguacugaggcuuuuaugcccugcugucuacauacuugaaacaugccauuuugaauggccagcauuagcucaguuugaagccauuuaucaugaguaauaaaaaaucugcauuuugcaaagagaauggaugguucguacuuggguucucaguaguacuugaaacagauuauuuuaaaccaucuugcuuuuaaauuuaauaaauuuaaguuguuuuaauucguuuugguaaccauacgucuuuucucuugagugccugcuuuuucugguaggcaucuuauaaaguaagaagauuugucuugccuucauagagcucacauucuaacaggagaaauaagacauuccugccuugcugugaggugugugagugagcacuaagaggggcuuagaugacggguguuaaagauagagagaacuucucucuggggagcguuagugugaacuuaucggaggauaugguguucgauuggaguuuuagaggggaaaaugggauggggagaucgaaaagucaggcacugggaacagcucagcaagggugugugguggggaagugugagaugagguugggaaagacugagaaguccaguuuggcugcagcugcgguccaccagggucagucauggauuuuacuucaggaugaauuuucauuguucuuacacuguucacuaaacacuuauacuagagguugggcagggaaaauuagcagugaacugcaaauacagauaguuuugcuacacaaguuaguaucugugguagaagaaguucaaaccauugguuaaaauuaagauuuaguuucaccagugguuuggauguccaugucauccauuuuauuauucaagacaguguauuuuauaguucagcuaaaaauggggaaugucuuaguuuguuuugugcugcucgaacagaauagcugagacuagguaauuugucaugaaauuuauuuggcucaugguucuggaggccaggaagucaaagagcauggugcuggaaucuggcaagaccccuucugcugcagcaucccaggguggaagguggaaggacaagagagagugagggagggcaagagagagugaggaagagcaagaggggcugaacauacuuuuauaacaaacccacucgagauacugagcccacuccugugauagccacauuaaucuguccaugagggcagaacccucaugaccuaaucaucucuuaaaggugcuaccucuccacacuguugcauugaggauuacguuuccaacacgugaacuuuggagaacacauucaaaccaaagcaggaaguaaaguuauucucuuacuaguuuauugaggaucgacuauauaauaguuaaaugucagugauagauugauuuuugacauucugaaauuuggauaaaauuaggaacuuauagacuuaaagugggauucagcauguauuuaaagugcaggauguuuuggugcugauucuaagcuaguguuugauaauaaaauguuugugccauggccaguagguauaacuaacagaugauauagcuuguaauuuugauuacacugaacucuaguauugauuuuauuguaauguaggcuaucuuagauuuuaucucuuucauggauguaacuauauuuguuuugccuucagagcguuuccuagguggaugauuaaaguagugugauagauuucggacggguuaccaucuuuuuacauagugggauuuagagguuuugaguuguucuuaagaaucaggccaggugcgguggcucaugccuguaaucccagcacuuugggaggcugaagcaggaggaucucuugagccuaggagucugcuuuggaaauuuccucagagcauagaaaucauuuuuaagagaaauuacagaugcuauuaagcauuagaguauaacuaaguuauuaacauaggaaaauauuuuaaaauugcaguuugugguuauguaaucuuccgaggugcaaauucucagaaaaaugcauuccggaaaaaucccagugauccaaagcuugcacguaaguauugauuuauguuuauauuauauauauuacaugaagguuuuauuuuucuuuuugucucgacaucauuaaaaauguacuuuuauuuuuauauagauuuaaaaaccauucauacuucaacgggaaaaaaucuucuaguuucuggaugguggggcuuuguucgccaccccaauuacuugggugaucucaucauggccuuggcguggucccucccaugugguaagcauuucagaagagugcuaguuugacccuuuuagccgccagaaagauguguguguguguccuuugugugggacaguguggccaaggugggugugagucuuuuugucgcccuuuucuacugugagguuggccucuguagaagcuccucuggcuucugaggggaauugggaauucacagagccugaaguuuuacuuuaagccuaaaagcacuauuuuaaguuuucagcugugccugauagcuuuuuucuaaguagaauauauagaaauuaauucagcuucuuaauucaugauucaguguacauagauugggaaaaacuuugguuuuuaagaagagaaagagauucuguuuuucuuuuugugugucuggccucguggggagcugggaaagcaggggagcagggagagcugugggagcuggaggugcuuggggagcuggggugucagggggagcuggagguacugguggagccaggggagcugggggaacugggggagcagggggaucuugggaagcugggggagcugggggaacugggggagcagggggauccaggggagcugguggagguggaggagcuggcccgugccugcugccuguuugguggcccagccugugguggaagacagcaguuuuucuucuuugcugggggaagaagggcgagaaaugaagagauguguauuaacuaugaggacagauguuuugauugugauggauuguuagaauggauucaucagucuuugaguagcuucuaauuuagauacgaccuucugccacuuuccagugggauuuuacagacuuguuuaauuauucucaucauuauuagagaaaaugaaguaccuugugguuccauuuuuagagaauuugggggaaagcaggaaaaaauacauuguagugauaauaaaaauaucuaauacuguguacuauuauuauccacagguuuuaaccacauucugccuuauuucuacauaauuuauuucaccauguugcuuguccaccgagaagcucgugacgaguaccacuguaagaagaaauacggcguggcuugggaaaaguacugucagcgugugcccuaccguauauuuccauacaucuacuaaugcucuucuggcuuuucuacaaaauacuccugcaauuccagcugccauuugcaaaaacaaggaaaaaaauccgaaacuuucuuuuguugcacugacagggucuguacuuuuuuuuuucuuuuugagucaggacuauggagccgaguaguugaucuuuuaauauagccguguuuacuuguauuaacuuacaguuaacauaggaaaaauacaaguaaggaugugagaauuugcauuuuaaugggaaauuuucaacccuuaaucugaaaacagaagacagucuuaauauaaauguacugugaagaaugcuauugauguuuaugguuucugauuacuuuucaaauuuugauguuuuuuugccaguuggcuuuucuuaaaugaaaacacuguuccauuuaaaguacauuuauguuuuauucaguaagagaauagaauuuucauuuguuuuucuuuaaauccuuuacuaauuauauaauuugaaagcaaaaagaagggccuauauuaaaugcugaaagugaaaagugaugacauuauuagcagacacugcuuaaaggagaccauuuguagcaguuggcuuaaccucaacuucuaaaacuacauugaaaauguaaauacauagcuuaguuuuuuguaauauauggugacuucagauuuuuuuguacaguauuuugaaugugagaugauugucaggacuaacugucuuuuuaacaaaacauuuucaguauuuuaaauaaaauuuuguaaaguaaugugaauuaaaaauuuuggaacaauuagaauucauucacuauuguauagaagaugcuguuaaaacauaggaaggguauuuuucuugauccaaaguuugugaauuuggcuuugcuaccucaauugcagguguuuguuugccuuuauaaacuguugcaaauagaaaaaaaauagaauaaguauauauuuuuggaguaacaucaauauuuaaacauuuuuacacagaucgguguuugaaaauuugccauuucaggcuaauauuuuuauauauuuuugacuuuuuaaaaguucaucaguguuuuugcuacuguuaagcuuaugcaguuuauacuguauuuuuuauguauccuuuauauuuaccaaaccugacucccuguaaaggagugcugucuuaaaaacaacugaagggguuaaagucguuucuuuuaguuuaauagaugugcauaagguagcuuuagcaauuaaauucuagugaaguugauauagucucauuuuuaauuguccuguaauggaacaguagcaaauucacuaaacuuuuguguucagaguuaaauuguucucaguacuuucaauguaggggaauguaauaaacauaguguguauguuuggguuuuaauuacacauuuuauauaugagccauuuagauaugcaguguuaauucuauacugcauuugaaguguauguaacuuagcuuauguuaaugcagucaugaaguugguuugcuccagcauccgguagucuuuaaacauucuuuuagugaaauugucauuguuuuaucagugcuaaugugugcaagcaguuuuuuuauuuugcuuuucuccuggcaucagaaagugguggcguuuucuguacuggauugcaccaaggaagcuuuuggggaggaaggaaggacauuaaauucuuucccugguaaugaaaagagcccuuuaucaauacagugcugcaauuucuggauaucagcuacacuuuguuuuuaaguuuguuuuugacauguuuauuuggcaaauuuuauaaugaaguuuuaaguugaaaauaaaauguagcaacauuuugaucacuuuggagccuuuuuuuuuucccuuucuugcuugaaacugagauuuuugggaccaagacaggagcccuuagauucccaccccugcccagccuccuguuuuccuaggaucaucuguuugggaccccugg

SEQ ID NO: 13002 - RNA, 1109 nt, Homo sapiens
aagagacauuaugcauuacugaauaauuagggauuuauuguccuucucccacauggauguucagacuuugaucauucauuuuucaguacugacuagcacugaaggacugaugguggcauagccauuguccaccagcaucuggacucgaugacggacuggaucacuguuccacaccaguccugagcaggaggcgacaacacaguccaaaacauacacaaucacaaagcaacucacgagcagaagaauggucugcguggccauuuuuucugggggugcuuuuggagaaagguuggugcugugaaaaugcugggacugccuguuacgccuggacaagagaaucaccauguauccacuggaggggggccgugagcccugcaagggagacauccugaaaugucaucagugugaaaauugucugcucaaggaagcaacucaggaucccagcagagcaggauugagugacaaauguaaggcuauuugaggccagauuuuugaugggaagaguggagacuaagaagcugucacuaauggauauguggaagacccauaggaagagaaagcaacgugguuggugaugugagaaucuuugaacacugccaaacaggagcuucuggggcugcaggugauggccgggaggauacucagcaggcaggugguggaaauggagaggccucucaucaaccuguaccuguagauaacugacuuauguuugaugucauccucugaauccugagacccaaaaauaucuguagcuaugaacucuguggguagcagcaauaugauauggauuagagccacaugacaaacgaucaggucagcgggcuugguccugugcuugagaaggcacgugaggauguggaagagaaggagcauggcauuggcagagaucccaaugccgacuucagagaaagcagcauuucuuauggcuaugaaacuggaagguuuguuguuuuuauucaucuuauggggaaaauaagcacauagugaaugucuaagaagaaaagcaagaaaaauucuuuauuacaaauauuaccacuucuuucaaucucaaccaacauuauugccaucaucaaaauacaugaauuaauccugauccaacuuuucccccu

SEQ ID NO: 13003 - RNA, 304 nt, Homo sapiens
caagucaaaggcagacauguucagggagcaccugcuaugagcugcugcccaaagagguggaugggguugucucaaaaggugaaaagacacagggaggcccugcccacagggccaucuccugugggcagcagaggcuugcucacagcagcucaggcaaagagcuguaagucugaagagccaagggcgcucugugcagcaggagcuggagggaagcagugucauuaacaucccugccauuugucaucaucaaaagguauuucuuaagcaccuaauugagccugauacugugcuuguguuuuauuuu

SEQ ID NO: 13004 - RNA, 1470 nt, Homo sapiens
uucccuagugcucauaauguauuauuccauuauuucacuuuuuaucccuucucucacagauaagaaaagaaaaagcucuacuucuuuaggguucuuggacguagacucuccacaguucaucugggguuguucaucuccacuucuuuuuguaucccagggcaacuuuccugcaguuucccuaaugagaauauuuuccggacuaggcaaggggcggcuugccccgcccccuacucuucucccugaucaggagcugcggccagcuaccuggcgccggccaaagucaggggagcggggagaggcggcgucaccuccuccacgcuccuccggccccauucaaucuagcuauuugcacucggcucuggcucuuuuccgccagcugcggcuguuccagaagcgccgggcugccgguccuggccucggcaggggccgugcgggaccgagggguggcggccgaggcauguggggcggguggguugcgcgcugcuggcacggcgcggggacccagcgcgccaggcgggaaaggggggcggcggcgggcggggacccagacccggaggggcagcgggcgcguagcgggccccaggacgcccggccaggggauuggccucugcaccgcugcucagggcgcgucccuugccgccucuggcgucgacucaagccuccuccuccgagcagcccucaguggcgccgccuuagugcucugggucgagccccgggaggguuagccuggggacggcaggggcgugaccguggcgcggaaguaggugagcagcagggcggcgcgcggcggucaggccgggacagccagaggggcagcgacaucugcgggcgggcgggcgggaggcggacgcuucccgggcggagcagggcccuccggaggacgcaggccgcgucgaggcugaagggccucccuguccgggacggucagcugccaaguucgggcccuuagcgcguggccccgggccgcggcucggagcggaagcgucgccccuggcugcgcgcucaugcugguccuagcgcagaagacccggcgagguccgcgaauuuuggcuuagcguuugucaagucaccucgagcgacucggagagaacccggcuuucccacuagggacggugaucgcagucucuuuccuuuagaaaguuacuccgauacuuuugaucaucuguccauaguaaggaggaaaaauagcgugguuuguccccgggugagggaguguuggaggaucccguccagugggaagagccaguuuuagcggagcagcgcguccagcccgcugacacuucagccugguaaaggguuaacugcauccugccgguucgguuuacauguaaauagagagcagcugcuccgcgcggccccggcuggcucuuuuaaguuuuugauugguugccaaugacaucaccgcccguguuuuaacaccgaggacccagagcagcuucggauaaacccuccuuaaagagaugaggccac

SEQ ID NO: 13005 - RNA, 1470 nt, Homo sapiens
guggccucaucucuuuaaggaggguuuauccgaagcugcucuggguccucgguguuaaaacacgggcggugaugucauuggcaaccaaucaaaaacuuaaaagagccagccggggccgcgcggagcagcugcucucuauuuacauguaaaccgaaccggcaggaugcaguuaacccuuuaccaggcugaagugucagcgggcuggacgcgcugcuccgcuaaaacuggcucuucccacuggacgggauccuccaacacucccucacccggggacaaaccacgcuauuuuuccuccuuacuauggacagaugaucaaaaguaucggaguaacuuucuaaaggaaagagacugcgaucaccgucccuagugggaaagccggguucucuccgagucgcucgaggugacuugacaaacgcuaagccaaaauucgcggaccucgccgggucuucugcgcuaggaccagcaugagcgcgcagccaggggcgacgcuuccgcuccgagccgcggcccggggccacgcgcuaagggcccgaacuuggcagcugaccgucccggacagggaggcccuucagccucgacgcggccugcguccuccggagggcccugcuccgcccgggaagcguccgccucccgcccgcccgcccgcagaugucgcugccccucuggcugucccggccugaccgccgcgcgccgcccugcugcucaccuacuuccgcgccacggucacgccccugccguccccaggcuaacccucccggggcucgacccagagcacuaaggcggcgccacugagggcugcucggaggaggaggcuugagucgacgccagaggcggcaagggacgcgcccugagcagcggugcagaggccaauccccuggccgggcguccuggggcccgcuacgcgcccgcugccccuccgggucuggguccccgcccgccgccgccccccuuucccgccuggcgcgcuggguccccgcgccgugccagcagcgcgcaacccacccgccccacaugccucggccgccaccccucggucccgcacggccccugccgaggccaggaccggcagcccggcgcuucuggaacagccgcagcuggcggaaaagagccagagccgagugcaaauagcuagauugaauggggccggaggagcguggaggaggugacgccgccucuccccgcuccccugacuuuggccggcgccagguagcuggccgcagcuccugaucagggagaagaguagggggcggggcaagccgccccuugccuaguccggaaaauauucucauuagggaaacugcaggaaaguugcccugggauacaaaaagaaguggagaugaacaaccccagaugaacuguggagagucuacguccaagaacccuaaagaaguagagcuuuuucuuuucuuaucugugagagaagggauaaaaagugaaauaauggaauaauacauuaugagcacuagggaa

SEQ ID NO: 13006 - RNA, 5860 nt, Homo sapiens
cgcuagaaaucucuuaauuagaagccucuaaacccagacgcccaucucugaugucuguaacaagauggcucugagguugagccacuuccccugaaacuccagccccaccaccuucagcugcugcauucuacaguguccccgggacuaagguccgguuguagaucucuggccuuaacaacccccagcaaagccaagcggccuuuacaaaccguaguaaacauuuuauuuacaaauuuaaggcguccuaagugccuuugagccacgaccucuggggcgagucagagaaacaguuuagucaaacaccucacagucgaaccagccugcuuccggagagaaguguucggcuggcuagcaggacacugagacuccccucugcuuugggcaguguccgcugcagccagucggagcagcguggggcgaagcgugaaugucgggagguaggcuccacgcugcgucuccugcccuaccaagucgccaacauacaguaagcacaaaacccagcccaugguugggaggcugcacgcaaggcccggauccccuccgcccuaguacagucuauaagcagccaagcgcgccuugggcuggcucggggcuuuugggagcgcugcuggcugugggcuguguugcagggagaagcuccgaggcgccgccgccgccaaggcugcuggcgcaacccgcacuggugcugcugcuacuaagacugcuggcgcugcugaagcugaaacuauugccgccgccgccgcugcucccaccacucccagcacugcuggcgguaaugagggcgccagugaccggggccuuaauaacuguuguuuggugcagagaacgcucacuccccucaguccgcuccgugucgcugggggccauguccagggacucggagucgcugcucucgcucucagccucgccuucagaacggcuggggcuccucucguccugcucgccauccgcagccggggcuccaccugauggcuucucgccagccuccuuguccuuguccuuuugggccugggccuccuuggagugccgccacuucauccgccgguucuggaaccacaccuucaccugcgccgcgccacaccgggagacaagaagagacaccgagaugagacccagguuugcuccuauccgacucgcgugcacccucaagccaccucccugagugaaaaagcaacgcuuacuuggcgacucuaccaaggaccagacacugugguaggcgcaggagccaaggggcagcccaggggaacacaagaagccaggaauccuggccuagggaacccacuaagaccguuuucaaaaugcaacccucaggccccaggacuaaaaugaccugagugacuguuggaaaggcagauuccugcacccgacccccaacauacucucucucuacucuaaauccauguaauuuuuuuaugccaggacccccaugagaaucugauuaaaguuauggacuccuagcccagaaaaauacacauaugcccaagauauugcuuacaaugucaaggguuuggugugccaguguuaagaauuccugcucuaaguuggcccucuccucuacugccacuacccaaagcaauacuuuuuucaaaaaaggaaacaugggaagcagaaagggaaagggguuuuaaacuguuaaucacaguagggugggggcauuguugggcuuucaguaagacagcauuucuuugguguguuuguacgcaagagcugauaaggaccuugccccuguuaaggauaaacaaauucuccugggggcucagaaaacaauggaauuaaaugugugcaaaauuaaggaaggggauagagauggggcagagaaucuauacagauauauacgauccccugggggacccaacgcauucacacaaguuccagcuucccuuuuaaaaauaacauccacagcugguggaaaacggcugggcuccucguguguguguguguguguguguguguguguguguguguguguguguguacuggggagaagaguuguguaauggaggucagaaagaaacagagacagcaauuuggggaccaaggagcuaagaaaaagaagccugccucuggcuucugaccugcuggggaaaaucagcaccccagagccagagccagugcuauggggugcacaagagugacucuuccacagucaaagcucggguggugggggguggggaagcccaguucuuaaauuuaagaaaaagaauaaaauuauuucagccacaauacauuuccuauugucuugaaaaaauucaaauaggcagaaccugcugaaaugcucuuggguauucuaagagaaucauuuuucuuucuuucuuucccucaccucuccccuuccuucagauuuucuucagagccuaagccuuguaauguguggccacuccaagcagacucccugcccuccuggagcuaacuaauuccguuugaaauuauauuuucacuuccucacaacuggggauuucacaauccagcagaagcagcaggaggaggaggaaggagggagggugagagggaaaaaaacccaacaacaaucucuugccuuuggguuuuuaucuuuucugaaauaaacugccuccuacagcgaauugcacuacaguugaguguaucaguguuauuuccagcggcccuuuugcuuucuccgugguucuuuagccuguuggccaaaauaaacaugcagugcuuguugacacacaucuuggggaugagcucuucucucgguccuucucccucaccccaucuccacccuccucuucuccugccucaaguugcguaguccacaaagccucuugaaagucaagaucuugcguuugcaccgcaggaggccagucggccgggauggaggggaccuaccagacuaggccgugcgcugcugcccgcccgagggcgcugugcgcuggagccagaacugccuuaccugugcguccgugaggcccagcaucgccgccagcugcuuucgguccggcuuggucacguacuucugaaucucaaaccuuuucuccaggccuuuccucugcagguuggagaacacagcgcgcgaccaugaacgcuuccuuuuguacgucugcggcaugguguccuucgugagcacagcauagggaccugccgcagaacgggagccagagggaagaaagacaagagggccguucaguguccaguccuugaccugccagccuggggguccccguaaggcuugaaacuguuucguguuaacugucgauuccacccucauucagaaagcccuucgcacauacaccgaauggccccucuaaggaggaauuuuacacgacagucggaagaccuaaagcgagcguggaguggagaagccuggcggcuuguccuuuaauuccaagagaaaaacauaaaccucaugcguggccaucaggccuacgaagaguagacaaaaaugucccuugggccugaaugaugacagcccugaauugaauuaucucguguguguguguguguguguguguguguguguguguguguguguguguguuuauucccgcauguguccaggcacccagacauaaacucgccaagcacaaguguuugaggucaucccaaaauguguauaugcuaauaagcaacauugaugcugcauuuuucaagcccucuggggcgaaaagacuucgagaaagccccccaccccaccguccacgcacacacuuucugggaucuccaggcgccucuaccccuuuucaaggggaaccauccgaagcgagcgcuagcucgcugagaaaucuuucgguuucucucuccugacuccguagccucccgccccaauugugagauugcgacaccguggcagcccuggaggcgucaguccugagauuucugacuguuagucggcucgcccguuaggcaguacucuggaguuuuuccguaccuggaaacgugucuuggaacugaugcugaacugaauuucuuggguucgaguuuaagggacucaggauugcagaagccucguuaaugggaucuagagaugcgaagaacuggccggccgagggcugcaggccugagaggugcaccccggcgggccgcccaccgguuagcagggaagugagaucuggggacaagggaaaaggauagcagguuacaucucgggcacacucacacucuccgcugauuuguuccuccccuuccccuugcccuggauucacuuuuauugagcgaagucaagagagaacccgucuaggcgcugaaaccucucucucccaacaguugccaaggagcgacgcacgaaaaguuccugugugucccucacguccauaugcauguauauaguaaguaaaggcuuuacauaaaucggcuuacggccucacuuucacgugucuuccaagaacgccacagacgcaaaaccuccgccccaagguggccccacucugcccgcucaucuaggcgguuuuguuuauuauuuacauuuccugggugaaauuuuuacuagaaaucagauaagugcgaaaguguuucccaaaaaugcuuuagcugucagaaaauauaauucugucucuagauacauuauuaaagagaucaaagucauguuagcagauaauuacaccaaccacuuuuauaaauauugauucuaagacguguuuuuaaagaaucccuggagucauuuuuuguuuguuuuacauagaacaggugaguuuuagaccuaauguuuuguaguuuucuuacaauucguuuucuucucucccguuuuaccgauuuguccuuaauuguaaaaacacucaaaggcaccccaagccagcccgggguccggggagugggucaguggucagaggccugcagccucccgcccaagaccuaccucucagcguguugccuucuuugacuuuugggucaaauucugcagauaaaaugcggucaauuccaaauuugaggucuuugcuggagggggccggggcagagccacugugguggggguucggaaccacucgcguccccgaggccgggggcugcagggcgccagcccggggcggaggcggaggcuguugcugcugcggcuguugcugcugcuguuguuguugcgggugaugguggugguaggcggcugagagcggagacagccgcugcgggaagccagccgggacuucggagggcgccaccacuggggugggucgaagcggggaucuggccgccgcuuggaaagaggcgugcgggugaaccgagcccaagugcgcggugagggcggcggccgaggccccugccaggcccuccggggccgcccccagaucccccacgccggcgugcagaaugucugcgaugcagaaggagggcuuuuugacggcggcgggguccaaggggaaggagcagccgccugggccggccgaggagcaguaagcggccgaccagaggcugaaguuggaggcguagaagggagccagcccggcugcgaacauccugccggggugagccgcgcggcugccgcaguccagccggacugggugggugggcgcgcggggaggggcgcgcgagucccggagaaggcggcggcagccgaggacgauccgcuuucgcuucuccgcccgcacugaggaagagaggccgggagcccuagcgccaccgagggaggaggcgagggccggaucucggccggucaccgccucgcucccuggccucgcuuuaaaggcggcgcggcgcccgcacuccucgcgggcuggaugagagcgaggggcgcuggggccgcagggcgggcgggggagccagggagacgggagccggacaccgcaagaaaacccaaauagcuaagcccuaagagcuaaauuuaaaacaacaacaauaauaguccguuaguuagggggggggaaaaguaauagaaaaaaaaaaaaacucgucucuaaaaacucccaaaguuuug

SEQ ID NO: 13007 - RNA, 8907 nt, Homo sapiens
gccaacgcuaucccgggccccacggccagggggcgcugcggcccccccaaucccccgccccguccgggcuggggcggaggagcgggcggggaccaaagguuggugucuuugcgcucggaccuucgccagaggggccgggacaucaugacggugggagccaggcuccgaagcaaggcggagagcagccuccugcgccgcgggccccgagggcgagggcgaaccgagggggacgaggaggcggccgccauccuggagcaccuggaguacgcggacgaggcggaggcggcggccgagagcgggacgagcgcggcggacgagcggggcccggggacccggggcgcgcggagggugcacuucgcccuccugcccgagcgcuacgagccacuggaggagccggcgccgagcgagcagcccaggaagagguaccggaggaagcugaagaaguacggcaagguaggggcccugcgccaccacugcccggggggcgcggguguggugucccgcgggggagcgggagccggguccuuaccaucgacucacccaguuucuccgggcugcaccugcgaccccuccgcccccgcucccauucccucgccggagggaagccgcgaguugcgagucgugauagaaacuuaaaucggggguugcgcuggguggucccugcugugccugcuauugcgcuccuggcuucuuaagaacauucucaaggggcuccuaccgcggugguuuuuauguaagaucaggaaucaguuuccugauuacagaugggaauacugaagcguuagcgcggcaggugacuuggagaagguggcccaguuggaaagaaagaaauugcaacccaguguauuuguuuuccaguaacauccccuccaggauaucccacuaguugagaaauguuuggguuacucucccaaauauucccaagguuauuucccgagccugggagcgcaacaaauacauaaauaggcgcucguugaauuuuucucgucuagccaacuaucaguguacucuggggccuucaaaacauucugccguuugucucggggagaugggguuaggaagaaugaauaugggagaaaaugacaguuuccuucgcggaaaucaaagcgcagaugcaguucccaggugucucugcauggaaacagucgaagcugcugccggaagcucugcuggccuggacaaggccacccagaauaaagucacagaaguuacuguguccuggccaaaggccacgggccccaucugauuuauugucuauuuaucuguguugcccaaugccgucuuacaccugaagccauucagucuccaugccugggagcuuagguuuaucauccucuuuaaagguaugucagcagcuucuggagcagaauacaggcagggguaaaacuauaaaguugggucuuucaggcuuagagcccugcuaggacgauucaucucugcuuugggucccaguugagcacaaagaagccaucaugucccucuccauuggugaacugauacugcagaaaccucagcucaaggacuaggacuugaagauauuuugggggcacucauuaugcgucaggcauugugcugagcaguagagaugcgaaaaugaauacagugcagcccugcccuagagaagggcacagccucccagggagacacugacauagcuggcuccccccgcccccgggggggcuucagggcacagagcucaggcaguucacuccucagcggugagcuuguaaacucagggaaguuuucaaaucacggugacaugaaaacugggcacagaaggaugaguuaagauuucaccagauaacagugaagugguaugaaguaggcacacuucauccccacuagaacggcuacuccaaaaaauguccaaacaaaccgaauaacaaauguuggcgagaauguagagaaauuggaaccauuguacauugcuggugggaauguaaaaugggacagcugcuguggaaaacaauuugggaguuccuuaaaaaguucaguguagacuuauucugugaucuagcaguuccacuccuagggauguaaccaaagaauugaaaacagguacucaaaucaauguuuauauacacauuuuaauggaauuauuauuuacaauagucaaaagguggaaacaacccaaaugucccuaaauggaugaaugcauaaacaaguguguuauauacauacaauggaauaguauucagccauaaaaggaaggaaauguacuaauccaugcuacaauaugaugaaccucuaaaaauauuaugcuaagugaaguaaacaagacccgcaagaucacauauugugcguaugauuccauuuguauggaaugcuuaggauaggucaacccauggagauggaacacagauuggugguugccagggacugcgggaaagaggaauggagcccaucugcuuaauggguaauguguuuuuuccuggggaugaugaaaauguuuuggaacuagauagaaguggugguugcacaacaauguaaauguacuaaaugccaccgggcuguacgcacuuuaaaauggugaauuuuauguuaugugaauuuugccuuaacuaaaacaaacaaaaaaaacaagauuucaguggauagagaaguggugucaucucagguagaggggccaucacaagcccagcugugggcaugaaagcucuagaguguugcacgcuaguucaauggacccaggaggccaggugagaggaugucgucagguuaggguuggaucucuccuuucugcccuucaaaagugacuucagcuucuacuuucuuggagccaccugagagggucaccaggcucaaacauggagauauaaagcaggugaccccucuuuguuccccgagaccccagcuccccucugagagaguaguuggguagaaagcucuacucagaucaaagaauuccaaaugcacucucuuaaaugacacugaaauagugguugagagauauuuuauguuucuuugcauuucauuucucaaaucuguguuuuuaacaguguuccaguuaaugaacuauuuuaguagauuuuuuuucccuaaauuacaaagugacaaguagcuuuuaaaguauaacaggcugagcaaaauggauguacaaauaccaaaaaugucacguuuaaugcaggcgauugucauucugaucuuguuuauaauggaucacucuugauuguuaagcuuguucccagagaauauguuuuucuuuuguuguuucaaacauguaaguaaaauucccccagugauucuuaucacacauuuaaagaacuguaucucuuagcaacaucacauacccacacaugcgcaugccccagcccagugucucuuugagacaucaacaggguaauguccaggaaagcagugucuagagaagacacagacauuacuugguucuugcaaagcuccucauuuagcgggagagguaccaaaggaaacacucagccucuuucuacaugcucaggauacaguaaugagcacaacagagucccugcccuccuucuguuacugugagggacccuguaauuuaaacuauugaaagcucagcugggugugguggcucacacauguaaucccagcacuuugggaggcugaggcggguggaucaccugaggucaggagcuggaaaccagacugacgaacauggugaacccugucucuacuaaaaauacaaaaagauuagccuggcgcgguggugcaugccuauaaucccagcuacuugggaggcugcagcaggagaaucgcuugaaccugggagguggagguugcagugagcugagaucgcgccauugcacuccagacugggcaacaagagcaaaacgcggucucaaaaaaaaaaaaaaaaaaaaaagcucaaguaagccagaagucauaggaaauuauagucuuaagaaacuuucccaaacagacaacaaaaauauuggguuuaucuaucaccaccacaaaccuaaauugcuauguaaucaaaagaagcagauguuauuuagcaguaauaauagcugacauuggggggcacuuauacugccugcaguuugugccaggcccuguucucagugcuuugcuuacaugaucucauuuacuccucuuaacaacccaaugaggugguuacuaaauauucccauuguauaggugaggaaaccgaggccaugggaaauuaaguaagugauagaguuggaauucaagcccagggcaugagugguuaacuagaagcuuacauauugccuuuauuuaaaaagggaaacauaguauggggguuaaggucauaggcccugaagugagauuucuuugggauugaacuucagcucugccccuaaccagauauauacauguggacagauguaaucucucugugcuuugaaugauugaagucugauagacaaaggccaccagggacaugccaguagccaauccacguuagguuuaugugcuuagggcuacaagggagagugcaugccagaggaauuguggggucuucaaaaaguggagaucucaaguaacgaauugaauauuugagucugaacuaaagaguucuucaaaucuaggagauacuuguagucauuagaaauggaugagaccaucuaaggagagacuguagggaaagaaagagagaaggaaagacccaggacugaguauugaacaacaccaacauuuuaaagucugguagaagggauaauuuagcaaagaaagcugaggaggagcucccuauuuagguaggggagaacuaagaauauggagucaaagacgccacaugauuauuucauaaaguaugucaaaagcugcugagaggucagggagagaaagacagaaaagcguccacugggucaggcagcauggggguuguagauggccaugaccagacagucccucauggguugggguaggagccggagucagagggaauaagaagcgcagacauggaggcaguauaugugguuggcucuuuuggcuggcuuggcacgauggagggcagagacuggggcaggauauggagucacggugauacccgagcauguauguaagcuaaugggauccaauggagaggaagcgaaugauggagguggugaagggaaagccaagaucaaggugggagaaggcacugacaccaaguaucaagggaauggcuugggggaagaagaccacuuucuccaccguaacacaggcaaugcgggagaagccaggggcagccacaggcagggcuguugagagugguggaaggugaacguguucccugacgaugucuggguuuuuuuuuuuuuuuuuuuuuucugugaaaggugaagugggaucaucucaugaagguauggagacuuggguguguucguguguguugcaaguggggaggcuuaagaagggaaaagguaugaggcaguacccgggggagagagaaauucauccuacuggacagauguggagguuugucaggugguguuggaagucaaggugagauaugugauugugaucaggaauuuuaaguuaaaccagucugagugguuaugguaauauggaaaagucaaaggacugagagacaagguauguggccuaaggcacagguuaucugcauggacauugauaucaccaagagugaugacagaaguugagguacggaggggaagaccaugggcagccgugcaauaaauguuugguggugguggugguaauuuuucuguugcaaucacauuugaguccuuuagauguccccugucuagcaccugacauucccugaauguccccuacccagccuuguagaaaaggaagaggaggagugguuaccaagaaagcauugcccaagccugaccaucagggagcuuauaaugguauuggaaaugcuggacuuacauagauauagcaauuagaaaauggcagaagacuacaaaaggacagaugugugggucagacagaaauaugccauugagguagaaggaggagaagaugggcuuucagauaaggugaaggaaggaaaacuuaacccagccuucugacgguccaguaauuuuuagcuggaacagagaagaggagugaucuuugguuuaaaaaacaaaauaaaacugcuuuaguuuuagaauuagcagccuuacugcuguuuccaagaaggucuuugaauuaucuggaaauaagcugugcuugaaagcacuuugcaaggugaugaugucugcugugagccgcuacauauucuuaggcuggaggugggcaccuuccaccagagaugugggaaugugguaacuugcugauuugucacaagagaaucaggaaaaaugaucuuuauauaugucgccgugacucauuuuuuuucaugaaagauggcagaauuaaaaaguugccuacccuaauccuuugcuuuucucuuuuauuccuaacacuagaaugucgggaaggucaucaucaaaggaugccgcuacguggucaucggccugcaaggcuucgcugcagccuacuccgccccguuugcgguagccaccagcgugguauccuucgugcgcuaaugggagcugcuguggcaggugcccccagagugaacgggagccccugcugugggaacuuugugaauccuggagcaucucagacuugaacacacagcauauuuggaagagaaaacaugccuuucuuuguugaaucacauuaguaugaugagugagucaucccugcccaucugcugagcuucucacaucucucagucacacguggacccaguggucaauccugcagagaauucggcggagguuagguuugggaguggagcuagcgugcuaaagccagagccuucacgugaagguggcaggcacuggggcggaagccaacacucaacagaugcaagcagugugggugugcagcagaacagugaucuugggggaggaagaggauguuacuagagucagaugauuugcuguauucuccugaaaggucguaggcugacaggcgcucacauuccuuggcugccucgguucugagggcagcuaaggagcuguuuauuccucaagucaugcuccccgaucuccuuccucuaccacucugucaccaggaguuuaauuacaggcuugaggagaagaaaggaagaaaagauaucuugaugcuuugaaaacuguguuggcaguguggcaugacuguuuaaaguagauaaaaccuugucauuuuaccccaucccugcaugacugugaagcuggcgaggaaggaggaagaagggcaaguucagaugcaggcuggguggcugggacagguuggcuaagggacuacucuggagggcucuucugccuggcauugcccacuucggcccagccacguguuugcagcgaccagagucccugcaaagguguggcuggcuguggucagggugcuacuagcaccaucagcgcacucccgccauuggcucagcuccucucugccaguccaacuaagagugcuuuguccugggugggacauaggggcugagagagauggggggagacauaacacccaggaaugaaaauacagauuuagagaaggaaccaguaaguaggagacagaugugaaggaaauggaaaugaggcaagaggacauuggaagagagaaguuugcuguccaggagccaggucuggagcaucagugugagggaguucagguaggcugggccugugccucuagguagggacaagggaggcuggguagccagggcuggugcuuaaaaccccugaggccaugagcucauuggcugccuuuguagcauccugucuucuucugugcugccugguuugaucucaucucaccuggauucaaaggguaaggugggcaugggucuugggccugacacccaccaaggaugaccuguggacugccaucggaugcugaacagggagaugaaaggagguccucuuaccauaccccucugccaaccccccaguaggccacuguucugacuuuguuuccagaauauccagaaauccaaaggggcuguugcugaacagucugcaggaccagugacagcaccuaccuguugucccaaggcauacaaaggaggccucaacgcucaugcuucucuaaucaagcccuaccaagacagacagaaagacagacagaaaaaaggaagggguagaggagaagguugaagcuguggagcuagacucugcuucacuuccugaagcuucaacuucaugucgaagauucacugggacccaauuccugcauuguuaauauuugugaggaaaagugaaacaagugaucugguuuuagcccagaugaugaaaguggauauggcacauuuucacacacgugagauaauuacagcuugccccacaacacuggguguuggagaaagggagagauagucauaaguggaagaaaaagccaagcauagugagugggaaagagagugagagccugugcaggcugcugacgagccccaggcagcccacaaguuucucguggggagauggaggcagagcccaggguaggggacagagcugcuggggccuuuccuugccugggaaucugucccaggaagagcuuccccacucccaucccccaaauuggaaaaaccguacauucaagccuguuuggcccugaaauucuuaagaaucugguuaagaauuaacucacuaaugucaaaagucaaaaccuccuagggguuguccugggagucagguucacggguacagaagaugaaucucagaugucacucaaccugagccgucauucucuguggcagggcugcccuggguuucucuuacucaaucccuggaguguaagcauuuggauugugucacagauuaccuuuuuaccuuuucuuucuuuuuuuuucuuuuuuucaauaucagugcccacaccuuacugaguauugaguuuuagagcuuucgcuugaugugcuugaccaagagacuucuuuuguauccuuuucuuguccuaugauguaaauaaaagccucgauuuauguaauguuucuggugu

SEQ ID NO: 13008 - RNA, 978 nt, Homo sapiens
uuugcaauuuaauaaaucucuugaugauugcagacauauaaggcuguuuggugguauucagaaacaucacaguaauggcaguuuuuucaauugguuuguaguccucaauaauuauauauuaaauugcugucaaaccaguaagacugcauuuaugcauccaucauuuucaggauuguugguaaccugggcauauuuuccccaaauaacuuugccucuuugcgucacaagucccaguuugcucacauuuaccucaaugacaguaccuuugguaauaacacccaaaguuguauacagugggaaugagggauucuucuuuacaccaaguauugguaagcaaaagguggcuuucaguucaggauguguuacaugggcuuucuugaaaugcaagcccauuggccugaugagucuuucauauuuaggugguuuucuuauaaagccaucuccaacaaagcagacuuuaguaaccauccucuuccaugccuucuucuuucucuuuccuguucgaauaacuuuuaauacuuuuguuucuccuugggcacauacuucaggcagagggacuucccauuuucccaccuucucuuuucguuucuguuuaaucauauuggaaaguacuguagcucgagauugugccucucuguccagcagauaggcagguacugauccccguggagucuuuucauuauucuuguguuugguguuucucuuuucaugcaucuugauagucuuuuucauuuguauuuucucagcauggcacgguuuaugguaaagcuuagccuucagaccaucauuuucuuugccuucuuugaacguucguagccucucgacuuuccuucuuucucuuuuucucaugguaauccaaacgauauccauagcguuuacaguguaauucaauauauucguucuguggcauggugaaggccgcagaguugccaguagcagccucuggggugcgaaaaugcucucaauuuucaggucuca

SEQ ID NO: 13009 - RNA, 39024 nt, Homo sapiens
ugcgugcgcggccccgcgcggcaacgcaggggcggaaccgcaugacuggcaguggcaucagcgauggcggcugcgucggggucgguucugcagcgcuguaucgugucgccggcagggaggcauagcgccucucugaucuuccugcauggcucagguggauuucaauuuuacguccugguuuucuacagcucgggaaacauccuccccucgguuaccccaguauugcccaaguggaggugucgccgggcccaaauagggcccaguggguggcucccccgucgccagccccggcuguagaugcacgggcagcgccaccugcccccagccucccccguuagucuuccucuuucuaucgggcggucacugguccaccacccucgcuuuggggccuugugucccgccgcucagccagcccuccauccccacaacacaccuccccauuccucgccccaaguuuaaacagagcaaguuaguaagguaagucuucugcuagagggaaauuauuuaguguuuuucauuaucagcuacuagugauuuuucagucguaauugcccauugcuuuuuccaggcucccauacuaauguagacaauugagauucacaguuaacuuagauacuguuuacagauuaucucuuuucuguaagccacugugccauggcuggagugcuuucucucacuuuccuuuuugcugcuucucuuuccuuccuuucccuuucccgccugugucauuaaacuuccaagauagacuacaggggcaggacccccagggacaggcaucuuccacuaccugcccuuaguaacgugugcuuaaugcuguaucguuacuuaacacucaucuguaaucacuuuugucugucuuccccacuggauugugaacuucccacuggauuaugagaguaagggcccuugugucaaccuuugcacccccagugcuuggcccaggguaagcucucaggaaauguuuuuuaaagaaaugagaugcagccgguguccucagggggccuaccuaaaguuaaaaacaaaaacaauccaauuaguuugagucagcagugcauggaagaucacaagacggugcaugguuuccugccaagugaauuguaagagaaaaaaaugugguuaggcauuauuaaggcauuuggaagaugaaaagcuugucagacuuuucgaagaaaguggucuuugagccgagacggguaggcuuaaaugggacggugauuggaagggaauuggaaagguacugggcagagaccuggaaaagggcaauugugggagguauucucuuuauuuugaaaaugaggccagacagguucagcagcuuggccaaggucucuuagcuguuacugugaguaguggcggauuugggauuagaacccaaagcucuccgaccucaaacucagggcuuuggugggguaaggugaaaaaguuugaacuaggauauauuguuuuggagauagggaagaagagguccaauaguguuuaaagggaaagacggcauauauuuagaaggugacguguguaagaugacagcgguacuuaauaacuaggagacugguaguacuauuuagggcuccaagaguguucauuuauaaguacccagaaauuccccaacacuguacccuuucucauaaucaauucucauuaucuuuaggaagaacuccuagacuauguucuuuuuuccccuggaccucuuugcuuaaaauaauuauccuuuuuuugaauuucagauuacauuuuuauaaccuguaaggguaugucucuaaaauucagagucauguauguauguauuuuuuccuuuguacuuugaaccaagaauuuauucaaagaauucugccaaguaugcgaguauaaugugauuccuauauauuuaaaucuccacugaaguaaauaaaaccuuauugggaguaggucuuuaucaucuuuaucguugggaguaggucuuuaucauccaguaggucuuuagcagcuagugauuuuacauucaacuuuaauguaugugguuauguuauaggagauguuugguuucugcuuaacuagaauaugggcaaaccaauucuguuuuaucacacucaguuuugccauacuguuaaccaguuuuaacacuuuuacuauggaauaaaguacuagcuuuuuaaaaaguggacauugggaauggauagauguuguuuugcagcugcauucuuacucuucgaggcugaaaaaauguuguuaaagacagauuuuguguuuucaaauaaaaaaccuuaaaagcuugagauuuucuucuaggagauagcagccauagaagaacauaugggaguguaaauuauauguagccaacuuaauuugagccuuuucuauuaauaaaguacuaaagacggaccuucuuuuaagaugauaaaaauaaaugauagguuaaugaguuuuguucagucucucagaucagauuaauucacucuuauuugcucccauaggacacugguucuucuuucagugguagucaucauacuuguaauuauguaauguaaugucuguauuccacacuaagcuaguagguccacaaagcccaaaccaugugucuuguuuauggcuuucuucuugugugguaaggcucagcaaguugacugaguagcuucuugguaaagucaccaguaagcucaggcucuaugucgcucaauguaauggacauuuucagucguccucuuacgugaacugucaucugcauucagcuuucuucucaaaaaacucuccugguucuuuuucugucuugauuugcuccuucugguuucuuuugcagacucauccuccucuaccuggccauuaaugaugggguuucucuaaauuugguccaaggucuuuucacucuacauuuuucucccuaggcuaaucacagaagucuccuagagauacccauuugugucacugguguauagguaaaaauagaaccuuugaauuucuguggagauucauagauucuauuuuugagcucuagacaaguucaucuaacugccugauagacauucauucaugaauccauucauucaagaaauauaucacagccuccauguguaaggcacuguucugugcucugaucauacagcaaugaaaaaaacaaaucacugcucucauggagcuuauguucuaaugaaguaaauaaauacuauaguagaagguaguaaguuuuauggaaacaaggaaagcaggauaaggggauucuuccauggaugagaaguuggaacaguguuacaauuuuaaauaaaguagucagguuaugccucacugcaaagaugacagaagaugaaacuucacagcuagacuuagacuuggcuuuaaagccaagucggaggcuccaggguaggguccuugacauguucaaggaacagcaguaaggcuagugugucuggagugagaagaauaggaagggauauccaagaggguacuggcauccagguaguguagggcagggguuggcaaacuuucugcaaaaagucagguaagcauuuuagcuuuugugggccauguaaggucucuuccccauaguuuucccuucucucucuuuuugagaaaggagucuuuaauaauguaaaacucauucuuagcuuauccuccuuaaggacccuaggcuggauuuuguccuccccucuagcuguccauaguugcucaaucaacccaugguauaagaccuuguaugcauuacaaagaggcaccucacacucaaccuguguaugccuguugcuuauguuuccugucuaggcaggugucuaguauuguucacccaguuacuccggccaaaagccuguuagucauccaugagaccuuuuacuguugacccuuuauaacaaauccguugccaaucucuauuaauuuuaccaccuaaauuucucuaguaucuguuucuaucuacaucaucgcuguagucuaagcaugaacaguaguuuccuaacugaucucuguacaucuacuuuugcucucuuucaauucugucuugacacagcuuccagauugauccuuuagaaucaugccaaccuuucugucagaaauauucaugacuucuucaugaacagauuugucacguuccuacaguuucucuggucucauuuuauagacacugcucuuuucauucucugcuuuucaguucuuacaugucauacugcucccucuuauccagaauccuggcaccugcccuuuccucgcccugggauacuuuuuucuucugcccugcacuucucaccauccuguagacuuuaguucaaaccauucagcaacuauauuuggauacccaguuuuugucaguccuguucuaggcacuaugugaacaaauaacucagauaaaauacaucauaaacuuccucuugcagaguuuauaggcuagugcauuuauuguugaacuccauaaacccagucaguugugaauaaaauaaauauuugcaacaccaagugucucauuuuugaagcagguacauuugccuuucacauuuauuugugugauuuuuugacuaauuucuguuuuucacaauaugcuacacacuccaugagaauagggacucuauuccucccucaccccaccaucauugccucucuagcagugaacacagugcuugacacauuaacagggauucaauaggcaguuuuugaacugauaccuuaaugaguuaauugauuaaaaaauuaaaguugugaccuuaauuuccuccucaggacuccauaagauggacuuauauuuccuuccauuuuuuucuguaaauacauauacauuaauauuuauauggcuuuuuauuacuuaccagcuuuggaguagauaauucuucuuuuaggucauguaaacauguugucaaaauuaaauuaugauuuuuucaaguuaaaauaaaauuacacugaacacacauuuuggacuuuuuuuaaccaagaaaauuagguucuucuaacuacagaaguuuaacagucacuuuaggaauuuauuacuauuaagaauaugauaagaaaugacuauuaaaagucacauauaaauacagaaauaaaauuuuuuuuagaaaaaucaauuuauuuauuuauuccuguacuacccacuaaacaaauuagguaacuuaaaacuuaagcuuaaacaagaucuucagaguaaucaauggugaagccaggaguaaaauaaucaaaauuauugcuaguuauugagaccuaguuaguuaauucauauuaguaagucaguuucuauaugguuauuaugauguauggagcuuuuuuaaauccuuuauuccauccucugugugacauaaaaguuuuagacugcuuugaaaugcauuguauuacuaaaauauuuauuuuaaucuagauuuuuugauucaucaggugauucuggacaaggauuaagaauguggaucaagcagguuuuaaaucaagauuuaacauuccaacacauaaaaauuauuuauccaacagcuccucccagguaugcaguaauuuaucucacuugucaauauaacucuguggcauaaaauauauauagagagaugugccagcuagguguucuuuaagcuuaauuuuguauuuaacauacuuuaaauuagaguacuuuguccccagaauguauucuuuauugcaguuacacuguuggaccaaguuuugccaggugaguaauuuauucccuuucuguaaagcauucccuaaagcucugaauuuaaacugugucccaagcauggcuuauguaacucugcuuccucuugcccugcagauugcucaacuuucauacuucuucccuacauucaccccaaaaggaaacuuaauaacuccaacaaguauaaucuuucuaauaauuuaguuaagccagaauucauaaucucugggaaaggguuuuauggcauucuuuccacauuuaaaaggauuaucaagaaacaauguuaugcuuuuuuaaucaguaaaccagaauaggaagauagaauugacuacuuaauaaauauuuagguuauauaaccuguaggugugugcaaaaaauucacaguaauaaaacugcuauaguuuugaggucaaacuacucuuuguaaauauuaaauuaacaucugcauagucuuuuauucggaacacaugccguaaaucagggauugggauuuuuuuuugguuaagugaaaugauguguggagcuacgccccaaucugauuuuucucauaaucuguucuugauuuuuuuuuguuucuuuuucuucuucuuuuuuuauuuuuuccagacagagucucacucuguugccuaggcuggagugcaguggugcagucuuggcccacagcagccuuugccucccaaguucaaaggauucuccugccucagccuccugccuagcugagaauacaggcaugugacaccacgcccagcuaauuuuaaagacaagguuuugccauguuggcuaggcuggucuggaacuguugaccugaggugauccacucaccgcggccucccaaaagugcuggaauuacaggcaugaggcacugcaccuggccuguucuugauuuuuuucuuaucaggcauacuaugcaaaugccuugcuuuauauuuucauuaacuuaguauuaaggagaaauaaaaccagaacuucaaggacguuuuuauauguacuaauaagaauuuacuuacuuuaauugauagaauugaaaaagggagaacaaaaugauaauguaagacugaagacucaaaggaguuauuauuuaaauguaauuuuaauagaguuuaaaaguuugguaaucuaguuaaaagacccaaucaccagugguuauuuuugugcuauaaauugcaugucuuugaaaaugucaaaaaagcuucuuguuacugauuuuuaggauaguugaaguuggaaggaagaaacauagugguauuucugcagggaugaaagauaaguucauuucuaccuaaauauaaauacaauugucugauuaaucauaagaccacugaaaaccuuauucuaggaauuaauauuuuuuaucuuaagaauuucaugucauuaccaauugugauaggaauucuaggcaguauuucucaaacuuuaggccagaguuauuucagaaaauccaaaaaucuccaugugcacuaagcauuauuugugggugcuguugugauuuaguaaaauaugaaaucauuggaccagcuucaugguaacuuuuuguuacacaguuuuauaaccaauagcuauuugaacagaucaucgaacguuuuagaccauacucaccaauagaaauguaauaugagcuacauauaaauuuaaauguucuugauaccacauuauaaaaaggaagaaauacguaagauugauuuuaauaauauauuuuauuuaacccaguauauucaaaauauucaacauguaaucgguauaaaauuauuaaagugauauuuuauauuuuuuacacuaaauuuuugaaaauuggcauguuuuacauguacgacacaucuuacuucugaugcuaaauaauuacacugaaauuaaauaguaguaaaaauuagguuccucaaguugcccuggcuacauuuacgugcuucauaaccuuaugugguuaggggcugccauuuucuacagcuuaguuuuagaacuuaaagaggaguucccauauacaguagauugggagccacuguucuagaucaagucaucauuuuuacuuauugguuugcucaaguuuucacuuauuaguagcaaaacauagaagauuuccaacacauuacuuuaaauauuaaauuauuuaauugcaauagaaaaugaaacuggcauaaacaaauuugagaacaaacauaguugacucuuaauaagcauaaaaagcauaaggcucaguuugugggagcaaaagugugagggugugcaagaaugaagccucuugaucuggaccauuuggucuuccaugggcguuagauauaggaauacauggcuuugguuaauacuaugaggcaauucaguggaggucaguuaagagagaugauaucauacuuaguauauuauaauuagcugauuuuuuuccuaccuuaugcuggacuaauuuucuagagcaguuuauaugauacuuacuucuguaucccuacagacacugagggauacuguaucucuaagcacuuagcauagaaccugacaaauagauguuuagugaagauugaauaaauaucuugcaguauuugcuuguuguuguuauuuaaaauaguguaauaggaaugaguaauuguggguauuuauauauaauacuaauauuuuaauuguguaauaguuuaugccuaugugagguuuuaaaaaguguauuuuguugugguaaauaaccuaagaauuguuguucauaagggguugcaauuacuuguccuaagacuugacccugcaauagauugagugagcaccagauuaugggccaguuuuaacuaaugagucucaaauugaggagcacugcgguaucauuaagccuguagcuuuuaacugguuuccagacuucagaaugcuguuugauaguauuuuauuagaaugcucuggcauucaugguguacuuugcuguuuuaagacuucugacugguguuccuaacacauuacccuguuuaggcaagcaguuugggcauagauuuauugucguugcuuuuguagcauaauauggcuucauuugcgguuuuaaggauaguugcuaccuuccaucuauuauggcaauguuucuugugcugcuaauaagagagauucuggugucaucuaccuugcuugcuaccuuuccggugacgucaaaaggaggcaugugauagauacgugccuuccuuaacucucacucuuuuuaaugugauugguacaggauaaaaaugaauuuuaauaaccuuuuuaaaaauuuaucaagguuucaugcuuuaacauguugcuacauacuuucugauauuguccacauuucugguauuuauucucucuccugauuuuuuucuuucaccacuuguaaacccauaaguuuuucuguacuauggauauuucauugacuauguuauuccuauaagguauauugaagauaucacuuggcuuguaaaaucauuccauugauggcauguaaaugauauucaggguuuaccugccuguuaguuggccaguuuuguccuagaauguaucuaaucucuuguuacauggaagugaugcuuacuauuauguggcuuuacccaagccaguauuuauagaaaugagugaaaaugaaauguauaaaagcagguuaagcuuuauuaacuuugguacacuaugccaagcauauuuccagagaggcuguaacaauugacagccucaccagcaguauucaagauucccauuugucucacauccuccugaacacuuuccauugucuuuuuaauuuuagccaaaccaguagauguguaaugguauccuauugugauuuuuauuaauauuucuuuaauacuaaugauguugcacacuguuuuaugugcuuauugagcauuuaaauauccucaaaagaaaugcccacucagauuauuugcccauucuuuuauuuggucaucuuuuucuauugauuuguuggaguucuguaguuuuuuggauacaguuuauuauuguuguuggauauaugaauacaaauaccuucucuuugugguuugcauuuucacauucuuaaugacaucuuguggacauaaguucuaacauguuucuuuaaaauuuacagugaaauacagaaauuguaugugcauaguuaauuuugauaaauuauaguacagagaauuuugguaaaauuaugcaccuauuuaccucaauuaaguuggagaauauucucaucaccccagaaaguuuccuugugcuucuuucaagucaacucccaucucauguauuauuguuugcauaucuauuacuguagcauaguuuggcuuguucuugaauuucaguuaaauugagucacuuaaugagugacuuaauggaaucuugugucuggcuucuuuuauucaaauugguauuuuugggauucaucuauauguguguaucaauaguucaauuuuuaaaauucuaaguagguauuauauaaauauaacacaguuuguuuauuuaucuacuguuguugcacguuuggaucauuuccaguuuugagaucuaaugaauaaugcuaccauaaauauucuuguuacacgucuuuuugugagcauaauuugaauucuuaucuagacucuauuccauuggucuaaucuuauaguaguacaaaauuguuguaauuaucacagcuguauagaaaauuuugaaaccaagugguguaaguuuugcucauucuauguuacuugcauuuacguguaaauuuuagaaccugcucuucaauuuuacaaaacaccuguuuggauuuugauugaaauugcauggaaucuaguuugauuuagagaaaauagaugccuucuaauacauacacaugguaugucucaccauuuacuuaggucuuuauuaauuucucucagaagugauucggaguuuuuaguguagaagucuuuugcuaaauuuaucuacaaguauucuguuucuucauguuauuguaaauggaauguuaaaaaacuuaauuuucaaauuguugcuaguacagagaaauaaauuuuaguuuuuuauuauguccuuguauccuucuaucuuucuaaauucacuuauuucuaguacuuacuuaguauauuccuuaugaauuucgugugugcauuuuauuucauugucuugcuuuuuuggacuuguuugaacuuccaguacaauguuaaauagaagugaguacuuccuuccuguguaaucuuagaggggaaguguucaguauuucacuguuaagugugauguuaguucuaggguuuuuuguauauaugccuuuuuuuuauauugaggacauuucuuugccuaauuagcugagagguuucuuugugaauuuaucaaaugcuuuucuguguccuuugaaauagucaugguuuuuaucuuucauuuuguuaacacagugaauuacauuaauggauuuccaagucuuaaaccaaccuuacauuccugggauaaacccuuuuguaauguauuauccuuuuuauauguaucuaaauuuguuuugcuaauacuuugguaaagaauuuuaugucuguguucaugaggaauauuguucugugauuuucuuuaaugccuuugaaaaacguuaucaucgggguuaugcuagucacuuaaaagcauugggaaggauucccuucucugugucugaguuuauguuauuucuuccuuaaauauuugauaaaauucacuauugaaauuaccuggaccugagauuuccuuuuaugaagguuuugauaaugaauucaauuucuuucauagaaccaggauauucagauuuuauauuuauuuuuaggccaguuuugauaauuuguauuucucaugaaauuuguaucuuuuuucugauuugucaaauuuauugacaaaaagauguucaugauauuuccuuuuaaugcuuuuaugauuuguuguugauaacuuuuauuucauugcugguaauaauuuguauauuuucucuuuuuuuucgugguucaucuuaccaagaaguuaccaauuguauuaaucuuuuauagaaccagcuuuggcuuucuuauuuucucucuuauuugcuuucuauuucauuuauauuuauucuuauguuucuuauuuucuucuauuuacauuaaaucuauacauuucucacuaaucauuacuguagcuaaguuccacuaauuuuuuucuuucuuuuuauuuauguugaaauguuuucaaaucuaaauggucccauugcuguacuuguauaacagaccaccccaaauaauaauaguuuuguuauguucacaaauuuugugggcuaagaauucagaagggggauggugguuaugacuugaucuggggccucuccuaugggaaaacuugaagauugguaaugacucgucgugugauugccaggaacuggaaucaucugaaggcucacucacauauauggcauaaugcuggauauuaacugggaccugccuuuggucuuauuaccguaacaccuaugugagaccucaccauguaguaucuuggcagcauggaggcuggauuccaagagcaaaagugucuaaagagaaccagaccuaaagacuuaguguuaacaguaacauaguacucuucccucauuaguuaaaagacugcuuagaaucaagcagagaaaacacagacuucuguuucuuaaugaggugucagacagaguuacacuguaagaagggcaugugggauggaagguauuuuucuggccaguuauggaaaauuuaguucugggaccuauauaaccccaugggaccuaaauaacccauaaguucuggguccuaaauaacccaugaguuauuuagaaacauguuguuuccagauauuuggagcuauucuagauauucuuauuacuguugauaucuaguuucauuucauuauuauuagagaaaauauccuguaugauuuucuucuuuugauauucauugggaccuuuuuauggcuuugcauauggucuaucuuggugacuguuacugugcauuucugcgugucacguucuauaaauguuaaugguucaagguauuugaaagcauuacacaaauucuguauaugcuuagugauuauuuuucuaaguuguucuauuaguugccaagggauggguauuaaaaucucuagcuaugauuguagauuggucuguuucucccuuuaguucugucaguuuucucuuuauguauuuuuaggcuauauuauuaggugcauauucauguaguaauauugucuuuuuuauggcuacuuuuaucuauaaaauguuccuuuuuaauuugugguaauacucugaaguguacuguguuuaauaaaaauauaguauaucucagcuucccuaugcuuauuguuuacauggcacuucauuuuucauccuuuuacuuucuuuugauuagagcuguaugguaugucuuuuuccauucuuuugcuuuuaaccuaccuauaucauuguauuuaaaguggauuucuuauagacaacacguaguugggcuuuguuuucaucuuuaaccaaacugauaauuugucuucuaagugauuuguuuaagcaauuuacauuuaauguaacaauuaauaugcuugaauuuaggucuacugcuuuucauuccucuguuucccuuucacacuuucuauugaauuauucguuuuuuaauacaccauuuuacuuuauuuuuuuucugauugccauagggauuaugauauacauagcaaagcuuuuuuaccuacuuagaguucuuuguuguuuuuuuuuuccuuguaacuauauaggucccuuuauccccaucuuguguauguuauaguuuucauauguauuuugucugcauacauugaaaacuguaucaaacaagguuauaauuuuuguuuucaacagucaaccauauuuuaaacagcuuaagaggagaacaauaguuuauuguauauacucaguuguggucuauuacagcauauaaguguguuuugauuaaauugugaauuaccauuuugauuauaagguaucccuuuuccucaacuguauuuaauagauguuuuaaaucagcuaagguaggggcauagucaguaaaagucagcaauuaguuugcuguguugauuuagauggaaaauacugcuuuuuuuuuucacugugguaauuuggacucuuuaaaugaagugcccaauaaagauuuuuauuucuauaacaugcuuuagcuauauuuacaauuagagauuuucuuaguuuguguuuauuauuagaauuuccauuuaaaaauaauuuuuaacaagccauuuaugauuuauaugauaauauaguuucuuuugguguuuuaaaaaauucuaaaaguaauaagauuugcauagugccuauacuuuuagauucacuguuuuuccacacaaaguccauguuuguauuuuucaguaaauauguauucuaaaauaaacuaggcacuuuuuauuuaggcauaguaaaccaugaauuccucuuuacuccaucacuuagaauuccuaucugaagcaugauaguaggagagcccucuccugauaacaguauaucuguacuacaaguaugcuaguaaggaacccuacuaaaaacagcuauuuugaagaaauaauguacuucuuugguaaguauuagguauguuuaaauagguacuaguauggaaaaguuuucuuagauaugauuuuuuaaaaaagaaacaaaaauggacuguuuucuacaaaucacaguguagauuuuauaagaguuaaagucaaaauauauuuggagcaaaaauaaaauaauuuuagacauuguuauuucuggcuggcacaaauuauucccaaguggcacaaaugauuacugaaauuuauucagcaaauauuuagcaucuauucuaugucaggcuuuguucuuagcacuggguauguaucuguggaaagaaugaagucccugcucucaaugagcucauguagagacagaaaauaaaagggaaauuaaauguaauaauuucaaauagugauaaaugguauuaagacuggggauagagaguauauguguguguugcaggguaaaagggagguauacuuucaguuggagagucaaagaagcuccccugagaaggugacacuugagcugagaccuaaaugaacagucggagcccaccaugcagaaauguugcaaagagcccucuaaguaguggggauaucagaugcaaagccacucaacuaauaauaagcucguacuauuugaagaaaaggaagugacaaaugugacuggaaccuagugaagggugggagagagaagugguaugaaaugaggauaaagaggaagacuggugccaauuuguuaacuuaaagguuaugaaugaacuuucgauuuuaugacuuuaaggcaacacagaucaaaaacaacuugguaucaagcugaaugucaacuuuuuuuuuuuuuuaaccuuggacauuuuauucuagcuuaauauuuuaccaauguguaauggguugguugauugauuaacuuaggaaccacacagauguucuuugccaaacauauuuauuuauugugguaaugucugaggaguuuuauaccagcuaauaaagugauuuauuugaggaagaaggugaaugaguauaacauaugugauaguuuuuagcuguuuaaaaaacaaacuuuuauauuuuauuuaaauguuauucuaacauuuuaggagauuuauacauucuuguuuaugcuuucuuagcaagaaaguucuaaauuauuuuugucucguuaaauuuucucaauuacuccauuugaacagaauuuuaauuuucuuagcuaccacauuaguaacauacuuacauugggauucuacuucugcugagcaucuaucucuaauuaaggcauugucaaagaaaaaaguuaagugaaugccacuuuuuuccauuaauggcugaguucccagaaugauucacauuuuagccuaugauaucauccuuauuuaaguauuuagacagacaaauaaacacagaaauagcagaguaaaaugaaaagggaaguagaacaauucagaaggguaauaggcucauuugaauuuuaaagugaguguuguauuuuugauauuuugauuuagaacuucacugugauuuuagugacaguuugacuacaauuugagguuucauuuugucugacaaugacuauuuggaaagcaccuacucucauuuucagaguaaugaaaaugaguaacucaaaacuaguuaagaagcuaguuuugagaagggauucugggaggaggaagguuugaaugcuuucugccuucucuccccuucugauucuaauuuaucuaccuuucuagagccacacagcuucuggggucagaaggcauaugggguugugagauaauuuaugcuuauuggaguccuaguauagagguggugcaagauuuuaucuuuucugcagcaguugaaagccuggauaaagagcaaugaaggaaaagcucagucugcaaaaaucugcccuccucauagguuuaugucauaaaauguaauucucagacaauaaugcaauauuaauuagaauuccaaaaggauuuuuuaaggauaauuauuugaaaauaguuucaaguuuacuaaauuuuuugauaaauuuauuggauaaucaagaacaauagaugccugagaauagcuaggacaaguaugaaaacacagacuagaguaaugauaggagaggggaacuuaccuuacacaacuucaaaauaugcucuaaaaccacuauaauaugauuaacguuauauacuaacuuaauaauuaacuuaauagauacuaaauagaaacuaacuuaauagauaaagagauuaguggaacaaaauagagccuuucucaacuaaagcucuucagcugaaucacaagacauagaaaauuauuugagugacuguucccccgcccacugcauguaugauauagaacgagcaccauucuagauguauuagagggaagucaguucauuauauauagcauaugucuuacagaaaucaggguuagagagacuagauaaugcagaacuauaaaauauauggcaaagauaaaauuucacuguuugcugagaagggugucuuccuccuuuccucccuuucucucuccuucuuuuaauagcacaagcacaauugacuaucauaugggauaaaaugaauuugaauccuuagguuacuccauguaugaaauucccccaaaauucaaggcuuagguguaaaaaugaaaacaaaagucuuaaaagaaaaucugggcuacuauauauaaaaaauguauggauuggcaggagcuucuuaagcaaaucuagagacccagaaauuuaaauuuuuuuuuaaaaagacauuauaucaaauguagagucuuuuguccaguaaaaaaaaaaaaaaaaaaaacccuuaaguacauaauaacguaauaucaauauucaaaauagacuuggaagaaaauaccugaaauauaugcaacaaauauuugucaauaauagacaaaguacucuuuuaaacaagaaaaaaauugaaaugacaauaggaaaaaauaauagcaaaugacaucagucagcaauuccacuuauguggaguuuuagaacaggcaaaagaaaucaauguugauagucucacucaguaguugcuugggaagguuacgggaguugcucgugaaggggcaugauggaauuuuccaaggaaaaggaauguucuguaucauuguggagauggugguugcauuguaaaaaguaauugaacuauacaccuaaaauguguguaguucaauauaguuuauauauguaaauuauaccucaauaaaguugguuuuaaaacuucaauugauacucuuaaaugguaacauuuuaauguaugucagcaccuacugcuauuacugcugugggcaaaaggauauuuuccuaccuuuccuguagaaagguaaauuuuuacaacuuuuauggaagcaacuuugagacaucuauuaagacaaaaauuguaccuuuuaauccaaccuguuucuugacucuuuuccauaggaauaaaaguuccaguagauaaaaacacguaugcauauguuuaaugaagcauauuucuuaguggcuaaaagcuggguaccaaauuaauucccauuauuaggggaauggcugauuaaauugcagaauaugcuuaucauaggauauaauauagccauuaaaaggguaaguuagaacuguaacugaugaaaggauuuccaugagauauuguugaaggaaaaaagcaugaugcacauaauagaaucagauagacuacuuuauuuuugaaaagaaauagugugccaagaaauagccuguaaauaugcauauuuuaauuuauaagaauaacauugaaggauauauuucagaucauuuacacaguuuaccgaauguaaaggacaagaugugugagggaguuggagagaagaggaggaauguagagauggguaaaaaaugaauaagauugacaugaaaaacaucuaaacaauguauauauauauaaucucauauuuaaaaaauuuuauguaucugcauaaacuuagggaaaacauuuaaguuuuuauguacugacuuucagagguauucaucauauccauuuaaauuuuagaaaauguguuacaaaguaauguuuauaugauucuauuugaguaaauaaaagauccccguauaugaauuuuuguuaaauuuuagucaguucaacuuucuuguuuccagguuuuuuuuuuaguuucucugagaaacuuuccaaauauaaccuugacguucaagccccuuaaguggauguccauuuauuuuggggugguaugaucaauauugaaaaaugguguaauuuuguucccuuccagcaccacccacugguccuaaagauuguaugcaucccaaggccaaugacaauugaauauuucuagcuccuugaauaugcugagguucuacuuggguuuuucacuagagaagaaguacaaaagcauguucaggucucaccuguugucuuuuagccgucuauuuuuguuuuucaauuuagcugcacauuucaugcuuuuacuuuacuaacuuuggugggugacaguauacagcuaaauuugagauggcaaaguagaggagguauugguguggaaagaauccugugucuggguucaucaaagggaaauauuacuugucauugguuuagaguucuuucaaauuacuauaggcacuuuugucacuggcuauguuuucuuugccacucuguuucucaucauuacgugaggagaaagcagggcaugccaagggauaaggauuaucuucugugcaacucuuccguuuuucauauuuggaaaacauuuguucucuguguuuaucuaauauagcccccaucccucucuguguuugcccacagaaaucucuaagguuuuuuuuuguuccccuuucauuuacaucuaccaacauaauacuugaauacaggacccccuuuacuccauuacaguuuggaauaucuugauggugugugugccugugcacguauguguguguauuuuuuuuaaccaacauaguaucccagagcaugaauauacaaugaauggauuaagauucacugguacuguaacuguucucccucuuaaaagauggagggaguagguaaagaggauaugaacuggcauuaguagauuuuaauggauuagauacaaguaugggauaguuaauacaauauacaugagaguaguuuuaauaugcauuuaacuuauaaaacuuagaagaaauugaaaucauuuauucaaaacacuauuauuuugguaauuaaagcauccauuuucauauucccuuuuccuuucuuuuuuuuugggggggggcgguuguuaaacagaucauauacuccuaugaaaggaggaaucuccaauguaugguuugacagauuuaaaauaaccaaugacugcccagaacaccuugaaucaauugaugucaugugucaagugcuuacugauuugauugaugaagaaguaaaaaguggcaucaagaagaacaggauauuaauagguaagaccuuuaaauguugguaauuuaucacuguucacuuuugucuaauucuauacaucaaaucuuacuuggaacauuauuuagaagcacuuguauaucauucgaugcauucauaguuucagauaaacuuuacauauugaggauuucaaagauauuagaauuauaaacagcagcgcaugaaacuuuaauugauuuucuuuuugaauaauaacggauuuugagacucuuguggcaguuaaaauuuuucuucuaguuuaauuuucaguuaagaaauuauucauuucaauuuuuaaaacauuuuacuucaguuaccuuaacucuuaugaauauaaguuuaaacaucuauugccauuaagauauacagucaaaauauaccacuacauuuaugaaaauuauaaucuucagaguuaaucucacaagaauauuuguaaauuuuuguuagacugucuuuagcaagcccuguuccuaagggaauauaaguagcuuuauauaagcucuuuauucugcuuaauaccuuuuucuguuucuggacuuagcauauacauaaauuauuaaaaucuuuuucuaauacaugcaaaagugagauggggcauguagaauaugaaugguacacgacauauuuuggugaaaggguuuuauuuccaaauguaacuauuuaacuuacaaugaguuguauuuaaugaugaaauuaaaaagcaaauuaaguauccccauuauguucuaaauaacauuaaaaugcacauugaaauucuuuauagaugggauuuggguaaacuaauaaacuuucuuuguguuuauugaagugcugaacugucuguugagucaugagagacaacaugauauaauggauaaaauccauucuauucugucuuggcguuaguuuccacuuuguugaaagcagcguggccucuagcauaacaacaucaccuuucugguccuuaguuuccucauuauguuuaacucuauauuucuguguuuccauguuuaacguugauguuuaacucuaauagagauaaacauggagcauuaugggaggacuaggaagaguguagggaagggauucccaacuuagucuaggggauuaugaaguaguuagaagauagaauuccaaacaugugaaucauguaucauucagucaucauucaaucuuuagcaaguauuuuuuaaguccccacuaugugcuacgcauuauuauagauguucacggggaugugcagauaaguaaagcaagaucuaucugccuuacauauuucuuacaaccugaaagggccaaugagauucuuaaagugguaacuauaaugccagccaggcugugaugagugcucuaaugugguauaacuaauagcuuuucaaagccaaugauaguauauauuucuuuuuauuucccagaaccuaucacaaugccuggcacagagcaaauacucaggaaaucuauaacaaauaacauuacccaaucaauaaauugucaguacuguaggaauugagaggaagaaguagucacaugcauuuggggcuguaagagaaagauuuaauagaaagauggcaguggcauuuaagaugcacaaauuauuaaaauuuuaacuauuacaguguagaagucuagguagagggaaugauuuguacaguaaaguagaaguggacagaguaaugcuuuuuguuuuugucugucuggacaguaguuggcuguaacaaaguuugugucuaacuaaaaaguaccuguugacucagauagccacaguaagagacuagaacgugauggcauaauggugacaaaaaugaguucaaaucuacaguccaccacuuccuaguuggcucaccacuuauuaccuacacuuaauuuuugcuaccuaaucuguaaaguggaaauaauaauauaauaucuguuuacugagagaugaacaaacuauuugguuucuuccagacucucaguaaauacucuguucaguuuuuaauccuuuauuuuguagguauaauaacauguaauaauugguaaaggaucauuaaauaaugucuucaagucauaagaauuguacuuugaaaaacuaauuuggcagaagggguaaguaaaaggaugagaagucugacauggagaaaccaguauaauauaaugaaagucugaaguggugugguggcaauaggaaaagaaaagaucaggaugagaaauugcuuuaaaaaauaaaaguacauucuucauaagcaaaaaaauagauaaaaggagaaaauacucugaguaguacucuuaaugaguguguauugaagaguuuaucacacugaaugguaacugcuguccauuugucucuugccccauccucucucuuccuuucccagauccauuacuuuaucuaguucaucuuugaguacuagagauauuauggauuuucugcaguauauuacauuuuaaagaauccuaguacaacaaaaucaaaucuuuuaaaaauuuuaauuuuauuuuaaguuccaggauacaugugcaggacaugcagguuuguuacauagguaaacaugugucaugguguuuugcuauaccuauuaaccuaucaccuagguauuaagaccuguauucauuagcuguuuauccugaugcucucccucucaccgccucccugacaggccccaguguguguuauuugccucucuguguccauguguucucaugguucagcuuccaacaugcaguguuugguuuucuguuccuguguuaguuugcugaggauaauggcuuccagcuccauccuugucccugcaaaagacaugaucuuguuccuuuuuauggcugcauaguauucuaugguguacauguaccacauuuucuuuacccagucugucauugaugggcguuuggauugauucaugucugcuauugugaauacugcugcaguggacauaugugugcauguaucuuuauaauagaaugauuuauauuccuuuggguguauacccaguaaugaaauugcugggucagaugguauuuccgguucuaggucuuugaggaauugccacacugucuuccacaauccuugaacuaauuaacauuuucaucaacaguguaaaaguguuccuguuucuccacagccuugccagcauauuaaaaauucaaaauucaaaaauucuugaauuuuuaauaauugccacucagacugguaugaaauggcaucucauugugauuuugauuugcagcucucuaaugauaagugauguugagcuuuuuuucauguuuuuuggcugcauaaguguauucuuuugagaaaugucugaagagucauuuaugacaaacccacagccaguaucauacugaauggacaaaagcuguaaccauuccccuugaaauccagcucaagacaaagaugcucucucucaccacuucuauucaacauaguauugggaguucuggcuggggcaaucaggcaagaaaaagaaauaaaaaguguguucaaauaggaagagaagaagucaaacugugucuauuugcaaaugacaugauccaauaucuagaaaacucuaucguuucagccccaaagcuucuuaaguggauaagcaacuuaaggaaagucucaggauacaaaaucaauauguagaaaucacaagcauuccuauacaccaacaguaggcaagcagagagcuaaaucaugaaugaacucccaugcacaauugcuacaaagagaauaaaauacuuaggaauacaaaggacuuccucaaggagaacuacaaaccacugcucaaggaaauaagagaggacauaaacaaauggagaaacauucuaugcucauggauaggaagaaucaauaucaugaaaauggccauacuacccgaaguaauuuauagauucaaugcuaugcccauuaaacuaccauugacauucuucacagaauuagaaaaaacuacuuuaaaauuggaaccaaaaaagagcccauauagccaagauaguccuaagcaaaaaggacaaagguggaggcaucaugcuacccaacuucaaacuauacuacaaggcuacaguaaccaaacagcauggcacugguacaaaaacagacacauagaccaauggaacagaauagagaucucagaaauaagaccucacaucuacaaccaucugaucuucaacaaaucugacaaaaacaaacaguggggaaaggauucccuauuuaauaaauggugcugaguaaacuggcuagccauaugcagaaaauugaaacuggaccccuuacuuacaccuuauacaaaaacuaacucaagauggauuaaagacugaaauguaaaaccaaaaauuauaaaaacccuagaaguaaaucuaggcaauaccauucacaacauagacaugggcaaagauuuuaugaugaaaauuucaaaagcaauagcaacaaaagcagaaguugacagaugguaucuaauaaacuaaagcacuucugcacagcaaaagaagcugucaucagagugaacagacagccuacagaaugggagaaaauuuuugcgaucuauccaucugaccaaggucuaauauccagaaucuacaaggaacuuaaacaaauuuacaagaaaaagaaaaccccauuaaaaggugggcaaaguacaugaacagaugcuucucaaagcagaaacaaaucuuaaaugaaguuaaacacacauauaaaaacaguagcaggagagguuaccuguuugagcaccuauauuuucuuagagggaaucaugucuuaccagccagauugcccauaaaccucaaaaaaagucaccugggagaaaaauauaacacaagacuugauuuuucaaugucuguaagcccccucaaaccccaaacuuggggcucacugaaugaagauaauuuguuuuuccauuuucuucuugagaaaaagaugauuuuuaaaaaucagugccuuugauauauuuucaaaguccgacaaugugauugauuaaaucaagucucuuguugaauuuuucuaaugcuccaggguaguuuucugauugacagcauauacagaaguauuucagcauucauuguagaaaagcuagcagaaaugaccagucaauuauaggcaccaaaaaagaaaaaaaacuauuauuaaacauuuuaaguagaauagcuuauaauauaugcauauauguacauauuauauaugcuauauauaauccaguuuucaugggugauauaaaaacuaucagaaauguuuuuaaaguauaguuuagaauuaauuuugacauaaaaauuuacaguaauuaagauuuuaucaugauuacacauuugauauauuuuuucucauaauggaaaugaaauuacauaaguuauuaaacauuuaugaaaauaaauuuaacauucacuuaaauaucuauugcuguuucuuuuggguucuuccagaauaauuuuuucuuauucuuuaccuuaauuuuuaaggguauucaagaagaucuccauguuuauaaaaucuaaguuaaccauuucuccccuuuucauucugauguauaaguuuacagcccagaaauagguugcuaaagcuauguuuuaauauuacgugaaugcacaaaagaugguaaguaaaauuagaagugaacuaauuucagacauuuccuaugauauaguugguuaaguugaaaaaaagcuacguacauuuuuccugguucccauaccccaccaacacaaacuugagcuuuucaucaaauacagagguuguucuguuuguguuuuuaaaugcauuugucuacuuacacaugacauauaacuauucaaaguauauauaucauaauauauguggcaaccagaaggucuauacgugaacauaugaaugaugauuuaauuaagcaguucucuuccccauuuauuucucaauaccaaguaguaugcguacuccaaaguauggucauucagugaaaaaaagcauuuaguauuucuuucuguuaaugaguuggagguacuaauauauguaugugagucccucaguuacccugugcaagacaaauucuuuuagguaugauuagaauauccgaagauaaguuagaaacuccucuuuuguauauuuuuuaugaggugaaaugagauccuguacagacaagaaguauuauucuguucaugaauaaucaaccuuucaaucaauuuuaauauuauuuaaguguaugguaaaaaauuuuauaacacuucuuuuuaaaauggggaaaaauuguacaaguaagcaugaucaaaccucucuuaaagcugguuaauacugaucuuuuuuuuuuuuuggagacagagucucgcucuguggcccgcccaagcuggagugcaguggcaagaucucggcucacugcaaccuccaccuccuggguucaagcaauucuccugucucagccucccaaguagcugggacuacaggcacacgccaccacgcccggcuaauuuuuuuuuuucuuuuuuuuuuugagauggagucucacucugucgcccaggcuagagugcaguggcgugaucuuggcucacugcaagcuccgccuccuggguucacgccauucuccugccucagccuccugaguagcugggacuacaggcgccugccaccacgcccggcuaauuuuuuguauuuuuguggagacgggauuucaccguguugcccaggcuggucucgaauauuauugccuucaaguguccaagaaauuaaauuuaagguccaucugaaggaaaauagcaaauuucacuggccucacagagaaggagccaucaucuuucaucaagagaugagugccacacacauccauccccaggauauuagacaccuggacagcuagcugcuuccuuuguucacucagugagcccauuauccccacaccaccuagugagcaguugcuuugcauccuuccaucuguugaacaauguaacauggugccaaccauacagccucccaugacaguggaacauauauccugucccugaaacucuucuacaugcuucuggaauugguauagagcuucaugaugaauaagauggcuuagaucagccaaauaaauggugcuuaucucgagccaagaaaacagcuuuaccucuaugaccccauguauucuucacuaccauuuguagcuccaguacuucuguuucaucagucauuuuagcaaaauuuuuauagccaucauaagaaaaaguaucugacagaggaacaccauggccaaccaacucuugaaaugcccaccacuuauuagcacauuucaggaugguuugaggucaguucaucaacuggcauuccaucuucucuagauggugcaaaacauugauaucacccaaggguuggacugucacugccaccacgugggauaagcaguugauccguagaccugcuuuccuuguuggauuguugauaccacaucauccaucaccacaacccuuggccuucacagcauuuggccuucagugcucacaagaucucuuuuggggguaguguuccugaugccacgaucugucaaaaaccacaacucggcagccaaaagagcuacacaucuugaucugcuugcucuuccuugcuuggauuauuuccucuucaguauaaaguuuaucacuugauuauagaagauauuauaaagaagagaggaacagccaggugaagagauauauauggcaaggucuggaaggguccugaggacaggagcuucugucuccccggaguugccuccugguacaaggaagcaguccacuaaccuggaaucucuggauuuucuuaaggucugagagccaauaugaauuuugaaucuaacuuuauuucauuuuaaagccaacgauucuuacauuuagcugaacuuuuuuaagauucuuaauacguauuaucaaauuccugucacaaaaaaaguguaccaguugauacuuccaaccaucuuuagaagaauuagaaccuuauuacauugauuaauauggucuugaaaaaauuuuucucaaaauaaguacacaggaagugguaacuaauuuuaauuugugcuuaauuuguuauuuucaauuccauuauaguuugacauaaaaaaacuuuuaaaaucuuuuauaauuguuuugaaauaauuucugaguuuaaguuuucucauuagaacgugggugaauauaaaauaaauuuucuacugguuuuucuaguguugcuuuuuuuuuuacacugaauuauuugacucaucuggaguuuauuuuuguuucuuucuaccauauaauggaagacuauuuucugaaguaccaagagaaccuuguuaaaagacagucuuauuuauaauucuaaagcaccaguuauauggucaguauuuuguuaagccucuuuuggguuuaugagaauaaaauuucuuuuuggaagauauguugacuuaugaaauuauaaaaucuaagauuuauuaauuucauauuauaauauauaauauaccaaauuaaaguggggguaaaaacauuuuuugugagaugagcuaauuaaugucuauaaagccucuuuuuucuacauugagauacagaaagagaccacaaaagugcaaaggcagucauguuuguuuuuguuaacuguauaguucuuuaaccagccagugaaaauaaaucuucacuaaguuuuauggaauuauacacaugccacaaaacacacguuucuugaccucuuauacugugacaaaacauuagugcuauuaccccacuuuucauaugcuggauucuucacauacguuaguuauugauucauagagcaaauaauauucaagucuuuuguugcaguuuuuuguuguggugguuguuuaucuuagugaucuagcugaaccucucguauguauuuguuguuuaccuuagugaucuagcugaacuucucauguauguauucccugaguuagaaacaucauaauuacaaaugcccuuaagcugacaucauauaacauaguuaagaacuugggcucuagacucagagugcugaguucuaauccuauauuccucacuuuguagguguccagucuccuuauucucugugucuuggaugaugguaauaauaucuaccuuuuaaaguugugguaguugaacuagucaguucaugugaaauacaaaugugucugacauguaauguugaaaaaguuuucuugccauuauuacauacuucauaccacccauccuauggucaccuggauagcaaaaggccacacuggaacagugguaccacuuggagacuuacagguagcuuaguuguuucuucccuaccagcugcuuacuuuuuccucagugguauaugagcucugcuucccucuuucuuuuucauugcuccuagauuauuuaaacaagaguuacuguuuaguauuuuucuacuagcuuuuauacuuuuguacagugucuauuaggguacauuuaaguuguuaggucagauuuaagugcuauucauaacguuuuaaugaaggagggauucagugggaaauaaaagaaaaaugcauuugagauuccaaacaauuuuuauuaagcacacacaacccauagugaggaaugaaguuagguaauuuuuuuuugaaacagggucuugcuguguugcccaggcugaagugcaguggcgugaucauagcucacugcaaccuaaacuccuggacucagugauccuccugcaucagccucuugaauuguuaggaugauaggcacuugccaccaugccuggcuguuuuuuuuuuuguuugcuuguuuuauguagagauggagucucucuauguugcccaggcuggucucaaacuccugaccucaagugaucuucugcuucagucucccagaguguugguauuauaccugugaaccaccaugucuggcccaggcuagguuucuuuuaaaaaugaauuauaaugggaaaaacuagcaaaauguaagauuggaaaagaaauaugaaggggauagguucaaaaguuguuaaccuuuuauuuuguuuaauaaucuguucagauuucugauuuaauguaagacaguauguccuaaugggacccaaucucugagaguguaguuguguuuguguaacuuuauaaaacaaaacuacucucuguauuugauguagauaggagcccauucuuugcgguuuuauuugauuagugguacuuuguuauguugaacucaguuuuacaaacuuuuuuuuuuuuuuuacaguaugugaucuucuaccuuuucuagguagugugucuagcuuggacaggucaaaaaugauacuucucacuaaauuuuauuuucaaauugucaauaaaauguuaugugcuggaguauaaaagaaacugagaaauuuacagucuaguaaggcagagagggaaguaaaguauucuaauacuguacagguauuauugaagaacaaugucgaagguauagcguaagcagcaaggagagaaguaaaucuuucugggaguugggaacugcuuuguugaaguggcaacugagucuuaaagaauaauugagaaugugacugguaaacaaggacagaaacauguucaugaaagaaagcaagggacacauuaaauccuuccaggaaauaguuugguguacaucccaaauccuaguaucauugaauuauauacagggagugaaugaugugaucaaaugggcauuuuagaaagauuaugcugacaacucuggagggcugacuagucagugugaaggucagaaaaacagcaagaaagcaaaugcaauagaucuaguagaaugaugaagugcuaaacugacacacuauuuuaagacuucaggaauaccaggaugaguaaaacuacauuuaaaauuuuaaucaucugugggguuuagcuaugaaaauuuuuuguuuucuaagcuuucugcaauggauaugcacugcuuucuuaauagaaaaaauaguaaacuuuguuaagagagagagaacucagcaaaaggcucauuacaggggauguucaguuaaaggggguuccuuggagacauucauggauccucacucugcacauuaggaauauaagaaaaauguugauuuuuuaaaauuuauuuuuguauauuuauguuucauaugauucuaccagacauuaagauaaaacuuagggaaaacaggcaauagaauagugacuuuuaaauuacuuuucgaaaguuggcaguauagucauugacagaaccaggauucaaauucuguauucugagaaaauuauuaauaauagauuguccugccuucuucuggcuuuauuaacauauuaacaguguccagugugcagaauauaagcauuuuauugucaguacauucuccaucauuauuaaagccugucuugaacucuucauuuccuucuaguuuguuucugucuaagacaggaaacuggagaaagguauaucauuuuucccuuguguauuguugugcuuagaaaguacauaugguagagauagcuuuaaauuaauuggcaucuauauugcacuggauaguuuuaaaauugccauuacaugucaguguuuucuauuuagguaauguuuuaaguucugaaguuguuuuuauauacauuagaucuccugggucuugcaguagguaaaaguaaaguaggauauaauuauuuucauuucagaggugaagaaacuaaaauucaaaguguuccuggcuaauacagaguugggacuagaacccggguccccauaauaccuuccuuuauuggccacuagguggugauaauucguuguuaagagagaauacuguuauaauuuaggcuuaacuuagaucuaggauguauagaaccugacaaaugauaugaauagauuuaucagaauuuugauaauauaagcauauuaucagaauuuugaagcagagagaaucaagucuuucuggaacuacacuggaguaauuuacguggaugaucuaaauauccaucaugacaggaaugguugagggaaugauggccuauuaauagaauugaguauuauguaaccauuaaguacuacaugcacacacacauaaaaagcacucaguaggccgaggcggguggaucaugaggucaggagaucgagaccauccuggcuaacaaggugaaaccccgucucuacuacaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaacaaaaaaaacaaaagcacucaguaaguauguguucaauuaaaaauaauuauaaaauuuuguaauucuguagaaagacuuucaaauuaguauuacaugaaaaaaauaagauacauugaacauguagaguuaguuuaacuguaaaaaugaaauuuaagagaacaugucaaaauucuguacaguacaaaauauuguaaaauuuuguacaagaaacuuuuguacaagaaacauuuuguacaauggguguauauuaauuuugcaauaagauuaaaaauaaaaauaaaugaagggauaguuagaauucccaagaugaagucuagcaucaaaauuuccagccugccuuuuucugaacuuguacacguuuucucuauagcccagcugggagcuaaaacuucagaaugauagcauucuucuacuuucuuugaacauauauguauuuuaauuaaacauuuuauguuucuucaacaacuaguaggacuuuaaaggcucuggacuguuguucuaacaguuuuccauagaggaaaauaaauauuuuguuuaucccacaaguuuuguaugagaggagauauccaaauaaauguaauagucauaauuucuguauucccaaaucugaagaauaauuauaauaguauaccaguuaaauggaagagguguugaaauuuagaaugguaauggacuuuauugcauguuuaaaguucuuuucaguugauagcacacuuuaaguggauuuuuuuaaggauuuuacuuucagauugauuaucuuaauguuccuaauauagucuuuuuauagauuguuucuguuuuauuuuauauaaagaguucauaaagccagguuuauuauuuuuuaacauguuuuauucagcuuguuaaucuuaaguguauguugaaauguuaacucuugacauuuuaaauacuuugccagcaaccguaaauacccguuauaaccauuaccuacaauggauuuacuauuuucguauuuacuuauugaacaguagauuuuauaucauuuuuuagacucuuagguggaaaauugaauucaaauaacuaguucuuuguguuaaauuuucuucuguuaggaaaaaauacacaaagucccuuuucacaguaguguccuaugcuaaaggucauuguauugucaaagacggcuagugaggaguugcagauuaccucacaaaaucauaaaugggaaagggacuuagauuaaaucuuaaaauaauaauauuucaaugaguauauuuuucuucauuguaacuuaagagaauuaaacaugaaguuaaaugucugcaggaugcauuuauguguauucauaaugacauuuuaugugcggguaaauguuuucuuucucucuuuuuuuuuuuuuaaguuguuaccaucaaaagucucugaaacuacauaaagugauuacauucccuggucaacaaaaaugaaguguuugucacuucauauguaaaauuuucuugauaguuaugcuuuuaaaaucucuuuuuaauguaaguuuuugccuacuaaucuuuuauuuacauuuuaucuuuuaaugaucuuuaucuuagccucaaaauuaucuaugaaauacuaauuuuauuuuugcuucauuuauaaauuuugaagcuuuuuucaaucauucguacagcuuagauggucuagaacuaugguagccacuagcuacauguugcucuuuaguuaaauaaaauauagaauugguuccuuggucacacuaacauauuucaaauauuaauuaguuacauuuggcagacacauaauucaggcucuugaauuucucagaaaaaaauaauaaauuugcuccugcagccuuguuaucuaucgcguguggauuuucuuuaaauggugaccauauuuuaacuuuuuguuuuuacccauuuuacuuaauuuugaauuauuugccacacagcugugauucucagacaucugauuuauggcauaagagcuuuuaaaaauuagacauaugcagugagauuuuguuagugggucugggauugggucuaaaaucuuuauuuuuaagaggucagauuaggaaugaugggcuuggagcacacuaaucauucauuccuagauuuuguagguuuuuuuaagcuuuacuuuuauaucaaauuaaaucaccaaaaaccuacauuuucugaugauaaauuugucuccuugcagagauauuguuacugaguuacaguuacauuguucauuuguuuaauaaguauaagcacuuucugugugccaggcacuguuguaagcauagagggauacauugaugaauaaaacacaaaaaucccagcucccaucauuaaauucuagugaaaguuaagucuuuaugucccagaauuuuaugagaagaaucagcaacagaaguggcaguauguagaaugucugauuuugaauuuuauguuuaauaaagauccauuuaauaaauucuauuaaggaauucaaugcuaagaaaaauuucuaguaugacuuguuaugauuccuucuguuaaagaauauugccuugcuacagagaaacuguuaaaugcccaguugcacacguaauuacugcccccacccuaacaucauggucuguaagucucuuuuuuuauucucugugucucacucuuugcucaaaucccaucucuuccucucucacauucucuccuauuuuagagauguaguuuuauuauuaacaguguguuugauuuuaagcaaccugaaauuccuuuguaaguaaaugggcuguaaagaacagaggggaaauuggaagagaugaaggaagugaguguuugguaagcucuauucugugaacuuuuaggaaagcuagaauuguguucugagagauagggauucuuaaacugaaaguagauuucuguauuuacaguaacuguacauuuuaaaaguucucgcaauuuuaguuuuuauaacugauuaaguauuuguauuuaaaagguugguggaaaaucuagagauuaguccaucuaucuuguuuuacuauaaaugaaauccagcauuuuaaauaauuuacacaaagacauucagcuugggaguaucacaggcaggacuagaacuaguuuccuuaauguugucucuuugauaagcuuaagagauauuuguaaauuuuuuacuacuuucauuagaaacccauacgguuucuaaaaauucaguuaaauuuuuauugaguuacugcuaugugcaaagcacuauacuuaccacugagcguguaaaguugaaacugacucauuaguaugcgugcaccacagagacacuuuguucagcuaaucauaagcacucaaugaaaauaugauuauugaagaaaaacuguuucuuacccuuaaggguuucaaaaucucaauaauuuauauucaauaaauuaaaucgauaagaauuuuauuucaaaaugucuucgcuuuacaacccucaugauguuauuaaagagaaaacuucauaagcagagagaaaucuguaacuagaauuguggcaaaaaacaauaaaguugagauuuuuuucuguguacuuacaauaaauguuuaccagaaauacuaauuuguguauuuacguaagcuguucauaucuaaaugggacaugucaaagauuuauuaaugcacaaauucauggauaauguagcccaguggcuuuuaaccuuuuggagaaucuaauguacauuugcaaauuuuacauacaguguuaagaugcuuaugcuuuuuucucccccaccaagcucauuuaugaacuucuaauuagauguaucuacaucuggaguuauuggggguauuuugaaagagccuuucagguggcucuuguccauggugggcuacugcuacgauaagaacuuauuauuucuugcugguauguugaaaaucacagauaacuuuuauucauuauuuacauagugugccuuuuuuaaaaaaucuaaacuuugccagacugguaaucuucucucggguauuuguguucugaguccaaaauaauauuaccugccuauuccagauaaaguaguccuauuuuaauaaauaucaagggauaguagaaaguauauuaaacucuauugcaaaagauccgaauuccaaaauuacuauuaauaguuuuauauuuaaaauaauauguaccuaaucuugggccucaguucccuccauguauaaaagauuauuguaguaaauucaaauuuauggucucuuaagagcucagcuuuacacuuuguuaagugaaauaaagcagcagacuugaaauuaggagauuugaauucuacuucaaaguauauuuuuguauuucuaugaguguguggcuacaugauuuacauucuguauuuucucauggaauauaaugagaugucauuuagcuuucucucaagcuuaggaaugucacacugagucacugacuugucgucaggccuggaaucaccauucucucugcugccgucaccucauaacagcuaucuccauauucuguguuggauguguuuccuucucaaaguuccccugaacaggagggucuguguauuuuaaucugcauauauccagugacuggcauagaauugguacauuaaagagacaauaacaguuugacuaauuuuuuuuucaaacuuugguuuuaaaaacuacauauaggcauacauguuucauuuuuauuauaucaccauaaauuaguuuccaaaauaauauuguaauccaaaaauguguuaacuagcuccucaaauuuuuuuuaucauucuuaauucagaauucacuaagcaucuauuauauagcaaacaccagauacauaacuccuuauggagcucacagcuuagcaaguaagacaaaaaggugcaaauuauuaauugcguugcagugugaggguuucuguacguguaaacaaaauauaaguaaauauugagaauuuaaguaaugcuuguaauaugacucauuuugaauuacgauagauauuuuacuuggugaacaugauauauuuguuuaauccuggcuccuuguagagcacagcucucuuuaccaguggugacauagagggaacaggguuauuuauguuaucgcaggccuuugucugugaaacuuagaguagacgaaauuucuuuuuagcauucucuuuaaaggucuccagauauuuuaaaaauauggaaaauuguuauauaucauauccuaaauuauuauuuuauguauucuacuuuuaaguauguuuuuguuuuuaggaggauucucuaugggaggaugcauggcaauacauuuagcauauagaaaucaucaagauguggcaggaguauuugcucuuucuaguuuucugaauaaagcaucugcuguuuaccagguaaguuccagauuuaaaaaaaaaugaaaaaaauaugaaauauauacauguuaaaacuaaagcaaaaucgguaauaaagcuguaaaacacacacacaguugaugcacaguugauauggauugaccauuccuggaauucauggccaaaugagucguagugauuaaauuccagcugaucauuaauguuuuggaaauccccuguacaagaaauauuguuaagcaaaaugucaaggaggaaaggauaaucaugugugugguugugggggagcauauauguaaauuuuauacauauuaaaacugcaugaugguuauagcuggguuugcuuauugcaucaugaacauaaaacaaaaaucaauuacauagcacauacuuauuaugcagcaauauccucaucuaugaauaugaugcagcuucaauuauaauguuacagcuucaguaccagaaguggaaauguuaaagcagauacagaauagagaacuaaaauguaauuguccccuugauugugccuuagcuguguacuccucccuccuuccacauugugugaagaggucugucuucccaagucacuuaguuucuuuaggaaaugcuuuggccauuuuuaagacguccucuauagaauaaauguaagugacacacaguuacaaauugagugaugccaggaaccagcuaaguccccaggccuggcccaccaauguauaccucagacagcacucccucugccuuuuuuuucccauuaguuauugaagccuugguaaaauuggaauuuuccuguucucucugauuucuaagaaugaucuuaaauggaauuucuuaaacuuuucugucuuuguaucuucuucucuaggcucuucagaagaguaaugguguacuuccugaauuauuucagugucaugguacugcagaugaguuaguucuucauucuugggcagaagagacaaacucaauguuaaaaucucuaggagugaccacgaaguuucauaguuuuccaaauguuuaccaugagcuaagcaaaacugaguuagacauauugaaguuauggauucuuacaaagcugccaggagaaauggaaaaacaaaaaugaaugaaucaagagugauuuguuaauguaaguguaaugucuuugugaaaagugauuuuuacugccaaauuauaaugauaauuaaaauauuaagaaauaacacuuuccugacuuuuuuauuauuaaaaugcuuaucacuguagacaguagcuaaucuuauuaaugaaaaacaauagacaaacaucugugcauaauuuuucagacacaauucuguaaauauuuggaaaccuuuuaaguauuuaaacuuuuaaauuuuugaaauaaaguauucuaaacuaauauaaauaaggacaaugaaaaaacaugaaaggacuuagcauaauguuauuuuaucuuuucuacaacuuuguuuaaauuaccuuuccaaagauauuuguguuuauguaauuuuccacggaauaacauuaauacucuagguuuauaaaccgguuucacauuauuucauuugaucaucacaagagcuuugugaaguaagccgagaaguuguuacugguauuuaauaauagcaauagaggaguuaaagacuuucccacagcuugcaggucaagacaagaaauucaggucuccuaauucucaguggagcucuauuucuguuaacccaaauugcugcucuguuuuaggucucaauuucaucuguaaaaugauacuaauaguacuuaucccauuggauuuuuguugagauuuaaauaaauagccaaaagccaauacauaauaaacacucaauaaagauuaaccauaaggagagucaugaucugguuccaggaauacauuguuagaugacugaaaaauuguauuacuucaaugaaaauacuauaaauaauaacauuuucauauauuaguugguucucaugcauacauaaucuaauuuuauuugauccucacaacuguuuaaguuuuauuaaauauacauuaucccuauuuguauaaauagaaucauacaauaccugccugcuuucauucaacaaaauuaucaugagauuuuuccauguuguguacaucaauaguucaucuauuuuauugcucaguaauauuccauuguguggauguaucacuauuuguuuacacauucaccacugauauauaaguugcuuccagugugaggcuguuuuaaauaaagcugcuauga

SEQ ID NO: 13010 - RNA, 414 nt, Homo sapiens
uuguaaaagaaaaaaaacaaaacaagagaaggcaugauuauaccucagcaaugauugaaaauccaaguucaauaaauaacuauaggaaucucaucucugcugcucuuuggagaggugggaaagggcuugccuccaacccccauguccauucuuguaggcaauuugacaugcacaagcgcacuuucccuuaagcccccacaauucacaugugcuguagguagggcaugaaagugaugacuuauaacaacugagaagaugacaaauuucucucagcuguauaggcggacauuauucagagaauuaaagagccgaaagagugcuaggcccaagacaguccaauguugagcugggccauaaaaccuggauacaugucuuccucaugaauuugccaagugucaaaguucguuuuuuaaa

SEQ ID NO: 13011 - RNA, 1167 nt, Homo sapiens
guagcuaaagaagaauaguugaagagaauggcaggugaccagcacauucuguuagaaaauccaaguugauuguagcccuuuacagugauguaagaacccaguaccuaagucuuccggcuaagaaauuaucacgaauggucuuuggaugucaaauuggaaauauucauaucugagcaagaugaaaguuucugagagaauaaucaaacacaacuggaaaauaccauaccacaaacuuggugucgugaugacuuuacaaucuuuuauaacuauaaaccauuuaacguucuucaauaaaagcuuggaaaaggccaaauagcaugcaauuuucuuuggcagaaaaaaaaaagccugauuuaagcacagcgaaaagguuuguauggguucaaaaggagugacaaagacacugcuuuugcugucauuggccugcuuucaacuuuuauguccaaaacaaaugaaucuggauggaaguaguuaaaacagcaaagugagcuaguucaauucuuuuaaagauauuauugcuacacuauccucccccauuuguaaucugugucaggagauagagaccacuucaacucaaugagucacuucaacuuccuagccagaacaauuaaaauucuuguauaaaacaagaccugaagccugcccuucaccacaucaccucaccucaaaaaggcccaagggucacaucugacauuuaacagcucacaaauucaauuuuguaacuaaugaagccaacuuaaugcuuuuacaaaugaauacuggguuauugcaaauuuucuucuucaacauuuggguaauauauaaaauguauugucaguucaacugccagccugaauaacauuauauaugccucuucaucaugauggcaugauggagauagcauuuguaagccagugguagggagaauuagaagaggauaagacagucuuccaucccucacucuccuuucuccaugcacagacccccccaaggaaagaaaguaaggaagaggaagccucaacaaauacagcccagaaacacagauguacaguuugucuagcuaguacuccugcugacuagaugaagacggcacuagccucaaggauuaacugcacugcccuacaaguuacugaaacaguuaaugcaauuugcagauuugcgucuucuuuauugcuagcagcugagcag

SEQ ID NO: 13012 - RNA, 1659 nt, Homo sapiens
ugcaaaauuauacauuaaugaauuuaacaguaugaaguuuuaagacauaccacagcuuuccucuagguggcaugauuucagcuaucauugagucaacugauaaaaauccuuuuucccuacaagcacacgaguauguaguuucugaacaaucaguauaagugugacauugauuagauuuaauuguuacaacugguuaaauaaccagauugaccuuauaauagucuauuguuuaaugaucuuaaguaacuuaaaauuguaagacaaaguccucuuaaagaaacagauacaaaaaacuuguuaccuccaauaacccagcaggcaaaauuauuugucucuucaggucacaaugacacacccauuucuggauuuauuucuuuggcauauauuuauuucuuaugguagauagugcuauuugcuuggaacaguaaugauacugccuuuuuacuuaaaaggacucauauagauguaacaaaucuaaagagaaaccacaaaugguaggauucuugaucacaaaaauuuucacguuaacaggaaacagccccuucaauuaugugaaaguaacuuuccuggugucccugguuuuaugaagcaguuacugugugcuaaacaagaaggaucaacaugugaaaagucauuauuaugugaccugcaagcaucaaacaacaaacagaaacacuguucuuuuuuuuucuguacuggcacuaaaaugggaaggggggccaaacucguuuuuaccuuugggauucuuuuucuguuguugauuuucaaaaauuuaaaaaugaauuucucuggcuauacaaagaauacauaaaaugcuuguuaaucccauuauuguuguauuuaucuucuccuaccuuucucugugggagacugcuuucauggagcucaaaagaacuugaccaagcaccucucggggguucauuuuuguggcagugcagguuuauauuaaugcuaaaauugugcaaguagcauuuucaaaauguaucucugauggugauuuuuagaauaugcugcauaggcaaaggaaaaaaaaggucuuggaaguaugcaaaauauaauaucaccacuguaaccgaaaaaaggugaaagacuaacagauguauucuuacagauuuaaaguggcuucauuuuaaauaagguaauuaucugggagaguccugauuuaccccuguugucuuaguguaucaaugaguggcauccucuuuacugcaaaaaauguuuggauuugugugacaaaugauguagcuacccuaguuaugagaacuuuauuuucuacuaagauuucaaauaaucaucagugagaguuuguggucuguagucucccguuuuauaaauuauaaccaucuauauagcugugcuuuucaaaauacuuacauacuuaggcuuuuaaaaauacuuauuuacuaauuuuucccucuaucauaaacuacacugagguuuucuuuuuuuaugcaauuacuauugacccuugguuuuuauuuauuuauuuuuuuuuuaauugcaggcuaaucgaggcagcagaacggcauauuuguuugaaauguagguugguaauuuuggcaguggaaauuuagacauuuggaauuuuacccaaucuaugaagcccacugagaugaugacagacacauaaauucauuuaaagaccauguaucuuuaaaa

SEQ ID NO: 13013 - RNA, 1254 nt, Homo sapiens
acuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacagga

SEQ ID NO: 13014 - RNA, 1066 nt, Homo sapiens
ggccuuuacgugggaggcggggugggcguguguguuucauaaagaauaaaacuguacggggcugggcggagcagggggugaggagggggaaaagcgcgugcccgagcuggcccuagagggcugccccgcgcgcugggggaggggacgaggugcguccagauggagaccuuuccuuucgcaguagcucugaccugggaaugaggacgcagugcccaggaagccuggccauuuggcaccaucccucugcggugcggggacagaucucucuuaaucaaaaucucagaaccgcccugggcggaaagcggggaaaggagaggaaggagaggcugggacuagccggaaauagagucagggucaggucccugaauuccagguaaacugggcgcugcggcaccuuuuuccagcggcugcggccaggacucgcuugcugugagagcaaaggugcaagcggaucgcggcggucgguccacaggccuugaccuuguccucuuuuucuaaaugccagagccgcagacuaugcgguuuuagaaaucaaacgucaaggggacgggaccacagcaggcuggcgagguuccucgagccucagcccggagcaagagaaacguagccgcgccaaacacgcggggaagagcugugcgcucggagccgcagccaggcgcucuuucucucaggcgcgcagcggcuggcuggaaacucgcgcacggcgggucaaagugcccuuucccgccugagcugagguacacuuuuggggguacgggguguggagaaaguugugacugaaaauaaccucgggucuuggauccaugaggccgaaaaugagaggccagagcggggguagggaggaauuaagaacaaguaaguggagaccgcuggcuucgcuucucuggcgcgcagggcccugugcccucacugcgcgcaucgagaucaacuucuuaggcaccaccaguuucuccuuccucuguagaugucgcaguuagaguccccuuuuggccacauucccccaaaagugcccaggcggucuuugcggauagauuagcagggagagaagauccagcgccagucugug

SEQ ID NO: 13015 - RNA, 4256 nt, Homo sapiens
guuaaguaaaaggcuacugggaaagaugucaaugaauuacuuaguaaugcacccuacccucacaguuggguaaugauugcucuucccagaaacuagagcuaaaccacagcucuggaauuugccaucaggagagugggaucuuccacuggcugcccuuaaccauuucuuccuuugaugcuauuuugauuuuaguggaauccugccagcagaagcugaacugauguacaucaaugaaguugaacguuuggauggauuuggacaggaaaucuucccuguaaagguaauaugcugugcccugugcuggcuuuaaccuucucagaccgguacuggcauuuggaaaaccauuguugauagcagugggccagaauggcuuggccuucuuuuugcuaugcagccuuaguuggcaaguccaauuuauuauagauaaacaaaugcuuuuucuuaaccaagacguuuugaaguuugccaugguccucagcagaauaguucaauaagacaguccaucuaagugaguaccaagcaucagccaauccggcaccuuggagguaucaaggcugauauccagccuuauaacaggacaaguagccaaugucauguguaacauuaaugaagacucuagucaguaguuuucuuauucucuuuuucucuucauugagccaauacagggauaaucguuugugagguagaaugaaacguuucuuguauacaaucaugcuuuauuucuccagcuuuauagggcccuccccuguggguuccuagccccuuugguguuuuauggaagcuaugccucggaaacugcuauagcacaucacauccuuugcagcacauccaccuccugaagugggugugguugggggggucauggaucauagucauuuauagagcugagcccaucauccaaacucauuuuccacucucuguugaccaacuuuacaaaaaauggagauuuaucagaaaccuaaagcaacuggcacauuucagcaauuugggagaugccugcaauuucagcacaaacauuucacuccagacuagcuccacuggcuguuuuauaaguguucaguucccccucuguugcacguuugcaauuugccuuaaugagaacugcccaugugcaucaaguagaaucgagcaggguggccgcagcuuucagaaagggcuaaauggcucuuuuuuagauuuguuuaauuuucuuuugcuucucuaauagcugcccuucauaggguuguaauccauuuuccuugccauaaugccuuaugaagccaucugcaucccacuuacauuucugcagcccauauauagucauauuuugggucauugaaaaaucagaguaaacuuuucucugcuucuagaaaacugacuucucaaucucuggaaguuggagguuuuguuguggcaauuugcuuguguuguuuuuuaauguggacugcgagaaacaggggcaguugaggucauguugaaaucugcugugguugguucugaugugcuuucuaguauguucuuucuuuagugggaccaacaggguuauaauaccuuccucugaguuggaagauaggcgcuucugacuuauugccaagcucggguaacugagcuggacugccucuuuuucuucucuuuccccccacauaugugugcauaucuaaggugaccaccuauagaccgcaugauuccuggugacucaaggaugagggugggagcaacaguaccaguggggggugguaauguggucagcucugcaauaagugaaaaagcagacaagaaaauaugcagggaaagacugugaguaggacuggagucucuuuugauugguacagguucuuauugacaaaaagcaugucaugauauauccuaggaaaaauacuugaauuuagcaugaacuuuuccgugagugguuccucaaaaauuuucaagaguagaacagcaguggacuggcagaugcagauguuguacaggaagaagaacccccugcucaaaauacuauccagugagccucaggauauauuuuuuuuuaaauuuugcuuccuugaaggaguaagauacuuacaaaaagaugcaucuagaaaacaaaaauaaacucugaaauuuaaaaugugauaucagaaguguacaaccuaauagacagguuagaagauaaaacugagaaagucucaccaaaaaacaaaguaaugguaagucggggacaggagauaaaagaauuagaggaccuguccaggauguccaauauuugaauaaugggaguucuaaaaagagugaacaagggaaacaaaagguaauuauucgagaaaauaucccugcacugaagaaugggaguuucugcacugaaagggccagagaugguagcugcaaagagacacaucgagagcuuuaagaggugaaaguuuuggccucugugcagaggaagugguagggacaggucuccucuuggcuuccuuuaaacaagcccugaagaauauucaacucuucaaauuauugcauguauaacgauuuaaaaaacaaaaacuuugguaagguugaaaaauaaaagacaucaauagauguucaugaaagagaaaauccaaaugccaaugaaucugagaaaauccagagauugucucuuaaacuggacauguguugugacaaauugagaaaaaaggaaaaaaauaucuaucucucuaucuauauaguccacuaggauguguggugggugaguuccuguaggaccugaccccgccgacacagcuggucaccuuauugcugugauguugucuaugauuuauucuacucaugggugagaaaugggaugugaugccuguggguuuugaaauaacguguauauuguggaguggcuaaaucaaaccaguuaacauaugcguuacuucacauauuucuuugugguuagaacacuuaaaauuuacuccuuuaggccgggcacgguggcucacgccuguaaucccagcacuuugggaguccgaggcggguggaucacgaggucaagagaucgagaccauccuggccaacauggugaaacccugucucuacuaaaaauauaaaaauuagccaggugugguggcaugcaccuguagucccagccacucaggaggcugaggcaggagaaucgcuugaaccugcugggagguggagguugcaguuagccgggaucacgccacugcaccccagccuggcaacagagugagacuacgucucaaaaaaaaaaaaaauuuacucuuuuagugauuucaagaauacaguacauuguugccgggcacaguggcucacaccuguaaucccaacacuuugggaggccgaggauggaggaucacuagccugggcagcauagcaagacccugucuguaaaaaaaaaaaaaaaaaaaaaaauuagcagggcaugguggugcaugcuuguagucccagcuacuugggagacuaagguaggaggauugucugagcccaggaggucaaggcugcagugagccaaaauugugccacugcucuccacccugggcaacagugagaccuuguuucaaaacaaacaaacaacaacaaacaccaauauauuguuacuaacuaugcuauggucacaaugauaccuugaacuuaguccuccugucuaacaaggcuugauuuccuuugaccaucaucuccccauuccucccauucuccagccucugguaaccaccauuauacucuauccuucuaugaguucaguuuuuuagauuccauguguaagugagaacacguguuauuugcuuucuguaccuggcuuauuucauuuagcauuguguucuccaauuccaucuguauuguggcaaaugccaauuuuauucuguuuuaaggcugaaugguacucccuuguacacacauguaccacguuuucuuuauccauucaucuguggauggacacucaggucgauuccauaucuuagcuauugugaauaauguugcagugaacaugggucaucacaaguaucuuuuguuggucuuacccaggacaaucauggaaacuguguacaccuuggcauuuucuuuauggggauuuucgugaggaacagaauuggaagacaagcgguaauauacagguagucuuauuuguuuguuuuucuuuuuucuuuuuuaccuugaggaacuguaauguuaauguuacauuaacauccaaaugaguuaagagccaaacuguggauaagauuugacuucucucagcucauauaaggugagcccucugcaggauuuaagcaguuaaauucaucucacuuuucguagaaacccaucccaccugauuccag

SEQ ID NO: 13016 - RNA, 279 nt, Homo sapiens
uagauaccccauguuuccccaucacucgaggagucugggcagagacuggacuacaccgugggagaaucugcaaagguguugcuggaacagacauauuucuaguuguaugagguggccuggacauuacucucgagcuccuuacccauacuucaguaguaggcauuuuucacuaaauuggagaccacccuguuuguuugagucuagaacucaguuccaguacuguaacuggagaccugacaaccugagccagacaucuuugauucaucucucuaguuacgu

SEQ ID NO: 13017 - RNA, 41545 nt, Homo sapiens
ccccucuuuguugcgguggccaauagacgcauucggaacaucggcggcugcccgggugacuugguuauaugucacagaauaacauucgagaaugggacauggaaugaggcgacggccccagcaagccccagcagccccagccccagccccaggcccagcagcagcagcagcagccccugcucucccgccgcccggagaggcucugcagccaugaagccaaccgucccgagguaggaucuuggagcugccgcgcgcccuuccugcgcgccgcccgccugcagccagucccucccggugauaggcgcuggaacucggggaaaagggggcggauggagcucuuuccacuagauccccgccgggguccgggagggcuuccuggaagaaagcgggccgccuugcaagccaaggcugcugcagcgcccucgcgccagcucugggcgcucacaugccagcacguucguggcuccccuccucucuuggccacaucugaggacccaggaauguguggagccuugcgggaaccuccuguuccuucaugcuacacaagcugucuuucuucuccccacaucuugcgcuccgcaucccccaagcuccuugugccccuccauccccaaccccccggguuuaggugugugugaagcuucguggcacauuuugagcugccuuucuagguaaucgcagggcuggaagcccgucaucgauucucagggaggcugucagcgugcaggggggagcggggagugucguggagacacuccgggaccccucacucgguuccgcugugcguccacuuagcuguggugucagcugugucuccgcugauuucaggcaccgccgguaagcagggagccuccgcggagcucccgccgccgcucccccuuggugaguccugccgcagcgagaggcauggagaaggccgcccccgcggggcgcugauccccucgccgcgcccgcgcgcacacgccccccgccgccgccgccgcugccgccgccgcgcgcccccaguaccucgcuccccgcccaggccccaccaugaccggcuccgcggccgacacucaccgcugcccccaccccaaaggcgccaaaggcacccggucccggagcagccacgcgcggcccgugagccucgccaccagcgggggcucagaggaggaggacaaagacggcggggugcuguuccacgucaacaagagcggcuuccccaucgacagccacaccugggagcgcauguggaugcacguggccaaggugcacccuaaggggggagaaauggugggcgccaucaggaacgccgccuucuuggcaaaggucaguggcuuccagggcggaguuggggggcuggggguagguaggcagcgaugggaccguuucagccuauacauagcaaacacaggcaaucuccauuuuccuaguccugcuacaaacucccuuccucuccccauuccuuccugccagcccuuuucuaauugagauauuuagauuggaagccuaagaaauggggaagggagagguagcgggcuugcuauccugggacuguguaauuggauugugccaaggugucuuugaagcuccagccaaacucuauuauuuacucacccccacauacauccuccuucagcaaaagcuagagccaccagguaccagcgaugccaaagaaugcacagaccccagggaucccacccugcuuguucucuuuggagugucuugcuccuccucugcuccccucuucccccagcaaaugauuuauuaagcugugaaugaauuugaaaucaaccagucagacuucucagugugaauaauuuccagacuuuuugccaguuuuuuuucuuuucuuucugguuuuuuugugugugugugugugacagugacuuucaccucugaaacuugcaaaacggugaacucucucucucucuucccagcuuauuugugcuccaagaaaaaagaaagacuuuuggcugagacuuaaaagggacuuuccaguacacaugaugaauuagucucacuggauagaaaaagaggaugaggagugaaacucucuuuuugccuuggagagaagccagugagccauuuggguuugguggcuaaggauaucuuuaccgagggagggagauguacccuggugggaguagauacguuauaugaaacaucaaaaugcaaacuggggagaaaugcugccgagccucgggguuauagcguggcggaugguuuccccuggacccuggggacgcugguacggcugagaagauuccugggcaggucuaggaaugccagacuugagacccggaaggccaucugguugauuccccagccuggugacagcugagcaucugagccugcaggccagaaagcuguguguguccuuggagaagugacagagccucuaaacuuccugcugcagucaguuacaguguucuauuacucugcuggucaaggagaucuucauugugcccaacuagaaucuugccugcuuuagugucaaccauaauuacccuugcugaguucuugaauaugagaacaaccuuuguuccugguuugcaguucugacuugagaauuuuuccuccagugaggagccgagagcccuuaaacuuggaagaaaagugaccacaaggaaaaaaacgccuguuccuacugucccaugcugccuuucuuaguagcacccguaccaacccugccucuaauugugcuuuuauccuuccuccaaccauguaugcgggugcgcgggggggggugcauucucuaugugggaaucauggaauuuugcuguuuguagagaccagucucccaccucucaacagaauccccuccucuuucugaagaccucuugggaauggggagcuugcugcuucccagggcagcugaucuuaggccuggccagagucgauuguuaggaagcucuuagaccaaccauaaauccuccucgcagcacccucccacccgcaaaucacauuucaucacugauuguuguguuccucuugccuuuugaaucagggcagagcauugucaacuuccuuugcuacucacagcacccuugaauguuaugagagagugcucuuaggauggaagggacuuggaguaaaaaucaaggaacugaauccuagucuugguuguaugacaucuagccuugugccucacuuaagugaggucauucacuuaaaaucucuguccuuaguuuucucaucuauaaaaugggaauagaccagacuuuguaaguucuuuccagcucuaaaaucucaugauguuaugacccgugagucuccaggucacuaaugcugaucugugugaugcuagaggucugcuagacuaugagcccucaggacugugacuuuuucuaucauucugcuucugcuucuuccuuuggccuucuuuguccacagauagcuccuuuugcccuuuuucuuuucuuuuuucuuauuuuggagacaaggccuuccucugucacccaggcuggagugcagugugugaucauggcucacggcagccucaaccucccaggcucaagcaauccucccaccucagccuccugaguguagcugggacuacagacacguaccacccaaccuggcuaacuuaaaaaaaaauuuuguagagacaagcucucaccguguugcccagacuggucucaaacuucuaggcucgagcgauucucccucacuggcuucccaaaguggugggauuacaggugugagccaccgcaucuggccuuuugcccuuucuuauaugucauagcucccagaccaacucacccuccuccuucugagacaauuccuaguuugucaguagucauuugcaagcacauaugaaacacaggcuucuaaaucaugucugagcaguuuagaacacagacugcuacuuccugagaccuguaccugauuuuuccauuauuguagcugaaugcuguguucuuaagaaaguguuaccuuuucuuuugagauggagucuugcucugucacccaggcuggagugcaguggugcgaucucgguucacugcaaccuccaccucccggguucaagcaauucuccugccucagccuccugaguagcugggauuacaggcacaugucaccaugcccagcuauuuuuuguauuuuuaguaagauggaguuucaccauauuggucaggcuggucucgaacucaugaccucaugaucugcccaccucggccucccaaaguaccgggauuacaagugugagccacugcgcccagcuggucuucccuuuuuuacacaguggccacaucauauuguacuuuucauaguaacuagaagguuacgcgaaaacugcuuccaagccaggaauccccagcccaaauguggacagucagcuuuuuggcccuaaauauaaagaacuuaacauuucucucacauugcaucuuaaugguugguucucuauccccaguccuaucaugguaucuccccugguccugacauuccccaagcccugaccccugccuaggccuuaacaugggaagagccucaaaagcucccuuuuccaggggccacuccucucggauuagaggguuguuucugugcucagcauggcagacucuuuccucuggggucaaguccuuuucuccaucaaccaaaucaauaucuuacugaggaauuuguacagaagaagggugguaggguggcggcggugguaaaagcuuggcaggcuucagggggauuaaccauuuuuggccauugaauguagacuaagaagcaaaagaaguagaugggggagguuuucaagggccugcauggaggacuaaaugacacuucauuugacuacaggacauucccuuagcagccaugguaacuucugccugaagguccagauauccccaucuugcagggauuccccugcuuugagauccuccuucuaaauuugugacugcaggccucuccccuggagguuguugagucugaaguuagcaguugacgaggucaaaggcaggauuuuucagaaagacuuuaaggaaacagcaagagucaguuggaggauaauagcagaugggaagcgaggcucagagagaguggccagcccagaagaaaacagugggcauucuaggaaaauucuaggacaauccuccuguuucuuaacagcuuggaacuggacucuccuuggggcagaaaaccaggauggauucagcaagaaacagcagucgguuucuugcagaccucacuucuugugccuuauucucgaguugauucccaauuggaaaauaauucacauuuagaggaccgagcuucaccugagugaagacacgggaguguuugguacuagagaccuggcugcagucaagggcugucccugcccgcugccaccucuugcaggcaucuccuuuccucccccauccuggauugagaaccuuccgucugucugucuguccugcaccucugucccaggcccuucacagguuccuggcugccucuguugcaggagccuggggcucauucugggcucaugggugcuguuuugugcuucucuucccaagcugccaaagaagauucuucugccuggugccugcauaguguuuucagaguagggaugacaaaagguuuugaauuccccuugcucuuguuaaagauuccuagugccugggguucuugcugccucucugguuccuuuccuggucuuucccuucucugccacacggcaguucaguuacacaacuguccauccguaucacuucccuugcguucuucccacaggucaguugugcuucacaagaacagaguggaagagaggcugcucacaagagccuugccugugguuuguuucauuguucuuucucuugaacaccaucuuucuguccacuccacucccuccuccugcccccuagcccucaaguuuucuggggcccccaccccuagaaaacaggcacagugccugugugaagagguugguuucgaucuguuuccucuagauugugccuucaucagccuggccacggcuguggggcuaacguaggcagcagguggugagaccguugaggggaagggcuacagaaagacaaaguuggaguuucagguaguacagcaauugaugaaaucuggcaggaaaauagcaugaggagggaccccagucacgaacagaaaaaagggauaugcccugggcuuuucuugaaaagguugcaccaauuuauguuugccucgauccuguaggagagcauccuuaccagcauuggguaucuguauuucagcauguuuuugcuaauuggagaggugaaaaaugacauuuugcaguggguuuaauuugcauuucuuauauuauuagagcacuuaaacaauuuuuucaaguauuugguuauuauuugcuuuucuucuuuugugaauugucuuuucguggcucuuaaaauuguggagagagagauauauauaugauacaguuuaccauuuucaccguuuuuaaguguacaacucuguggcauugaguaccuucacacuguugugcagccaucaccaccauccaucuccagacguuuuucaucuuccuaacugaaaccuuguauccauuccacacuaacuuuccauuucccucucuccccagccccuggcaacgaccauucuacuuugugucucuaugacuuugacuacucugggaaccuuauauaagaggaauuauucaauauuuguccuuuugugauuggcuuacuucauuuagcaaaaugucaucaagguucaucuaugugauagcaugugucaaaacgucuuuccuuuuaaaggcugaaucguguuccacuguauaccaucguauauuccguggugcgccacauuuuguuuauucauucaucugucaauggacacuuggguugcuuccaccuuugggggccauuuuuauuuucacugaggccuaaagauuuuucuugucacuuugcaugagcucauaaugaauuaaggguauuaacucauugucaccaaugcauccccagggagcagugaacguuuucauccucuccauuaagguaagaagguaucuucaugaugugaagcucccaaguugaguguccagggacucugcugcugcuguuucuguuuuccaguuccagaaaguagggaucauucagguuuccccagccuagaccccugacaauauauuggugaugaauaauacacagcuuacacuuuuuuuuuuuuuuuuuugagauggagucuugcucugacacccacgcuggagugcaguggcucaaucacugcaaccuccgccucucagguuuaagcaauucuccugccucagccugccaaguagcuggguuuacaggcgccuaccaccaugcccagcugauuuuuguauuuuuaguuucgcccuguuggccaggcuggucucaaacucccaaccucaagugauccacucaccuuggccucccaaaguguugggacuacacgugugagccacggcaccuggccaacacagcuuacacuuaaugagcaccauaugccaagccccaaguugccuacuuuugcauuaggucauguaaugcuuacaaccagcuuggaagguuggaaguaggugauacuauuccuauuuuaucaggaagaaaacagaggcuuagagaggucaugcagcuugaccagggcccacagcuaguagguggcagagcagggcuuuggaccugguugugugugucuccuaaugacacuccgggaagcccaccugguuuacaguccauggccagugggaacguugggagcccgaggcgcugguuggaaguggacccuccaggcugagcccagacagcucucccagacaucagagugagcuguagccuaugacaucauucccucuguggucucugcgccuccccgccacugcccugcccccagcugggacuuggggaauguauacguuuguccucccguugggcaggaaguguggccacagcuccugcacucugcuuacagccaggcugagguaaccaugcagcuguuuuuaaaagcccuugggcgccaucggguugcuauuuuggggaccaccugccgucugcucccacccugccauccagcucuugugggcucugcugggcuugagggggguugaaauaauuugguggucaguccuucagcagacucuugaaccaagucacugguuacagcaaggcucuggccuagggacaccccucuggggaucucuuagguggcuggugauuccucagagcauuuucccacacuuaccagcuuuucuauuaaagagguucagacugugcuuuucugugcagaaauguuuaugucuuuuuuuuuugagacagggucuugcucugucacucaagcuggagugcgguggcccauuuauggcucacugcagccuugacccccugggcucaagccaucuuccuaccucagccuccugaguagcugaaacuacaggcgugcaucaccaugcucggcuaauuuucuuucuuucuuucuuucuuuuuuuuuuagugauggggucucgccauguugcccaggcuggucucgaacuucugggcucaagcgaucugcccaccucggccucccaaagcgcugggauuacaggcgucagccacugcgcccgaccugcguaugucuuaauaaacuagaauuccccuccucucugccucugcuccugggcuuucucucucguucguucguacagggccuaaaacuugaaacacaggaggugcuaaagacauacuuguucacgucuccccuucucuccccacuuugugaaaucucuggcacauuuuuuacauagaacacuuucuaguguaugcuagggcagaaacacagaauacgcuuuacauuuugacuugcucugugugugugugugugugucucugugagugucaugggagcaaauauucaaugccuugcccccugaaaugacucucucagacagcaaugugauugauuuggguugacauguuguaaacaaaauggagcuugcagaauagcugugccugagugugcacacacacucacauucacacgcacauucacacacacacacacacacacaauaccuuggcuguaaugcaggaagugugauucugaugaguuuccuuccagcugaggaggcaguugcugugaaguaggacauuucaaagccaagagagaauugaggcagugagaggaaaggaaugucaaggaguacuugcaguaaguguaggcagcgggguggaagcauggaaagaccccgaugcccaggcggggggcagcgugcccucagccucacacuggggcuggcgccuggagagucagggagagagccucgaacagccuuaggcagugucugccucugcugccuggccuggcugcacagggccaucccugcaccuccccagcggaguccccuuccaucagcggagcaccagauccccagggcugcccuugcccuguuugcucugaggaugggccucaccuguccucaggcccuuucugcuucuccuuaaguggcuuagccuggaggagccuccuuucuccuucccagcagcagcacugccggagccccacccacgugggcugagauucucugucaccaaggaccccagggagacagaggucagaagaccgagaaacauguaggugaaauaaagcgaaaaacaaaaccaaccaagaaaaccccaaaccgugccuggcuuuucagcagcgacuugauuggacgucccugucuguucuugcucuuggccuucaggguacggcugcucagagccgaguggauaucuuagcucuaaauuccugagaagugggaccugcuucccccuuuccaguccuugccugacuuugguucuuucucuuccuggcagggauuaggacuucgucugcuguguuguagacauucagggaguguugauugaggggcagacuaggaagugaguguguugguggagcugcugugagggguaaagugguaagauggcgugugagccagaggagcugcacuugucuggggagagucgaggcaagaggagggaucuucccuaauccaucugggggugggacucagggaaagggacacacugggcguugcagggagggugguauugagauguggcacucguagugccauguugcaauucgcuagggcaccauucacuuuauuuauuuaucuauuugaauuuuagagaugggguuucaccauguugcccaggcuggucucaaacuccuggacucaugugauccacacgccuuggccucccaaagugcugggauuacaggcgugagccauggcgcccggcauccauucacuuuauauucuguguaaauguugcccugcaguagagcacuuguaguggaucaccauuugccaugcagcaggcauuaugcaaucauugauggaaugcuggaaugcuuucguguccguccugggccaggcucgguggggggacaugauagaacauaguccuucgcaucaaggaggcauuagccuucugcagggaaaaaggcuguauucacacagcacggagggccauagagagccaccaugacucagagggaacucagagaggcagagcuucaaugagggacccacuguuccugggagaccucauggaggaggcacugcucaaucagguaaccacaccagggugaccaugcugccaucggcucucaggagcaccucucucucugguggcuuuagcccucugccugcccccagaagcugggccccagagcgccuccuucauaaacaccuccucuucucuauuuuucugcagccuucaauaccccaggucccaaacuacaggcugucgaugacgaucccagacuggcuccaggcgauccagaauuacaugaagacccuacaguauccuuccaaccaaggucugagcacacccagccaggggacaggcauggugaucgcaagccugguggcaaaucuguccccagcuggucaucaaaagcucucuaagguuggugaggccaggcauggagggaugucccgggugggagucuagaaagagugugcguggagguugucauugcagugacccaguagggcaggcugguuccccuugagcccuucugcuucucuuucucccuccucuucccuguccuuucccuuuuuccccugagcaccccucuuccuucuaucuucuccucuuucuccacuuccuuucucuugggcaucuuuguuccccuccuccuguucuccuucacuguccuucuuuuugacaugaggacuugcuuugucacccaggauggagggcguuggcgcauucucagcucacugaaaccuccaccuccugggugcaagugauucuccugccucagccuccugaguagcugggauuacaggcauccgccaccacaccugacuaauuuuuguauuuuuaguagagacagaguuucaccauguuagucaggcuggccuggaacuuaccucaagugauccgcccaccucggccucccaaagugcugggauuacaggcgugagucaccacacggagcccuccacugucuauugccuucuucccuccuacucuuccauucguuuucucuuucucuguuuugcccucaucccuaacugcucaugaucuacaagaggcccaccuggugcugccuuugucuccccaggugacccaggcuggugaccugcuugguucuacaugaaugguucggcuucugggauugggggcccucucccccgacucgagcuugaagaagacuuaagaaacucacuggguucagucugaguucagaccagcugguuuggucccuuucuucuccgcauccgcagguuguuugcagucaggauuacaucaguucugagaacucccacgagcaaugcuguagggacagaggggcaggagcgggugguccaccugccccuucugguauuuuauagaggagucagaugggaagcuggaccccagcacauuguccaggaggucaagcuucuguggaccgcuauccuuccuccaugaauguauaaaacauagccuguucuacaaggucccaggcacauugacuggcuuucuguuugucuguccauacccagcccugaggcagaaaggauuucagggggcacugcacacaugccccacaugucccagaaaagccccuccauucuauguuauggcaaaaaucuuucugguggauauuugugucuuccuugcagggaccgaacacuagcaccucccccacagggguugguguuuacuagaucggaaaacaccaauuucugcucauuuggguagggagauuacuugauuggcuucucuguuuucacuucacggaucaucaacuccccaacauggcaucuuuccaguaaaauccuaaggcaauauuaggaggaggagguagcgccggucuccaagagugaggcuggcagcccuagcccuuggaaggcugucugcuguuugugcugauccccacucugggaccugcauggggaguuccacauggucccaaggcacaaacuccugccagagcagaccuggaccccaagagcuggcccuuucuggaugugacugacuccucauaggcuauucuagaaggugacagcaauuagaaugccuccccaucucuuuuuuuuuuuuaacuuaaagucaacugauuauaggcuuuaagguuccccacuucuaucuaggacauggucuucacaaggaucaucuggcugagaguuaagagaauuaaacugggaaugcauugauggggcaaauuugcaugugcuuuacauaucauuugcucacacugcuguaaaccugacagcauauucucugccacauuuucaugguugcccugaaggaucugcuuuuccauuuuucucuucucugacccauuaugacugcgaaggucaaugaccaacagcaucacugacugcagagagggccagagaagggaagcaccagcaggcugcggggaccugcucccagcccccugcccacuggggccacugcacgaggaagacagggcacccacucuucuaccugcugaccugacuuuuauuuaguuccuugggacuuccuacugcuuuguccuggacacagugacaggugccaggauauggggacugguuggcaucaguccugacugugaaugugcucagcuggcgguggggauaggaaaggacaaauccugccuuccccucagacauccucggcagcaaccaacaagaguacugguguugcaugggguucuggagagagaggugccaugugagcucugcuggauugggggagaagccuucuaacagcaaauucgggcucagugaguaucucccacucagggcauguuuagagcagacuucuccccagcccacuuucagggacucaaugauuaacucuaaggaacugaaagaagauguucagguacacuuuuuuuuuuuauuuuacucuacguuugucucauuuguuacacuagauguauaaauuagauaugugagcggaggaaaguugggcauagaacugaauuuuugccaauugaauucuacuuuauguaccaggaaccucguugcuuguauaaaauuuuuggugagguaaagaaaucacuucacaaugagaauauuuagcccuucauuuuccucuuuuaccucuaggaucuuguauguuguauguuuuaaaaacugggcaagacuguaugguuaguuguuguucuuaaugcccaggucaguaacucucaaacuggugaucuugggaggccccccagcccucacccuggagcuuccugcucagucaucuaaggugaggugacucugaguagcaucugggguuaugcuccauggccugaaaucagacucuccagggcuggagcccagaaucugcuuauacugagcucuucaagggguuacgugugcucgugucugagugaccaagcacagcugugccaagagaggaaucccagcccuuuucaggagggaucgaagugccgcuaggcgccccugucacuguggggcacccauugacucucccauccccaccuggccugcagcagcucugggcauagaaauucaggcuucauuagcaccuucccgaugugcacuuuuccuauaggcuuuuguuugaggcagaagagcaaaaccuacaaagcaacuucucauuaggcucagaaaaaucaaaacccaguccucagagagcacggcaucagggaacucuccaucuccuucagaacaacuuggugcaagcuggucagucccugagaccuucugggcagucagcuaaaucccagauagugaauaauggugcagcuucucagauuuaguaaucaaugccaagugccagcauaggcaugaaaaaaagugacaucuccacaguaagcccugcuacagagucuaugcgcuacugcaaagcccuacugcuaacaauccacccuuucauccuugcuuccauccguccccauccacccuuccaauccauccauccacucauucauccauccaccuuuccauccauccauauauucauccauccauucauguauuccucauucauuuaguaacauuuguuaacuugcauauguuggguuucugccagguuuuuuuuuuuuuuuuuagacagaauaucacuauguugcccaggcugacgugcaguggugagaucuuggcucaccauaaauucugccucuuagauucaagugauucuccugccucagccuccugaguagcugggauuacaggcccaugccauuacacuuggcuaauuuuuguauuuuuaguagagacuggauuuugccauguuggccaggcuggugucgaacuccugaccucaggugauccacccaccucagccucccaaugggguuacaggcauaagccacugcaccuggccuucugccagguuuuaugggugauauaaagauaaugaaagaauaguucuagcuagguauggugguguauaccugaggucccagcuacuugggaggcugaggcaggaaaaucacuugagcccaggaguucaagacaagccugggcaacauagcaagaccaugucuuaaaaaaacuuguuuuuuuaaaaaaagaauaguaccagcucucaaagagcuuguagucuaguaggugaauuaagacaaauagucaacuacccggaauacagagcagauugaaaagagcuauuauaaagguccaugguacuuugaagccuaaguuagaaauuagauuuccagggcaggauagugaggaguuagaggcuacuacuagcuaccuucugggugcuggcgacuucugaaagcccucacauccucaucucauugagaaaucagaaugcauagcuuucucugccacauuacugggaccuuuggaguuuucugucacuuucccuuuacauacuuuacacagauauaaucacacagggacccaguucuuugaaauuaggaaaaugagaccgcugaguggguaaguggugcaugaucuaugggccagaugaccucucuccuacauucgagcugccagcuuccucucccaaccucuauucccguagcccauggcucagguauccuagucuguaagggguggaggcggagggugccccagggccagguuggaggugggacugaggacugagcaacucugacaguggagcucaguggugaauucuagcuuccaggguggaggaggcuuguaaacucugccucucgaggcuucauuuauuuguucuauuguaaugcccccgugcuggggcauugggagggugcuauggaguacuggcacuaacuccaggaauuaacucuugugcuuuggugccuuccugcaaggugacuucucccuuuucccuccgugcuccugugugguuccugguguggggacaggcaugcugauggauugacagacugaccgaguguguaauuaaauagguucugagauccucugcugugcucuauccuacagguuaauggaaacagcaaaagaaaugacccgagaguccuugccuaucaaaugccuugaagcugucauccugggcauguauccuuuaaguuauguaugcuuaguuuacuccauaaauggcggcuucacaauggggcuuguugugccuuuaacauuguaaauucucagagaugaugcccauuaucuccuuugaggaaagugucaaacuccucugguucaucucuuuaacuuucaccauguagaauugaaccaaaucaaugcuuggcuucuuggaccaauaucagucuaaccugugagcuucagccuccaucagguccagcucucaggccagugaccuugcagacucacuaaucacaaggagaauucuaacuuggagggacuagagagaguguguauguggcuguucuuugcauuaauaugacauugcagcaggaaagacagucaaggggaaaugcaaucagagccaagagugcuaguauccaaacccaucuccagggaaaugucuuugaaaauucagugauaugaucucagcucgcugcaacuuccgccucccaggcucaagugaccuucugaccucagccuccugaguagcugggauuacaggcgcaggccaccaugcccggcuaauuuuuuguuuguuuguuuguauuuuugguagagaugagguuucaccauguuucaccagcaggcuggucucaaacugcugagcucaagugauccgcccaccucagccucccaaaguguugagauuagaggcaggagccaucgcgccuggcucgccagggaaaauucuaagaguggcguguggaggagaccaagcaguggugguguauccugacuugacagaacccacagcuaaaacaagggucuagcuucucccacacuuucuguuccauuuuucaccagacucccggcucuucagccugagaggaauauggugcagagaaacugugauggcaucgacauauugguggugaugaccaccucccuuacacaauagucucaucccugcacaauuuuauacauucgagcaucaugccauuggaaucacccacaacccuuugaaauuguggggauagacccaggaacagccuuugagccugaucugccacaaucagauagaagagcaaagaugcuccgaaguccuaugggauggauggcuguaagggacaguggaaaaggaaacacugcaagacaggagcuugagagauggucccaggcaagaucaguuagguccuugagcgcugugcugagaaaugacuuuuuuccaaaaggcaaugggcaacccagaugaaagcucugaagcagagguguggcaugcuuagguauaugcucuagagagguaguucuccaaagcacaggcugaaggacagauugggaaaggcugggcuggaucagcaaagcccguugggagcuguuacaugagggaauggugaggcuagacucauggcccuggggaugggaauggauuucagggaaugguuuuaagagcuaucaaggagauagaauguauaggacuugcaggccaaccagacgcaggaguuaaugaggaaggagucaacgucuccagguuucugaauugggcaaucgacugcgggauuagcuggaggaaugagaguggcagagaaaggauaugcgucaaugcagaccugaacuaagacagugccagugaagguggagggaagggauggaggcauacaucaucaccaccacuaggggacugcuuagaugggaggaguuauuggagaaaggcagugacuccacauuucuggcuugcaugauaaugccacaagggaagaacuucaaggagaggaucggauuuagggaaagaugagcucagauuuggacaugugaaauuugaggugccuugugggaugucggaaugagguauuugcaauguggagcucacaggggaaucugcacuggaaaugcgaauuuaggagcugugauuaggagguugugcuuacuguucaauaagugaaaggagaaaaagaucaaagaugaaaucaguauuuuuuggucuaguuuggcacaaagagcccaugaaagagacuuaagaaggaaagagagguagaaagaaaaccaggagagaaaggggauggagaggucaguggaaggacauguggcucagaauuagacuggggacaggaggauuggucuagucuguuuucugggucuccuggacaucuuugugggaaggagaaucucugugccucucugcagucuguggaacacuugcagcccugaucugaaaccagauugaccacaggugccuuggcugacauuugaaaaauggaaacuugaaccuuacugaggccccuccccaacccucuugucauccuccucccuguuucccacaaaggagaugaaacaugugccuggggaacccagcaggaagcugggaaugggggucggggcagcagauggcucagggccccaacucuuuaguggcaggagucagccacagcuguucagcgaagccuccugcaaguuuaaugggggcagaugauuggcuggggauuugcugguggaagagaucaacgaaggggaacacaagcccaggcccuucaugggguagacaagcuaacuucagacucuuuguugaggggugucugagugccucuggauuuaggucauugaaaugaccaccucccuuacacaauagucucaucccugcacaauuuuauacauuugcgcaucaugccacuggaaucacccacgaccuuuuggaauuguggggauagacccaggaacagccuuugagccuguccaaaucagagacagugugcucgugguuuuccuuuguucuuauccuucugacauuucagaaaagugcaggaagguggagagcuucaguucacgcugcugaacucagggaaauuugacucuugcacacagacaggaaacacagauccgaauucuucuucuuuuuuuuuuuuuuuugagacggagucuuggucugucgcccaagcuggagugcaguggcgagaucucagcucacugcaagcucugccucccggguucacgccauucuccugccucagccuccccagcagcugggacaacaacaggcgcacgccgccaugcccggcuaauuuuuuuguauuuuuaguagagacaggguuucacuguguuagccaggauggucucaaucugcugaccucgugauccgcccaccucggccucccaaagugcugggauuauaggcgugaaccacugcaccuggcccgaauucuuuuuuugagacggagucucggucugugauccaggcuggagugcaguggcgcgaucucggcuaaguuuuuguauuuuuaguagagaugagguuucaccauguugaccaggcugaucuugaacuccugaccucaggugaucugcccgccucagccucccaaacagaccuggauucuaaaaguuacagcaucucugucuuuucucuuugcuuuggucagcaucccuggguccugcuuuccacucggggauagugaaggauaugaauggguucauccgucugugucucccacaggcccuucugcagguccuggcucaacaacuuugaaacugguuggcuuggcugcuuggacgccuguguccauuggccuguccuuccuugccuucucuuuuuuugacuuuggcccagaguucaggauucauuaguucugagccacuucuuuuuaucuugcuugagggcaugcgcaugcuuuuacaugcaugcuggagagguagaucuuugcuuccaaauuaucuugugaacuauggcagguauuuuggggggccucacuggccaugguggggcuugcuugugguacuaaagcacugugguuuauuaaagaaacagguucauuaugagaggcagguuaggaauagccccaggaggcuggaugccagaaagaugaucccuggcuuggcgcugcugcucccgcuucccuggaaaaggucagguuacuccccugccugccuccauacuaccucgccaccucccucuccauucccaguugcuccaggucccaaggcuuuaccaguugacaucaugaugggagaaauccucaagaucagugacucgugacaugagggacuggugcucucucuugucuccuccccacuucuccaccuggcugacuacuuauccuguaagaugaauuccaguguuacucugcugaggccccuccucuguccacccagagguugcuaggcuugccuuucuuauaacacacuucacauuguguuuugguuuuuauugugguaaaauauaacauaauuuaccauuuuaaccauuuuuaagugcacaguucagugacauuaagugcauucauaaugcucugcaaaaugaccaccauuccggccaggcgcaguggcucaugccuguaaucccaacacuuugggaggccgaggaggacagauuaccugaggucaggaguucgagaccagccugaccaacauugugaaaccccgucuuuacuaaaaauacaaaaauuagccagguaugguggcgggugccuguaauuccagcuacucaggaggcugaggcgggagaaucgcuugaacuugggaggcagaggcugcagugagcugagaucgcaccacugcacuccagccugggugacagagugagacugugucucaaaaaaaugaaaaaaaaaagaccaccauuccuccccagaaaugaaaccccauacccguuaaaaaguacuccccauuuccccccuccagccccugcccaccaccguucuacucucugucuguaugcacuugcuacuccagguaccgcagaugaguggaaucauaccauauuuguccuuuuguauuaggcugauuucacucagcaugucuucaaggcucauucugcacauugcagaauuucccucccuuaugaggcugaauaaauucuauuacauguauacacuacauuuuguucaucccuuuauccaucgauggauauuugcguuguuuccaccuucuggcuauugcaaaugaugcuguucagagcauggguguacaaauaccugcuggggucgcugcuuucaauucuuuuggguaugcacccagaaguggaauugccagguccuaggguaauccuguugaauuauuugaggaauugccauacugaucacauugugugcauucugaguccaucucccaccagaccuccggagaagggcuguguucuuaucuuuggcuccacagcccuaccuggcaggcugucgggcacagcagacacucaggguaaguguuugucacacugacuuaagcagcuaaggaaugcccuuguuccagccccagagaacuugccccagaaagcagcuaggaauuuacguaagaggacucagaaggaugugauuucacucccuaacugccaggugaucucacaugauaaagugaagagaaagcaaguacaaaacugcuuucuuucuagagaguggaggcauccgugauuaaaccgagagcagaggacaaggcugccgccagugcuguggauggauucugucagcauccuucucuucagggcacuuggauuagcucuggcaccgagagcagcccuuuuaaguguaaggcagugcacauccacaaucuaagguucguucuuucuguaagcauuaaacaagcccaucuguguaccaggccagugcugugcccagggaaugccaggaugugagacacaacccccgcccucacaagauacaaacaauuacaguacaggauggguaagcaccaagugccauggggguucuuguguguuuuggaaagaugaucccaggcuuggugcugcugcucccccuucccuggaaaagcucagguuauauacuccccugccugcauucacauuucauugccaccuccuucugcauucccaauuguuccagguccaaagccuuuaccaauugacuuggggcggggcagggagcaagaauaccuaagcuaggaugaggaaggucagggaggcaagacacccaggagaggggaagggauagucaugaggcuguuccaggccggguugcagccugugugagccccaggagcagaggaaaaagugccuuguuauuguuuuguuuugcauguauguaauuacugaagaaaaugacaaguuuuucucuuugucucauauuuacuugguuuggauauacagcauauaguagauagucaaacauaacaagcgaauccuuuauaaaaggauuagucuggaaaaguuagaugugggccugcucagaggcagggggauggacucacugaacccugagacacuuucccuuccuuugcauccaggcuucaaauuuucaaggccuccuuucucuuccuugacucagauugucuaagcuacuuaaccaaugggcagccuuccauugagcgguuccccaucagcuuuaaaaccuacuucucaggaaacuacuuucaccacguugugcuggggauuuacugcaauggccgcuauggcucauugggcaugagccgcagggcugagcugauggacaagccauugacuuuucggacucugagugaccucaucuuugacuuugaggacucuuacaagaaauaccugcacacagucaagaaggucaagauugggcuguacgucccccaugagccucauagcuuccagcccauugaguggaagcagcugguccucaacgucucaaagaugcugagggcugacauaaggaaggagcuggagaaauaugccagggacaugagaaugaaggugggugcugggaagacaaggaagccaugcaggagagcucuuuucccauuccuuucucucugucucuugcuccaggccucauuuuucuaggauggccaaaaauuucuugagguuaaagucucucuuugcacauacuacugcaaagaaagccaucuaaaaucaauuuagaugcgacaguuaaaacaaugucucguccugcaauuccuucuaugaaaucagaucuaaaguguuagucauuuuauauugaagcucuaguuuguucuguuuugucgauguaauagggugaccaguuguacuaguuugccuggaacugcggguuuucccaggacaugagauuuucaguauuaaaaccuggaaaaccuuauaugcuggccuuauauagacuauacucauacgucccucuucucucucucaguuuuaccuccaaagugaugugauucccgcuuguccaugucccuccagggcuugugcagucacuaagagaaaaggauuaugcugacuucaggccuggcuauguuuagcacuuguggacuugucaucuucacucugcaggaccuggaguggagauuccugaucaauuaaaaccauucugucauaugugugggaugggagcaucagaggaagaacaggcugguuucugaggcaauagagaugggacuuugccuucgugaggagaggaacuugccaagcaaacaaacacagccccggggagacugaggcauugggcuguguuccucucucuacacggcacagggagcacaaugugaccaucuguauaucugucuuggaaguggugcccuugcugcuugacaguacaggacgagagaggaaugugugugucuccagccuccuuuuuuagaagucuuccugcucaaugccuucuaaaccauggcaucaugauugggcugggggguggaauguggugcuagaagaagaccugaggguggaggucccuuaggaaccagggugauuaacuccucacaucuccuucagauccugaaaccugcaagugcccacucuccgacccaagugagaagccggggaaaaucccugucccccagaaggagacaggcaagccccccgaggaggcucggccggcgagagaagucgugaguaauauuuccucuuccccaacucaaagcccaacacacacauucaagggguuguccuggcccauggggacaaagcugugucuugggcauggcauuugaaccugacagcaaucuccaagaggacugccccucauucaggggacaucuguggaaaaggauccacugggcacaucaccccauugccacuucucugcugucaguugcacacaaacggagggauaagccccaggcagaaugaggugaagaauagucugaaaugcagguggcccggagggagccuuggacuuagaauuaggaaaccuggggcuggaacuggcucagcugcuuggggaugucuuuguuaucuuucugggcauaaguuuucucacccauaaaaugggauuguuagaauuuaugaacuucccuaaaauucuguaguccucuguacccagcagaaggugugauuaccaucaguggacgguggcaucagaaacacccaccggcucuucuucuuccuuggcuaacucuacccucuccguuucagcccugaggccagugaucccacaucuacuucuuagaccaaaauaacccacuuaagcaaugacagauuggagaugcuggggaugcccaaauucaccagcgauaauccgcuggcaaauauuugaacuauagccauccugggaaaaaauacugcuuuucuuaauaauagcagcaugcugugucacccagccucuugccaugcuggaaccauguggcacagugcacagggggcuugguugaaucccaacugugccacguguuagcugugcagcugggcacauccuuccuccucggggagccuugguuucuucauccauaaaagaguaucaaaugcucuccuugccuaucugacacggugguuuguaaagauccaaguagaugauguaacgagagugacuugucaacagugaacugcuuucacacaagcacauuaucgucauuacaucaauccuguacagugagcagggaacauuuuacgaguuuuguuuucaggugaagaaaccaggacacaaaaagggcuuguuaucuuguaguaaguucuguagcuggucagugagaaauggggcugaaacccagguccucugauucugggagguggcagggcagagucggggaagguucuguuuucggaagaacaggacaggacgaaguauuuucauuuccaaggaagguucuuuacuugccccauuccgcguccuacagccaguccuggguucagcagguacugccacgagggccuuggugacaauggcugucguucuggguugggaaggagggugugaggugugaagcagugagaggucagguguuccugguagcaagagaggcugaagaugagaacaguuuuggcauagguuuguccuugcagggagcaggauggcuuccagccauucacacguggccuccugaccccaauccuccccgugaugcuggccacugcccuugacccuggacccuaaccuuagcccuuacccuauaucucucucugucuuugauucaaacauccauuaacugcugucaucacaaaguaguuguugucucagaggacuaugaacauagaaacucuucccagagggucauuuagcauagagugagugacccagcaauagcaaguugcucauaaaagaacugauuuugucugauuuauuaucuguuuugcccaaggagggcugagucauucccugaggagcucccaaucuucagcaaaugucgagcagagucuauaaaagccugcccuucccuuuagacucuagaauccagaggacaugaaggcccaagcauuccaccuggcaauggauuccugcacagaaugguggcuauugauuuugaagacuaguccugguggauccguuuuacuuggauccacagggacuuugcauucacagggccauguugaguuuuuaaccaggaaacgugaccauaaaugugaggggaugguaaagaucuuagaaaccaugguaacaggaugaugucaggagucaggagguggugguggcugguuugggaaauguggaggaaggagaguuugaguuuggaugaugggauguggggugcaucuucggcauugggggagcugcuaaaaaugcagaccuggaguuugaggaagcugggggauaaaaguccuauuggagccaucuacuuagaauugccaguugaaaugacagccagauaagucugugagcaaagaaagaagagaaaaaagaaauggcugggcauggugguucacaccuguaaucccaacacuuugagaggccaaggagcgauaacugcacaagcccaggcauuugagaccagcaugccuaugccacauagggagacccugucuuuacaacaacaacaaauuagccaggcauggugaugcaugccuguagucccagcuucuugggaggcugagaugggaggaucacuugagccuggcguuucaagcccggauagcaccauugcucuccagucugggcgaaggagugaggcccuguaaaaaaaaaaaauggugacgacaaggcccugaggaagcccaagaaaaagagccagaacagaagauggaagaggaacagucagagagggagaggauggaucaggacugugagugcaccugcgccugcagaggacagcugucagagugccgcagccgugagugcaaagcuaccuucugguguugaggcaccacuugcccucugcccuccugcccaucuggcacaccagagugggccugggaauggggagaaagaccagggaaagggaguggucgccugaggucaggaaggaagaccugcaggaagagggcauucuccuccauuaccuucugucgcgcaugucccggagucgaccccagccccacugggggaagcacaggagcacagaggugauggcucagggcucagcagugaaaacauaagcuuuucaaaaacgaugagaaguggccgcaacaaggugaggagggguggguuucaagggggaggagggaaaguagugggggaaggagaagcacuaugcacugaggugacauuuagagaggcaguguugagagggcugaggggcuggaaccagccugcgaaagggagugagagugagagcugauggagcugaugcaggccagauuccuuuaucaagaaggagcccugaacagagaugcagcaaccugauuucucacuccaacucugccaugaaccagcuugcggcuuugagcaagcugcuucucugugccucaccuguguaaggggacgggggacuuagagcagauuauucuagguaguuuguaaacucuauagaguucuccuggggcuuuugucuuucuagaauuggaagagaccagagugucuuuggacacacggagaaaauaaccaggagaaagaaaugaguguucaagagcaaagggauuaauggaggaagauauaugagcagcuggggucacaugguauggaaggcuacagagagggcuuagaagguggugggugggggagaggguagggcaaaggaaggggggacauuagggagagcuugacauacaugaggagguagaaguugaaggacuguaccuuaaguggccuuuauccugccagugaaggaguugaagaaagggcccagcugaggacagauagauaggcccugcaguccuguucucaacucugagugugcaccagcaucaccuggaggguuuguugaaacagaagacugcuggaccccuuucccagagcuucugauucagcacauaugggauggagccugagaacugguguuucuaaugaugcugauccugcugguccggggaccacacuuugacaucuaccguuugcuucagccgcaggccuccaccuguguuugaugaaucagaaugggaaaacugaguuggcgguugacccugaaaaauaacagucacuggcuaaaaguacugggucugcugagaggggcagauaaagccguugggugugauuuaggggcucagccuuguccaguguugccuggaucucuggauaaugagguuguggaggugaaguuagggggucugacccugcacuggcucccauguuugggccccagugaagucauucugggaggggcccaacuggucacucuccugggggccagacugggccuccgguccuucauccccuaggccaugcccauacgcuaaucucugacuacuuuuucaugcagccaaggcaagugaccaccccugcgccugcagaggacagcuguuagacugccucaguugugagugaaagcuaucuacucucccgcuccccuccuacccugccagcacaucagagugggccugggaauggggagaaagacuggggaagggaguggucggucacucgaggucaggaaggaagaccugcaggaagaggggaauucucuuccaucacccuccucccuccacgccccaaagucgaucccagccccaguggggaaagccccaggagcacggaggugauggcugaugguucagugaaaucaucaacuuuucaaaaaaggugaagagugauugccaccugccucagaaucccccugacucacgccccugcccucgagcccuuccucccagguaaacauugauucccaaaaguccuccuuccuaaacugcucccaguaggucagagucuuugcgguuuuuuuuccccacaacuagggccgaguggccuuggaacgguuugaccauccacagagcccaguuggcuuguaggugcccguggacaauuuuguauuagcaaauccaguaagacuaugguuauucuugguggcggaaacccuugccacuucuuuucucuuucuccagcacuuggagguugggagggaacucuggagggcagaucucucagcugaaguuucaaauggauugagguguuugaggagggaagauucucucccuaauuccuccgaaaccuugacuucugaguugcagggcuggggaagagauugcagggucuacuguguaggaggagagggaagagaggugcaggacaugagaauaagaagaagagcugugagaggccacaagcacuggagcgccaagccccagcuucccucucuagauuccagcucccgccauucugccacacuagaacucaggacagcuguguuccuggagguauguuuggagagaagcagcuucucagcuuccacccauggccuucgccaagcagccuuuucucuagguaaucuugcuuuuggcgaggaaaugagaaagugacaaauauggucuugacccaaucacuccacaaacuccgggaaucuuacuguaagauggccaggacuaggguuuggugacucugucccugugcuauucugucagcauuacauaaggccaucgcgucauuucuaaauguguugggugucaugaggaagcuugggaggggcccaaaggguggaaaauuaccauaacaggcgagaggcccaucagcuguggggucccagucccugucugccauggauaauuuuaguggcauuauauccccauccaccuccucccuccagcuggagcgacuuccagccuugaauuccucuccauuuuugcacuugucuaaauaaucccuuucgagaggaggaucagugucacuggguugacaagaaucagccgagggggagggcaggugaagaugacugcguagcauccgcugagaccaaguuucaagagggaaaccaggacucccccacccuuccacccacggguccuuucucacacugcuccucugggaguguguaaagcaccuacuacacugaauugucaaguuuuuuccugugguucguaaagagaaagggagagggagguugagauucauguuucaaaggccaucugugaacuuaaaccaacuccuucccagccccgggccucagaacccuugcagcucuucacuaagggguguucccagggguucucaacugggucagcucugggagaggaggguuagaaguguggugggagguggaagcguuugcuucucacaucuugguaagugaggaggcuccuugcuagggccgggggccugagaugguaaaugccccgcaaagcccaggaccacccugcccaauaaagaaccguuccaccucaaaugccaacagcgcccucacugggaagcuucagcgcucuccgagguccuuuccauuucugacaguucaugacucuuggcuugcugccuaugagcuggcccugggugaauuggagugagcagauagugauuuucugguuuugcagccagagugaccacgugaaacauucuucucaauggaggccaguguuccugaggacccaugagaaccucuucaucuucucuccccuguguggcugcuuuuuuccugcugucucuccuccuguuuucuuugcuggucaccuuucuuugccuccccuuuucuuccucuuugauuucccuucuucaucacugaucucuguggcaguucauggcuccagcgggcucugucugcccugcuggacacccugggggucccagagguuaguaagcccugaaagcccaucuccuuucacugcagggccuugagcuggacaauggaauuccugcugcauucugucaggaaggauuacguauguccagacaucugguugaguaagggcagaaguuguuuaaugaagucauugaaaauaaauuugauuccauggucuaaucacauugacuggugcccaagaaguaauucuccuuagaucccaaaugagaaauauccccagugagaaaaggagauuuccuuaggguggaaaguagagggaagcaaacaaacaaaaaagaacacuaggaaggcuacgaagggaaaagcuaaaccgccaagauggugaaggggcaguuucuacuccagugacugccuggucaguucccccagggaaauucauauggcccagagucuccagggaugcuuggagaaaccaagauggaaugaugggccucaucagaaaagaccaccucaggcagagugagccaggagccucugugagcuccccagggucacauagggucagacaggggcagacagggugagguuuccuagagcugagggguucuugucccggaaaggagaagugacaucagagccuggaaacugugcccuggaaucuccaacaguuggccuauggccagagucuccugccuggggagggcucaaagggaugggcaccggcugaaaaaucucuucugggccgaauccgucuuggcugaggccucuguuuacauagcaacaucagcugucugcccuggcagcugccagcaccggugcuuuccaucaggggaagcaaggaaugugagggaggagcggacuggccuggaaugaaggugacaggugugaaugaagcuucccuuucccuguguccguccagcugaggccaugcucugccucugcggccuacccagaccggccgugaauccuaaaucggggccuggucugaccugauucuggccagacuccacaagaaggguggcccuggggucuuugcuuaaacuuguaaaugcugggccaagagcaccccugguuuaaucucuuccacauucuuaacauccgggauuaagagucuaacguuuacaguggcacuuuucccacacuucccuuccuggacucccgagccugcaggcuguaccgccagucuggccuuuguguuucugugugagggugagcaccugccggcacacguacccagacauggcccucagucagaggugcggaagagagacugggugguugagggaacccugugaacuuccucuccucguccuguuucuuuucuuaaaccucaucucucccagauacaccccuaugcauguucagccuugggauguggucaugucuccacuccaucacuuucugguucugaggcuucuuguggcugcacagauggcaccaucuggucaggccgagcuccuccucugcacugaggcugccucagagugugaaggacuuggugugcagcugucaaaguugagauagcaguggcagagaguaguaggauuuuugacagaauaacuucucuguggaaccaccacccuguucucccuagccuaccuccugcuuugagcacccuccguccagcuggcuccgggaaugcagaccugucauugggguuaaguguagccuuggggccaggccaucaagcuuucacccuaguucacucugaguccauuuacgucacaacaggugaggcugggacugucugugcauguggauauccuuucuccugcaaagugagucaaaguaaaguuuucuacucuuuuuccccuaaaacaaaauguugccggagaaccuugaaaaaagaaaauucuuucauuucuuugccuuguuuggaggaggauggcagggaggugggguuggagaaauauauuagucuaaaauaauaacccuggauccgaugagagguucugggcaagugcagacccggcugaaucaucauccuagugcucguguuucuuaaaaauaaacccccuugcaauauucuaauuagagcugggggagcacuuggaagaguccucucuauacacaauagcucacccagcucuggcccugagaugagcuggcaaggacugaaugacauuucuggcugggccccacaggcagguggcaugcugugauaaccuacuucugcccuaugccagccaaggagauugcagccacgguugcuguaaaagaaaaggauuucaucuucugggcaguucaccaggaaucucaguuuagcucauuuucugucaguauuagcccuuuucuucuccuggguucuggguacuuaguggaagguggcagggguggggauacagaagaagaagaugaccuagucccuuuccuuuggaagcacucaagcuguugaugcauucagcuuaaugaguaggcagguuccccacauggcuuucagggguaaagcaaacccacuccaauacggaaaauaaauguucuuccugcuuguuaauucugaaaauguugucaugguaacuugaauuccuggcuuaggacuuugucucuaaaauaaaauaucccaugauaaagguaacagaugauucacuaucauccauuuacauguuagugagaauuugauugauaaguacguauuccacagugggauucauagaugaauuucccuggucccuccuuucaaauuguucacagucucugaggcagguguaaugauuaugaauuggcaggauucuggaacagauguugucuuaguccauuuugugucgcuguaacagaauaccugagacugaguccuuuauaaugaacaggaaauguauuggcccaugguucuggaugcugagaaacccaagaucaaguggcugacaucuggugagagccuucuuguugcacugucccaugacagagggcaaagagagggagagaggaaagaaagagagcaagcacaagugugcaaaggggccaaagucauccuuuuauaagaacccacuuuugagaaaauacuaaucuauucaugagggugaugcccccggauccacacaccucccacuaagcccugccucccaaccccacugcaccgaggaucgaguuuccaaacccaugaacuuuuggggacacauuuaagccauagcaaauguaccaaagaaaaugccagagcauacagagcaaguaguggauugugaugguagggagucagaaaauacuuccugagguuagugacauuugggauugccuucuaaggauguggagauguuggggagagcauucuagacaggagacagcauaagccaaggugcagaggcaggaguggccaugguguccuucucagaugcuuggaaagaugcuuugagguggcagaggaagggugaaguuugcauugugguucagggugugggcucuagauucuggggaccaacucuggcuccaacacuugcuaacugcaugacuuugcuuugagcaaauucccuaccuuucaguaccuccauuaucuccucuauaaaauggacaguaccaguaucaaccccguggguuauggugaggauuaauuaauccacggaaaccucuuagaaugaugccuggcacaucguuaagugucuaauaaauaaaagcuauuuauaauggugauuuccugguaccuggaaggcaugggaaaacuggugcaagugcgagggaaaagacuaagaaaaggaguucaaagguucccaaauuaaauuucaucuauuuucaaaugugccaauagcagaacacagguaaugguaaagagugaaguuuaagaaacacacaaacuacaaaaaauuuaugggcugaggggcuccaaagugaggaauuaaggugaguggccaaaaaguggcuucucgaggagguggcaggccuguggcuaguuagcugcagugaucccagugagccuccaugacagggaugagcgggugggcuuuguuuucucccugagccuacccuguaggcuguucuggccacugacuuucuaggagagacugucgggcacaggacugagggagagauaacaggucagugcagaucuaguccaacaacuugaaaauacugugaagcuagugucuuauuuucuuauaugaagggcagcauauuuagaguuucagaaggaggagaggugugacuugguguugaggaagaugccaggccaggaaggcaacauauguaagaaagcuucagaaacucggaugagcuaacugguagguccuacaaggaccauggaacaagacagucucuuguuaagcacaugcacugcuuaauuuucagagacaacaggagaucuaaagagcuaccauggcuuagguccuacauaguuugcaggguuacagggaagaagacugacuccuagaagugaguaugacuccugacuucauuuggacuauggccauuccucccgaguuagaacuugcuaggagcauguucuccauacuccacacaguaaccuuccucagguugacuuagcacccacuguuaguggaucagguuuggcuaagguuagguguaagcuguagcuuaaacauaauucacuuuuuuuuucuuuuuugagauagggucuugcuuuguugcccaggcuggaaugcaguugugcaaucucagcucaccgcaaccuccaccuccuagguucaagcgauccucccaucucagccuuccaaguagcugggacuacaggcgcaugucaccaugucuggcuaauuuuuuuugcuuuuuuuuuuuuuuuuuuuuuuuguagagaugggguuucaccguggugcccaggcuggucugaaacuccuggguucaagugauccucucuucucagccucccaaagugcugggacuauaagcaugacccagcgcacccagccaugauucacuuuuauguaaaagcagcucaacagagguggaaaugggcuuccugcugcgcugccaucuuuagagaccaucuuuuuuuuuuuuuuuucugagacagaaucucacucuguugcccaggcuggagugcaguggcacgaucuuggcucacugcaaccuccgcuucccagguuccagugauucugccucagccucccaaguagcugggacuacaggaaugcgccaucauacccggcuguuuuuuguguuuuuaguagagacaggguuucaccauguuggucaggcuggucucaaacuccugaucucaaaugauccacccaccucagccucccaaagugcuuggauuacaggccuaagccacugugcccagcccuagagaccaucuugagguccccacuccagccgucgcuuccauguucccaucagcaggaagaacaaaggaaagaaaaagaugaagggcacauaccaguugucuuuugaagacguguccuacuaacugccacaccacacuuccauguaaaucucacuggcuacaacuuagucugaggccaugcguggguacagggaggcuggaagauguacuuuguauucaaggcagcuauguaccuaacuaaaaaucagggaugggagacggguguuuuauacuaaagaagggaagaauggauguugaggggcaacuaauagacgcugcugcacacagaucguuagauaaaucaguuaugaaaaucuaauacaaauguaguuuauauuuggauaaaaaauauaugcuuaccuaauuacaaaaccaggaaagguaguauggaaauaauauuuuacuagcucuaggaaaugaccugcauuuaaucuuuuucuaaagcaaggaaugcauagguacugcagguuuauccuuuugccuuauccugcaggcaaauugaauuuuugauugcugaauuuucuacaaguggggcacacuguggagcagugauuuacuuuucuaaccacauuugcaucaggcugaugcuaauguauggggagucuacuugagaaagucucaaauuagcuauuuguaaagaugacaccaccucaggcaaggagacaaaauggaggcucacuucaggcuuuaugagagaaccagaugcauguggacucuuuaaaccugacuuguguguaagaacccuaguucuguccacauuagugggcugagggcuaggguaggaauauaaauuugaauccccaagcaaacauguguuccuuuuccugucaauccaagaaugguccucauagugucaucugggggccacuccuccaggccuguagcaguggcuuuguuuaagggaauagcuaaucuccagggcaugcagaggcuggaggacaccauccccugaaggauggaagccuugagcucugauacaaugagcagagucuacacacugaaguguagggauuucuacuggcagucagcuguguuaauuagcaucauguguaugacccagucgcuauggggagagacacaaagaaauaagaggcauaauuccugaccgauaaaggagggcacauggucaagcuaagaaauaaggcccaugcaacagauaaguaagguuacaaguuauuugaguagggccuagucagggauaguuucuugaccaccuugagcagucagguuucaaagggaaugaucagacuguugaugacuauuccuucccauuucagagagagagagagagagagagagaaaagggguaguggaauugcuggcagagauuaaugccauucacugagcugugcuuuagcuagaagcuagcuguugauuucuaguucuaucaacauugaauuaguuggaccacuuuuaugccagggaaaaaccauuagcuguuaggaaaucuuucaagggcauaaaauaagaaaccuucuaacaauuauauuuucuuuuuggucuuuuuuuuuuuuuuuaauacuuaagaacaagguucggcugggugcgguggcucacaccuguaaucccagcacuuugggagaccgaggcaggcagaucaccugaggucaggaguucgagaccagccugaccaacauggugaaaccccaugucuacaaaaauacaaaauuggccaggugugguggcacaugccuguaaucccagcuacucaggagggugaggcaggagaaucacuugaacuggggaggcagagguugcagugagccaagauugugccacggcacucuagccugggcaacaagggcgaaacuccgucucaaaaacaaaaacaaaaacaaaacaaaaacaagguuuauguguaaccuaaacaugucuuuuucuugcaaaaauggaugugaaacuuuugaauuagaacucacuagccauacugaauauccuaaacuugauucaugaucucaguucucucuuauccaaggugagaagaggcucauuaagaaauggaaaaguuguaagauacauugugagauuguuuaggcauaaucguauauuggaagucauuuaggacgcaucuuuaaugaagacagaugaugugcuauugaugugaauguuguauuucccagcuugaaguacuuucucacaugacuuugcauaauugcuuaguuguaguuuuauguuggaagugacuuuagcacguuucuagggaagagauguuuugccacugagugauuuuccacacugacaugcuuuuucagaugaauccuaagauucaccuugauuuuauacauucaagccugaacauuaaccgcucccugggaacgugagucaccuuugauuccugggcuuccuccaggacacgaacacuaggaagccaauguuucaaggagaauuugacucagauucuuggcucuacuguaguguaugugacuuuuagacccuugcaagguucaagaguacuggguuucaaaagcuauaaugugaccaaagucaggcuuaaagcugcagaagcucauuccacacccugaaaacuuuucugaacucuacauugaaagucuguuaaaauguuccuuaaaaccuuuaaagguggacuuaagaacaagaaguagaguugugagcuaaggcuggcagggugggggaaugggaggaugagacaaauaucagaaggauuaggaaaaccgaguagaggaccuugaaaaugcuguugucuuucuuugccccauccccucuccuccaccauauuucugucuuuuacccuuaggccugcacugccugaaaagaagguggcugaucugagcacucugaaugaagugggcuaucaaauccgaauuuagccaagccauaccggccagcaagaggguuucuguggugcuucucucugcacuuuacccagcaucuucaggaggaacugcaacuauuuauuaagaacuugugaauuuuauuuuuaaggauucaccuggaaauagaaucugagugggugguaaccauuagcuuuaaaaaauucacuaaaaggcaccaugaaaaggcugaaguaauaagccccacugggguuggacuaugucccucacucaagaucuuaaggauaaccguaacugaaguuuuauauuuuuccauuuaccuacuuucuuuuacuugcuuugaacauuaugccucaccaauaguaaauguucaugaaauaaucucuugaacuuuugguauaguaagguaacucuaacaguauuacugucuuuuucagcaauaacagaaagcaaaaauggguggguuuuuuuuaagcaguuauuaccucagcauuuugacaucagauaugcaaacuuaauggcguuuuguuuuuuuauauucuauuuguauucuuuccccaguauuucccauggggaucuccacaaguuuggaguuuuuuccuggugcacacacgugaggagauuuaagguacuauaugcaaguguuuuacuaaaaagcacugaaauucuucuggcaauacaagaaccauuuucaggaucuuggaguuacuuccuucuuaaucuuucuuaaagcauucacugauguuuuuguuuuuucaaaaugaaacaaaaauaucacauugagaagcuagucuauguucugucacuaacauuuaaacuuugcagacucuaacaaaaagcacaagaggucacguacuauuauacaaauuuagcgguacuggauuuaccucugacauuaacacacucaggcagagaccaggagugaucagcaggucuucagaaccaaaaaaccuuucuguucacauuucaucugauuuuuaaacugaggcaggcuuugauucuucugaaggaugccaagaaucaaacuaagggaggacucacuguuaaagauguguucugaugucuuauauuaagaccaaaugugacaugaugugauuaucuuccaguacuuugcuuuuagguaccauuucaugacauuuuaggaaugaguauuggaaaauauaaagaauuagaaaagcagcacuuuuuuuuuaauggaaaagucuucgguccaguguuacaccuuauaguguaauucagucccuaagcacagaaugaaugucuggccugcauaugguaguuacaguguaaccucuggcugcagaccacacaggacaacccuaacagccuagucuuguaugguguaaauaucaagaguacagcuucaauuucauuugcuuuaucuuagcaacaaugccaacucaggagagcagacggccgauuucagugaagucugguagucaacagauguuauuucagucucagugcaucuccucuggcuuucuuugacugaagguguuuauaggaaggaaguuaaaaaaaaaaaaagcucauugagauucuuuaccaauucuuuacaagauuucugggggugacagggaaagcaaaaggacuucaaagcaaaagggugcacaagagcuuacuucacccugaaaaucaguauuauuaaugaaaaguacuguuuucuuaaagaagucgaauguccuuuagaugaacaagaccaaguauacaucuccauuagauuaaaauguagcacaggguuaaaaauuaucaguuuaaucucuuuaagaacaguauuaucagaguuuaaaaugaguuagcucuguuuaucuacacacagcaaacccauucgcagccucuuggccacauguauucagauguuugaaauagugaaucauuucauuuucauucuaaaacaauacugacuuagccauauaccuucuguuugucaaucugaaacuugcuuacaucuaauaaguagaccucuuauaacacugcaaccauucuaagaguuggaauuuauuuuugccaaguauuaaguacuguuacaucuaaaauacagaaugucaaaugguugcauagcuuguuucccacaacaaggaggaaaagaacaggaauacaaacucuguaauaugcugauaaagaagccuuagaacugccaacuggcuugaugguucaauuaguaagcuaauuucucccacacccgcuccuugauuuuuagacuaauuuucccaaagcaagguuuagucacacaaacuugaaaguacauuuaaaauguucuuaguugucauccuacuuuuauugccuauggaauaugcuaauuucuaaaaaaaauacgggagaggcaccaaaccccuaaauucuagugcaauaauuuaaaaaacaaaaaacaaaacaaaacaaaaaacauguuauaugcaccccccucccaaagcugauuuuaagacuggcuagaauucaaaauauaaaaaauaaaacuaugaagugauuugaaaucgguuuuaaaaaguuguuagugcaagagaaauuuuauguuuaagccaucauggcaauauaugcaaaguuuaaaugaaugacagaaaucuugauuuuagacuguauguugugcuguuuugaguacacuuuauuucggagauauuuaguauuuucuauacacucugaaaucaugagcauuucacuuuuucuaagucaauuauuucauaaggauuuuauuaauagauauugguaaauagaacuuuggaaaucuuaauucagaauucuuacuauaccugagucuuuuguaagcuauaguuuuauguacaaccuuguacaguuuuuuugacauacaauucagaacuuuguuuauucucuuggacuuuguucuggccaauacauuuuuuuuaaaucuuuaagaagaacugugauuguuuuaguggguauuuuucuaauuaaaugaaaacuuguauaaugguauuuuagagaaugccaguaagugcauguuucaaguuaauguuuuucucaucacuuguauguuucuaacacagcaugggacuuuaauaaaaccauccuggaaacuuaaggauuguuuuucuucuaaauauguaagauguggccgggcucaguggcucaagccuguaaucccggcacuaugggaggccaaggcggguggaucaccugaggucaggaguucgagaccagccugaccaacauggugaaacccugucucuacuaaaaauacaaaaaauuagccgggcaugguggcgggcgccuguaaucccagguauuugggaggcugaagcagaagaaucgcuugaacuugggaggcggagguugcagugagcugagaucccgccaauguacuccagccugggcaacagugcaagacucagucucaaaaaaaaaaaaaguaagauggugugauuuuuuuuuuugguccucuuauuauauauuuauucuacugaaccuauuuaucguucuuucacccuucuuucacaaucugcagacucuauauuaaaaacacucuaucacucuauuuugacauaucucaau

SEQ ID NO: 13018 - RNA, 12100 nt, Homo sapiens
cagccugggacuggcaacacggaguaaacgaccgcgccgccagccugagggcuauaaaaggggugaugcaacgcucuccaagccacagucgcacgcagccaggcgcgcacugcacagcucucuucucucgccgccgcccgagcgcacccuucagcccgcgcgccggccgugaguccucggugcucgcccgccggccagacaaacagcccgcccgaccccgucccgacccuggccgccccgagcggagccuggaggugagcgcuggaagccgagggagugagcgcgacgagggcugcucgccuucauucccuucgcgccccucuaaguaaccaguccgccgaccccugacccaccccggauccgcgcccccagccuccggcuuggaaauaacucuggcuuaaacuucuucuaagccaccgcugcuccucggcgcuucgaaaaguuucccgcaaagcgaaagaacuaacuuucucuuuugacuuggggcgcgaaagguuccuggugacggaggucgggcguccacucugccgccagccucgagcgccgcuucucuccgccgacggcgcuggcuugcccggcugggagagggcguaaggugggugggcgggugcguugggguguccgaggcugccucgcucgccgucccgcuccaucccucgcuucgagacacggcacugugggagccgauccuucccgggugggggggggggggcgcagagaggcacgaaggccggaggcuugcgggagggcugccccacgcgccgagaggaaugaauggggaaggggcgagagggcgggaggcgucccgggcgcggccgcugggggucgcccuggguaccccgcagcacuggcggcaggaccgugaaggcaaccccgagaaaaaguuagcugggauaagcuuggaaguggcgagcgcuggugucgcgcugucccggggcggaagacggggagggcucccggcaacggcugguguccggaccccgagcccgggacucccacacaccugggacucucacucuggcuuuuccuucggcggguccgcgggagacccaccguggcggggaagcgaggguguggagccacuugugcagauauuugagagaauggcuuuguggucuagugccaggacucugagcgcuuacacugcaaucgaugucguugggccucaguaugcggagccgggaaauaagggcacaugggcaguaccggcccccucugcguguuggagggcacaaugcagugguuggaccagauaacuacuaagguccuuucugucuggagauuuucagauuuuggagugguguaguggggagaaaaggagccagugaggggacuugaauggggugggucucuaucuaaugucauucaccaguguccagacagugggggaaaggggacuuuucugcagggcaucuuuucccucaccagcuuucuuuccacuggauucguucuccuucucugcuccccccacucccauuuucauuucucaucuacuuccuuuccuccuaaacauuuucuuuucccuaauuucauugcauaggucacauaugcuuucuuacaaauaaaauaguuacuaaauccuugaugaacccagaaagaaaaggagagccagaaaaucuggauguucucucaguguaccccuuucguuguaggugacagucauaucuucuguucgaaguuucugucucuguaacuuaaagugaaggcaaaaaauugguauuacuguccccauuguuuugcaguuagcauugguuguagaauaaugcuacaacauacaggcuccugcuuugaggauauccugggcaaagaugggauggggugaggauugcaguuacugucggaaugguuucagagacagcaaagaaggcagcaccccacgcccgcaguggggauaagauacagcacccagcaucuguggcagugaugggagccuucuuuuucucucucucuuccuccuugcccuuuagccauuauagaauuccuuuuucuccauggccguuuucuucgauagccccucccuaucucaguccugucaaagucuccucugugauugguaccaggugccaggacucuugaccccuuaucuaccuggcuaauggcucuguucucugguugccuuguugguugaucccuugaggcggucgauaccuauuggugauggagcaaaaugagcagucgguggguguucagcagcuuggcaugggcugggccacucaccagcuuuaugaccucaggcaagucauuuuuaccucccuggaccaauguacucauuaugaaaugagaaucugaccuagaugauucuaauauugagagggugugauuuccauuagauagaguccaugauuccuuccuuuuuaaaauuggcugggcaugggacagggccaguggcuucgaguguuuacccagccaggggaggaggaaggacauagccaagaugccucagaagcuuuccaagggagaaaugguuuauaugugagaauugguucucuuucaaauauguaaugcagaaaugcuggcaucagcaaauaguggggugaaaccuaccuggucugugaagaacuuggggucaaugagaguacaaaagaggcucugacugaccugaaugucuugaagguuccaguuaauuccucacuaacagggcuuuauugaauugauaacaacagaaugaguuuuuccugaaauggagaagauggagucacaguaguaaugacuacccgguguguauguaaaucucauauguccuucucaacagcccuuuggggaaggcaguuuugaucucaaauuacagaggaagagaaugagaggcccagaaagccuaagugauuuguugguggaugcucagcuuaugaguggcacugauaggcuuagaaacauugucucuggcccuugaugcccagcuuugcaccucuucaagaggucugggaggaagaccaagauaugaagaguuagugaaaggccaguacuggcuuccuaguaacauaagaugguuagcaagcaaugcuuaguggaaagaggaugaaaauuaaaagugaaaauucaauguagcuguagcuacuaggaaauaaaaaucugggagcugaauuuccaguuaaaggaauacaugaguaaacuuucacuuucuugaaaaugaugaaacugccaaugauacaacaugauuucugauuggaaauaaucaagcagaaacaaaaugcaaguucuugguagcaagucugaacaauuuuaugaucagcauagaaagucaacucugaucugagguccccaaacaauuuuuuucaaugaccgggauguuugaggaucucaacuuucugaaaaauugugugaagauuuaacuucauuuccuuguggggacacagccguagucuaggcugaaucauaccucgagagacugaguaaaggaauaacuagaaaguaucccgagaaguuaagcuuuagccuagugccgagaaaacccaaaucucgacagauacaucuguuuuauuuucugaaaggcuuuuaacauuuuuacaaccauuuauguccccaaggaagcccacccaaugcuuuucauaaaagcauuccauaccacugacauucuucagcuucuuucauugggacugcugacuuuacauaagaagaaggguagggggcgggagucauaaacagcagaccccaagcccugagagcucauuaauaaaccuaguuggauggcaaaauggaacuacacucuacugcaguggaauucaaaguccccguguagaagggagccauccaggccuccaaacaaagaccagcccaguggcagcucugaaugucauccccgaaucacugaguuuuuaauaaacuuggaaagggaagggaaacaugaaugcaugggagaaucuuaagccucuggcuuuagaaggcuaguuucucagaguuuauugccugacagcgacaaguauccucccagcauccuaagauuauaggauuaaauugagagaagaacuucaguucugacucaugacacagggcuuugggaaaagaauuacauacauagccuggguuucuuugacuagucaagggcagauuucauuggccuggaagucuugccuccauugguguauguuagaucuccagggggaguuugaagucaggguauucuauucagaagccuuugagaucaaagugggugaccagcugcccuccuuccuggacuccacagagccucugucagagagccagcccugggcuggagagaucucugggaggccuaguaaucauggagcuccuggccaaagaauguuuuccagggcauauucauguauuaguuccucaauuccucauaggauauuaugggaaaauagggcgauuauuacaagcccucuuuaacagaggagaaaaagccacggggagguacaaugauaacacauaauggaguaagugggcuucaaaucuucaucuucugaccucagucugggaauuuuguggauaagagacccacuugcucacacucccagaaggcaguuagcaagcagccuggguaugcaccgugacauaaagauuagcaguucauuaaacagaguucaguuuaucccgaggaaucuuuacuuagccuccccucuaucacuucauuuccaggccucccaccuaccuuaaggccugccccgagaaaauuugcucugguuuuuuguuuguuugugcaauauaacauaaugcuuguuuguuuuuguaauguagaauaauauuuguuuguuuuuugcaauguacaaauuaagggcaugaauccuggagccaaacuaacuuaauuccaaauccugaugcugccccauauuaauucugugaauucgggcaaaugacuuaguuugucuaaaccucaauuaucucaucuauaaaaggcagcuagaucuuaacucacuggguucucgugaggauuaaaugagauagugccccuaagguuucugguaugaaggaggcacuccuuaaauguucgagacuugccagagggcuucuucucugucuggacugugcuaaugaccacagauccccgguugagaggaaugcccagaccacacucauccuacacucaucccuauacucauugucccuugggaaccaacugcagggaggaggggaaauggccaccacuggagggaguacacagcaggccaagacuuaugggggacucuuccaaauuggggccauggaacugucacuauuucuacucuuuauuuuccuuuugucauccuuuuggguucaccgagcuauagaauaacagagggagaugaauuuagcaaauacaucacugaagcuucucccucggaaguugggcccaagcaaugggaaugagaaagguaaccuuggaccgugggggccauuugauuugaugaccccauccccacuucauuuaucaguuggccaaugaggcauggcgagucaggcauugggccaggcucuggguaaagcaaugguggagacucaaugcuugcauuggaggagcugucagucauuuaccagacacagacuggguccuagagagcugaaauuacuagcucaagucacugcuguuuagugccagagccagccccaggguucccugcccccacacccagccuaagucuaucccuauaccacaggccugaacaacucccccacaauacagugccucacuuuucuuuaagaccuuuugcuuugccaaccuuaaccuuaagaauccaccuccccauccccugccaaagacuggggugaagaaacgcaccuggcuacaguuaccuuucucauucccauugcuugggcccaacuucgggggagaagcuucagagauguauuugcuaaauucaaggauuccccacuuuuugcuuuuacuuccacucacugauaguuucagcuugacgucaagccucuuugaaaaagaggcuuuuuuuuuuaagugaaagaaacuuuauuuugaguaauauacaaaaaaaaaaaaagagagagagagagaaagaaaaagaagcugaaaaugagauuacucaugauuuuuaaaauggccucacugauuuuuaaaaaauguucuuccucuuucaggacuguuuguggccacauuugcacauaggcacaccagccaaaacucauagaucuugugaauucagaguagccugaaacaucaucccuuauaaauuucaaauaggcauuuuguucaugucacugagcuauguguauuuuaagaaccugcuuuacuuaagaugaggauggcaugaaaugaaaacaaaacagaaacccaagggcuuaugggacuuuucucugaggguggggcucugguguuggaggucuggugggggagggggacuugaucccaugccccagagccccugaaacaguuuggguuucaaugugucuuucagcaaaaugaugcuucaacacccaggccaggucucugccucggaagugagugcuucugccaucguccccugccuguccccuccugggucacugguguuugaggauuuugcuaaccugacgcccuuugucaaggaagagcugagguuugccauccagaacaagcaccucugccaccggauguccucugcgcuggaaucagucacugucagcgacagaccccucgggguguccaucacaaaagccgagguggguucuaucacagguauucauucuuucggcacauguuucgcucgcagccacuguguguugggcauguucuaggcagggggcuguuguugagagugaaacaaacaaaaccacugcccucagggagcuuaccuucuccugggaggagacagaaguacauaacauacguaaguacacguuaagagaugagugcaaaggagaaaaaagcagggagcggggcagagagaacggguagggaugggguugcuggguuuaaaaacuuuucaggccaggcaugguggcccacgcuuauaaucccagcacuuugagaggccaagaugggauuaucgcuugaguccaggaguuugagaccagccugggcaacacaaugaaacccaaucucuaugacaguauuagcugggcaaggugguacauggccuauagucucaucuacuugcgaggcugaggugggaggaccgcuugagcccaggagguugaggcugcaaugagccgugaucaccucacugcacuccagccugggugauggagcaagacucauuuugcuuuuagagacaguguugcuccaucacccaggcuggggugcaguggggugaucacggcucauuguagccucagucuccugggcucaagcgauccuccugcuucagccucccaaaacacugggaucacagggaugagccauugcacccagccgggguugcuguuuuaaauuaggaagucagguaaggauucacugauagugacuuuugagcagaggucaaaaggaaaggaagaaggaaagaggagagggaagaagccacguggguaucugguaaaagaaauuaagggcacugagguggaaguauuggugccuggugggcugugcaguggggcagaguauaggggugggagauaaauaggggcuggucauauugggucuuacagauuauuauuguauagaugcagcccugggcucaaagugaggugggaaaccacagaaggcuuuugagcagagaagcaacaagauucaacacacacacacacacacagauacacacacacacuuuuuuuuuugagacagagucuuguucugucacccagacuggagugcaguggcaugaucuuggcucacugcaaccucugccucccagguucaagggauucucaugccucagucuuccaaauagcugggauuacaggugcccgccacacgucuggcuaauuuuugaauuuuuuuaguagagacgggguuucuccauguuggccaggcuggucucgaacuccugaccucagguaauccgcccgccucggccucccaaagugcugggauuacaggugugagccaccacgcccagccuugauuuauauuuuuaaaugaucacccuggcugucauguugagaaugggcaguagggguaagacagaagcugagugcacagaaaggaggccguggcaggaauccacgugagucagggggccugcagcaggagggagcagugcaggugcugagaagugguuggcuuuggaucugacuugaagguaaagcugauuugcugauagauuggaugugggguguaagagaaagggaagacucaagggugacugaguuuucuggccagcauagcuguaagaauggagcguccauuugcugcugagauuugggauuauagggguuagggugguggcaagagcaggaggucuguccuauucugcagaccccuguggagaugucaagcaggcaguuggauaugugagucuggaguucagaggacagucugggcuagagauaauagaguuggaaauuaucggcauauagauggcacuuaaagccaugagucaggaugaggccaccuucuguguccaguuguucugaagaagcuuggagcgugguggucccuguuuuuaucacuacuaggacccaagcacccagacaguagagcaaggaccaggcagccugccccacccuucccuguagcaauguucacagccuugggaccagguguugcuccagguucacuucugucugacacacuugcacuguuccacgcuuggcaaccuuggguaagacuccuggaauaauaaacauggugagaagucugggagguggcuucuggcgaugccauaguggcuuaaggaugucagagcugagguuccaccauuuuauuggccuuuuccucaugguggcaaguggaaguguuucaggcuuacucaacuggcaugauugcagccuuugggcaaggaguagugggacugaccuaaaagacuguccuaguucaccacuugcagguggcaccccagcaugggccgauuaaugccgcuuugguugggaaugggcuuaggugccuuuucuacaggagcaucaugggcuucucccaaauuugggaagcuggugcucugaugcuccaggugaagucagaggugaaugggguugcccuugggucuugaauugaagaagaggccgggaguggguggcuagguaaugauccugagaucauuccugguucucaaagaaaggagauguuuaccagacagaaucuguuucggcuuuaaaugauuauaguuaauaccaauaguuaucaauuugcauauuauccucaucucaaaauccaaaugcauuuuuaaaauuggcuaacuuuuaauuuacuaauauauugccgguauaauuuuaacuuugauuuuuguuguucacucacgugugugugugugcguguguguguguguguguguagggguuuucacacaaaagucuagagcuuuaguauuucggggucuuuuagcgcuagcauugcccuugucugccagcuuuugcuggcaguaaaaggcaguguauuugagguagguggcauuucuuacugcccuuuaaauguguuucuuuuggauuuuacagguagccccugaagaagaugaaaggaaaaagaggcgacgagaaagaaauaagauugcagcugcaaagugccgaaacaagaagaaggagaagacggagugccugcagaaagugagugccuucuagccuuacccuuccucucgcucacgccugucuucaccagcuucauguggcuaucagaagaagaguuagaaaacccccuacuugguuauaguuucccaagaagggccuuguagcugguagcagaaaugccaguugcagaaugaggagguggcaaagcaguuaacacaauggaugugacgguggauguauaaaaacaggugugugaauucgucugaugccugacucccagcagccucggccgguucauacauguccaucagcuuccaggcugcaggacaugccagcccaguuaaagaggcuucacuugacuguuuuccugagaaaaggaagcugccagcucucauuuggcucacuaugaaaagccuuuaauuaaucucuucaaacaaguuauuuccuuaauccacaagcagugguuacacuugcuuugcauucuugucugguuccuaacucuagagcccuucucccuggcuuagccaguaagcugagccccuggcugcguucagccggcccgccugagagacacuaggggaaauagcuuuugugggcaagcaggguggccgguggugcucagcagucuuuccaguggcugugucccuccuccaaauguggacaggccaugacagagucuuagcccaagucccacagauccccaaaaguucuguugauugcuucaggggaucagugaaaauuagggaauuuuguguguugcuauauacauuuuuucuggggagaugagcuucucauugagaucugugacucagaaucgacuaagccaccauaagucuggauuucuccccagcucccaaggcccuuuuggguccagaagaccugcauaugggcuguugacucaugcaaaugagguaucugaacugcagcuucaguauuagcagagccacaggccgccucuguggcaucaccaggguuucucugaagaagagggucugcauuuuccuaaacccagugcugcucucccaucucccaucuuccucucgcagcuugaugagccccggugugucccagguacaccccugcauccaggcagcagcccaggccacccccuccucacuggcccuuggcuccuuucuugaugccucuguugcuugucccccaggagucggagaagcuggaaagugugaaugcugaacugaaggcucagauugaggagcucaagaacgagaagcagcauuugauauacaugcucaaccuucaucggcccacguguauuguccgggcucagaaugggaggacuccagaagaugagagaaaccucuuuauccaacagauaaaagaaggaacauugcagagcuaagcagucgugguaugggggcgacuggggaguccucauugaauccucauuuuauacccaaaacccugaagccauuggagagcugucuuccuguguaccucuagaaucccagcagcagagaaccaucaaggcgggagggccugcagugauucagcaggcccuucccauucugccccagagugggucuuggaccagggcaagugcaucuuugccucaacuccaggauuuaggccuuaacacacuggccauucuuauguuccagauggcccccagcugguguccugcccgccuuucaucuggauucuacaaaaaaccaggaugcccaccguuaggauucaggcagcagugucuguaccucgggugggagggauggggccaucuccuucaccguggcuaccauugucacucguaggggauguggagugagaacagcauuuagugaaguugugcaacggccaggguugugcuuucuagcaaauaugcuguuauguccagaaauugugugugcaagaaaacuaggcaauguacucuuccgauguuugugucacacaacacugaugugacuuuuauaugcuuuuucucagaucugguuucuaagaguuuuggggggcggggcugucaccacgugcaguaucucaagauauucagguggccagaagagcuugucagcaagaggaggacagaauucucccagcguuaacacaaaauccaugggcaguaugauggcagguccucuguugcaaacucaguuccaaagucacaggaagaaagcagaaaguucaacuuccaaaggguuaggacucuccacucaaugucuuaggucaggaguugugucuaggcuggaagagccaaagaauauuccauuuuccuuuccuugugguugaaaaccacagucaguggagagauguuuggaaaccacagucaguggagccugggugguacccaggcuuuagcauuauuggaugucaauagcauuguuuuugucauguagcuguuuuaagaaaucuggcccaggguguuugcagcugugagaagucacucacacuggccacaaggacgcuggcuacugucuauuaaaauucugauguuucugugaaauucucagaguguuuaauuguacucaaugguaucauuacaauuuucuguaagagaaaauauuacuuauuuauccuaguauuccuaaccugucagaauaauaaauauuggaaccaagacaugguaaac

SEQ ID NO: 13019 - RNA, 678 nt, Homo sapiens
cccugcgccuccacccagcgugcgugcacguccuccgcccgcccccgccacgguauccucuggccccucccugcugucccucuguggccggcucguuccagcccucccagugagcucugcacggccgggccggggcccaggaaggacaggagccagugcuaccccguccugcccggggaaaagcuagaagccccgguuugcugcacccaugaaacucggguccccacagcgucuuggcgggguggggagggcggcaggauggacggggcuggccagaggcgaggaggacgggcggacggcgccgccuucuccccuuuuccuuggccgacucuagggagcgauugccucccucccuccgugaccggguggcccagccagcccgucguccccacccagaaccgugcucugggccaaagcccgaagaaccaggcagcgggggccggggcaggcggaccccccgggcucucagcgcccacccgcuccuccgcacacagcagcucgcacaggccucccaccucugccuguugauugaugcagggagaagcccgucccccccucuccccucuccccuccccucuccugcacgcaacgcgcccucucggcccucccugucccccuccucugucucgucuccccaucuggucuggaaccuguuugcaagugaagcaauaucuccgu

SEQ ID NO: 13020 - RNA, 678 nt, Homo sapiens
acggagauauugcuucacuugcaaacagguuccagaccagauggggagacgagacagaggagggggacagggagggccgagagggcgcguugcgugcaggagaggggaggggagaggggagagggggggacgggcuucucccugcaucaaucaacaggcagaggugggaggccugugcgagcugcugugugcggaggagcgggugggcgcugagagcccgggggguccgccugccccggcccccgcugccugguucuucgggcuuuggcccagagcacgguucuggguggggacgacgggcuggcugggccacccggucacggagggagggaggcaaucgcucccuagagucggccaaggaaaaggggagaaggcggcgccguccgcccguccuccucgccucuggccagccccguccauccugccgcccuccccaccccgccaagacgcuguggggacccgaguuucaugggugcagcaaaccggggcuucuagcuuuuccccgggcaggacgggguagcacuggcuccuguccuuccugggccccggcccggccgugcagagcucacugggagggcuggaacgagccggccacagagggacagcagggaggggccagaggauaccguggcgggggcgggcggaggacgugcacgcacgcuggguggaggcgcaggg

SEQ ID NO: 13021 - RNA, 96405 nt, Homo sapiens
uuucucccagccgcgggaaccuggaguccaagagcuccuugagcgccugcgcaggggguagcagaggcgcggacaaaccgcggggugaccagggcgcaugcguaacagggcuugacagcgcgcggaagaaaaaccagcaagaaggcggcgggggaagauggcgguccugggguagaguuugcaagcuuucugacuaggcuagucgaguaacuauucgggucauggcgucaaacucaacuaagucuuuccuggcagaugccggcuauggcgaacaggaacuggaugccaacucugcccuuauggaauuggacaaagguauucgaaagagagggcugaaugggugaaacaggcguggggggaaguggcgccaccagguggugguugcuuugggagaagacggauaggcgcaugcgcaugucuucgcugggcggggagcgccugugcuuuugcuggggcgugggcuuugaccccuucgggagguugcgggaaauuugcaggauugugugacuggccuuauaccggcuaaacaaguagcgagcucuagugagaggcccguuuugaccacuugagggagcagucccccgauuuucuaagcagugacaguggcuaguuucuaagagacacugcaaagaaauugugaaauugguuuucagucuguucaguugagaccaggucuucaugaaaugugcugaauaguaaucuugcaccgacuugacagcgauucauuugauuuccauagcucuguuaccugcggguuacaaggcaggcuaaaccuggccaagaccauaaaaaagcaagggcccugcucauucucugcggacaaguuccaggaguucuguugccguacagggagcagcuugguguagagggagcuuugggguuacacugaguuaaguuucaaugccgcugauuuuaugauuaacuucaucuagccucggcuugucgucugcaaaguggguacaguaccauugagccggcagaauuguauuaagugacuuaaugguaugcaaaagaagcauuuaguaaaugcugaagagauauaccucccuucuuagauguggauaugggaggcaaggucggaaauuuguuaguaaagaacucgacuaguaauaugaaaccuuuauuucauauugaggauuuuuauuguacgggaaacauuucggcagcugguauacaauuaaaucuugauuaaucguagccaauauauaauguuggagaacuggacuagaacucagaaggguuugagccacuucccaguuuucugaguuggacaugucuauuaacuuuuuugggacucuuuuucuguuuauuuuuuaaacugugaauauuuuuaguggguuagucuaaauaagaguuucucaggcucuuaaaaaagcuuuuaccuuauuuugauaaacacaaaaauuucacagcccccuaaugggauauuccuuugguugagucucaguaucuuuagugcacccccaucaaccaagaaaauuauguugaacuuuuccuucucuuaccaaaucuuuagggguuuucuccucugaaaaaaaaaaguauaauacuaaauguguuuuucucuuuuuuuuuggagacagaguguugcucuguugcccaggcuagagugcaguggcgccaucucggcucacugcaaccuccgccucccgaguucaaacgguucuccugccucagccucccgaguagcuggaauuacaggcgcccgccaccacgcccggcuaauuuuuguauuuuuaguauagacgggguuucaccauguuggccaggcuggucuccaacuccugaccucaggugauccguccgccucggccuuccaaagugcugggauuuacaggcaugagccaccgcgcccggccuuaaauguguuuuucaaacacuuuccuccucauucugauacauuucuuucuuauuccucagugaaaguuacaggucaggauaauaucuaauaucccuacgaguucuaaggacauuuucuaccauucuggugcagcugagcuugucucaugcugacaauaggauagugguuguggaacagggauaaagauggggcacugaagaggagucuagaaugguuuaauuccucaaauuuugcaguuguaagaaaaaaaccacaauuuuuccuuuuuaaagaagaguugaaaugaaaauauuuuauaucuauaggaaagaaaucaggugucaaucuuagacacagaguaagugaucauuugcacuccucccagcaaugccuggcgugaguguuuuacaggugaaucucaggcucagaaagaugacuuguucuuuuucaucucaucuguaguaacuuuuaaagcuguuaggaaauuaaguuauagaaauagccaguuucguguagaauauaguugaguauuuuaaauauugagucauuucaucuuguaccuguuaaaguauuucuguuuugugagcuaaaggucagaaggcuacaaguuccaacucuuuuuuucguucccaaacuccaaggaauacuguuucugaaauaucucccccaccucagcauacacacucagacacaugacuuauuugaucgggcuuuguacuaggaacauggcaguuaaugagacaaaacuccugccccuauagagcuuacauucuagacagcagaugcagacacuccgcaaauauagcaaacgugacaguuagugauacauauuauaaaggaaaaugaagcaaugaaagggacuggagaaaacugaucuggggcuggaguugauuucuuauuuuaugaaguauaggcaagaaagaccuccucaaucaaguggaagaacagcaaguacaaaggcccugagguagaagccuccuuugcaugcaguuaucuggagcaaaguaauaggcaaugaguauagaaagauaaccagagucagucgggcguggugguucacgccuguaauccccgcacuuugggaagcugaggcgggcggaucacgaagucaggagaucgagaccauccuggcuaacauggugaaacccugucucuacuaaacaaaauacaaaaaauuagccaggcgugguggugggcaccuguaguuccagcuacuugggaggcugaggcaggagaauggcgugaaccugggaggcggggcuuccagugagccgagaucacaccacugcacuccagucugggcaacagagcaagacugucucgaaaaaaaaaaaagaaagauaaccagagucccguucagguagggccgugcaagccaucaaaaggacuggcuuucauucugagugagaaaggaaaccauggaggauuuucagcaggugugugacaugaucugacuuuccuuugaaaaguaucagucuggcuacugugcugagaauagacugaaguggggagggucagggacccaaguagggagaccaaugagaaggcaacuauaacaauccagggaaaagaaaauaguggcuuagaccgagauggugacacugaaaaugugugaagugcugagauucuggauauacuuucaaaguagagccaagaagauuugcuaauggauuagaugaggauauaagaguaaguggucaagaaaacuuagagguuuuugguaugagcuacugggaggauguauguauuguuuacugaaaucaaaucaguuugggucauguuaaauuugagaugucucuuagacauccaaauggagaugauuagucaguuaggcauaagauguaaccuuugaacgcuauuuuaaagaaauauuuuguggcacugguguccuuagaaacacacucaggaaaugcugccauucauaaccuguuauauauuuauaacuguuguacuuuauucugagccuuuugagcaagcauuggcaguaagcugauuguuucugaucucuauaggaauaagugaauacuauuuugaagcugacucaauuccauuacuuuaggauguaguuaguaacaggaaaaucauccuucaugugauagccauucauuuacucaacagauauuuacugaccaccugcauugucucaggcucuauacucagacuaggggcuauguuggcaaacaagacaucuuuaaggagauugcauacaaauguaaggagauggacaaugcuagaucaaauguggugccguuagucaggacaagaaguuggauuuugugcagagugcaaugggaaggcauugaaaguuguaggcugauggccaugcugcuugagcuucuguaagacugagcauacacaagcagaguuaagugucauaaucaaauacauuacagcuuauguuuaucugacacauuucaugauaugaucauuacuauacauaauuggcaauauaaaggaugcaucucacaaaaauuaguguaacuuuuucacuaauauaauuucuuagucuaaacauuuuuagaucagcugauggaagguuauccugaugauuugggaaaacuuaugcaagaucuccuucccccugggaaaagaggagucucuuaaaugauauuauucagccuaucugccuucugcaauguugaccuuggaaaggaugagaugaaagcaauggggaagagagcagugacucauucccuuucuugcagcugaugcaaugggaagggaggaaauauagaggauagauuuguuacuagaggugcuggugaauguaaugcugugugaaaaaccuugauggugugcuuaaugaaaaauuuaguuaugaaauagagaaaugaugugaaucaggacaacugucucugcacucuaauuucccccuuagacggugucaccucaccuguauuccaaaauaccugaauucucagaccaucaagaaaguuugucaagaaagaccacagauugcuuuuacauuaucgauauggcucagauguuguugguguuucaguaaacaaauaugaggccuuuggggaaguaucuucauaggcccuccucaagagaaaggccucagcagccagauuuguuccaggugacuaauuccauaccauaacugauugauucagaaguaggcaugugacccacacugagucaaauucuuucuccugagaaucucugcugccagaccacacuuagucugagaguguugagaagcggaccuauaaaaucauauagaauuaggccgggcgcagugacucacaccugucaucccagcacuuugggaggccgaggcgggcggaucaccugaggucaggaguucgagaccagccugcccaagauggugaaaucccaucuguacuaaaaauacaaaaauuagccgggggugguagcaggcaccuguaaucccagcugcucaggaggcugagacaggagagucacuugaacccaggaggcagagguugcagugagcugagaucaugccauugcacuccagccugggcgacaagaaugaaacuccaucucaaaaaaaaaaaacaaaaaaucauguagaauugaagcuaaggugagacucugggcaacuuaaugcaacauaaaaaccagcagccugguugguaauuccuugaugggcuaugaacuaauccaaaaauucaaguuuuuacugaaacccacagacucauucuuauauauaacuaagauuuacugucuuggaauuugcaaaguggguuauuaaauauuccuagaaguugguauccauaaacucaaauuuguuuagaauucuagauuaguauucucaugugcauacuggaugauguugcauacaucuugccauguacguuuacagacauuuucugaaauuugggggauggaugcugccuuauuaaugcaucauuaguuuucacugucauuuuacuuguuucuauuucugcuuuuuaaauauaaaaaugggcuuugccaucaauuuuuuaagcuguggguuguauguuuguguucauguuucuacccauguccccccacacaccuuuuauuaauguauagauuuuaagauauguucguguuaugguucaauuuugaaucauccucaucucuuagcuaaagcaaauguaugucacaaauuguccuaaauuguguuuguuugguaaugcuuuauuugugguguucuuuguaguggauguuaguuauguugaugguugcuuaauauauuuugaacacucuuuuuaugcuuaaggaaugucccauaucaugaaccuugucuuacuaagguagaagcaaaaacuuauuuccuaguuucccuugcaagagugcaggaucugacuuaggcucugccagucagacacaccuccuucacacugucugauuuagaaguuagagaugcaagaaggaagaguugaaguguccacucacaguucugccauggcagcagcaguauuucuagcuuacagcagcaacaacaauggcuacgauauuccuagaugacagcagagcuaauuguugcaucugguguuuccuaucaaagacaggguucuuccauccaguugguuggguagugugguauuagguguuccuagaaauuuagccuuaaaauuguuucuuaagcuuuuaauaaacucauuuucugccucauaagccagaguuagcuucuguugcuugcagcuaagaacugcugauagaugcuacuuggagauuugugcuguuuugaaaacuugauuaauguguaucccaaaccccaaguuuaccauaauuuaugguauuccccuaauucccuagaauucaucaccucagaauuccaccauuuaaucacuaauuuaaaugucucauucuugaaucuuaaucucuuucuuucuaguugcuugcuagagaugcauuuuagcauagugguuagcacuauagccuuuggagcuacauugccagaauuugaaucccagcucugucauuugucagcauuguuguuucuuacgcaaauugcuuagcuugucugugccuguuuccucaccuuucaaauggggaaaauaaugguaccuaauuuaugugauuuuuagugagacuuuaauacaugcaaagugcuuaaagugacuggcacagaauaagcacuucauguguaucaucauuaucauuaugauuaacugcuauuuuggcuagucuuuauuuucauucagaccucgguauuucaccucucuacauuucuguaccuguuuuacuucuuuguucagcuuagauuucaugguccuucauuuuauuaacugcauuuacuuucuuaccaguacuuuaaauucacauccaagguuccauucuacucauguauccccaaaggcagucaaaaauugcugcagaaagucauacagugggguacauggcuaucaucauaaaugggagccgaaucuacacugaccuucaacauggaccugcaguacuguaauguuucugcaguacuacuauguuucuuuggucagacacuucuaccuucuucaguaagauuuuagaucuuuuacuuuucuaaaaccagagauccugggguuuuaugugaaguaugauuuguaaaacuugacaguguguucgaaaccuuuaaaaacauugugccagauaaaagcauucugaggaccaaauucagcagccuaguaguuuucuaacuccaguauaaucagugugggcaggcuaguuaaauaaguuaucaaguggcagaaguuaacuugagaaucuaggugcuggcugggcgcaguggcucacgccuggaauccuaguacuuugggaggcugaggcgggaggaucaccugagguugggaguuugagauuggccuggccaacauggugaaauccugucucuacuaaaaauauaaaacuuagccaggugugauggugcacgccuauaaucccagcuacucggcaggcugagucacaagaaucacuugaacccggggggcggagguugcagugagcugagauugcgccacugcacuccagccugggcggcagagugagacugucucaagaaaaaaaaaaggaaucucgaugccaaccuuuucaaaguaguuaaacagaugccugggacucugccccauauauuuaguagguuuggaguaaaacccauagcauagauauuuuucaaaaacuuagcagauauugcugaugcagaaccaagcugaaaaccacuagccuggcaaaaagcucugcacacuuuaagugcgaaauaauguuagaauaaugaaugcuuuacuacugccaaaugaauuuugaaugaauaaaugauuuuacagccuauuuuaguuucccuggucuacaugcauguugcaacugaguuaagcacuguuuaaguccaggcacagaaaaggaagagagaucuguuuuuguuuuuguuuuuuuuugguggaagaauacaaaauaaaauguagguauagcaaucacaucccuccuucuuaaucuuaucucugggcuuacaguaguauucuuaugauuaguggucuuaugaccagggcauucuuccuguagcaagcaauacaaauaaaaugucuagccccucuuauacuagaacuggaacgugcugagcuccuguuuuccagugcuuacaaaauuggccuagagcaagcaagaugaguaccauacuaccccaacccagggcuguugcuaaguaauaggccuuuaaagcacuuuuuccuucuuuuucaccuuagcuccuguccuucggagccagccugaauucucacuaccucuuuccuaaggagggcucuuacaucagaaaauacagaagagguuuaauauucuuuaguucauuuaccccguggcguuguuacagaggaaugagagucuauuuuaucucagagaaaaaaguuugaugauauuagauaaaucaaaacauucucucgcuucauucaaaauaaucuuugguacauuuuaaaucagcauguuuaaacaaaucaauauggucuuugguucuguuuuucaagggaagauaaaacaugauuauauucugucaaggagacuaccuguacauaggcuguuuccuacuaugccuuuuucaucucagccaagguuaauucauuacaaacagaacuuuaccauccuuuguaucuaacucagcuacugacagugagaagaaaaugaaacaauccaauuacuguggauuuuuucaaccccuuugccaacacauauacguaagcacacaucucuguuccuucucaccuccauccucagcuaugucuuuccccuucucugcccugugugucccuugacccguuuuucauaucaggcuuuuagaaaaguaaggcuacaugagccacacugccagcuacuuagaauuaucccuuuuggcguuguguuugauaggaaaaggauuucuagagcuucagaggcaguucuuuguguguguaagagggugaaggggaggagggagcagaugaaggagggauguguucuaucucaguuagaaauguuaauuaauuuucccauagaaacauuuauuauaaaugguuauuagguuccagaguacugugagugccgauagugcuauuauuuuccuaugaggaaauaauguucuaaguacugaauaacuaacaugagugcauuacggaacaucacccauuaguaaaugauagaaauuaccuaugcaguuuuacuuugugguugucuuuuguaugaaacauuguggcaacuaggaaaagccuucagauuuccuuugucuuuuuguuuuuuuuggagacagggucucugucacccaggcuggagugcaguggcgugauauuggcucacugcaaccuccgccucccgaguucaagcaguucucaugccucagccucccuaguagcugugauuacaggugccugccaucacgcugggcuaauuuuuguauuuaaacgggguuuuaccauguugcccaggcuggucuugaacuccuggccucaggugaucugccagccucggccucccaaagugcugggauuacaggcaugagccacugugccuggccuccuuuguuguuuuuuuuaagaauaaucaaagguuacuggacagagauauucuaagauacuuauuccugugaggacauaaucagcauuuugugacugguaaaauacuaaacagagacauuugaaauugaugcuguuaaauccuuaccaagguauucauucuuagugaauuuuuuuuuuuuuuuccugguacagcugugacuccaggcaggauccagagaggaguuuuccagucucuucucuggguuuuguagagacuuacuuuauccuucuauguuagcuucuuaaagcaccacaucaaccuuaaaagggcauaagaaagggcaaauucuuaaugcauuuuuuagaaaauugaauauuaacucuuuuuucuugguuggguuuuuuuuuuaauuuuuuaaauaucagauuuagugagguauaauuuguaucagauaaaauucaccaaauguaugcagucaugaaaccaugaccauagucaagacauagaauauuuccuuuaccccaaaaacuuuccucaugccccugugcagucaguucccucucucuagcuccuggcuaccaccaaucuguuuuuuaucccuauaguuuugccucuuccauaaugucauauaaaauagaaugauacaguaaguuaaguguaguccuucaggucuggcuucuuucacucagcauaaugauuuugagaucguuuuaugugguuaaaauaagguaugauuucacaaaucacgcaguuuauuaccauacagaaagaauuuucccugccuuuuucacaauguuuagagagggagaauaacaagaacacaucucacagggaacacguuugauagacaaaguccagaaaccacaugugagugaauacuaguuucauuuagagucaaauuaguaaagucuaguugcgcauuuaggauggaaacaggccucugugaauguagucuaauugaaguuugagguguaccuuucuaugagauguucucuggagagaugaucagaccaacaguggagauccaugaugacaacaagauuuucaaugcuaggagccaugucaucagggagggagauuacacuccauguucuuaucacagcagaaaauuucacucacaauagcagacuauguguuuguaaucauuucaaagcugcacaacagagauccaccuuuguuguuguaugcaucaguaacugguuccuuuuuuauugcugaguaguaguucauuguauggauauaccacaauuuguuuauucauccacuaguugauuaacauauguguuuccaguuuggggcuauuaaugaauaaagcugcugugaauauuugcauacagauguuuguguggacauauguuuucauuucauuuggauaaauagcugaaaguaguauugcuauguauauaguauguuuaccugcauuaagaaagaccaaacaaaaaauaaaaugccuaggaauacaucuaaccaaggaggugaaagaucucuacaacgagaacuacaaaacacuaccaaaaggaaucuuaggugacacaaauggaaaaacauuccaugcucauggauuggaagaaucaauaucauuaaaauggccaaacugcccaaagcaaucuacagagugcuauuacuaucaaacuaucaacaucauuuuucacagaauuagaaaaaaaaaacucuucuaaaauucauauggaaccaaaaaagagcguaaauagccaaaccaauccuaagcaaacuaacaaaacugaaggcaucacauuacccaauuucaaacuauuuuguaaggccacaguaaccaaaacagcaugguacugguacacacacagucacauagacagcagaauagagaacccagagauaaagcugcacaccugcagccaucugaucuucaacaaagucgauaaaaauaagcaaugggaaaaggacucccuaugcaauaaaugguacagggauagcuggcuagcccuaugcagaagaaugaaacuggaccccuaccuuucaccauauacaaaaauuaagguggauuaaauauucaaauguaagaccucaaacucuaagaauccuagaagaaaaucagcauugggaaagaauuugugacuaaauccucaaaagcaauugcaacaaaaccaaaaauggacaagugggaccuaauuaagcagaagagcaucugcacagcaaaagaaacuaucaacagaguaaacagccuacagaaugggagaaaauauuugcaaacuaugcaugugacaaagguguaauaucuagagucuauaaggaacuuaauucaacaagcaaaaaccaaauaacccuauuaaaaagugggcaaaggacaugaaaaagcauucucaaaagaagacauacaagcagucaacaaacaugaaaaaaaugcucagcuucaguaaucaucagagaaauguaaauuaaaaccauaguaagauaccaucucacaccagucaaaauggcuauuauugaaaagucaaaaaauaacaugcugugaggcugugaagaaaagggaaugcuuauauauacacuguuggugggaauauaaauuaguucagccaguguagaaagcaguuuggagauuucucaaagaacuuagaacugccauucaacccaguaaucccauuacuggauauauacacaaaggaaaauaaaucauucugcccaaaagacacauguacucauauguuuaucccagcacuguuaacaauagcaaagauguggaaucaaccuagaugccugucagucauggauuggauaaagaaaacaugguacauauauaccauggaauacuaugcagccauaaaaaagaaugaaaacaugucuuuugcagcaacauggaugcagcuggaggccauuacccuaagcagauuaauguaggaacagaaaaccaaauacuguagguucucacuuauaagugggagcuaagcauuggguacacauggacauaaagagaggaacaguagacacuggggacuuuuaaaaguagggaggaagggagggagaggggaagaguugaaaaacugcuuauuggguacuaugcucacuaccuggguaaugggaucaugcguaccccagacuucagcaucucacaguauacccauuagcaaacuugcacauguacccccugaaucuaaaauaaaagaaaaaugaaaaguaaaggaaagagccagaggguugucaaaagagcuguacaguuuuacauucccacuaacaagguaugagaguuauaguuaucccauauccucauuagcacuugacauuguuggucuuuuuaaaguuuuugccauucuagugaauguguaaugguaucuuaguggaguuuuaaauugucauuucccugaugacacuguugagcaucuguucaugugcuuauauuugccauacauauuucuuccucaaugaaauuucucuucaauucuuguccauuuaaaaaguugguuuguauuauggaauuacaacaacuguggaugaaguccuuuaucacauauguguuuuguaaauguuuucuuucagcaugugguugucuuuucgucuucuuaacagugucuuuugaagagcagaaguuuuaaauuuugauggaauuuaacuuagcacuuuuuuauuuuaugguuuaugccuuuuguuuuaucuaagaauucuuugccuaaccuaagcucauaaaaauugucucuaugucuucuucuacauaguuuauaauuuuagcucuuacacugaggucugugguucauuuugaguuaauuuuuguguaugaugcaaguuaaggguggagguugauucuuguugcuuaugcuuaucuaguuuuuccagaaucacguuucaaagauuauuguuuccacauugaauuauguugguaccuguguuagaucauugauuugagaacuuucuucuuucuugauauaaaccuucaauguuauaaauguuccuugaagcacuacucuaguugcaucccauagauugugcuuuuauuuucauucaguucaaaauauuuuucuaauuucuucuuucagcuguggguuauuuauuuauuuguuauuaaaaaauuuuuuuugagauggggucuugcacugcugcccaggcuggagcaccgugacacaaucacagcucacugcagcuucaacuucccaggcucaagugauucguccaccucagccuccucaguagcuggguccacaggcacacacaaccacacuuggauuuuuuuuuuuuuuuuuuuuuaagagaugaggucugacuguguuguucaggcuggucaugaacuccugagcucaagcaguccuucuuuucccagccuuccaaaguguugagauuacaagcaugagccaccuauggguuaaacgugcuuuuuuuuuucuuauuucuaauuuaauuccauguggucagaaaacauacguuguaugauuucaguccuuuuaaauguguugagauuuauuuuauggcuuugaauauucuuaacucuuaccuuuaaaaaauuuuuuuucauuauuauguaucuaaaaguagcgauuuccagauuacuauuucaauauaccauuuuuacuuuuaaaaggguaaugaauuauacuuuaccugcuucuuaagaaugauuauuucuuuacuaucuaguaaauuauauuugcuauuuuugcuuuguagccacaaauaugcaaacuguucuucccucucugugcuuuuuuuuuuccauaggccuaagaucuggcaaacuuggugaacagugugaagcaguuguucgcuuucccagacuuuuucagaaguauccauucccuauucuuaucaauucugcauuccuaaaguuagcugauguuuucagaguuggguaagucuuuuuaaauucucgauguccuaaaguacuuuguucauauuucuuguuuuauauuguggucuuuuucuuuuugccuuuuaguacuuccaccugguuaguuaccauuaguggacacacaugacugugugcagcacaucagugugagauuuaaugacauuuaaagcaaaaugaagaguauaauuuagacgauacuuauuucuuuggagaacagaauaaaauuaagacaaccuuaauauuuuacuguguacuucaggaaaaucugugucuuuguacagauuguuuuugagaaguuucugauuuaauuuaauaauuuauuuuauagcaugagaugcaugucugugaaguaccugaaacauguaagcacugaauacaugccuauuugcuuuuucucccccgaccauuccaucuucugcugcuuucugccauucuccaugcacucgugcucauaugcacacaauaccacacuggaaggagaaaagaaguuguggaauaagcccaagagaagagaaagaccgucugauuuccuggccuugguuauaauauaguuugaggagauuuaguucugcucuaggucuucuccuugugucacugccauuuuggugucuugcagcaagacuguagcauagcucacugcuuaugcuuaauguccaccuaaaguacaaacuuuaacucuuuuaguaguuaaacaaauaauguuaagauugaaaaauauuuguguguugcuaaaauuuaauauuauuaguguugcuuugguuccuaauuaaauauuacuuucuaaagugaccuaauuuauuucugguuuuucuagaaauaauuuccugaggcuauguguucuuaaaguuacccaacaaagugagaaacauuuggagaagauucuaaauguggaugaauuugugaagagaauuuuuucugugauucauaguaaugauccuguggcaagagccaucacccuccgguauauaccguauuauaauaauucacuaugagauuauuugaacuguaauuauguacaaaaaaggcaguguauuuacauuuuucauuuugaguauuaggaguuguuuauguuuuuuugacuaagagucaaggcaaaacugugauaacuaucccagucugcaaaugcuuuuuaguuaacaucuguguuaacuguuuugguuauaaauuguugccuaacuuguguuugaaaugcaucucuauguagauagguguucugaucaaauaacuugguggaucucaauauagcuuagccucagcacauuuugaacuucguguuccugcccuuguacuuaauguuuucugucaguuuucuauauucuuccuugauuaugugaucauuuuuaaugugauaaaucauauuugauuucauuggagaacaucagauauaaccacuauaguuucuuuagcuuuuucuuuucuuucuuggcauauuuaaaaaaauuuauuuguuagaauuucauuuuguaagccuuauauccagcuugaaccauauucucuuuuuagcucugccauuuauaguaucauaucuauaacuuuuuauaucuuuugaaauucacuuuccuaaauuauaguguucauuucugaccuagccugcccagacagucuucuuuuuaaccaggaaguuugggaugucacaucuucccugagugucguuuuuuccauaucaggaaucaguucuuccuucuuguucagaauuuagugcuuuugucauuucuuugccuuuugagugauuaaauugugaguaauaugugauauuuuaaagucaguucauugauuuucaucuuuugaaagcuauauucaaucgaauuaauuaauuaauuaauuuauuuauugagauggagucuugcucugucacccaggcuggagggcaguggcgugaucuuggcucacugcaaccucugucuccuggguucaggcaauucuccugccucagccucccgaguagcugggauuguaggugcccgccaccacacucaacuaucuuuuuuuacuuuuaguagagacagcauuucaccauguuggccaggcuggucucgaacuccugaccucaggugaucugcccgcuucggccucccauauuguugggauuacaggcgugagccacugcaccugucccagaauuuaaauuuaagguauuuuuacccuuuacuucagcaaauauaccuauaggaauuuuuuaaaugaaucauuuuuaaaaguuggugaauauauguauauagaugauuauaguaucauuuuuguagaaugaaaaauuggggaaaaaucgacaugggaauagcuauuggugaacuacuguauaacuuuuaaagaguaaagugaguugugagucuauauauacugacauagaaagauauuguuuuaaaaaguagucaaauaguauccauuuuguuaacucauuuugcuaguugauauuaauauauauguuuauauaggcucagaaaaaaaucuagaggaauauauacuguuaacagugauuauuuuugguagagucuuuggguuguagauuacaagaggcuuuuccauuuggcuuuuuuugguaauguuugaauugguuuucacaaacaugguuuuuuuuuuuuaaucaaaagauaauagaaaagaauagaauuuaacugguggaaugaauuucauaaauaauuuagagcuagccugaauauuuugauaagaauguagauuaauauuugaauguuaaucauuuuccaugcuugcccuucucuaagucauggcaauugacuuuugccucaauucuuuuuuuaagcacugugguuaucaauaaagccagcgaucucuagaaagcuuccaaaaagaaggaucacuuuaaaggaaaaaaaaauuagauugaaaucagauuuuucuacaguaacacuugaugcaauaaguauuaaaggaaaauugagccaagaauuuuauaucuaauccaguuuucauuuaaaagaguaguaaaauaaaaagauucucaggcacacaaggccuuaggagguuugccauauaggaccuguuuuguaaacauucuagaaggagguacucaaguaggaagagaaaaauuaagccggaagcagugggaauaagucauuaaaugugucaguauuagccuagucuaaucuuuucugguauaauagauuaauagucauuuguuauuucuuuugaaagauguauaauuccaaaaccuucaaauuaaauauaaauuacauauuuaguccauuuuaguuucuugcuacuaacaguauuacuuauuuuuaacaguacuaggaacaguacuacuuugaguguaauuacagggaauaauuaggugauuacaugucacauuggaagguuauuuaggauguugacuuugaagaagguugucauuguaggaacauuguagguuuuguuuacugcaguguuuugcaaauuucuaaaauguaugccuuucugcugaaaggauuuuucaaacuacuuucuguaguuuauaccacaaacaauagauuuuuuuccuuucuaaauguaugauuuuauuauaaaguagacuguguuuuccaagcuuuaccuucugcaccguuguugauucuggugugagccccaggggcguccucaaccacugcuuucuugaucuugaggacauuugaaaaucaucauaccaauauuuacugaugugggaaaaaaagauugggagcucuuacuuuuuuuuacuuuguguaucugcuuaacagcaaaaauguuguauucuuaaugcuuugcugaaauggacuucuuuaugcaacauuggaaaauugauauuuugaugcuuuaauaauucagaaguuuccuuccugggcuguuugguaccugggagguacuucaaggugauuguuaaaaauuuugcuuuuuagauaagccauuuuaauuuuucugacauauugaaauauguaaaagcguuuaaaauuugagucauggauuucuaaaguuaugcuuuauuaacuggaguuacauagaauuaccuauaaacuuuaguuuugauaaucugacuuugccuugccucuuacuuuucugaccuugacuuuauuuuaugcccgaucuucuuggguuucucuguuucuguaggauguugggaagucuggcaucaauaauuccugagaggaagaaugcucaucauaguauucgucagaguuuagauucacaugauaauguagaaguugaagcugcuguuuuugcugcugcaaacuucucugcacagucaaaguaagcuuacaaaaguacaucccuuuuaguaauuuggcuucccaagaaaaauuuuugaaggaaaaacugaucaacuuauauaaacacugagagauacaggaaaguguaaauuacaagguguguuuuccaagaagguuuaccuuauguuggggaaacaagacuuaaauucauaaaauggaaaauguaaguacaaauguuggcauuaauuguguaaaugaaaugaguuuccagaaggacaggaucagcauagauuaguuggagaaggcuucauuggguagcagaagcuuuguugacugaggagcuucucccagacauauagaucuguaauacuaaauugcuuacuuacugucuucuaauguuaauuuguuuugcauuagagcuguccacaguuuggcaaagacaauaacuugaauuaaaaccaauuuuaaccuauucagaaugucauguccuacacuguuguuuuacagaacaguauuuuguuuugggcaggaggauuaaauguugaccaugguuuuauuacuauguuugauuggcuucucuucuguaaaagaaaauacaguaucucccugacugacaggaaaaguagcauugccuucuggggugcauuuugguaauauguaugaaaagccuuaaacaaguacaucccuuugacccaggaaauucacuucuagaauuuauccuaagauaacagcaauauguacugauaauuauuuguauggaugcugguuguaguguuacuuguaacaacaaaagaaaugagaagcaaccuaaauuucuuccauugagcuuagauaaauuaugaucauacaauagaauacgguaacaacuuaaaaccaauguuuuuagaaacauauuuggaagcagguuacauaauagguuauguaauauaacagguuuguuuuaaaaaaccccaauagcuuauauaauguaacagauuuguuuaaaaaaaauaaaagccguaauauuuguauuuaugcaauagaaaaaaagacuagaaggauauauaucaaaaucuugguaagaugguauauaauuuuuauuuucuuuuuauaaauuucucuauaucucuauaucuuggcaugagcaaguuccaguuuuauaaccaggugaauaauaaauuuuuugaauccugaaaaguuaacuuuuuuuuuuuuuuuuuuuuuuuuuuuuuuuuuaguauuuauugaucauucuuggguguuucucggagagagggauuuggcagggucauaggacaauaguggagggaaggucagcagauaaacaugugaacaagggucugugguuuuccuaggcagaggacccugcggccuuccucaguguuugugucccuggguacuugagauuagggaguggugaugacucuuaacgaguaugcugccuucaagcaucuguuuaacaaaacacaucuugcaccgcccuuaauccauuuaacccugaguggacauagcacauguuucagagagcaggggguuggggguaagguuauagauuaacagcaucccaaggcagaagaauuuuucuuaguacagaacaaaauggagucuccuaugucuacuucuuucuacacagacacaguaacaaucugaucuuucuuucuuuuccccacauuucccccuuuucuauucgacaaaacccccaucgucgucauggccuguucucaaugagcuguuggguacaccucccagacgggguggcggcugggcagaggggcuccucacuucccacacuucccgggcaggggcugccccccaccucccucccggacggggcggcugcccgggcgggggccgccccccaccucccggauggggcggcugccgggcggaggcgcuccucaccucccagauggggcggcugccaggcggaagggcuccucacuucucagaugggguggccgguuagagacgcuccucacuucccagacgggguggcggccgggcacaggcugcacuuugggaggccaaggcaggcggcugggagguggagguuauagcgagcggagaucacaccacugcacuccagccugggcaagauugagcacugagugagcgagacuccgucugcaaucccggcaccucgggaggcccaggcgggcagaucacucgcggucaggagcuggagaccagcccggccaacacggcgaaaccccgucuccaccaaaaaauacaaaaaccagucaggcguggcggcgcaccugcaaucccaggcacuuggcaggcugaggcaggagaaucaggcagggagguugcagugagccgagauggcggcagcacaguccagccuccgcucggcaucagagggagaccguggggagagggggagggggagggggagggagaggauaaauuuuuuuaaaauuuaaaaaauaguauuugcauacccuccucuucagcuuuuuuuuuuuuuuuuuuuuuuuugagauggaguuuugcucuugucauccaggcuggaguacaguggcgcaaucucgggucacagcaaccuccaucucccagguucaagugauucuucugccucagccuccgaaguagcugggauuacaggcgccugccaccaugcccagcuaauuuuuguauuuuuaguaaagaugggguuucagcacguuggccaggcucgucuugaacuccugaccucaggugauccaccugccuuggccucccaaagugcuggaauuacaggcgugagccagugugcccggccccuucagcuauucuuaucaaaccuucagaguuccaggaauucuuacugaaaaaguagauaauagaaagcauauaauuuuuaauuucacagaucaaaauuaauagaugcagcaguaauugaugaucagaaauaccugaauaaguacaguuccuauuugugccuuugaaaauaagcauuuuuuucccucauugagagagucguugguauugagaggacuuuuaaaaauuucagucacacgucucuuaacuaugagguuacauucugagaaaugcauuguuaggaaauuucaucauugugcaaacauuguagaggacuuacacaaaucuagaugguauaaccuacuauacaccuagguuauaugguauagccuguugccccaggcuguaaaccuguacagcauguuucuguacugaauacuguaggcaguuggaacacagugguaaguauauguauaucuaaacauagaaaaggcucaguaaaaauauggcauaaaagauaaaaaugguauuccuguauagggcacuuaccaugaauggagcuugcaggacuggaauuugcucugggugaucagugagugagugauaaaugaaugugaaagccuaggacauuacuguauauuacuguagacuuccuaaacacuguacacuuaggcuucacuaaauuuauuuuugaaguuuuucuuccuucaacaauaaauuaaccuuaccuugcuauaacuuuuuaacuuuguaaagucuuaauuucuuuuaacuuuuugacucuuuuguaauaacacuuagcuuaaaauacaaacauacagcuguauaaacauacuuucuuuauauccuuauucuauaagcuuuuuuuguuaaaauuaagacauagcugggcacagugucucacaccuguaauuccagcuauuugggaggcugaggccgggguaucacuugagcucaggaguucaagaccagccuaggcaacauagugagaccccucaaagaaaagacacagagacacauacauuaaccuagaccuacacagggucagacaucaagacaucucuggccaauaugaauuuuucagcucuguuauaaucucuugaggccacugucaguauguaguguguuguugaccaaaacguuguuaugcugcacaugacuguacuuuuauugauuaggaguugugccuagggaauaauuaccaucugauuaccacugccaaggugucagugcuucauagucugucagauuaaauauauacuuccagugcuuccaaaaauaguuuucuaaauuuaguuucuaaauuuaguuucuaaauuuggaugauaaauuuguaguuuagugauuaaauuuuauauaugagaaucacuuuuaguucaguuuuucucuuguguucuuauuagaagcuaauuuuauuucacucugcaaaauuacugguuuuggaaaaugauuaagaccaaguaagagaaacagcaagauucuucacuuguggaaaugaugauuaaacaucuaaauuagcaguuuauguagaaacaguuuuuaauauaccaugcuucaauaugauguacuucuaauuuauuaaaaaauaccaaaugaaucucugucaccuaggcuggaaugcaguggcgcaaucauggcucacugcagccucgaacuucuggacucaagugauccucucaccucagcaaucccaaauugcugggauuacaggugugagcuacuguggccagcugacaagacuuauauuuuugauaucaguguucauaucuucucccggaaauaaugaccuggcuugagaucacauaucuucgucaguacugauggauuuuuuuucuaguaucuguauugaucaguuuuggauauuaaaucagaguaacaagccaagccaaauaagaccuuuagaauuuauuuaauccuguucuccgcccccuccccccccaaucuccuaccauaaccacauuuguuuuauucuaaauugcuagucccuggguggcaaagcaggaguuacaaacucacacgcuuucaggggccaggugaacauugucagugagagcaguguccccuaguggcaacuguggugaacugaagcacguccacuccaucuaaagugccccauggcaccagccuauuguuaacagugcaggaauggaugcccagugcucagguuuuuggcaaaggagaggggauaaucugaaaaaccaaauuauucuauuugggcucacuauauuuaaauguugacauuaagaauuuuuaaaauguuauuuuaaaaagaauuuuaaaaauauuauuacacacaaaaaaccugcagucuccuaguuugaaguuucuuagcccuaaaggucuguaacagauuuuuaaauucuaaguuguuaugagaagucuuuauaugguuauuaaagaaauacuuacugaauauccaccauguucagacacuuuucuaaguuccagaaauauaggagugaaaaaggucaggcccuguuguuauauaaacacaaaauaauuucagaugcuuguuaguguuaugaaaaaauaacacuguauugugguaauggccuaagugagcugcuuuagagcaguguuggcauagcccauuuggugcuggaguuuuuguuuuaguuguguuucuuaccaccuccccuaacccgagcaccugaccuuggaauauuaguugcaguuuggaauauuguauuucuucugcgcuaauuguguuuuauuucuuuuaaguccuuagaaaauauaagcaaauguaaguuuuuucuguucucuguucucuuuuuccaaagggauuuugcuguaggaaucuguaacaaaaucagugaaaugauucaagguauguauucuucauuuaguauuaugaagugacuuaauuagauuuauaauaguugcuaacacuaauuaaguacuuauuauuugcuagucaccauacauucaaauaauauuuauuaaguaucuucuauuugcccaaacuguucuaaaugcugaggauacaggaaugagcaaaacaaaguccuuacccccaucuaaccuacacucuagucaggggugggguguguggggauagacaaaugugccuaugacauuucuggugcuauggugaaaaagugagagaagaaggauagagagucucaaaaguaagucguugguggguugagagaagggacuuaucuauuuuauauauauugaucagagaagggacuuuuuuguauauauugaucagagacagucucugaugaggugauacuugagugagacaugaaggagagaaaggagugagccaugcagauauagucuugcauugcuuaacaauggggauccugugugagaaauggguccuuaggcaguuuuguuguuugaacuucauagaguguacuuaaauaaaccuaaaugguauagccaacuguacacuuaggcuguaugguauagccuauuguuccuaggcucuaagccuauacaacauguaacugugcugaauacccauaggcaauuguaacaaaaugauuuguauaucugagguagaaaagguaauauauugcacugugguguuacaaugacuacagggucuaugaaguuacuaggaauuuuucagcuccauuauaaucguaugggaccaccgucugucaugugguccaucauucaccaaagcauacuuauggggggcaugauuaguguagggaagacugcucugugugagagaggcuaauauuauuaggagcucuggaacucucugcuaaugucccuccagugucuuccaguugcauuuagaaucaaauccagauuccuuaccauagacuacaaagcccugguuuuccagucucuuauaccauaagucauguguauuaacccuauuuauccuuacaacagucauuaugggagcccaagagcucccauaggguuaauacacgugucauaccccuauuuauccuagcagucauaaaagggagcucuugggcuacagcauugccugacucuagagaacaccacuuuguuuauauucuuauaaagagcauuccuuugaauugugcaauguggcagccuuggauagguaauaccauuauguucguuuuacaggaaaggaaauagagccacacuaaagcugaaugauugguucacaguaaaaaagcugauaacuuacaguuuggcuuugaggccgaugcuuuuaaccacuuaugcuacugugcccuucuaaggcaugaauugcuuaguguaguuauauuuugcacgcauuuaaauuguccuucaaauuaaaauuaaagagaacuugcucacuugcauaaauaauaaaaaucacuuaaagaccaagauacagugaaugagcuuuguuguguuccccuuuauuccuuuguguuuuuucuuccaccauuagcaaaagggcuuuccugcagaaaaguauccuuaugacauuagaaggaagcaucacuuauucauugagcagauuuuaucagugccugcugcaucagacaagaucucagcaggaaacagguggcacauuugaauuaagauaacucaaggaagguguaauaaaggaaccauucacaaaggcauggucaggguguacuauaggggauaauguaguucuugaacccguaauagcuuuuaccauaccucuaaggguacagguuaaagagagguuacuagaaaauugguaucaugucaggaggaccacuuugagaagcuaaccuccaggagcaugaugugacccugcagugagagaaccagggaauaaauacucugaccucauucuucucugcaacuccugcugggcucuccauugguuaaacccaaacaaaggguagauagcaagggaguugaugaaagcuauacaggugagccuucuaggaugcuggaguauucuguguaucugaugacaguuauaugagaauauacauauguagaaauacauuaaucuguacacuuaagauucauuaccuuauuguuccuuaaauuuuaucuuaaaaaaaucugaaagaacaggaauuagcaggagagagaggcagaggaaaacauaggaguguggguggaggaaaauuggaaccuaagauauggaaaugaaagaggaguuuuaggaacagaauccugacauuugguuuuaagccacuuuuguuucugccaaguaaaaucuccgagccucccuaaaucuuuaguaaagaugccuguaaacacaaagaucccucugaguacuggguugagaauaaacuugcaguggaggaaagagggggauauaagaguggagucugccauggggaaaggccuaagcagggagaauacuuaggagacuugcaauaauuuagucaagagaugguaguggaaauggaucggcaugguaacaacggagguagaaagagucaguuuggguuuuauuuugaaguuagaaccaauaagauuugcuaauacauuuggaaaugggaugugauagaauccuuucacuaauaagaaagacuccagggucuaagaagcuauaaugaugugauuuacugagacaggaauauuuuuggaggggcaguuucaagguuaagaucaguucucuuugagccuuauuaauacaaaaugcuucugagaccuccuagugcagaugaccagaagauaaugagauacaugcgucugacgucggggcaggaggacggauggguggcagccuuucacauuuagccgauaauggaaaccaugggauuauaucagcucacucagggaaaacacauagaaugagaagagaauuuauuaccaaccuaugggaauaucagaaauuaaagcguagacagacaaggagacuacaaaggagauuaagaaggaacagccagagaaagaggucagaaaacaguaaaaguggaagagccaaagccauuaggagugaguuucaaagauagaauggucagcagugucaagugcauucagaaccuuaaggaacaaaguaauaacaugagcaugaugugacccugcagagaggaaagcagggaauacucugaucucauucuuuucccucuggcaaacccaaguagaggccaucuagcaagggaguuuauugacguaggcaacuguuggacguugaaaugcugucuuacguucauacccacaauuauuucaccauggaaaagccagcaauacgcagaguauaauuagcuuguggcauguaugugguacauuacgacugagaaauuuguguucaccaugaccacaaagccaugccauagagaaaagauuuguugguuucgcuccacuguugacaggaaaacguggauuaggguuagucuucauggauccagucguguaugcaauaaagaaaggcauuuacuacacaaaguucagaggacuucgaaaccauucuacacacaguuuauucacauccugauuaugauuuaguuguugaaggaaauaauuaaaaucauaaguauaaucagacuguagccaucaaguguguguguuuguguauauauauguauauguguauguauaauuuuuuuacuaugacaaugagaggaaauaggcagcaaauaugacuuugcuuucuacugugcuuuuuaaaggcaguuuuuauuaucagcauguaguuuuauaaucauugaaaaguuaaugucaagauaaauacuuaggaaaaaauauugaauuuaucaauugguucuaguauaaucuuuaauguuauaaauauauuaguauacuguguuuuucaagugcaauuuugcuaaaugagucacagcuuuuaaaucuggaauauuauuaaggauggugaucacaaauaccuugagaauuauuuuugugucuagguuuagcgacaccaguagacuugaagcuaaaauugauacccauucuacagcacaugcaccaugaugcaaucuuggcuuccagugcucgucagcuuuuacaacagcuggucacauccuauccguccaccaaaauggugauugugucuuugcacacuuucacucugcuugcagcgucaucuuugguugauacaccuaagcagguaauuucaauuuucuuuaaacugccuaucuuugguaaacuuacauauuaaauauaugauuagaaauaagaaaguggcccacaagucuugaggacauuaagguucuuuucucuaauaaaggucagauuaauuugcuuuugcuugcuuuuuuauucucucuguucacaguacugauuguugggagcccuugaggaaaaugagauguuauggaguacauggcugggugugaaguuggccguauaaaaaaaaaaaaagaaaggauugaguaucuguaaaaugccagggccugugcuaaaacuuuaaaguuaaaugguaguauuuuacaaacauggagaaagaggcccaaaugugggcacauagcuagugagugacagggcucugauuugaagugaguccugucccuuuauaaguuucacuaaacuacacugcauuucuaaugaucauuucaguuacaguauuguuuauggagugacuuauuuccuuuauagauucagcuucuguugcaguauuugaagaaugaucccaggaaggcaguaaagagacuugcuauucaagaucugaaauuacuugcuaauaaaacaccacauacuuggaguagggagaauauucagguauguagaacuuguaacauuuuauauagaaaaaauaauauaacauuauaauauaguaaaauguuuugcauuuuuauauugucuuugucaucuucuaagugguugaauaugaaaaacuucuaaaagcauuguugauguuuguggcaguuauuuuauaaguggcacaauaaauacauaaaacuucuauacuucaauguuuguuuuagucagugaaacuugccacucaguugcuuguucauucucccauaguggcacuaaggcuaauugagaagcccaauuacauugguuugguuuuuuuauucuuguauuuuucagucaauuuggggagaaaaauuuaggggcugaauguuaucuguaauggagguagggcuggaugggcaacuugggaaauauauuucucucuuccuggagagcugaagacauuccuaagucuucuuuuguaaacagaagagcagaucucacucuuuagacuuuuaaugugcaucuuugacaccaucucuuaccaucuguuagguuaaauuaauauuuuauguuuauuuuuuucucaaaauagaacccuguuuguuuacccauuaccgauagaaauaacaccauuuugcaaauaaugcuauuuaaaauggaacgguaguuuuuaucucucagcuucaucaugacuccaguggauuaaaaaucuuugaauuucagauuauuaaaacuaaacugcuguguuuguuuuucuguuuguuuguuuguuguuuucuaaacaucuuuuaauuuacuauauuaugauuugauagucacagauaucccaagauaagggcaguuguuaaaucugcauuuaauagauaagcaguuaggguucagagagacuuaauaugcuuaagagagcaucuuaagagaaguaaauuaagaauuuaauuaagagagcuucuguccucugaucccuagucuuauugcuuuuucuacuaaauaaugcuaucuuuccaagaagagaaugugcccagccacuuuagucauuuuagagaauuuguacaaagaaccaaacccaguuauuuagaaagaugagugagaagcacaguauuauuccuucucauuuuuuucuuauugugagauagaucauacauacagaaaaguauguaaaauauauaaauaguuuaaauaccuuuaagugagaaaaguauguaaaauguauaaauauuuuaaauacuuuuaagugaaaacccaugcaacuaccauccagcuagaaauagaacauuacaggaucacagaacccugccuccuucccuugcgugguccuuccugguugaaacuuuacaccuuccaaaagcaaaccaccauuuugacuuucaugauaauaauuucuuugcucuucuuuuaccuucuucacaugucuuccuaaagaauacuguuuagcuuuguuuuuguuucuuuugcucagcauuacacuggugagacucauccaugucuuuccccuuuaauuguaauguacuaucccauuguaugaauguaucacaguuuauuugcucucgauggguuauuuccgcaugggccuauugcaaacagugcagaacauucuucuguuugucucccaguucacacacgcaaauuucuuuagaguguauaccugggaaugaaauuucugacuuacagaaaaugcguaucuucaguuuuaacagaugaugucaaacuguuuuccaaagucaaugaaccaguuuacauuccugcuguguaugagggcguccauuaaucacauccguaccaacacauagaauuaucagacuuacguuuuuuaccaguuuagaaguuguacuuuuuauguguagcuccuugauuauuaaagaaauugaacaccuuuuuaauauguuuauugaccauuuggauuuucucuuaugacauggcuauucaggucucuugccuauuuuucuguugauucauaguuauuuuuuauauauuuggaauacucauacuuuguuaguccuugacaauucuauauaaauuucagaaucagcuugucaaauuuaacaguuugauugggauuacacugaauauaaagauuaguuuguaagaaauugguaacuuuauaauauugucuuccagugcaugaacauguuauaucuuuccacuuauuuuaggucccuuaaaugugucucuugcccuagucuauuucgucugauauuaauaucacuacuuuaguuuucuuuuacauauguugacaugauagguuguuuaccaucuuuuuaguuucaaucuuuauauaucuuuauguuucacauguuucuuauaaacagcauuuaauuggagguuuuuuggguuuuuuugagacagaauuuugcucugucacccaggcuggagugcaguggugcagucuuggcuuacugcaaccucugccuccaggguucaagccauccucccaccucaacuucccaagcagcugggacuacaggcaugugccaccacacccagcuaauuuuuguauuuuuaguagagaaucgucaucauguugcccaggcugguccugaacucuugaccucaagcaauccaccugccucagccuccgaaagugcugagauuacaggugugagccaccgugccuggacuaauuggauuauuuuuaauccagccuggcagucuuugucauuuucagauggagcauuugauucuucugauuuacuaugauuugucacacauuugaguuuaaaucuaccauuuuauuuuguguuuucucucugucuccccuguuccuuuucacucuuuggaggagagggggguuucuuccuguauugauuauuuuugauaucuuaccauuccauuugacuugacuagucuggaaguauacagucuuguuaaauauucuuuuaguuguuauccuagaaaugaaaauauaacucauagucauuuuuaucagucuaaaguuaauucugcuaaaaguccuuugaacacauuugaaugccauuuucaucacucuacacuuuuauguauuauugucuuguauaauuaagauacaaguuaaauaaaauauaauuaaacuuuuuucugauacaauuuuguuauuguuuagggaauucauuguucauuugcaccuuccacugucuuugcucuucuugcaucucagcuauuuccuaguuacuuuuccuucugccuucggaagguccuugagugagagucuguggugguaaacccucucaauauuugcuugccugaaaaugcuuucauuuuguccucaaucuugaaagaugcuuucuugggauagaauucccagggcauugaggauaccauucugcugucuacugguuuucuuuauugccacugaaaaauaguaauacucuuugaaggguuuuuuuuuuuuuuuuuuuugcuuuaaaauuguucucuuugacuugauuuucuguaguuucacuaugaaaugucuaguugcgaauuucuuuuuaaacugucuagacuauguuugauuucuugaaucagaagauuggugucuuucagcaauucugggaaauuguuacuuguaauuucuucagauauugccgcugucucuuuuucucaccuuuucuucuggaccuccuauuaaauguaugauaacccuucucccguuaaucccucauguuccuuaucuuguuuucuauuuucuaucucuuugugcuaaguucucaguaauuucuucuuauauauguuuuaguucaauaauuauuuuuucaguuuaucuaaagucugcagauuugucucuacucucuauuucuauacccuuuuuccuuguauaccugauuguuuuucacuuugaacuagucauuauucuuggagaaguaugugugggaauucuuugaggcucaaaccaaaaaguacauuccuguagggauuugcauuugcuuccgcuaggcagagacgucagacagugauaaaugcugccaagaaaacuuaagucaggaagaagauuagugaauauggaagguggagguugcaguuuuaaguaggcugguuagggaaacccucacugcgaaguugacauuugugcaaagaccuaaagaagggaaugucaauuuugugggccccuaaaggaaggguauuaucaggaggagaaaagccaaaaggcccugaagugagaacauucaugagugugaggucagugugacuguuaauagaggagauuaguaggaggugauguuaggugaugguagggaagaauaggcauuuagggccuuugaguccuucuuaaggacuuuagcuuuuuacucuacaugagauagauugccucuggaagauucugagcagaggacauuaucugacuuaaguucuaaaagauuaucucuggcuuagcuauauugagacuagguuguaggggcccaaaggcagaagccgggagaacauuuaagaggcaguuacaaauaaucgaauuagaaaauaugugguuaccugaaccaagguaguuggggugguagugagaagugguaauaguuuggauauauuuuaaaggcuagagcugauggauuuccugguauaguguagagaaagaaagguggcucuaagcuuuuuaccaucaacaaaugcaauugugauuuacuuggaaugggcaagacucugggagacucauuucuugaagaucaagaguuuacuucugaguauauaaacuguaaaauguuagacauccagguggagaugucaaggacauaugccuggaguuuaguggacagauccagcugagguuauaaauaugagaguugucaguuuauagaugguauuugaagccaugagacuggaugacucaacuagggagacaauauggcuagagaagauuuagggaaugaugaacugagaaacaaccagcaaaggggccugaaaaggaguggccagugauauguaagucagaauaguauuuuauagggagaagaccuugaucuaccaugagagcuacugcagccauauucgccaagauaaggacugauaguucaccuuugcguuuggcaauaugaagucauugauaaccuuaagagagcaauuuugcugcaacauuguggguaaaagacugaguagaguggauucugcaggaaaacaggagggagauuuaaggcagugaauguacauuggucucucaguauccgcuggagauugguuccaggaccaacccuucucuagauuacuuauaauaccuaauacaauguaaucuuaaguaaauaguuguauuauguuguuuuuuuauuuguauuauucuuuuuuauuauuauuucaaauacuuucgaucuggauuugguugaaucaguggaugcggaacccaugaauauugagugccuacuguagaaaacguuuuaagaggaauucugggccgggcgugguggcucaugccuguaaucccagcacuuugggaagccgagguggguagaguucaagaccaggcugacaaacauggagaaaccuugucuccacuaaaaauacaaaauuagccgggcgugauggcgcaugccuguaaucccagcuacuuugggaggcugaggcaggagaaucgcuugaauccgggaagcagagguugcggugagccuagaucgcgccauugcacuccagccuggcaaaaagagcaaaacucugucucaaaaaaaaaaaaaaaaaaaaggaauucugcccucaagggagcagagaaaugauaugguauugcuaaaggguaugcuguuuguuuguuuuuauccucggaggaguaaacuuguuuuuuauugauggaaaugaccugguagaggggaagaauugcaacagcaauggccuugagugggugagacuggaagggauccaguguagaaguagauaggcuuucucuaguucacauagaauaggaaggaagaccuuaagaagccuaauguaggugaaugaguagguauuaugguaaaaaguuauagaaagucucuugugauggauuuuuuuuggguuuuguuuuguuagguaauuaggaaacauggucauuagguaugguuaaaaauggaggaggcaaagagaaagguuuuaaagaaacacagaaauucaaauaaacuagggaaauagaggauugccauguaagauauuugaguaaagcaauauauaauguggugucuggcacauacaaauaaaugcuuuuuuaaggguagcuguaaguuauauuaaagguaaguuuauucuuuaguuuuuccuuuuugaauacuuugacagauuguaggguugggguugugcugucuuaaaaugaacugggaaguuucucuuucuauacucuggagugguuaagaaguauaacagaauuuucuguuucugaagauacaacuuuaaaaguaccacaaauuuaucugaauguagaacuuuuuccagcgauaguuguuuugagaacauuuccaaucacuacauguuauuguccugucaguuuuuuaccucuucuggaaucaguuuuggucauuuguuucccauuuaauuuacuucucaaauucauuaguaucagcauaaagagucuuuauaacuucuaauagcuuugauuuaaaaauuuuuuuuaucuuguacauuuguguuuauaucccuuuuuccuuuuucuucuuucuuucuuucuuuuuuuucuuugagacagagucucacuguguugcccaggcuggagugcaguggcacaaucucggcucacugcaaccucugccuccaggguucaagcgauucuccugccucagccucucaaguagcugggauuacaggcaugagccacccugcuuggcuaauuuuuguauuuuuaguagagacaggguuucacccuguuggccaggcugguuuugaacuccagaccucaggugauccacgugccucggccucccuaaaguacuagaauuacaggcaugagccaccacgcccggccuauauauccccuuuuccuugauuagacuugccggaagcuuugcuuucuuaucuuuuucaaauccuugguauauucauuuuuauuuuuuccguuuaauaaugaaagcaguuaagaccauuaauuugcuucuugguacagauugaccgcauuuuguaaauuaugucuuguauuguucucauugccauuaguuugaaaugcauuuuuuaaaaagccagauuuauuaugguauaauuuauuuacagaaacuuuucuagguuugcaguuggaugaguuuuuacaaauguacaaaaccaccaccacaauugagauacagaacauuuucauuacccccagaaguuucugcaggccccucuguagucaguccuuuccccaaccccugacaacuaccagucugauuucuguugcugugauuuugccuuuccaggauauaaauagaaucauaugguauguggccuuuuggauauggcuucuuucacuuaccauaauacuuuuaauauuuauccauguuguugcauguagcaauaguucauuccuuuuuauugcugagcaguauucagauacaugggcguacaacaauuugucuguucauaaguugauggacauuuggauuguuucuggguuuuuggccauuaugaauaaagcugcaaucauacacgguuuugugugacaucucuugguuaaauaccuagaaauggaauugcuggguugugugguaaacacuuacucuguuuaacuuuguaagaaacugccaaaccguuuuccaaaauugcgauaccauuuuacuuacccaccagccauauauaagaguuuuaguucuguauccuugccagcacuuuguguuguaugguuuuguaauaguguguagugguaucucaucaugguuuuauuuugcgcuuuccuaauggcuaaugauguugagcaucuuacaggcuuauuugucaucuguaucuucagugaagugccuauucuaauauuuuauucuuuuuuuauuagguuuuuuugucuuuuuguuauuguuauuuauauauucuugauauuaauccuuuaucagauguauguuuuacaaauauucccucucaauauguaucuuuaguaucugucuuuuaaaaagaaguuuuaaguuuugauaaaaucuaucuaguuuauuaauguuuuuuucuuuuauagguuguauuuuaucuaagaagucugccuaauccaaaaucacaaaaguuuucuccuaaaaguuuuauaguuuaaguuuuauauauagcccugugugauccauuuugaguugacuuuuguguaugguacaagguaggcaucaaggugcuuuggauagccaguuguggcaccauuuuguggggaaaacuuuucuuuccccauugaauuacuuuagcaucuuuguugaaaaucaguugacaauaucuguauggauuuauuuccaaauucuauucuguucuauuggucugugcaaauaauacacugucuugauuaccaucguuuuauggcaacucuuggaaucagauagugugaguccccuaccuuuguauuucuuuuucgaaauuguuacgcugggugggaugugguggcucaugccuauaaucccagugcuuuuaagaggccaaggugagaggaucacuugaggugaggaguuuaggaguagccuuggcaacauaguaagacccugucucuacaaaaaaaauaauuuuaaaaaucagcuaggcauagugguauacacuuacaguccuagcuacuugggagacugagcuggcgggaucgcuugaggccaagaguucaaauuuggcuguucuaggucuacugccuuuccauguaaaauuuagaaucaguuuguaaauuucuaugaaaaaaaaggcugcugggauuuuuguuggucuuuacaucuaaagaucaauuugggacgaauugacaucuuaauaguauugugguuuuuuuuuuuuuuugaguuggaguuuugcucugucaccagggcuggagugcaguggugugaucucagcuuacugcagccuccaccucccagguucaagccauucuccugccucagccucccaaguagcugggguuacaggugcgcaccaucacccccagcuaacuuuuguauuuuuaguagagaugggguuucaccauguuggccacgcuggucucagacuccugaucucaagugaucugcccgucucagccuccgaaagugcugggauuauaggugagagccacugugccuggccaauaguauuguguuuuuuugauccaugaacaugguacaucucucccuuuuuuuuuuuuuuuuuuuuuucuguuuggagauagguuucacucuguugcccaggcuggagugcaauggugugcagucaugauucacugcagccucaggugaucucccaccucagccuccugaguagaugggacuacagguacacgccaccaugccugucuaauuuuuguauugcugguauuuugccacauugcccaggcuggucucaagcuccgggucucaaaugauuugcccacgucagccucucaaagugcuaggauuccaggcaugagccacugcaccuggccuaucucucucuuuuuuuucagcucuucuucaguuucucaucagugguauuuuuguuuuguuuuguuuuuuccauagguuuuuggggagcaggugguguuugguuacaugaguaaguucuuugguggugauuugugagauuuugguguacccaugacccaagcacuauacacuguacccaauuuguagucuuuuaucccgcaucuuaucagugguuuuuauuuuuauuuauuuauuuuuugagacagggucucacuccagugcccaggcuggagugcaguggugcgaucacggcucuuugcagucuugaccccccaggcuuaagcgauccucacacuucaaccuaccaaggagcugaaaccacaggugcacaccaacacccagccaauuuuuguauuuuuuuguagaggugagaucucgcuauuuuguccaggcuggucucaaacuccugggcucaagcagucugccugccuggaccucccaaagugcugggguuauaggcguguaccacugcgccaggccauaugggugguuuuuaguucagcauacaaaucuugcacauauuuuguuagauacauuccuaaauauuucauggucuuaaugcuacuguaagugauuuuuuuuaauauccaugagagcaauuuuuauuucuucuuugaccauggcauuaguuuaauguuuucugcuuuugaagugauuaauuuuccauauuuguugguggaauuuuuguuguugcuuuuugucauucuuaaaguuuauuuguggcccauuguaggaucacuuuuuguaaacaguucagggguuugaaaagaagacauuuuuuuuuuguuuugcuuuguuuuugagauggaguuuuccucuguugcccaggcuggagugcuguggugcuaucucaguucaccucagccuccaccuccuggguucaagcgauucuccugucucagccuccugaguagcugggauuacagcugcccaccaccaugccuggcuaauuuuuauauuuuuaguagagaugggguuucgccggguucaccaggcuggucuugaacucccaaucucaagugauccacccaccuuggccuuccaaagugcugggauuacaggggugagccaccgcauccggccagaagacauauuuucuauaagcucuguugacucuuauuuuauuggugauauuacuuagguauacuauaucuuaaauuaguuuuuuucucuugucagugugugaaauuuugauagucuuuaguuucucacuccaguuuauauuuuucuuaguucauuugggcugcuguagcaauaccauaaccuguguugcuuacaaauaacacaaauuuauuucggacauuucuggaagcugggaagucuaaaaucaugacuccagcagauucagugucuggugagggcccacuuucugucuucuugcuuuggcccucacaugguggaaggggugaccacacucccuugugcuucuucuguaagguuacuuaccccauucaugagggcuccuucccuauggccuaaucaccucucaaaguccccaccuccuaauuccaucaacuuggcgguuaggauuucagcauaggaauuuucggggagacacaaauauucagaccacagcaauaucuaaccauuucaauuaaaaaauauuagggcugucuuauuccauagagaguuuuaucugcauaaaagaaucuucuguucuauuugcagccuuggccucauucauuuuguuaauauugccacuugcuuguuuuucuuugcauguaucuuuugucuuugccaauuuuauuauccguuuaaccuuucucugucaucuagguaugauccuuauaguuagauuuaccucuuuugaugcugaaguuauugcugucagguaaaauaaagaaagaaaaaacaguuuaccucuuuugacuuaauucgagucuuuaaaaauguguaccauaaguuguuuacauuuauugguauaacaaguuuuuuugcuuauuucuuccaucauuauuuuaugcugucuguaaugcuuucuguuuccuuugucccaucgcuuuucuuugcuauuuugaucaaguuuucuuuguucuugucuuccucuagugaguuaaaagauuuuaaugugcuaauuaggcauaauuauuaacauuaagaaugaaaauuaugauggcugaaauguugcaaauuuuaagaggccuaauucucuuuucugcugccauucaucuuccccucaccccauaucauguuaaaguaaucuggaaucuaauugccaguuaucuuuuuuuuuaauacuaugaaguuucuuuuuuguaauaauuuuuaaaaauaauauuugcauugagcuuuacaaccacauuaacaauuaguuaaaugcaauuguuuuguugauucacagcuuacuauuauuucuucauuauaccauaucuuaucuugaauuuuuauucugauuuauguuucuuauggauuuuuguguuuuguuuuguuuuuuuuuuaauugaacauacuuuuuuuuuaauguuuguuucuucaugaagaauuuuuuuccucugggcacaguagcucaugccuguaaucccaguacuuggggaggcggagguaggcggaucacuugaggucgggaguuugagaccagccuggccaacauagugaaaccucaucucuacuaaacaaaaaaaaacuacaaaaaguaacuggguguggugguacgcaccuguaaucccagcuacucaggaggccgaggcaggagaauugcuggaaccagggacgcagagguugcagugagcugagaucacgccauugcacuccagccugggugacaaaagcaacacuccaucucaaaaaaaaaaaaaaaaagagaauuuuuuuuccauugcagcugaauccugagcauguugauuuuaauuaaacagauguugucaauuaaucauuuuuuauagccuagauauauuuuugaaaauacugaaauacagcaggggaaaacaauucuaacgauuuaaccuuuucuaaaguaauaagguguugauuuugaauuugaauuuuacucacaauuaccaagagugauuguauaacagguuuuuuacuuauuucuuccaucauuauuuuacaauuaccaagaguaauuguagggcuucccuucuuccuucucuccuuuugucuuuccuucucuccuuuugucuuuccuucuuuuguuacuuucugccuuugucucagccagucuuaucauugcugguuguuuuugaguuuuaguauuucagguucacauuguguccauuuccauugcuacuuuuucugguuuguugguuaguauuauaauuuucagauggaaucagauauuucagguuuaaaugaauagcuuucauucuguauaccuuuaaaaaccugaaagaaggaagggccuaaaucaagguccaaguauauuauuauuauuacgguagucaaaaacgauaguuucauaggaaaaacauuuuuuaguguguuuauauuuuucuuuagauuuuuuugaugccaugcugggauaaauaaccaucuuagcuuguguuaaucucuauuaauaguuuacaauaucugaugcuguagucuuuuuuuuuuuuuuuuuuugaguuuuagucucacccugucacccaggcuggagugcagugaugccgucucagcucacugcaaccucugccuccuggguucaagcgauucuccugccucagccucccaaguagcugggauuacaggcgccugccaccacgccuagcuaauuuuuguauuuuuaguagagacagaguuucaucauguuggccaagcuggucucaaacuccugaccucaggugauccacccgccuuggccucccaaagugcugggauuacaggcgugagcugccgcaccuggccuguagucuuacuggaagagaauauuugauuuaugcaaccucucuguuacagagcaaaguauuauuuguuccagauagucucaaagauguaaauuuuauuuuuagcauuaucucuucugagagcuucuaauuuguaccuuaccugugacuaggaggaguaacaaguucagccugagaauuaguucuuguaauaaucuuuuucuuugcauaacugcaaaggagacagaaaguuuugagguauucugucucugacagaauacuuucaaacauaacauuuuucuuuacuuuaaagauuauaaacuccuuuuuacuauacuuuucuggaacauaucccuggugaccaguccuauuccaggguguaggagaagccccuauuuagggauugacccagacaacaauaauucaggccagagccucuaguugaguagugaguuaagccaguagagaaggaaauguagaccaaauaguuagugaagaaggcagugguaaugaaugagacagaggacuccauuugaaaagacaguuuuuccuuuuuguuaugaaaaaugguccugguaacaauuuuguaauagguaauguccacgaaccagauuuuauauggaaaugugauugacguaucauuucuggggaacuucaugauuugcucuguuaagcuuacugauuuggauuaaugaacguuuaaaucaguguuuuuuaauuuuauuauuauuauuuuuaagacagagucuuacccuguugcccaagcuggagugcuguaccacaauuguagcucauugcaaccucaaauuccugggcucaagugauucucccaucucagccucccaaguagcuaggacuacagaugcgccccaccacaccuagauaauuuuuaaaaaauuuuuaguagagaugggaccuugcuaugugcccaggcuuaaacgaauauuuauuuacugagacugcuuuagguucccaauaaugugcuagaugacagaaacagaauauaacauuguaaauaauuuuaucacaagauuuucuaauauucaguuuuuuaaaugguaaaauucuucuuauuuaaaauuauuaauauuaucauuuuauauaaaaucucucaccuaguuuauuaccacagaaggcuaaauaucuguuauacauagagcaaucugagacauaauauggaauacauauaaauauagaacauaguuccuaacuucuggggcuguuugguuuaggauauuaguccuaaucacaagcuaauuaacaguacaaggcaggccaauuuagguaacaaaaagugaacaacggaaauggccuaagugcuugaauaaauaaauauaaauuauaguauuaaauaauaaucacuuuuuuaaaaugcauucuuuugaacuucaaaaacagcaucuauaucugcuuuuauuuccucauccccugcucuuucuuucauacacuugcauuuugaucuguuuuccugucacugugcuuaggcacuuuacauuuggcacugucaaccugccccuucucuuggccucuuuggcacuuaacuguccucacucauucauaacacuaccuaaccugcaccuucucuguauucuucacugcccuuuuucuuccaaguugaguccauggcucucugcuuucuaccauuuauucugucauucuuauggccuuucuuaaugccaguuugcagggccuccaacaaucuaguccuuuuaccugagcuucuacauugcucucuaacauaguagccuguaugggucacaaagugcuuugacuuuuaguggcuuuguaaucuuacagacaguagauguuaccucacuuacauuugauuuuuaauuuuaauucaguuuuuuaaaugccaacacauucauguggucaaaauuccaaaacuacaaaaggauguauaaugacuguuucccgccuacuguucucucaucuauguagcuccuuugcccaguggcaaccaauaucuauuuuuuuguauauuuuucuagagguguuuuuuaugaaaaucaacaguucuuuacaaauauuuaccccauuuuacagacaaagaaguugagacucaaauauuucaguaauuggcucagaucacagaguugguaggugguagagccagaauucugaugugagucuuccaguuaaaaauuugcuguaucuuagauuccaaaugccugguggauauuucuucuuggacuucauaucucauccuauuuucuguccuuuuucuaaaauugguuuaucccccauaaauuucagucuuuuaaauggaaucugguuacuagauuugaaaguuuguaauacuuacugaauccuucuuauucauuucuugauauguaaucucuuuuaaaaugucugucauacucauucacuagucuccauuccugcuaccaaguucuaguucaggccaucaugaccaccugccuggauuacugccagaggcuauagguuggcauccuuaacucucaguucucuuuguuaacuuuauuuuguuuaccauuugccagaauuauccugccuaacacuuuagaugccauuauucucuccucuggcuucuuuuuuuccuuuuucaucagguuuuaauuauucugccuaacuuuuaaggcccuauaucaucuggccuaaucccccccaucuuacuuagccucuauccuuuugaacauaucuccucuuaggccaaaauuaaacaccccauauucuggccuaauugccagaguauguguaugcauuaccuagacugucuucccuucaguuaccagaaacauacugcaucuuucaggucuauuuccauuccuuucaugauaauuuuugcugcugcugcuguuuuucuuguuaacuagguuuuucuuucagucaaaaaaguauucauguauaugacaaaaaauuucuagagcucaaaaguauaccaugagugaaauaugucaucucuucucaggucuccucugcagaagugaucacuguuaauaguuucuuauguauccuuccuaaacuuuuucaucaauauggaaacguguaugccccaucuuuuuuucuuuacaagugaaaauacacuacgugcauguucuaaaccuuuuaccucuuaauaugggggaacaucuuauauuagcagcuagaucuacugcauuuuuuuuuuuuuuaucagcugugugcuacuuccuuuauauacccaguuccccacugauggacauuaggguuguuucugauacuuucacgguuacuguugacauuucuacauugaauaguuuguaaaaaaaucaccuuugugagcauaaauuuucagaaaagaaauuucuaggucuaaugauggauauuuaaaaauuuuugagaguuaauaccaaugacucaccaaagagauuuacaccauuuuacucuucugacaacaaugagagcaccuauuuccccauauucuucaguguuauguauuaucaaacuuuaaccuuggucaaucugauagguaaaaagugacacauuuuaauuuaaaauguucaaaguaugaaugagguuagacuauuuaaaagacauuuguuuacauucuuucuaugaaauaccaaauuuuuauugaguuuuugccuauuaguaagaacuuuuuuuuuuuuuuuuugaaacggagucuugcucugucgcccuggcuggaauacaguggcgcgaucuuggcucacugcaaccucugucuccuggguucaagcgauucuccugccucagccuccugaguagcugguacuacaggugugcaccaccacacccggcugauuuuuguguuuuuaguagagacaggguuucaccaugcuggccaggcuggucucgaacuccugaccucaggcgauccuccugccucggccucccaaaguguugggauuacagacgugagccacugugcccagccagaacuuuuuauauauuaagguucuugguccuuaauugauguuauaugaugugaauauguuuuucuagguuugccaauuaucuuuuuacuuuguauuguuccauguuaccucauaguacuuuuuacaguuuugguuuuuuauuugccauaaaaaaaaaaacagggauauaguuuuauuuuaccaaaugacugguuaauugucuuuguaguuuugauuaacugguaucuuuaauuuaaaaugccauuaucauauauuaaauucuaguauauauuugaaucuauuccuugccaguuuuucuggauguuuucugauuuuuauuuuuccacaugaucuuuaaaaucagauaaucuaaaucauccugcaguuuuguugacaauuuuauugauggucauauuaaauuuauuuuaacccuuucugaaauguuauuuuuaacuuuuuuccuuagacuuuaaguuuugcuuauuuucugaaccuuuaucuuugugggagaauggaaauuaauuuaacaaaacaguuauuugacuuguuauauuacaugcaguuauaugauacagaaucaugugauaaaggauaaggcaagagucacuguacugugauuauguauucauaguucacugcauugaaagaaaaacuagcaucuuauuuuugguaauacuucaaacuaccuggucaagaguagaguaaaugccagaaaugggaggaagauagcucuguucacuuagaaaccagauagaauuccauauucccuguuauuuuuaaaaauuacacauauaugaaauaauauucauaucucuccuaagcaaaauaugguggggguuucagaauaguuuuacauuuacagaaaaaucgagacgauaguacacaggguucccacauucccccaccauuuccccuauuauugacauguuacaauaguauaguacuuuuguuauaaaugaaccaauauugauacauuguuauuauuaaccaaaguucauucuuuauucauaauucuuuaguuuuucccuagugucguuuuuauguaucaacauaguuuacauuuaguuauccugccuccugaggcuccccuaaagaguuuggaaguuugaccuagugcuuuuuuuguuuuuuuuuuuuugagacagggucuugcucugucccccaggcuggagugcaguggcgugaacaugguuuauagcagucucgaccuccugggcuugagcgauccuucugccucagccucccaaguagcugggaccacaggcacguaccaccauacccagcuaauuuuucgaauuuuuguagagacaaggccucacuuugagcccaggcuggucucaaacuccugagcuagagugauccucccaccucagccucccaaacuggugggauuaccagaaugagccacugcaccuggccucgauuuaaguuuuuuaacaugaaaaaaaguccuuaauauauaauuuuucuaaaagccagaaaauguaaauggaguagacaguuuagaaguauauugauguuuuaacuucuauauucauuucucuucugcauuccaggcacuuugugagugugcccuccagacuccuuaugacagcuuaaaacuagggauguugucuguccuuuccacacuaucagggaccaucgccaucaaacauuacuucaguauaguuccagguaaggaaaagacaggagauaccauauaaauaaugugcuaacuccuuuauccauauuuauguuucagguuguuucuucuauaaagcuuuaacaucagggaaaaaaaucucauacuccauugcaugcuagugauuuauuugaacaugauuucuuaacuaaugccuaugauaacaacaucucgcauccuugaucuuaagucaauaauauauuuuucuagguuuguccuuuuuuuuuugaauuauaugugggugaaaauauuuuugaggaugcuuaaaauaguugguuugcuuuuguguaucucugacucaaagugcccuuugaauuuaaguacauuucaaaggucaaguaguagugaguuuuaaaagcaaaugucauaugcuuccuuuuaggugcauauuauuucucuggaaaacaauuaaaauaaaacuugacuccagcccaauaacacuuuccuaguuaccuauucaagaugauuaacucuaaaaugcuuucauuaaugcccgguaaggagcuugcuuaccuaacagacuuaaagcuaaacuuuuuugucauuuuggguuuuuuuuuguuguuguuguuguuuuguuuuaagacagagucucacucuguuacccaggcuggagugcaguggggggaucuuggcuuacuacaacccccaccuccuaguuucaagaaauucucuugccucagccucccgaguugcugggacuacaggcgcccgccaccauggcuggcuaauuuuuguauuuuuaguagagauggaguuucaccauucagcccaagcuggucugaaacuccuggccucaagugauccacccaccuugcccuuucaaagugcugggguuacaggcaugagccacugugcccaggcugguuguuuuguuuuaaugcaaguuuugcggaaccucuauugcuuccuuuuguagucaguuaguuugaauuaaagaacuguaauguacauuuguuugucccuuuuauggccgcauaguauaugauacuuucuagguguagggaauucccugccacguaagucuuaauaggaagcuaaaaagaccugauacuccguugucacaccucccuuccagcuagugugcuuacauguggcuuggacucaacuaaucauuuccaugccacagacugaauugggagccaguaacaacaagaaaguagggauaugagagaauggggauauggugauguagcaaugacagagcaacauuuguuuccagaauauacucuagcaguggguguuugcuaugucugguacccuguaacagaaguuaagcugugacaugaaauaaucaguaacaauggcugcuguguccucacuggacuaauuccaugcauggucuuuugggcuguggucuugguugcucccuggcguuuuucuuauuuauuuucugaccuuguuuuucuauuaguuuugcaggcuuuccagugauucucugaaguacauuaucaguuaucuauugcuacauaacaaaaucaccccaaaccgaguagcuuaaaaccaugaccuuuuuauuugcucuaauuaugucaaucaaccauuuugacuguacucaggugggcaguccuauuggccucacuuggggucacuugugugauuauggucauguaugaccaggauuggauggucuaagacggccucauucacaugcuagaaauugaaaggcuuucugcugaggcaccuuaguuuuuauccaugugacucuuggugggcuaacuuggguuuguuuucaggauguugguuggagccaaaagaaagcaagccaccaacacaaaagcauuugucaaccuuuugcuugcagccuguuuuccaaugcuuuauuggccaaagcaagucacauggaauuggaagaucacaugguaaaggagcauguccacaagggaugugagaaauuaucacagccuucuuuauaaacaacguaccauauaccuagggugcuuucaauguauucuuuuucugcauaaaucacccaguguguuucuuagcuugcaguuaacauccuucaccaacauugcacuuugaaagagcugugauagacaaagucuuaaucauauaauagaugagagcuuucccauacaaguagccuuucaagugaggcauaugcaaaggaguuuauaaguauugaaacugagacucacaaagguuugacgguauguccaaaguucacauaguugugaagugucugagccuaggccugaacucagcggucugacucagaauucucuuuuuuguaccaaacugacuuacaugcacaauaacuuucuuuuucuuuauuuuuuaauuccaaagacauguauuagcauuauguuggguuauaauacuuaaacacuuuucaagcuagguauuuguccuuuuauugaaguuuguuaauuuuggcuuauauauggaauuaagcaaaggcuuaaauaaauagauaauauuuauaaaaaauaaaaucaaggauuuuccaaaguuacauuauuuccauaaauaaugguaaaucuuuauuuccguuuauuauguuuuuucaauguagccaaaaguaguuuaaaaagcaaacuuaaauuuaguaugucuaaaucaucacuaacaaauggcucaaauauauaagauguucaauaucagacauauuuaagaaaaaggcaccuuaaaacaacacuugaaauaauuuuaauccaucagauuggcaaggauuuagaaguuugauaaacaugguguguugacaaggguguggguaagcagucauuacugcugcgaauauaaauuauuaaacuuguacauagaugauuuggaaauacucauuaaauuacagauaacccagacuuuccacuucuaggaauuuaucuuauuuacauagucacacauugagaaauggcauauauacaagauuauucugagcaccauuuuauauaauagcaaaauauuauuucuuaguagaggauguaauagcauuaaaagaucaucaauagaggacucaaagaaauuaugacacaucacugcaauaaaaaucaaugcaguuuacuaaaaagaaaauauggcacggagcagucuccaugauacaauauuuaaagagaaauaaaacaagauggaaaacaguaugugaaaaggaaaaagaaagaaaggaauaaaugugcuuguaaauuuauggacucuggaaugauacacaagaagcugauaacauugggugggggaggaaaacuuuucucucacuagccuuuuaccauuuucuacucuuuguuguaccuuguaagccuugugaguuuaucuuagaaaaucauuacuaaauaaauaaaaauuaaauuaaaaauaaucuuauuccuagaaaacauaggaaaaggcucagaaauauuagauuuuaaaagcagaauauuggccaguaucuacauauccugauuauaugugaguuuuuaaauuguacuguuguacauagggggaaaaagauuuaaaagaaauauuucagaaaauuaacaguaaggucaugcugguuugugaaauuugguaugauuuuuguauuguucuuuggauuuuucuggguuuuuuuucugaguuuucuauggugaguguugguaggaauaaaacaaagaaaaaacaaguuauaaaacauguuuguaaauuuauagaugacuccgcauuguccauaucacauggacaaaaagaauagaggaaauacaauuuccacaguuuugaaaaaauaaagauauaguuucaucuuucuaauguuuugccuaacuuaaaaacacugaaggggccaggcaugguggcuuacacuuugggaggcuaagaugggaggaucuuuugaagccaagaguuugagaccagccugagcaacaaagcaagacccaucucuacaaaaaaaaauaacaaaauuagccagguaugguggcaugcaccuguauucucagcuacuuggaagcugaggugggaggaucgcuggaguccuggaguuugagacuauagugagcugugaucuguaguaggccaugaucgcaccacugcacuccagccugggcaacagagugagacucugucucaaaaaaaaaacaaaacaaaacaaacaaaaacccaaaaaacacugaggcucucucuuaaacuuguauuauauuaaaccagaaaucaacaaagugaccauaggucccaugucaccacagauauucaugguuuaugucuauuguaauucuuaguagcgucucuuucagccucaaaaaauacggucacccuugguaugagaaacaaaguugaaguugacgagaaucauggaaaaauaagcagaggaaaagaagacaggaaugggagacucuuuuaaguaguugaacaagcccuaaucuccuuguuuucuugaagcuuauucaguuauaacugagggcuucucuacuguaaauuacaauaguuacaacaugaaccuugcauuccagaauuucaaaugugaauuuuaaaaauugcugcaaucuauagcauggaauuuaagguauaaagcagaagaguauaauaacaggggcauuagaacaugacugauaaguuuuaugaacuuaauggcaagauucuuaaaauuuuggggcuuugggcuuugauuccaccuguaaaaauaggguguguuaaaucagaugaucccaaaauucuuuccagcucuacaaucacgaauucauaugagguauaaaugugugucagcaaucugagauggaaaaaaaaagcaaauuuaaauuuuuuucucuuuucucuccuaucuugaaaguaugguuuugucugacaagaggccuauaaugauaccuguuuuaaucagaauucauuugaacucuuaggauaguuguuuuggcuuuuguacuguuagucaauuuuuauuaauauuuuuuaagaaauuauacguugauuuuagaucuuagucauuacgaaacuguuggcacauaccuauuucaaguaccuuaauggagagaaaugcugauauguauugauagugggauugugguaggaaauuuuguugaaguuuauuguuagagacuuuucucaaaaauuaagaaaauugaaccuaugagcugaacugcuuuugaacuauuugaauuacaauuucuacuacuuuucucugcuuuuuuaggaaaugugaguucuucucccagaucuucugauuuagucaaauuagcccaagagugcuguuaccauaauaacaggggcauugcagcucauggaguuagaguccuaacuaauauaacuguuucuugucaagaaaaggguaaguuugaucaggacugauauuacguauaaacuuugguuuagaccuuggacagaauucuguuugauuuuuuuuuaaucccuuauuuuuagccugugugccuugaucuacaaauugacuccuuucaaaguguucuuagagcauguguucuuaagacuacuuuauccuugugaaaaauaauaaagagaugaagaccuugggaguggaauugaaagguuuuauggagcauugcccauuuccuuccacugcuuaccuuugcauauauggugcauauaugguggauaaagauugcuuaggacucuaccccuuuuguauaaggugguauguucacuuauacaaaaaccuagaaaauuuacuuagguucuccagggacuuaaauaacaaauaguuucaccuagaggcaagugaauucacagaccaaugugaauuaaauuuucacagaauuuacucuagguauauguggcauuaaacugacuugcauaaucaaggaggacaugcaaggaaaauaaugcacauauuuuguugucuaccuaacaucuuuugacuuguguucaagaacaagaaaugcauuuuggauauuccaucuguuucagugcugauuuugaucuucauuaaggauuacaagcucagugguuccucuuauccccccuagccuucagcacugcuuguuccuaguaccuguuuuuuucuagcaaccugaccuucacuagccuuuacucuguuugccaagcuccugcacucaggaaacauuucuuaaaguugaaaguugauucugauuuggauaauuaagccuguuuuauauuggcaucacaaagaguauuuucuuccauguaacacagaaaacugcuguauguucucaacacugaaauauauuaaccuaaagguaacuaauauauucagaacuuucuaaaaccuucagagaaauuuuaacccuaugguagugaaaagauguucuagugcugcuauuucaugagacaucuaagagguucauucuuuauggucagacuuaaaacaguaauaagguuauguggagaccuuauuauuuccuaaaagugguucagcuuucauuagaagcugaaaacuguuauaucuuagguaaaaauggaccugcauaauuuauuucugauuagggagauuaacacauacugcauaguuugcuguucuuaguauuuuccuuagcuaagcuggugacacuauuucaguuuugcuuuauuuauagcuuuguggcuuuagcucuugauuuaauguguauauuuuuauaaauacuucaauaaagugguagaaauaaagucugaagauagacuuuacauucuagaaguaaugccacauguacuuuuucaaggaagguuagguucauccauuuaauaauucccuauaucuuaaacuccuuaauguuuuuucuaagagaguguguaugcauguauauguguguguguuuguacacacaucacuugaccaucauaaaguuuacuguuuuucuucuagaucuuuuggcacuggaacaagaugcugucuuuggccuggaaucccuacugguacuuuguagucaagaugauaguccaggugcucaggccacuuuaaaggugaaaacuuuuauuuauuaaguuguaauagauauauaugauggucuuaggcaauagaaagcaaaguuaagcagacauagcuccuguacucuuagaaguuuuaaucuaagugauuaaaucuaacugauaaaacuacacugauuuaaucuaacugauaaaaccacaaaaaaacugaugacaugacugcagccgacucauaaauguucauuaauuuaacauaagcguucauuaauuucccagugguauaagcccuaguuuauaagccaagggaagaauauuuuaaggaauuuucaccuucacuuaguuacagaaaucaucuuagagauaugcaagauuuuuaaaaugugaaaugaggccaggacaguggcucucaugccuauaaucccagcauuuuggggcggucaagguggaaggauugcaugagccuaggaguucaagaccagccugggcagcauacugagaccccaucucuagaaaaauuuuuuaaaauuuagcuggacauauuggggcacaccuauaguccuagcuacucaugaggcugaggugagaggauugcuugaggccgagagguugaggcugcagggagccauuauugcaccacuguucucuacccuaugugaaagaaugagacccugucucaaaaaaaauaaauaaauaaaaugugaaaugaaacuacucuuuuuggagugaaacgugaaauauaauuugugauggugcaaaauuaaugaggagaagcauaguuaauagaaguaagaaacuguuagauaaacauuggcguuagcuugucuaaggugugguuucaaggaagucauggcucauuuuagcagguuaaggaaaguugugauauggucauagugaugaacaauaaagauaguaacaucauuaagugacagcuaauaagaaguagagaagggaaguagacaacauguguuuggcaacacauucugagggggauccucagaauccccuuggaaccacaguacauuuaagacuuuuuuuaaaagcaaaucuuuuuuccaacaauugugggugucaguaaaaugcuggauucagcacagugggacauacauagauggccaagaaagguuccuguaauagaggagcuucccaucuagaauaggcuacugauguuuauauaggggacuauaauaccaagcggaacacaauacauucucugauauuucacaaaaaaagugcaguucuaaugagaggucagagucgggagugauuaacuuuaaccaaggguauuagggaagacuuuaaauaaaugucauaugaguugaguugugaaagauggaaucgaauuacaguaaugaggaaagauuguuugagcccaaugacugcuguuauaaaagacuugaaaguaagaauguaccuguugugguggaagaauggugacuagcccacuguggcugggugaaauaauuugagauuuggaaaaguaguucagucauagaggauaucaaauaacaugguauuauggcuuugauucuauagguaaugaggagauaauauaauuuuaaaguaaugguaaccuuugucguaauuauuauuguuauuugaaugucuauuaugugccaaucuuuguugaagacuuauauauacauuuguuucaguccuucaauaacccuauaaugaaauguguucuccucuuauacacaucagaaacuuaaggccgagagagagaaguaccuuguucaaagccaccuagcuaauaaggggcaagcugagcuucagcccuugcauuuaucagacucuaaaguuaugugugugccugacaccccacugauggcuacauggcugcauugugaaggauggauugaagggcccaucuuuucaagaaauuggaauuaggaagagauuuaugaugugguagagagaauggaaaagugccaacaguggauauuggaggcuugacaaaagaaucuguuagcuauguaaaagugggaauauuucuagguuucuaguuuuuuggcuggauauuagugaugccuuuaagaaggccuugguaagagaaauucuguagccaaauugguuuuuagauuucaguugagaaauaagagaaaauugggaaccucuuucccacuucaguguacuuagagucaucuaagccgucuuuuuaaaacugugaaaccucaguagccucaacacacacacacacguauguuaauucaggaaucuauauuuuuauuuucauucugggagaugcuggcauaguuuacaagccacacuucagaagcaguuccugaaaaguaaugauaauacagugauggugacauuuggccuauauuugccucuucagcauuauuccuuaugauuuccaucuuucuuaaaaguauuuuaauagucuuagauugaaaugagugguugacgugcaguccuaauuuguuauuuuaaacguagugcacuucacaaacccuaaugugagauucaguaccucauauuucuuaugaaguaaaauguuaugccuacaagaaaccucacccuugaguuuccccaguaaccuguacaaagcucuuuuccuuaaagcuucaucuguaucuucaaaauguaacuaguucauuuucuuuuuggcgugcagauugcucuaaacuguauggugaaguuggccaagggcaggccccaucuuagccagucaguaguugagaccuuguugacucaauugcacagugcucaagacgcugcccggauuuugaugugccauugccuggcagccauugccaugcaacugccggugcugggugaugggaugcuuggugaccucauggagcuguacaaggugauuggacgaucagccacagacaagcaacaagaacuucugguaaaaagcccauuuugaaucuccuuugaaugacuaggaucuggucuagugggaauuacuuuuaagucaacauuacuauuugacuuuacuuaaaaaacagaacaaacaauagguuaaauucauuaccuaagaccaaagagugugcugaugucaaaauagaauuggcuuuaugagcuuuuuacuuuuuucacuuuugauuuagaaagccguguuuuguucaccucuaaaacugcuuucuuccgaaacccugucaaaucagccuaguauagccaaagccuucaaucucauguuuuuuuuuauugcaaaggacagaaugaaaaugaaauuuuuaucuuucuuauacagaguaaauaaugaacuaaacccuguuuuguacuuuagaaaauagaaguuaaaaaucuaaugauaauaaugaccauaaauuagcccaaauuuauguuuuccauuccaggaccucuuuagcuguuuaggauccaguuuaggcuucuguagacccuugagguugggaaagguacaugcuuagaaagaaacagaagcuguggaagcuauaaaauguuuaguugaaaaguucugcaggacugagaguaggcuacauucuaaauaauuguaaauuaaaugaaaguuguaagguugccauuccauauuguucuguucaucuuaauuuagaaugugggaaaaaauauaaugaaauaauuuauucaagccuguuuuauguuuaauccuccagagggaauuguguaaaagauugaccccaucccaucauuugcugccagaaaagguuaccuugaugaccaaauguauggaucuuuauaugaaucagcuuugaaauauuaagaggcaguuagcuaaguuuauuuuuuauugaaguggcauuuugaacuaacgguccugauaucuuuuuugugaguacuaccuuaagauugucuuaaauuaugaaacauaauauucaaaaaaucugaggaauaauacagugaaaacucuugcauucauuaucuagcuuaagaaaaagguauuaacaguuuaguugaagcccccuguuuaccuugcugauagcaucuccucccuucucucagguaaccacuauccugaauuugguauuuaucauucucaugccuguuauucuuuuacuaccaaaguguauaucccuaaguaauaugcaguauuuugcauauuuuuaauuuuauguaaacuuuaucauacuacuuguaaucuuuugcauuuugcauauuuuugcguauuuugcuugucaucuauguugguaagucugucgcuaguuuauccauuuuauuuacguaucucauuguuugauuauguuauauaauuuauucauauuauggguauugcuucuacuucuuugcuguuauaaagagugcccugagugaauggaauaaauuaaugacuucaaaauaaaaaauuaaauaaaugucauuggaaaacaaauuuuguucuuuugcagugggcucuaauuaguuuuccucccuuugggguagguuaucaaugacacugaauaaaauuaaaugauuuucuugguuuucuucuugcccaauguuaggugaguuuggcuacugugauuuuuguugcaagucagaaggcauugucuguggaaaguaaggcaguaauuaagcagcagcuugaaagugucuccaauggauggacuguauaccguauugccagacaggcuuccagaaugguauguguuacccuucugagugaacuggguugcuggaaaugucagaucauguaucuucaauuguaugauuauuaguuguagucaaaacuaaaaauaaagauggaaguaccuuuuagucauggguucugaagaugaggaaggaaaggaccugauuuuuaacuuuuaucauaaaagaaugguaucuauguuguuggcauuaguaaugaggaaguuaaaaucuggacccuuucuggcuguagguuguuagugccacuuucauuuugcucuguauuguuauaaccaaggccaccuaccacccgcuguuucuaucuuccuuucucaguauaccacaucuuuguuccucuccccagucuugucauucuuaaguagaaaugggaaagcuuuaguaugcuguacucuucucagccauauggaaagccuaacaaguuuuauuaauuuuguuugagaggaaauagaaaccuugguuaguacagaaauccuggccgggugggguggcucacgcauguaaucccaguacuuugugagaggccaaggcggacaaaucucuugaggccaggaguuugagaccagccuggcugacauaguaaaagccugucucuacuaaaaauaaauuaaaaaaaaaaaccuuggggauaaguccagagaccaaaguuugaggaagcauuacucuaggugauugaagugcauguucuuaauuuuauguugcuucucaaaugggggagaagcacacacucuuggcaggacaauucuucauuauacuguucugucccaagcacugcaggacauugaguaucccuggccccaggcauuaaaugguauucacauuucucccugcaacuaugccuucuccccugggguuucucucacccacuaaauaguucaucuagaauaacauaaaaaaguauuuauacuuccuguauuuugggcuaaaguucuagacuugguuuauaguugauuccauuuauuuucucuuucggaacuguuuuaguaaagaauuucaagcauuauguuacauaaaagcaacucagcauauuuucucugaggaaauauuuagacagagucucagcgaauuacauaauaugaggaaugauuguucagacuuauccaagguuuggguuucucuuuuagcugcugcaucaacucuuucaaauguaagaaccucaccgugugcuccuucuauucuuuuuucuuuucuuuuuuuguuuuuaggguaaucaugacauggccaaagagcuuuaucagaguuugcugacucagguugccucagaacauuucuacuucuggcuaaauaguuugaaggaguuuucacaugcagaacagugucucacuggguugcaagaggaaaauuauaguucagcacuuucuugcauugcugaaucuuuaaaauucuaucacaaagggauugcuuccuuaacaguaaguccucuuaauucaccuuugguggugaugauuuaugugagaguucucucccuucucuuuuuggauuguccuauuucaacuaacuugagaaaccugcugauaugaaauaggucauggaaauaaacccuuaaccuuuuccccuuuuuaacauucuuagauugauaaaaguuuaucacuuucuuguuaaaaauaacuggguaccacaugugaagaggauugcugaauccaugcagaauggguaagugguguguagacaggaugcucccucuacagacuaagauuccagccugugugcaucaguaccaccaucaaacauaaaccccugaccucaucucauaccuggcagcuacugacuaaguaacuaaaguuucuugcuuuauagauaaagagaaauuaucgaagauucuagugucccacuuuguaucucucugugguauccuccuacuccacauuaaccauuagcuagcuacaauuucuguuaucucugccaagaaaaugaaaggguugcaaagagauccuuauguuuccuugaaauuaguuauauuccuaaguaggaaccuauucccuaaaaucagcauuuuuuguauuaaugcaagggcuuuuucccuuuaaaaguaaagaaguuauauaaucaacguuaaacauuuuaaaaauacugucacaugacuuuaaaaauuguauauauugagaugggaccauaaaacuuuugguaccuguuuacguacauuuauaacauaucuaaaauauuuugaaugguggccuaucucaaaagaaauguuucaaaguagaaaaaacaggugucacuaaagagaauauucagacuacugugaggcacauauauuuugaaguauuuuauauauauauauauauauauauauauauauauuuuuuuuuucugggaagagauuguuguuuccuauauuaggcuaauaaaugccucagaaaauuaaaaaauauaauuacugguugagaucaauagaacuauuucauuuucuaguuuauguggagcagaaaauugguaauuauuuaguaccauaaaugguaagaacuuugaacagacaggcuuacaaaacagugugaggcagauggaauuaauuuuaugaaaaauucuguugaauauuugauacuuguuuaaugauuugugugguauguguauuuaaugaggcuugacaauaauuaaggauugaauucugauacaggaagaaagcacuugauugacagagaggagaccuugucuuagucuugguucugccauuaacacagcgugacuuugggugggucauugggccucagauauucuccuuuugaaauggaguuauuuuauucaacagaucauaaacacuugguaugugucaaacacuguuuuuaggauuaagaaaaacaggaaauaauucuucacuugaguguagucuacaggggaaggcaguaugauccucagaguuguuggaaacuucccagaacucugauuguacuguauacucucaggguuuuuuugaggacuuuuuuuauuuuuauuuuuuaaccuguucauuugguaaguguggauuugacaauugcuuucuaucuuuuuaacugaguaaauaugagcaugggcugccccuuuuaacuuacugaugugaaugauccauaccugagaucguacagcuuugaggaucaugcuuuuuaucugcuucagccacacuaaacaggagaaguucaaaauucuuuguuuauggagacccgauagcaaaguuagguguuuaauuucucaauacaaugauuaaugauagaguugucuuauuucuuaggaauaaaaauuauaaaaaguguuuauauuagcuuucugugcuguguaacaaauuacuacaaguuuaguggcuuaaaacaauaccuauuuauuauuucacaguuucugugggucagaaaaguccaggcauaggccaggcgugggggcucaugccuguaaucccaguacucugggcgaccaagaugggaggaucacuugagcccaggaguuugagaccagccugggcaauguuggaaaaccccgucucuacaaaaaaaaauuagccaggcaugguggcaugcgccugugguccuagcuacucaggaggcugaggugggagaaucaccugagccugggaagaggagguugcagugagcugagauugugccauugcacuccagccugagacucugucucaaaaaaaagagaaguagcaguaguaguccaggcauggcuuagcuggguccucugcucaugguaucacaaaauugcaaucaaggugucugugagggccagucucagauaucugaggcucaaggaagcucaggguccuguucuaagaucaugaauuuguugcagaauguauuuccuugcaccugaagaacuuguggaaccugguucuuccagaccagcaagagaaucucucacccucuuuuaauggccucaacugauuagauccgauucacucagaaugaucucccuuucuacuaauauaaagucaauucauuagggaccuaaacuacauccucaaaaucucaucacuuuugccauauuccauuaguuagaagcaaguuuugggugcuauccaccuucaaaagauguuguagguuuaguauuccuuaauguaaaaugcuuggaaccaggaguguuuuguauuuugagguuucuuuggauuuuggaauauuugcauuaugccaguugaaccucccuaauucaaaauuugaaacguuccaaugaacauuuccuuugaacaucaugucaguuucagauuuuggagcauuucagaauuuggaucauuucagauuuuagguuuucaaacuagugauauucagccugcccaagguguggauaccagggaacuugaaucagaggaaccagcuuagcguucuuccuacaauaguuuuuuuuuaaucauuuaauuuuuguuauuaaauauugaauaggcauaauaucuacacauguauuauguagggcauaaaaaaauacaacaaauauccaaacauccaguuagaaaauaggacauuaccauuaccuuuuaaaauucuuauaugcuugugaauaauacccugggucacauagcaagacacugucuccuaaagagaaaaaaaguaaaauucuuaugugcaccuccacauuuguauacuguuuccuuuccacaaagguaacaguacuuugcaucuuguguuuacuguuccauugccuuucuuuauaauuuuuucuuuuucuuuuucuuuucuuuucuuuuuuuuuuuuuuuuuuuuugagacugaguuucacucuugucaccaggcuggagugcaguggcacgaucuuggcucacugcaaccuccaccucccagguucaagugauucuccugccucacccuuccaaguagcugggauuacaggcgcucuccaccaugccuggcuaauuuuuguauuuuuaguagagacaggguuucaccauguuugccagacuggucucgaacuccugaccuaaggugauccacccgccuuggccucccaaagugcuggcauuauaggcgugagcccaaugcccggcccuuucuuuguaauuucaacaugcuuuuuuguaacucuaaagaaaguucuguuuuauguugcuuguuuuugaauuuuauguaaaaaggagucauauuuuucuuugacuugcuuugaucaucuaaauuauguuccuaagauucauccauuuuguugcaggaagcuguaggucaauuucccugccauauagucuugcaucauaagaauauacaucaauuuauuuucccacucuauaguguugauaagcauuuugauuucuccaguuucuugcuguuaccaacauacugcucugaacauucuuguacauaucuuuugaugcacuuacugcaaagguuucucuaggacagugguucucaaccagggaugguuuuauccuccaggggauauuuggcaguaucuggagcguuuuuuggcuaucaccacuugcccaguuguuacugguauuuagugcagagggaaugcacaggagagccccccucaacaaagaauuuauucaguucagaaugucaguaguacucaaguagagaaacacccuucucuagggcaguggaccucacucggagcuguguaucuucccccugcuccaauuuggaaguguguguggauguuucuuuuugucacagugauggggaguugggaagcauugcuacugguaguaauggucaguagcuaaauaccuaaucuccugcaaugcuaagaauacuccuguuccuguuuagagauauugcuguaagauauuaccuaagaguggaauugcacagguuaugugcaucuuuaaauugacuagcuaauaccaguuuuuucccaguggcuuuacagauuuaaaguccucccagcaguguauaagaguuccuauugccauacauuuuucucuuugucugguagguucuaaagcuuaugauuggcuuuucccggauuacuaauacaauuagacauuuguuucauauguuugaccauuuguguuuuauuuucugugaaguuccuuuugaagauuuuugcucauuuuccuacuaguuuuuaugucuuuuucuuacugguuuauaagaguacuuuauauguucuggauacuaaucuuuuguuugcuaaggucaauaugagguaaaauuggccagauaauauuguaacugacuucuagaaccccaaaaucaugucuggcucuuuugcuaaaagacuaaugugagauaguaucuaagaaacagcaucagcguguuuuaagugugucaugucauagaggaaaauuuucacuaugccucuguuuauuguuaaauuagcacauuuuuaguaugugccuuuuguuaaaacuacauagugcuaggaucuccacuaggacaguugccaaauaguuaaagguuuucuuaguucucugcccacccuggcuugccuuaccauuuaccuuuucuaccuagcuaaugcuacccaagacuuaccccugauaccccuccauccucauugaaacuuauuuguguguuauaaccucuucuuccuuggugucuucucugugcuuucugaagugucuacucaggaauuauuuuuaaaauuaaucugagcuacaggaguuugaggccagccugagcaacauagugagacccugucucuacaaaaaaaaauuagcugggcacagccaggcgcgguggcucucaccuguaaucccagcacuuugggaggcugaggcaggccgaucaugaggucaggagaucgagaccauccugguuaacacggugaaaccccgucucuacuaaaaauacaaaaaauuagccaggcgugguggcaggcgccuguagucccagcuacucaggaggcugaggcaggagaauugcuugaacccggaagacggagcuugcagugagccgagaucgugccauugcacuccagcuugggcaacaagagcgaaacugucucaaaaaaaaaaaaaaauuagccaggcauggugguacgcacccuuagucccggcuacuugggaaacucagguggggggauaauuugagcccaggaaguugaggcugcagugagacaugauuguaccacugcacuccggccugggugauagaaugauacccugucucaaaaaaaaaaaaaaaaaaaaaagaaaagaaaaagaaaaagaaauuugggcuagcaguggaagaggguaacuuugaggcaauguccauuuuuuuuuaaaaacagugacugucuagaaacauauuccuccugcccuuaucuuucuuuuucuuucugcccccgacuuuacaagguuccagugaugggaauuucagauuaggaagguagcaaaguaauaggggauuuugggggaugguaauguccuugaagcaucccuuaugcgauuaucuucuuuuuucuuuguuuuuuuuuuugagacagucucguucuaucgcccaggcuggagugcaguggugcaaucucggcucacagcagacuccgccucccggguucacgccauucuccugccucagccucccgaguagcugggacuacaggcacccgccacaacgcccagcuaauuuuuuuguauuuuuaauagagacgggguuucaccauguuagccaggguggucuugaucuccugaccuugugauccacccgccucgaccucccgaagugcugggauuacaggcgugagccaccgcaccuggccgugauuaucuucuugaugauguucuugacaauucacauauuauggggucuuugugaauguaggcaguaaggaaccuuugaauagugguuguacauacaguuuuucagagcugguguuuaauaacaauauuuuucauucuaauauuacauuauucuuuuuaucauuuaggucuuuauccgucaguguuuuuagagaacuacugcacuugaccacaaacugauaaauacuugguacugccccaucucacuguucuguuuacuuugucuuaaauaucucuuuuuuuuuuuuuucccaggcagcuaguacaccacugaauccuuuaagcuuucagugugaauuuguaaaacucaggauugaccuuuuacaagccuucucucaacuuaucuguacuuguaauagccugaagacaagcccaccaccugcaauugccacaacaauugccaugaccuuaggaaaugaccuccagagguguggucgcaucuccaaucaggcaugucuuaacuuucagugcauuuuuuauuuacacuuuagagguuuucgaaguuauaagaugaaaaguuguaaaauauaaaaucagugguuugacucagacauuaucauaaauguuuauucacucaacugucuggcuaaaaaauaggcugauguguuauuagaaagauaaagugauucauguuaucucaaugggugcuacauauuuauauaaagagaaaggacagauuuuuuuaaaaacuugagaauguuuauaacuaaauuauuuuaguggaacuugaagacgcuaaaauacaaauguuuuuguuucuauaugucauauauaauaaucuugugaacauguauaguuucauuugccauuuuuguuuuuauuuaacaaaguuuaugaaaaugaauggaaugacagugaaaagauggcaguauuuuuuuugaauuguuauuguuugaaggugcuuuuuuuuguuuugguuuuuguguuguuuauacaauaaugauagcauguuuguuugucauaauugauuuuuuuuuauagaugaaacaguccauggaagaauuucgaagccuugcuucucgauauggagaucuuuaccaggcaucuuuugaugcugacucagcaacuuugaggaauguugaacuguaucccaagcuugcccuaguacuucuuguucuuuuuggaaguauucuuuuaaauacggacuaccucagauaugcuuaccuacaaaauacauguuaaauaacccuauaaauuuauuauauaguuuccccuuuaaaauauauaagcagaauaaucuuacuuuuuaacuuuacccaggauuuuaacaaaaaauggugacucgaaggugucuuuuuuauauccagaaagagcauccaaagcaacauccaaagccaguguugcuuaccugugcucacuugagcuacaacagacaacacaacacauuuucccaccaaagaacauguauuucaccucaccuuucuuuguggccaacaguccuaguuuuuaucaccuuuauuaaugaucucuucaguagcauuaguugucacuuuuuuuuuuuuuuuuuuuuugagauggagucucacucuguugcccaggcuggagugcaguggcaugaucuuggcucacugcaaccucugccuccuggguucaagcgauucuccugccccagccucccuaguagcugggauuacaggugugugccaccacaaccuggcuaauuuuuauauuuuuaguagagacgggguuucaccauguuggccaggcuggucucaaacuccuggccucaagugaucuaccuaaaagugcugggauuauacacgugagccaccgugcccagccuggucgucacuuuuaaacccuuccuaaguucuccauauuuucuuauuagcaacuucaaaucacuuuugaaaggaaggaauagaaauucuuuuuuuaaguuguaggacuuuccaaucaguaguucuuggcauuuaguuuacugauugaaacccagugaaugcuaugggcccucugcccuacaaaaugcauauauacagagacacccaaaaugugcauguaaguucagggaguugccagaccucuugagcacuagauuaggaaccucugggauaaaggcuccuuagaccacuguguuuuguuuuuguuucuauuuuuuuuuuaacuuuuaucagugaaagcuuuauuugcuuguuugucucaaacucuuaugaaaaaccccuauaucuaagacagauaaaaacagacuugcuguaauugaaucacggggccuaucacuugauuuccccuucccacaguaguagccuccgaaguacccuucuuggaacagagucugaggaucacuauuauagacaauguauaucccuuaaaaagaaaagguagagccccagaccauucgaguugauaacauuaugauuaccuucacuaggcaaucauuaaaucuugaccaauuuaguauucaaguaauagaaaccuauagcggguuucuucucuauuuucguauguaaccuuaacaucaauccagacagcagcagagcuguuuacugauaucucaugcaauagaagcccugauuuuggauccagaaucagcaagguaauucuaauauuaauaauaguuggcguuacagaacacuuucuauacauugucuuaccuaaucaucagaagacuauuuuggagcuaguacuauggaaguaaaaacaaaguggaagaauucuucagcauuuuuugugggucacauaacuagugacaaaacauagauuuaccuccugccuccuguuuucaaaaaguuaacauggaaagauaacugggaagacauucuuugaauaugagcaauuucuucuuguauauuauaauuauacuacgaaaaauugaguuaaugauacaauuaaacuugaacuugagauuuuuuuccuuuggcuucuuaaaccaaaauaucccugguuuugcucuuuuaaauuuuuccccucccccaauaacuaauuaauuauucaaaauaguuguuuucauuaaagaaugauuccuuuuucuuuuccuauuauaguauucucuuuuggaauauacauuuucuuucuuuuuuaacuuuuaaguucaguguuacaugugcagguuuguuauauagguaaacucgugucaccgggguuuguuguacaaaugauuucauugaccagauuuuaggcuuaguacccaauaguuauuuuucugguccucuuuuuccucccaccuuccacccucagguaggccccagugugugguguuccccucuauguuuccauauguuaucauuuaucucccacuucuaagugagaacgugugguauuugguuuucuguuccugcguuaguuugcugaggauaauagcuuccagcuccauccaucuuccugccaaggacaugaucuucuuuuuuauggcugcguaguauuucaugaugcauauguaccacauuuucuuuaucuggucugccaucgaugggcauuuagguuaauuccauguguuugcuauugugaguagugcugcagugaacauaugugugccugugucuuuaugauagaaugauuucuauuccuuuggguauauacacaguuaugggauuucuuggccgaaugguaauucuguuuuuagcuuuuugaggaaucaccacagugcuuuccacgaugguugaacuaauuuacacucccgccaacaguguauaaggguucccuuuucucugcaaccucaccaacuucuguuauuuuuugaugauguaauaauagccauucugacuggugugagaugguaucucauugugguuuugauuugcauuucucuaaugaucagcgauguugaguuuuuuuuuuuuuaugugcuuguuggccauguguaugucuuugaaaaguguucauguccuuugcccacuuuuuaaugggcuuguuuuuuucuuguaaauaauucaaguuccuuauagaugcuugauauuagaacuuugucagaugcauaguuagaaaaauuuucucccauucuguagguuguuuguuuaaucuguggauaguuucuuuuguugugcagaagcucuuuaguuuuauuagaucccauuugucaauuuuugcuuuuguugcaauugcuuuuggcaucuuugucaugaaauccuugcccaugccuaguccugaagguugucuuccaggguucuaucauuuuggguuuuacauuuaagucuuuaauccaucuugaguugauuuuugucugugguguaaggaagggguccaguuuccaucuucugcauaugacaucgguuaucccagcaccaucuauugaacaggaaauccuuucccuauugcuuguuuuugucagcuuugucaaagaucagaugguuguaggaguguguggccuuguuucugggcucucuauucuauuccauuggucugugugucuuuuuguauaccaguaccaugcuguuuagguuacuguagacuuguaguauaguuugaaguuggguagccugaugccuccagcuuugcucuuuuugcuuaggauugccuuggcuguuugggcucuuuuugguuccauaugaauuuuaaaauaguuucuucuaauucugcgaagaaugucguuggcaguuugauaggaauagcauugaaucuauacguugcuuugggcaguauggccauuuuaacaauauugauuucuccuauucaugagcauggaauguuuuuccguuuguuuguguuaucuuugauuucguugagcaguguuuugcuuucaucuccccaguuagcuguauuccuagguauuuuauucuuuuugugacagucaugaaugggaaugcauuccugauuuggcuuucagcucgacuguuguugguauauaggaauacuagugauuuuuuauauugauuuuguauccuggaucuuugccgaaguuguuuaucagcuuaaggagcuugugggccaagacuauuggcuuuccuagauauaguaucaugucugcacacagggauaguuggacuuccucucuucuuauuuggaugcccuuuauuucauucucucaccugauugcucuggccaggacuuccaauacuauguugaauaggaguggugagagagagcauccuuuuguuaugccgguuuucagggggaaugcuuccagcuuuugcccauuugguaugauguuggcugugguuuugacauaggugacucuuauuauuuugagguauguuucuucaauuccuaguuuauucagaguuuuuuuuuuaauauaaugggauauggaauuuuaucaaaaagccuuuucugcauugauugagaugaucaugugguuuuuggcuuuaguuccauuuaugugaugaaucacauuuauugauuuggauguguugaaccaaccuugcaucccagagauaaagccuacuugauggugguggauaagcuuuuugauuuguugcuggguucaguuugccaguauuuuuugaggauuuuugcaucaauguucaucagggauauuggccugagguuuuuguuguugugucuccaccagguuuugguaucagggugaugcuggccucguagaugaguuagggaggagucccuccuccuuaauuuuuuuggaaaagcuucaguaggacugguaccagcucuucuauguauaccugguagaguuugacugugaauccaucuuguccugggcuuuuuuuuugguugguaggcuguuuauuacugauucaauuucagagcucauuauuugucucaucagggauucaguuucuuccugguucagucuugggagagaguguauguucaggaauuuauccauuccuucuagauuuucuaguuuguguccauagagguguucauauuucuguggugucagugauaauaucuucuuuguuguuucuaauuguguuuacuuggaucuucucucuuuauuagucuagccagccgucuaucaaauagauacuaauuuuuuuucaaaacaccaacuccuggauuuguugaucuuuugaauuuuuuuugugugucagucuccaauucagcucugauuuugauuauuucuugucuucuagcuuugggguugauuugcucuucauucucuaguucuuuuaguugugauguuacuuuguaaauugaggucuuucuaacuuuuugauguagguguuuagugcuguacauuuccuucuuaacacuagcuguguuccagagauucugguauguuguuucuuuguuuucauuaguuucaaagaacuucuugauuuuugccuuaauuucauuucuugccaaaaaaucauucaggagcacguuguuuaauuuccauguaauuguaugguuuugagcgauuuucuuggucuugauuucuaauuuuauugugcugugguccaagaaagugguuauuauuuucauucuuuuucauuugcugaagauuguuuuguguccaacuguguggcugauuuuagaguaugugccaugagaugaugaugagaacaauguauauucuguuguuuuuggguggagaguucuguagaugucuaucagguccauuugauccagugcugagauuaaguccugaauaucuuuguaauuuucugccucagugaucuaauacugucauggaguguugaauucucucaccauuauugugugggagucuaagucucuuugaaggucucuaagcacuugcuuuaugaaucugggugcuccuguguugggugcauauguauuuaggauaguuaggucuucuuguugaauugaaccuuuuaccauuauguaauacccuugucuuuuuuuuuuuuuuuuuuuuuuaaucuuuguugguuuaaagucuguuuugucugauuuaggauugcaacugcugcuuuuuucuauuuuucauuugcuuguuagguuuuucucuaucucuuuauuuugagccuauggauguaauugcaugugagaugagacucuuggcauaccauugaguuuugguucuuuauccaccuugccaaucugugccuuguaauuggggcauuuagccaauuuacauuaaagguuaguauugauguauggauuugauccugucaucaugauagcagcugguuaucaugcaggcuuguuugugugguugcuuuauagugucucacuggucuguguacuuaaguauguuuuuguagugacuggucuuuccuuucuauauuuagugcuuccuucaggagcucuaauaaggcaggucuggugauaacaaauucccucagcauuugcuugucugaaaaagauaguauuuuucugucacucaugaagcuuaguuuggccggauaugaauuucuugguuggaauuucuuuucuuuaagaauguugaggccgggcaagguggcucauaccuguaauccuagcacuuugggaggccgaggugggagggucacuugaggucaagaguuugagaccagccuggccaacaugguaaaaccccgucucuacuaaaaauacaaaauuagccgggcaugguggcacgugccuguaaucccaguuacucaggaggcugaggcaggagaaucucuugaacccgggaggcagagguugcagugagccaagaucaugccacugcacuccagccugggcaacagaccaagacuccaucucaggaaaaaaaaaaaaaagaauugaauauuggcccacagucucuucuggcuuguaggguuucugcucaaaggggucugcuguuaagucugauggacuucccuuuguagguggccugaccuuucuagcugccuuuuuuuuucuuuuuucauugcgaccuuggagaaucaugauuauaugucucgaggaugaccuugugaaguaucuuacugggguucucugcaguuccugaauuugaauguuggccucuuuuucuagguuggggaaguucucguggaugauacccugaaauaugucuuccaaguugcuuccauucucccuaucucuuucaggacaucagugaguuguagauucgguuucuuuacauaaucccauauuucucggagguuuuguucauuccuuuucauucuuuuuucucuauuuuuuuuucuuuuuucugagacagagucucacuguugccuaggcuggagugcaguggcgcgaucucaguucacugccaccucugccucucagguucaagugauucuccugccucagccuucugaguagcuggaauuacaggcaugcagcaccauacuuggcuaauuuuauuuuauuuuuaguaaagacgggauuucaacauguuggccaggcuugucucaaacuccugacuucaagugaucgacccaucuuagccucccaaaguguuuuuucucuauucuugucuuacucucuuauucagaaagccagucuucaagcucugugauucuuuccacagcuuggucugcuuugcaauuaauuuuaaggauugcauuaugaaauuauugcaguuuguuuuucuacucuaucaaguugguuacauucuuuuuuauacugguuauucuugucuuuuggcuccuguauaauuuuauugugcuucuuagcuuccuuggauuggguuucaauguauuccuccuucuugaugaucuucauucccauccauacucugauuucuguuucuguaauuccagccauuucagcccaguucagaacgcuugcuggagaguuagugcagucauucggaagaaaaaaggcauucuggcuuuuugaguugucaaaguucuugcacugguucuuucucgucuuugugggcugaugguccuucgaucuuugaaguugcuguccuuugcauguuuuuuuuuuuaauccuauuugaugaccuugagaguuugauugugguauaagguggguuuaaucaacuggcuucauuuccagaagauuucagggagccaaggcucagcucauaacuccuggacuaccugcucugggggacugauaugagccucaacuuuguucucuggcuccuugaggcuaggaacugacugcgcuggguagggggccaaggugcuccagggccacugguuacuacacuccaauggguggugccagccaaggcguuucauuaggauguuggcagcaggauccauccucaguugcacauaccagcagcagcaacagcagcauaacgggaugcacacuuguccaccgcggcaggauacuagcaggucugggaugccggccuuugugugggccuucacagcagcagcagaggcagcgcagguggccgguggggugcaggggaacccuguugguaacugcacgccauggcacuagugguaguauaagcauaggggcguggcgcuggcagacacagaacugugugugcccucuuauguagguggagguagccacuuagggcaggggaagguccauuguuguucacgccugguuucacucccagggcaauguugacacaggagcuccaaaugcaauggcgguaaugcggggguaaugggggcagaaugcaccagcagcaguggcagggcaaggugaacgugcacuuguggggcuggggaggcaagaucugcccaugcacacgcaggcaaagcaaugucgaggguggccaugggcccagggaaagcugccaguacggggagggagcaggugagccggcccauguccacaugcugggccgcugugcuggagcucacuaccaguuaggcgcaguccacaagcacaggagcuaugaugcaggccccccaggacacccaaggcugcacugcaagcaggcacagccagguuggggccccaggagaggccagauggacuggccccaucugaucgucaagacugcucuguaggcuugaggucugacaguucccuuagggauaaagucuccuaugggagcaagucagcaaguuaagccuagagggauggcugccccuggccguauuccacuacagaugcucacacaccaaacccuuugggcucugcauuggcuagaauacggccccuaacacuucucuaagcagcccucugugccaacucaaguguccauaguggucgaggaaucuccugccaggauuccagaggcccguggcaguagcugguuguuuuuuugccaguucaagucacuguucccccggugcgauauccccaugcaggggucccucccagcuuccuccccuucagcccagcuucugugucuucccucuguccacccuuaaucucuucccucuaaagaucuguuaggagaggaccagucauccuggucccuuggugguagcuguuccaccuggcugugucuagucagccaucuugcccauuuacacuaucuauaauuucaaucuaguaaggccugagauuccaauaucaguuuccucaaagagaauauaaucaacaaagcaguuuaaauuucucuacccagauuggaacagaggaagaaaaaaggcugaaaaaaugaagagucaaagcuggccugugggguaaugucauuuagacuaauaugcauguaacuggaaucccagaaagagggaaagggggaacagaaaaauauuuaaauggcuaaaagucauuuauauuuaauuaaacauauaaacccacagagccaagaagcuuaaugaaccucuagcagggaaaacauaaaauuagagcaaggcacacguagcaaucaaauugcugaaaaccaaugauaaagagaaaaauuuuuuaaagagaaagaagauauuauuuagaagggaagaaaauauuauuuagaagggaagaaagaucagaauaucuacugauuucucaucagaaauauuacaagccaaaagacaaguggagcaacaucuuuaaaguccuggaaaaaaaaauguuaaccuauaauuccauauucaggaaaaauaccauacaauaaaucaagguuaaauuaaggcauuuucagaaaaaaucugauaaauuuugccaucagcagaucuguacuacaagaaauguuaaaggaacuuuuuuaggcugaaggaaaauuauuucagauauaaacucagaccuacaaaacugaguaagaaggauuacaagugguaaauguuuuuguuuuuuuuuuuaauuuuuaaaaagauauuugaccguuuauagcaaaaaugauguuuaggaguuuuuaacauauagaaguaaaauauaugaaauaagacaacggggggauauaguaguaagaaucuuacauuuaguaguauaucauuugacaguaacuucugauaaacugagggugaauauuuuaaacucuagagcagccaccaagaaauaaaacaagccaguagagccauaaaguggaauacuaaaauauaaaacuccaaacuuucuagaagacuacauuggaaaaccucuucaugaccuugaaauuggucaugauuucuuaggacacaaacagcaguuaccauaagagaaaaauuugcugaauuggauuuaaacuuuuaaaucugcuuuuguuaagaugucauuuaaaaaaugaaaaagguuacggacagcaagaaaauauucuuaaaacauauucuaucaaaagacuucuauucagacauugcuuuauuaagaacgccauacaacucgacaauccgauuuuucuuucuuuuuuugagacggauccucucucugucgcccaggcuggaguacaguggugugaucucggcucacugcaaccuccaccucccagguucaagcgauucuccugccucagccucccgaguagcugggauuacagacaugcgucaccaugcccagcaaauuuuuguauuuuuaguagagucaggguuucaccauauuggucaggcuggucucaaacucccgaccucaggugauccacccgccucagccugccaaagugcugggauuauaggcaugagacaccaugcccggcugacaauccaauuuuauaaaacugguaagaguuuuggacacuucaaaaaagaagguauguuaauauccaguaggcacaugaaaagaugcuugacaucaguaaucacuagagaaauuaaaaucacaaugagauacuacucccacuagaacagauaagauuaaaaagaccuucaguguccaauguuggugcagauguggaggagcuugaauucauacuaguauguuguugggaauacacaaugauacagccacuuggaaaacuguuugacaaugucauauaaaguuaaacauaaauuuaucauaugaccaccaauucuauuccuacuguucuaccgaagagaaaugaaaacauguuuccacacagauguauacacaaauguucauagcaucuuuauucauaguaacaaaucuggaaaaacccaagugucucucaguaggcuaauggauaaacaaauuguaguauauccacaaaugaaauacuaaguaauaaagaugaaugaccuguugaucauucagcaggucauacagaaaccaugcgugcccuccgaaacaugcugugaaagaagccaaaagagaaaaucagugaaaccagaagcugguucuuugaaaagauuaauaaaauugauaaaacuagucugagcaagaaaaaaaauaaaucacuaauaguagaaauaaaauaguggcaucauuacaaaucuuacagauauuaaaagcauaauaagggaagaauaacuuugugcaaagaaauuugcuuaggugaacaggacaaauuuaaauauucuucauuagcauagacaaaaauuuuuuuaaaaaguucaguccaacaauauauauaaauauaauacauuaagacuaaauaggguuuaucccaggaauacaagguuggguuaacauuagaaaaucaauuuaaguacuucgccauauugcaaaauaagaaaaacuaaagugucaagacuuaacuacugguuucaagacuuaauauaaaacuacaguaacuaagacaaugugaugaugguuuaaggguaggauuaagaguccagaaauacucacguagucacuugauuuuugucaaagaugccaaaauaauuguaugggaaaagaauagucuuuucaacagauugugcuagaacaacuacauauauaaaagggaaaaaauaaucuuccuuaccccacaccauacacaaaagaguauguauuguauggcucuauuuauaugaacuaucaggaaacaaaucuuauguacagagauaaaaagcaaaucugugguugccuaccaccagaaauggaauuguuuuguuagcaagucuuuuauguaguuuagcuguccuuaaaguccaucauacaaaugagcuucaguucuugucuuaauagaacuuaagauauaguacagaacaggaaacagaacuuuggagcccagcaaaugugaacaugaaucccuuaccagucacuccuagcucugugaauguaugucaucucagugagccacguaugcauaaacuguagguagauaaugaugccuguuucccagaguaguugugaagauuaaaugaacuaauauauguaaaauaccuggcugaaaugccuuguacauaguaggcauuaaaaugauaguagggaauaaucagaguagucuuaugcccagcauauuuaaauuaccuacauuguauuuucaaaaguuuaguuagaaaugacuuugaugggauguaucucaaaauaauaagagcuaucgaugacaaacccauggccaguaucauacugaaugggcaaaaacuggaagcacucccuuugaaaacuggcacaagacagggaugcccucucucaccacuccuauucaacauaguguuggaaguucuggccagggcagucaggcaggagaaggaaauaaaggguauucaaugaggaaaagaggaagucagauugucccuguuugcagaugacaugauuguauaucuagaaaaccccauugucucagcccaaaaucuccuuaggcugauaagcaacuucagcaaagucucaggauacaaaaucaauguacaaaaaucacaagcauucuuauacaccaauaacagacaaacagagagccaaaucaugagugaacucccauucacaauugcuucaaagagaauaaaauaccuaggaauccaacuuacaagggacaagaaggaccucuucaaggagaacuacaaaccauugcucaaugaaauaaaagaggauacaaauggaagaacauuccaugcucauggguaggaagaaucaguaucgugaaaauggccauacuacccaagguaauuuauagauucaaugccauccccaucaagcuaccaaugacuuucuucacagaauuggaaaaaacuacuuuaaaguucauauggaaccaaaaaagagcccacaucaccaagucaauccuaaaccaaaagaacaaagccggaggcaucacacuaccugacuucaaacuauacuacaaggcuacaguaaccaaaacagcaugguacugguaccaaaacagagauguagaucaauggaacagaacagagcccucagaaauaaugccgcauaucuacaaccaucugaucuuugacaaaccugacaaaaacaagcaauggggaaaggauucccuauuuaauaaauggugcugggaaaacugguuagccauauguagaaagcugaaacuggaucccuuccuuacaccuuauacaaaaauuaauucaagauggauuaaagacuuacauguuugaccuaaaaccauaaaaacccuagaagaaaaccuaggcaauaccauucaggacauaggcaugggcaaggacuucaugucuaaaacaccaaaagcaauggcaacaaaagccaaaauucacaaauggggucuaauuaaacuaaagagcuucugcacagcaaaacaaacuaccaucagagugaacaggcaaccuacagaaugggagaaaauuuucgcaaccuacucaucugacaaagggcuaauauccagaaucuacaaugaacuccaacaaauuuacaagaaaaaaacaaccccaucaaaaagugagcgaaggacaugaacagacacuucucaaaagaagacauuuaugcagccaaaaaacacaugaaaaaaugcucaccaucacuagccaucagagaaaugcaagucaaaaccacaaugagauaccaucucacaccaguuagaauggcaaucauuaaaaagucaggaaacaacaggugcuggagaggauguggagaaauaggaacacuuucacacuguuggugggacuguaaacuaguucaaccauuguggaagucaguguggcaauuccucagggaucuagaacuagaaauaucauuugacccagccaucccauuacuggguauauaccuaaggauuauaaaucaugcugcuauaaagacacaugcacauguauguuuauugcggcacuauucacaauagcaaagacuuggaaccaacccaaauguccaacaacgauagacuggauuaagaaaauguggcacauauacaccauggaauacuaugcagccauaaaaaaugaugaguucauguccuuuguagggacauggaugaaacuggaaaucaucauucucagcaaacuaucgcaaggacaaaaaaccaaacaccgcauguucucacucauaggugggaguugaacaaugagaacacauggacacaggaaggagaacaucacacucuagggacuguugugggguggggggaggggggagggauagcauuaggagauauaccuaaugcuaaaugacgaguuaaugggugcagcacaccaacauggcacauguauacauauguaacaaaccugcacauugugcacauguacccuaaaacuuaaaguauaaugauaauaaaauuaaaaaauaauaaguuaaaaaaauaaaauagaaaugccuuuuuucacuuagaaauguuuucagaaauuugcagggguucaaagcaguagaggaaaaagaaagaaaucuagguuaaacuuaucccagcacgcuguguauacagacugucuucugaacgugccuaugcguuucaucuccaugcuuuagauucaugccauuucucuagcuaugaauguccuguacuuuccaucucuccaaaguuuacccaucuuacuuaccuacugauauguucaagacucucuucuucugugacauuccuccauguucugaccuguuauuuauauaucuaaccuguuauuacauaucuuuauggaugguuuggagcuuaucugcuggcuuuauugauaguccccuuuucagauguguuuaugucucuuucaccuguggcaguaacacugucauauuuccuggcaaccaaagagauuaagaauuacauaacuugaagucagaccuggguuugaauucuggcuugccauuuacuagcuguaugacuguaggcaaacuacuuacccucuccuagccucaauuuucucaccuguaaauggaaauaacuucauuauuuuaaaaauuaaaugaaaauauguugaaaguaccugauacauguaggcauuaaauagccaugcuauuuugauggauuaaugaauauugaccuuuacuucaguuuccaggaauauggaucuacuggaacagcccaugcugauagugaauaugaaagaagaaugaugucuguauauaaucaugucuuggaggagguagaaucacucaaucggaaauauaccccuguuucuuauauggcaaguggcauuuguuuuauugagcuuuuauuguauggauguggguuuuucauacauuuauggcacuuacugugugaguucaacaaauuaaccuuucugugccuguuuccuuauccauaaaacaggguuaauaccuaccucacagcauuguaguggggaguaaaugagauaauccaugaaaguacuuagcacaucucuagcugcuacguaguuauauuaauauauaaaaaucugcucuaccagaaugcaaauaaaauuuuuucuuuuuuuaacaauuuaacugaaguugcaauaauucucaacgcaggcuacacauuagaaucacuuugagggcuuuuuaaagaauacauuaauauacaggccucaccccugaccagcuaacucugaguuucuggaauuguggcccaggcauuaguaguuuuacacacacucaggugauucugucaugcugccaugguugggagaaccacuggacaauugaaacagaaagaacagggcuuguuggcugacuggcaaugagucauuuccuaccaggugaugacauuaaugccuuucaguacacucuucagccuuuacccugcugaaucucugcugccuuuggcacuuccuaagaaguucucagagcacucacccuuuuuuuuaucuucuccccugauuucccagucacaggacaggcuaacauacucucacccaaauuuucuccucccugucugaccauuccccaguaucucugcucagguuuuauaacaaaaugccguaggcuugguaccuuaaacaacagacauuuauuucucacaguuuuggaggcaggaaaguccaguaucaagcugccagcagauucgguuccuggugaggacuuucuuccuggcccuggugacagccaccuucuuauuacaucuucacaugguagggagagaucgagagcucuggucacucuuccucuucuuuaagaacacucauccuggccgggugcgguggcucacgccuguaaucucagcacuuugggagggugaggugggcagaucacgaggccaggaguuugagaccagccugacuaacauggugaaacccugugucuacugaaaaugcaaaaauuagcugggcaugguggcgcaugccuguaaucccagcuacucaggcggcugaggcaggagaaucgcuugaaccggguggcggagguugcagugagcugagauagcgccacugcacuccagcccgggcaacagagcgaggacucugucucaaaaaaaaaccaaccaaacaaacaaacaaaaaaaacacucaucccaucaugggggcccaccuccaaaugccauuaccuuggggguugcagcuuccacauacgaauuugggggaacacaaacauucaguucccaauucccagccuuugaacuuuaccccuuggagaguuucucuucugcuucugcucuucucauucuguacuuucaugcuuuaucaaguguuuuagaauaaauaggaugucauuaaagaguuagguuagaucuaaagaugggcaauuccuuugacauauugcuuuccauguaaaauugucaauaguauuuacugaauugaauugacagcuguuugacagugacauuguuugcuaagggagaguguaaagacagucuuugaaagaaauacacacaucugugugagacagugguuauuuucauauucuucuaagcuccauccuaaaaaaugaaauagaugcuaaacaaacuucauuuugauggaauugaauauaacggaaugggaauuuucugcccagcagaagacacaguacagagaaaagggcccuaggcucauucagaacuagguucaaauucuggcauugcugcucagcagcugugugacuuuagucacauugcuuaacauccuuuuauaugaaguagaaaacauaccugccucauaggauuacugugagguuuaaaugaaauaaugcuaauugccuagcacagugcugucauauagggagugguuaauaaaaguuauuucccggucgggcgcaguggcucaugccuguaaucccagcacuuugggaggccaaggugggcggaucaccugaggucaggaguucuagacuagcaugcccaacauggugaaaccccaucuguacuaaaacuaccaaaauuagccaggcaugaugucaagcaccuguaaucccagcuacuugggaggcugaggcaggagaauuacuugaacccgggaggcggagguugcagugagccgagaucacgccauugcacuccagccugggugacaagagugaaacuucaucucaaauaaauaaguaaguaaguaaguuauuucccuuuuucuguauuuccaaguuguacuuuauagauuuguuacugucugagccuccagauucaguucaacaaguauuuaugggauccuagggauagaaaaaugacaaagacacaggaucuucccucaaguuguccauagucuaagaaagaaagauuuuauaaacaaacacaauacaguauaugugcauuaauagaauucugcacaagguagagauguaguacaaaaaagagaguaguucacaucaaaagauagggaaaauggauugguggugcaguugagagggaagauguauuuguauaugaguuuuccagacagauaagaagggguugggaaucucagguagagaacauauucaaaagcagaggcaugaaauagggugaugucuucuaggaacaguuuguuauuacuucaauguaacauacaggcuagggauuagagagaugaaaucagagagguagccaguggccaggugacaaaaggcuuugaacacaguauaagggagcuuggacuuuguccuuaggcacaggggggcuucuuagaaauuguaaauggguaggagagagaagugcuuaauauagauuguauauuaucauauagaagcaaaacaggaaauggcuggcaggguguggaauuagaggaaagaagaaugacuacaaggcuuuuucaguaauccaaacuaaggaacaaauuacuaaaauggcaguaggaaugagaaaaauagauauauaugagagauauuuagugaaaauauuuucaaggcugaguuuuuuaacuagacaugagaugauggaggcaugccuuccagguuuccagcuugaaugaucaguuacacaacugauugauccuuuacugagagaauauagagaggugauagaagaugaagguuuuacuuucaaacauguugcugucuuuaggcaguuggauaguaaauacguugcaguuggaagaaagaugggcugggaugcauauaaggucaucugcacauagaaguucuuaaagucacgggaguggggagaauugccuaugaaaaacauggauugagaagagaagacaacaaggagagcaucagcauuuaaggaacacacaaaagaagaggcucuuuaaaaagaagauggcaaaaggaagaaucagaaauaaggguauggacuauuagguggaauuucauggaaggaagagcauuaucaggugccacagaaaugucagaaaauacaaagacugaaaaguauccauuggauugacaauuaagagagcauuguccaggcacagugccuuaugcccauaaucccagcacuuugggaggccaaggcggguggaucacgaggucaggaguuugagaucagccugaccaacauggugaaacccugucucuacuaaaaauacaaaguuagccaggcgugguggcgcaugccuguaaucccagcuacucaggaggcugaugcuggagaauugcuugaaccugggaggccgagggugcagugagccgagauugugccauugcacuccagcuugggcaacagagagagacuccgucucaaaaaacaaaacaaaacaaaacaaaaagcguuaacgucuuucugcugguuuacugaucaugauacguaauuuacaucuccagacaucuuaauagugaucugcuaauacaccuauggaggucaauacccaaggggcuguugaccucagaggcacuccacacuuuuccaagaggguauugcaaaaucugcaccauucuuuuaaaaggcaaaauggugacuuucugccugaaaacagccugaagucccuugugguccucugaguccacgcuucaaagauguuucucuccuuagacacuaguguggcaucagagguccaccaaagguggaugucucugcaaauacuuuccaaauuacuuguugcaggaagcugauuaaugcuauuuuaacaguuaaaucugaaaaaauagaaccagugucuuuaaaucuguguugugauuaucucagguaauagacuuggcauuuguacuaugagucuguugggcacaaaauguucaauugccugaacccaauaaggaauggauuuuucuggcuuuuagccuuaacacccaacuuuaaaaaaaaaaauguuuacagcaugagcaacuaggugacacucugcuugaaagcaggagccuagagggacagacagcauaccacauggugcaugcagcaguuuucaaccugugguguuggguuucaaucaggcuggugggaaaaauauuagagauaguuauagaaauagacacaaaucuucuuggaaggcugagaaguuugccuaacuucaguaauagaucuggcugaaggcggccugaucucuuuaccuuuaaacaaauuaaaauaguaauaaagaaaggcagaguaguuuaccuggcuagcuuguuuacucauauaaagacuaaccuuugauguaccgugagugcuuaagugccuuuuacucagaaguccacaaugucaauuucccucuaaugguguugacucaagcuuuuguuaauuaaucuuacugaauaaaugcgagucugacuagcugaucagggccuaguugcaacuguuuacaggacucagcaggagccuguaagcggcugggacccucagcuggacuggcagagcagaauaucugugugucagcauacuuuauuuauccguugcugaaucgggucugcaagaacagaccucccgcagcuagugcccccgugaaaggagcgcugccucacuguggugacuuacgaggccacugagacgggaguagacugaggaagggauaguagaccaagcaggaaugguucugguucaccugaaguuaaaaguguucuuaugauacuuucaguuuucuucuauuagacuggguaaucuuuaaaauaucuuugaacgcuuaaauucugauuuuaugaccacuuucauuaaggcucaaaauauucucugugguguuucuguaccucugcagucaugcugggauuuucaaaacucaguuaaaugugugaggcagauuugagaaauaagauauuuuauuagaguuucaggauuccccgacuauauaguccucuuucaucugaauucgaccaaguuuccaccacugcuuacucugaggaccaauggccauagagacaagccaccuaaugaaagaaugagccagcucaaagccaaaguccugcaaaaugcucgggcuucuuuaccauacuguuuaucauacuuugccaugugauaguuacucuauauuuuaguaucuaauauaauuguuuaauaauauacugauaguucugagcgcuguagaaauguggaauuugccuauugcuuggccucgaggacuguggauuuucucauuucugucacuuauauuuuauugaauauacuucacaauaaaguaaaaaucuguaaugaaugauuuaguauguaugcacaguuccuggaugugaugccuaguucuugauugguauguaccuuuguaauaaucuauaugggcauuuguaguuuuauacugaauguaccacuuguugaugaaauuugaaaauuuauuuuuauuugauuuaguuucuuuuuucccccagcacacagcaugccucugcaaugccaucauugcuuugcugaaaguuccccuuucuuuccagagauauuuuuuccagaaacuacagucuaccagcaucaagguaauacaggaagaauacuaagguuaauauagguuuuaaaaccaggugucuucugaagauuauguaggacauagcuacacuucaguguguuaccuuugguuuauugguuuuuuuguuuuguuuuguuuuuugagacagagucucgcccugucgccugggcuggaguacaguggugugauuuuggcucaccgcaaccuccggguucaagcgauucuccugccucagccucccaaggaacugggauuacaggcauccaccaccucacgcagcugauuuuuuuauuuuugguaaagaugggguuucaccauguuggcuaggcuggucaggaacuccugaccucaagugauccacccaccucugccucccaaagugcugggauuacaggcaugagccacugugccuggcuuaccuuugguuuugauaaaaccuaguuguaagccauuucucuccuuuaucaagugguuuggugaaagaaaugaauuugggaguuaaacucucucccuuuuuaauugucagugccaaauucuaugagacaggcauuuggguaacuggagcucuguuguuugucucucaccuccaggaauaaauuagugauuuaucacaguagccugcaaggaucuugagcugagucuauucagacccaacuuauagacccaacuuagaaugaaucagauccaguaaacugucaccaguucuucuuccaaaguacuucugccuuucaguaacauguuuugaggggcuaaccagugaguagaauuaguauuuugaaauauuuaagccacucacaauucaaaagcuauuuuugauucagaaaaugaaauuguuggaaaagggagaaaauugucacuucuaagagaucuccuggauuaucccuguuaguuaaugucuucaguaaacuuuuacauccaugcaaauguuuugauuacaaauaacagagcauuccauuucaaaaugacuggaauaaugaggaagauuugacgaucuagauaagaaguccuaaaguaggaugucuccaggguugaucaguaguucaacaacauuaucaaaaagacucaaauuucuuccaucuuuucauuuagcaagacuugggcuuucuuuaauugauguguuugggauuuuuaauacauuuuugaagaaaaacuaaugagaggugaaaaaugucauuugauucauuuguagauauugacuuuuuuuauagcacagugacuucguuguguagauaauccuggaacuuuaaguucauuuacauuugaauuuaguuuauuuaaaauuacguaagaccaaagagacagcucuuagguaaugaaaauuuauauaaugccuuucccuacuagaagugguucauugucaaagaaaugccucaccacaaaaauugggagaauagugccuuugcuuuuuucuaauucucuauuauccucaaauagaacugagguuugggaugaaaaccacagugauguuuagaaggaggcacuuuaaagguacaucugucucguuguccuggcacagucagguccugugggggugggggagugcacaaucgaauuuguuaaccuguaaccagugauuagcacagacauguuugucggaaggaagcuugcucuugguuguuggcauuuauuugaguguuggcauuccagcuugcucugucaccaucgccccggaauccugcagagcccauugcuguccagaauaaccagcagcuggcgcuaaagguagagggagugguucagcacggaucuaaaccaggacucuuccgcaaaauucagucugucugucugaauguuucuuccacacugcagaguaaaucuggacaagacuacaagguaauuuagaaaagaggcagaauugugauacagguuuuauaugagcucauugauggaaguuuuccaguguuuuucaugguuaaauagauugcaguuauaccuccaaagggaucagauggacauaaauuaaaagcccacauuggggcuguaagggguugauaaacacuucuuuuucucucccugaaccaguugauagagacaaagcauccaggcaaagaucaaaauaugaguuuuauuacuguuggagcugugggaaaaccuaacuccaaugccuggcagcaaggccuuucuaaccguagaccccugaauuggauuuuuucacccagccucagucaguacguaugggagccugccccuauaaaauuuauggcagggcacagaggacucaggugcccaaagcagaagagaaagagcaagugcuuaccuucccaugucugguuccugcccagaaagucacccaucagcaagacucaccuccucccugcuaggucaguaauauuaaucuaacgaaaggucucucuuacaucaggaggucccuucaaacgucagaaguuggaaaauaagugucucccuaacccacccaaucccuccccacaaaaaauacacaucuauuuaguuuucuccauuuuaaguaaauuuuaucauuaaaaaaaguauauagcauuucuauaaaaugaucagauaaaguaaaaucuuuuuuuaagaguguaacccuagggauuugcugccuugggaacucaggauauagguaaguaauaaccugaauuaggcuacauuguuagccagagcuaagaugcugaaucugugcccaugaaaugccaguguucgagauaaagaauguuccuugcuuuagacauuuauuuccgauucccuggugguuuauccacaguaaaugaagcaagggaccaaguccacaguuguagcagcgaaguuacucagaugcccagauuggcuguguccagguuuauuguggcauagcauggaaggcaggguaucagugaagguauaaaaagagagcauuuuauuaucuuuggugguuuuagguuaaaaagccaagggaaggucugguucuaaacuauuauuacuuucuuaagccauuacuacuuucuuaacuauggcaaguuccucucacuuuggcacucuguccacucugacacggcugagccuucauucuccucuuuuccucuguuuugacuucugugccauacagcaugguaccuuauguagccacucaauaauuugugaaugaugaaaaaauuauuuacuauauuuagaguauaacuguuaaaauuggguaucugcugucacagaagguuguaaugagaauuuacauaauuuaucccugucugcaacucucucuucacuuugaauuugaaacaguaguaaccaugauucucuuuguuacuugcauauaauuucuacuguuaagaaaauaacauucaaaccuagaagcuauggucuucugcuuguugaccuaccucucaagaggcauugauuaaagucaggaagcugauauaauaagccgaguaauaacaugauuacuuugcaguguuauucacagugaguuugcagcuuaagaugcagccauccauucagggugaucagguucccuaggccuauuucugguccuuuuaaggaaguucuuugguuggcauauucuuuagggaaauaaaaacuguacaaaggcuaaaugugaaaaaguaccuguacuauaaauaauucuaagaccuugaauugguuggugacgucaguucauuacuauuacagguaaaugucucuggaaaagugacaugauaacugcuccuugagacacaaagcugcagggcacauuuauauaauuaauuacaccacagaaacacgcacauaaaccuagaguaauuuggucaaauacacauuaagaucaccuuuauuugcauucucaggauaaaucugucucuugacacguuucaucuuggguacagguaagaguacgucagcagguuuuauucuggucuuugaagaacaaaggcaugagugucuggcuaaaugaaugagccuauaaaucuguguuuuauaacauauuguacuuccagucugaacaaaacagugcuuauuaaaugagcaauguacaaaugguucaguuaauuuguuaaaggaguaaggaaucacuacauuaaguaauaaaaaucagacuaacuguugggggggaaccuaacuuaaauuugcuuaguguuuuguucuuuuucagucucuuagguuuuaaacucucuggaacaggugauuucauccuauuucuucagaauaucucuucacagucuaaaggaagauagggauuuagagaugggguugaguaagcaaggaagaaaggccagcaugugaaggggcugucaacggcucugggagcucauucuacucaaguagagugaggagcaucacuuaguaguucagaguguaggcccuggagguagucugccuguguucagauuccuacuccguucacuaaucaugugacuuuggagacauuacuuaaccugucugccuuagacuccucaucggugaagcaaggaugauagcaguaccuaauuuuuuauugucugcauggucuaaauaagcucuuagaacagggccuaacucauaguaagcacugaagaaauguuagccauuguuguuaguuaacaauuguuucauugcagauacccauugacaacaugaccaaugagauggagcaaaggguugaaccucauaaugauuacuucaguacucaauuucuguugaacuuugcuauccuuggaacacacaacauuacaguggaaucuucugugaaagaugccaaugguauaguauggaagacuggucccagaacuaccauauuuguaaaaucccuggaagacccuuauucccagcaaauucgcuuacaacagcagcaagcccagcagccauuacagcagcagcagcaacgcaaugccuacacacgguuuuaaccauggaaugaaugcacugcagacucucaagagaucaaucaaauugccagaaacaguuugguuuuucauauggaauaaguauuaaaguuacaguguaguucauuuauucauugauuuuuguaauguaauauucuggaaaaaauuuuguuuucuuaaaaauuuugucugacagcugggcgugguugcucacgccuguaaucccagcacuuugggaggcugaggugggcggcucacgaggagaucaagaccauccuggcuaacacagugaaaccccgucuccacuaaaaaauacaaaaaaauuagccaagcaugguggcaggcgccuguagucccagcuacuugggaggcugaggcaggagaauggugugaaccugggaggcggagcuugcagugagccgagacugugcuccagccugggcgacagagcgagacuccgucucaaaaaaauaaauaaauacauuuugucugaaaaauaacugggauccuggccagaaagauuguucuuucuuguuuuauuauuaguuuuuucuguugccaagcuuuuuuuucuuucaagaauagucacauguugagaucacugaauugguaaauuugaccgcuacucuuccaaaauacaucauuugcugccugacuuagaccuaggauucugaguuguucauugggagguucugaccagucacuacaagguuuauccaugguagcagaaccugaguccuucuguagauggacuugaaaguguuccgugcaacauccagccuucuggauuaugaaagcccacagucuaacaguauugaaacauccugcuguauuaguucaaccacauauuuaucucuuccugugcuaaagcagucuuuauuauuuucauauuuaauugaaacaaagagcagcuagcaauuucauagaaaauuaauuuguuuuuucugaugugucugcaacuguguauaauacagacauuucacauuguuuccaaaagugaagaacacucauuuaauaucuucaauguuuuaaguuagaagggguggaucuuuuccuuugguuggugauugguuugguuuauacuugaugaguuaugcuagacugauuguuuagagagagcagucucuuuauuacacaggcucaguuuguugggaugcucagggaacagaguuuucugguuagccagaaaacccccuuuuuuccuauuuuaauucugguugaaaaccaugauaaaauagacuuucuuagcacaguaugguagauauaacuuaacugcuuuuugauuggggaucauuuagggcuucaggaucacgauuucuaaacaucagggaucauaugguugcagaugccgaugcuauaaguaauuuggccggaugcagcuccuaagguaaagcaggguacuuucccuggaauuuccuuuuuaaauaaauaucuguuucuuugcuuguguuuugccuuuuucucuucaaagucaacauuaauucaaaggagaauggagcuuaagauaaaaaauaaaaagggguuguuguuuuuuuuuucuuucuugucaugcggccucugggacugagaagugauuugcaacuugggucucuccaagauugcuugccuucaugagcacaacccauuguacugcuaacagccagaacauucucauaaaauguguacagaucuacaguguccacgguugaaugacaucucuucagaugcagcccaguuguaugagguucacacaaccuacacagucaucucagcaccugggaacacgugcuuaggaaaaauugccagagcagugcagaaccccuuguucuuuuaccagguguggaaacagcugaaucagaaagccuggguuucacucuugguucuggugaauuagcugugugaccaagcaagucacuuuaccucuacaucuuagggguuuuuuuuuuugucugucaagugacugaauuagacugguuuucuggauuccagccuagaguuguauuaucaagugacugaaagacuaaaaacaaacaaaaacauuucuuaaauuggagaucuuuuuuauuuguaauuaaguggcuauuuucaggguuaaaguuuacaauguggauuucaagcuucuggugccauucaagguagauuucuccaaaaaagaagcaaaucuuguaagccaucaauucccuuugagaacuucccaaauguuauguucuuaaaagauagguuuugauagcuauguuuaugaacuuuuuaacuugguguauuaugggcuccuggcacaaacucagaaaggaauuuuuuuuuuuuuuuuuugagacagagucucgcucuguugcccaggcuggagugcaguggugcaaucucagcucacugcaaccucuaccucccaggcuccggugauucuccugccucagucucccgaguagcugggauuacaggcaugugccaccacgccugguuaguuuuuauauuuuuuaguagagauggguuucaccauguuggccaggauggucccaaacucuggugaucgcccgucuuggccucccaaagugcuaggauuacaggugugagccaccgugccuggccaggaauuauuaaaauaaaagcaaguccaagaa

SEQ ID NO: 13022 - RNA, 1519 nt, Homo sapiens
auucagggcauguaauaagucccuuauuuuuacauaaagagcuuuuaaauucuuauuaauagaaaaucaggugucuuuuaauccuuugcugaacagauauuuaaagaaaacuggccuguucaugcauuuccaaauuauuagcuuucugguaauuuacauauuccucuaacaagcccuggauggaggccucuaaguccuccuucccugguaaacauggggcuguucauuuggcuggguaagcugagaacguuggugugugggugcguaaaagagaaucuguguucaaugaaguauugucgauaggguuaauuguguauuuggcacacauaaacgggacaagacguguaaaguacuugguaggagagcgacaguauuucuccuuuuuuuuuuuuuuuuggagacugggugucacucugucgcccaggcuggagugcaguggcgcacggcucacuguaaccucugccucccagguucaagcaauuccucaugccucagccucccaagaagcugggauuacaggccugcaaccccaugcucuguuacuuuuuuuuuuuuuuuuuucauuuuuaguagagacgggguuucgccauguuggccaggcuggucuugaacucuuggccucgagcaauccgcccgccucggccucccaaagugcuaggauuauaggcgugagccacagcgcccggccuaauuuucguauuuucaguagagacgagguuugcccuguugcccaggcuggucugaacuccugggcucaagcgacccacccaccucggcuucccaaagugcuaggguuacgggcgagcgugagucaccgcgcccacccgggagucuguauuucuaauuuguauucagcucucagcauauccucaacgugaccccacccagguucaggguacuggaaccugagcgaggaaugcgugugccggggagaguagguagugugaggggccagagugcaaaggucagaaggcaucugguggaagcggugugcaaagaagccugaggggaggaccuuagaucucgguuaccuuggcgaucucuaucagaggguuagaguugccgagaggcgccagcugccgcuuccucucucccgcccuccguuuggcuuagcucgccggguucucccacagguuaaaagcagacgccgacgcgguugccuagugacacuuuucccaaaaugccuaggguauuguuguguucuucuuagccaaugagagaggcgaagcggcccaccgccugccaauagacugcgagaucagggcccgcgacgguuaaacggggcccaaggcagggguggcgggucagugcugcucgggggcuucuccauccaggucccuggaguuccuggucccuggagcuccgcacuuggcggcgcaaccugcgugaggcagcgcgacucuggcgacuggccggccaugccuucccgggcugaggacuaugaaguguuguacaccauuggcacaggcuccuacggccgcugccagaagauccggaggaagagugauggcaaggugag

SEQ ID NO: 13023 - RNA, 1519 nt, Homo sapiens
cucaccuugccaucacucuuccuccggaucuucuggcagcggccguaggagccugugccaaugguguacaacacuucauaguccucagcccgggaaggcauggccggccagucgccagagucgcgcugccucacgcagguugcgccgccaagugcggagcuccagggaccaggaacuccagggaccuggauggagaagcccccgagcagcacugacccgccaccccugccuugggccccguuuaaccgucgcgggcccugaucucgcagucuauuggcaggcggugggccgcuucgccucucucauuggcuaagaagaacacaacaauacccuaggcauuuugggaaaagugucacuaggcaaccgcgucggcgucugcuuuuaaccugugggagaacccggcgagcuaagccaaacggagggcgggagagaggaagcggcagcuggcgccucucggcaacucuaacccucugauagagaucgccaagguaaccgagaucuaagguccuccccucaggcuucuuugcacaccgcuuccaccagaugccuucugaccuuugcacucuggccccucacacuaccuacucuccccggcacacgcauuccucgcucagguuccaguacccugaaccuggguggggucacguugaggauaugcugagagcugaauacaaauuagaaauacagacucccgggugggcgcggugacucacgcucgcccguaacccuagcacuuugggaagccgaggugggugggucgcuugagcccaggaguucagaccagccugggcaacagggcaaaccucgucucuacugaaaauacgaaaauuaggccgggcgcuguggcucacgccuauaauccuagcacuuugggaggccgaggcgggcggauugcucgaggccaagaguucaagaccagccuggccaacauggcgaaaccccgucucuacuaaaaaugaaaaaaaaaaaaaaaaaaguaacagagcaugggguugcaggccuguaaucccagcuucuugggaggcugaggcaugaggaauugcuugaaccugggaggcagagguuacagugagccgugcgccacugcacuccagccugggcgacagagugacacccagucuccaaaaaaaaaaaaaaaaggagaaauacugucgcucuccuaccaaguacuuuacacgucuugucccguuuaugugugccaaauacacaauuaacccuaucgacaauacuucauugaacacagauucucuuuuacgcacccacacaccaacguucucagcuuacccagccaaaugaacagccccauguuuaccagggaaggaggacuuagaggccuccauccagggcuuguuagaggaauauguaaauuaccagaaagcuaauaauuuggaaaugcaugaacaggccaguuuucuuuaaauaucuguucagcaaaggauuaaaagacaccugauuuucuauuaauaagaauuuaaaagcucuuuauguaaaaauaagggacuuauuacaugcccugaau

SEQ ID NO: 13024 - RNA, 7613 nt, Homo sapiens
cgucugcaaaggcgggggggcgaagaaggcgcccgagaccgggccgagugcagcugccguggccgccgccucucuagcuccucagccauccgcuccucaguccagccgccgcagaggagaccagcaagcagagcccucagaugcucggagcuuucucggcgcgaagcugcccgucgcccucuccugccgcccucgcccgccgcccuccugcuccugcuccggcugcggcucuugguaccccggcuccgggagcccagcuccccgccaccgccgccgccugggugugggggcugcugaggcugagccgggccucggcgccggcucugaggacggacgccugaggagcugcgcggcgcggcgccgccggcuggcggagaacgcccacaggcgcggggcucggcggcuugacccgggcuuguccccgugcggccgcgggggccccucagcgguuucccgaacggcccgacucgggcgcuccuccgugucgcggucgccgacccuccgcgucccgccaacgccgccgcugcaccagucuccgggccgggcucggcgggccccgcagccgcagccaugggguguuggggucggaaccggggccggcugcugugcaugcuggcgcugaccuucauguucauggugcuggaggugguggugagccgggugaccucgucgcuggcgaugcucuccgacuccuuccacaugcugucggacgugcuggcgcuggugguggcgcugguggccgagcgcuucgcccggcggacccacgccacccagaagaacacguucggcuggauccgagccgagguaaugggggcucuggugaacgccaucuuccugacuggccucuguuucgccauccugcuggaggccaucgagcgcuucaucgagccgcacgagaugcagcagccgcuggugguccuuggggucggcguggccgggcugcuggucaacgugcuggggcucugccucuuccaccaucacagcggcuucagccaggacuccggccacggccacucgcacgggggucacggccacggccacggccuccccaaggggccucgcguuaagagcacccgccccgggagcagcgacaucaacguggccccgggcgagcagggucccgaccaggaggagaccaacacccugguggccaauaccagcaacuccaacgggcugaaauuggaccccgcaggugagccgggaaagucgcugccgcaggugguuggguuuggggugcccagagccucgccuggccuucggcgggguggcccgcacgcccccugcugcccgagcgggccugcgccgcgccgccccugccugcucccuccccguccugcacacgccccgcugcugcuccaggaaaucagaacccccucagucgggugcaaggagccggcgacgcgucuggcauauuuguaggugggggcugugggucagacccuaagaaaaagggucaggaggugaucaucaucccgcugcaguccacacccgcacuuggcugucuuuacaggcugcagcaacuuugcuggagacuugucugguuaugguuauaacagcgucagaaaugcuucccaauucaauuccuuggcccucuugggaaacggagagaauccccaauucguccccaguaguugggugcuggaaaccuugcucugccaaaguaguucuuaugcccauugaacuccguuucauaauaugcauucagagcguguaaacccugguuaaagguuucuuuuaugaacagcaguguaugcuucagcuaauugaucccuaauccuggaaaucauagauuuaggaccugucugggcauguuuaacauuuucccaggacuuuucauaaucguacugaacuaaaagugaugguaauuuauucaucuuauauuuuuaguggaugcuuuuuauauuuaacauuaagugcucuugaaggaaauuugaaaauaaauguugaaagaaaggagauggaaaugacucaaccaguguccuacuacccaagcucaauggugcuuaacaauuuggucuuauuuccuucacuuacguuuauuuaccuuguaucauuauaaauuaugcuacauaauuuuccuuuucgagugcagaauaugaaguuagugaaauucaaguuguacauuggaaagguuuaauaaguaauugguuuuccucucacuccacucggcaagguguuauuccaaagaaaauuaaguuucucugguguguaauuucaaaagaucaauacuuuuuaucuuuuugaauacuuuugaucaauacuuuuugaaaagaucaauacuuuugauuuaaaaguuaguagggcagguagucauuuaguuucaauuuuucuaauaaucucugugauuauugauuuuuauuguugauuugucaguuuuuaaaccccccuaccaagaaacuuuuauauucauaauaaaaguuuaaaaguuaaaauugguuuuauucucaagcaauuggccucagugacaaagagugacuagagagugcccgagugucaaaucagguauuuuguauuaguagacuuauuccuagcugcauuuaauuuugguguuagcauucaauuuuauguuuuccuuuguauauaccauaaaguauagcagaaugguugcaggacuccacccccauagaaaauauacacuauuuuggagaggaggaggcaggagagugguuaggagggugaagaagcaguaucacaaugacuuaauuuagcccuggcuauuauguccuggcucauucccagaaugucaauuuauauuaaauugcucugagcacauuuuuuuaauuguacuuucugaaaaaauuuucaccuucaucaccacuuaaaaagaauuagacaaggauguuuauauaaacacuuuaaauguauuugauauaaaauuuuuauuucuuuguagacccagaaaaccccagaaguggugauacaguggaaguacaagugaauggaaaucuugucagagaaccugaccauauggaacuggaagaagauagggcuggacaacuuaacaugcguggaguuuuucugcauguccuuggagaugccuuggguucagugauuguaguaguaaaugccuuagucuuuuacuuuucuuggaaagguuguucugaaggggauuuuugugugaauccauguuucccugaccccugcaaagcauuuguagaaauaauuaauaguacucaugcaucaguuuaugaggcugguccuugcugggugcuauauuuagauccaacucuuuguguuguaaugguuuguauacuucuuuacacaaccuauccauuacuuaaggaaucugcucuuauucuucuacaaacuguuccuaaacaaauugauaucagaaauuugauaaaagaacuucgaaauguugaaggaguugaggaaguucaugaauuacauguuuggcaacuugcuggaagcagaaucauugccacugcucacauaaaaugugaagauccaacaucauacauggagguggcuaaaaccauuaaagacguuuuucauaaucacggaauucacgcuacuaccauucagccugaauuugcuaguguaggcucuaaaucaaguguaguuccgugugaacuugccugcagaacccagugugcuuugaagcaauguugugggacacuaccacaagccccuucuggaaaggaugcagaaaagaccccagcaguuagcauuucuuguuuagaacuuaguaacaaucuagagaagaagcccaggaggacuaaagcugaaaacaucccugcuguugugauagagauuaaaaacaugccaaacaaacaaccugaaucaucuuugugagucuugaaaaagaugugauauuugacuuuugcuuuaaacugcaagaggaaaaagacuccacugaaauucuaaguuugccaaguaguguaauugaaguccuugucuggucacacaguuuaauucuauuuuuguaagaacauaaugggacugcauaacagaguucuauauuacaauuuugugauuauuaguacagaguacagcuaugcugugacuguuuuggaaagccaguuuuaacacuauguuacauuuuuguuuaaaguaaguuaaaccuuauauaacauaaugacauuugauuucuggauuuuucccaugauaaaaauuagggggauaaauaaaauuguuacuggaauuucucugcuuuucuuuucccccaguguuauacuuuauuagaauuauaauugauagaacuuuaaaaucaucaacaguuuguuuccuuugacauuuuaggugauauugcccuuugagaucauuacauagcauaauggcagcauauuuuaagagugacucauggcuauuaguaggaaauaagaucaguuacuauccuguauucuguauugcuggcuauuaaacaguaagauaauuaacaaauugaacuacaguuuacacacaauggggcaaaugggguaguaagagcaaggaagaaaguuuaccaaacuaaauauuuagguuauuguaugauaauauugagacuacauuucuaaauuauuuugagaauuucaacuuuuuauucuaccaaaguuaaucugaaacuuggacauguucaccagcauuacuuucuuugaaagauugguauaaaaacauugagcugcaaguuuauuuacaaaauauauaaguauuuuuaaggauguugacaccuaauaauuacaugcuaaacgcaaacgauuaauguaaucuuuuaaaccgggcguuugaaaaaaaauuuucaaggucauuucaugauaaccaaucaugaauggauuuaaauggagcuuuuugagcacaaccagcaauguuugugcuuucuaagagucacugacuugagaggaaagaaaaccagaagguuaaugcaguuuggauauuaaauucuuagcaaaauuaauaauuaaagcaaaauuaauuaagauuuuguaagucauccugucuucacauacucagaucuuccaauaguggcuuauuuugcaagaugccacaauaucuacacagaaaauuguggcuauuucauuauugcuauagauuucaaauccaacacaaauauuuaaggguguuuaaguuauauuuuucuugauagaggguaugcuuugugacaaaauuagauuuuuguccuugaaaggauuaauauuagcaucaguuauguauagcucuauuuuucuagaaacaagguauucugacuacuuuuauagcugacuacuuuugggauggcuacguuuugggauuuaaaauaguucauuguuuaauggguuguaagaggaaaaaguguuaggauuugacaguuacuuuuuaaagggaugaucuuuugugguguguguuuuuccuaguauaagccuauugcuggcgaugggccuauuuaagaacagcugauuuuuuccagugaaaauaugguaauuuuaggaacacaguuuguaaguucacauuuacuauaaugggccaaaaccauaaccugccaguuugcaauacaucuugaucuuuuaauauucuuaucugauauuguguaauucaauuccuaaacugauaguuaccuugaauuuugcgaaaagguuugggugguuuuuuuuaaacaugaaauugagggaucucaucugggcgaacaagaagagaaagcugugaauuguacuguaucauguacauuccugauuuaauacuuuacagaacauuuuauucagauaucaauuuguuacauaaacauuucagcaaugauacaaagauaacugauaaaauauauuacauucaaugagguuuucuuuacaaaugcucuacuugaggucugugucuuaaagauggcaugacaccuaaguacaagacaucaacugaaugaggauuuuaaaaaaugguauauaagcauaggacaagggcuauguuuguuuguuuuucaaaagugcuuugaagauaacagccuuuagguuugaguuauuucacuuuucauaauuuuuaaguagcuuauauauaauggugguaccauaggauuuucuuuuuucaaaugacugucggcagaaacagugggcacugacucaccuuuugaguuuuagcagagaauuauuuauuucuuuacaaugcacuuucuaacccauuguagcuauauuagcauuaucuuuuaaaaaagacaugcuuuuguauuuaaauauuguaggauuuaagugucuuucucaaaauagcuuauuccuuucugaaagaaaaugagggaaauacucugaauuauuaggagacuuaaacccaauauuuaaauaugcuauuuuauaacacugcaucaguuuuaggaguugcaucucuccugcuggcucuuuuauauuugagcaagaucaguguagaauauguguuuagaaacuugucuguugucucaguuuagugaaaaggaggugcugcaugugccugaauuaaaaccaagaaauuuuuccaagccaaaugcagccuuagugaugagagauuuaauucuccauugucaccuuuuagcuuuuaugauugcuuaguuuuuucugaaggaugucugcauuguaaaacuauggacuaaaaccuaaaaaacagaauccucaaaaacuuugcuguauguguuuuaacauuuuagagaacaguauguugaauaacuaagguauguaacuugaauaggaaaaauguccaucaaaugcaccuuggaaaaucacaguagguagaaggcuguguuaaccguuugugucuuauuaacauccuuaaguuaauuuugaauuuuugacaguuuugagggaaaagaccuauggaaccuaaugugaaguauuucguauguuaacugguguugaguugaagauuuuuacuguguauaagcagauaucauuugaaugauaaaaaugucauuaaccugcugucuuaagauguucacacaaauauggagaguaauucuacaauauaaaaauauuuauuuuaauacugaguuucaguuaagucauaaacaguguuaaaacucuugggaagguguagggguuuuuuguuugucauuuuuaaaauugaaacugugucauacaguguuucacgucucugaaauugggauuauaauagcacuauuuugauguagcucuaccgauacuaugugguaaugcuauuuuguuuuacuaacaagcucuggaauauuuagcagucauuuucacuggcacaagagccuuuuguauguuauucaauuuaaacuuuuaaaccaaaaauuuuaugguccagugucuuuggcaaaaagaugcuggagggaauguaacauacaauuaauaugugguuauauauauauauaaaaagacacaaauugccauguuaugguucugccuugaaacagcacaaugaaguguaucaguauauucugugauuaugaaacuuauauguuguguuguuuugugucuucuguugccuguccuuugggccagaugugggccaguuaaaugcaguuaucaucucauuaaauacagaugcagauaaaauaucuuuagugcugcaacauuuuaccuaacuuuuuguauguuuucaugacuguguguuauuuuccaaagcuguuccuaccucaccaugaggcuuuauggauuguuauguauuauaaauguucuauaugagacagacuacuguguuucuucucauuuauuaaaaguuaaguagaaaaauaaacuaauuuuaauauc

SEQ ID NO: 13025 - RNA, 1667 nt, Homo sapiens
aaacuucaagaaacuuaccaucuuucaagaaauauaaaaauauaaauaauaagagaauauucuaagaguuuuaaguuucaaacugggacagaguaaaauguaaaaagacagcacuucagaaguuuuaaacugacuucaaacguuaaggaaaaaggcaaauacaaaugugcuuugagucuaaauccaggucaauaugauaaucaaaugugcucuccuccacaguucuggccccaagaaguccucuuaucaccccauaacagugacuagagauccuccaggucaguuaaguccacggccacuuucaagaacagagugucaucuuuaauguaggcguucuuggcauucuccaaaacagaaugagccacaaagcggggacagccagaugcaauguucaucuccccaucaggucuuuuaaagcugcugcuauuggggucagguuugaaggucuccauaauguucuuuuugccacucugguccagaagcaucagggucacccucugccugaauggccacugcaacagugagucaaacucuccucgcaugaccacaaaguauagggacaggugugacccccucccugacccauccccauucagguaugcucuagcacagagccgguagccacagcggcugguguagaaggacuggcugaagauggacacugugugcccauccaccgccucucucuucuucaucuuguaaucugucaccuuccaaaugagcuuuccauuauagcaaguacccuccagcaguuuaaaucgcucuucauuuuuacucagcugugcuuuaugaauauuaauguggguaucauguuuguuaguuuccucuucuaaaacggcugcaaauaagaaaaaaaaaaaaaaaagauuccauaggccuaaaaguuaucuuuaaaauuuucccaaaguggaauuuuguuaccugaaagagaaucaacaaaauccugccauccuaaagaugagcugaauucauuuguuguaguaauauuaacucagggaauaucaugucuuggcacagugccuccaaggaaaccuagauguguacucuuaaacucacugaaguguagagaagacacacugagcauucaacuagcgugaaucagcaugcugagccccaaacuuuucuaacuagaaugcuuuuaaauggccaaacccuuuaauauuuuuccauaccuaaaacaaugaucccaucacaucucucccugagucuucucauuauuuuucauucuucuuuaaagucaucaaucccuuucuuggaauuugcuggccuguuuccagucuuggaauuuccuagcccagucccucaaccccccuuguggcccucccucauuuuugccugaguggccagaaucuuaccauucucuuucacaaauagcagauucagccauuguuuauccuggacagaugugacucucuauuuggccagguguuugguuguuucaugaacacaugcagacaaaugagucaccaaaagagaaauaaaauaucagacauaccuaaucuuugaucauuguuuucuagcaggguaauuuucuguuucacuguaucaacugcuuccaucaaaggucucaggucaaauuuauuuuguugcugguuaaccauuuguaauaauugaugcacuugagcuucuagccaagcugacuugucaaugugacuggcaaaaaccuu

SEQ ID NO: 13026 - RNA, 2189 nt, Homo sapiens
aggccgcugcgcggcccugcgcaugcugcuggcagaucagggccagagcuggaaggaggagguggugaccguggagacguggcaggagggcucacucaaagccuccugcguaagugaccaugcccgggcaaggggagggggugcugggccuuagggggcugugacuaggaucgggggacgcccaagcucagugccccucccugagccaugccucccccaacagcuauacgggcagcuccccaaguuccaggacggagaccucacccuguaccaguccaauaccauccugcgucaccugggccgcacccuuggugagucuugaaccuccaaguccagggcaggcaugggcaagccucugcccccggagcccuuuuguuuaaaucagcugccccgcagcccucuggaguggaggaaacugagacccacugagguuacguaguuugcccaaggucaagccugggugccugcaauccuugcccugugccaggcugccucccaggugucaggugagcucugagcaccugcuguguggcagucucucauccuuccacgcacauccucuuccccuccucccaggcuggggcucacagacagcccccugguuggcccauccccagugacuguguguugaucaggcgcccagucacgcggccugcuccccuccacccaaccccagggcucuaugggaaggaccagcaggaggcagcccugguggacauggugaaugacggcguggaggaccuccgcugcaaauacaucucccucaucuacaccaacuaugugagcaucugcaccaggguugggcacugggggcugaacaaagaaaggggcuucuugugcccucaccccccuuaccccucagguggcuugggcugaccccuucuugggucagggugcaggggcugggucagcucugggccaggggcccaggggccugggacaagacacaaccugcacccuuauugccugggacaucaaccagccaaguaacgggucaugggggcgagugcaaggacagagaccuccagcaacuggugguuucugaucuccugggguggcgagggcuuccuggaguagccagagguggaggaggauuugucgccaguuucuggauggaggugcuggcacuuuuagcugaggaaaauaugcagacacagagcacauuuggggaccugggaccaguucagcagaggcagcgugugugcgcgugcgugugcaugugugugcguguguguguguacgcuugcauuugugucggguggguaaggagauagagaugggcgggcaguaggcccaggucccgaaggccuugaacccacugguuuggagucuccuaagggcaaugggggccauugagaagucugaacagggcugugucugaaugugaggucuagaaggauccuccagagaagccagcucuaaagcuuuugcaaucaucuggugagagaacccagcaaggauggacaggcagaauggaauagagaugaguuggcagcugaaguggacaggauuugguacuagccugguuguggggagcaagcagaggagaaucugggacucuggugucuggccuggggcagacgggggugucucaggggcugggagggaugagaguaggaugauacaugguggugucuggcaggaggcgggcaaggaugacuaugugaaggcacugcccgggcaacugaagccuuuugagacccugcugucccagaaccagggaggcaagaccuucauugugggagaccaggugagcaucuggccccaugcuguuccuuccucgccacccucugcuuccagauggacacaggugugagccauuuguuuagcaaagcagagcagaccuaggggaugggcuuaggcccucugcccccaauuccuccagccugcucccgcuggcugagucccuggccccccugcccugcagaucuccuucgcugacuacaaccugcuggacuugcugcugauccaugagguccuagccccuggcugccuggaugcguucccccugcucucagcauauguggggcgccucagugcccggcccaagcucaaggccuuccuggccuccccugaguacgugaaccuccccaucaauggcaacgggaaacagugaggguuggggggacucugagcgggaggcagaguuugccuuccuuucuccaggaccaauaaaauuucuaagagag

SEQ ID NO: 13027 - RNA, 556 nt, Homo sapiens
gauggcggacauucagacugagcgugccuaccaaaagcagccgaccaucuuucaaaacaagaagaggguccugcugggagaaacuggcaaggagaagcuccugcgguacuacaagaacauuggucugggcuucaagacacccaaagaggcuacugagggcaccuacauugacaagaaaugccccuucacuggugaugucuccauucgagggcggauccucucuggcguggugaccaagaugaagacgcagaggaccacugucauccgccgagacuaccugcacuacauccgcaaguacaaccacuucgagaagcaccacaagaacaugucuguacaccuguuccccugcuucagggacguccagaucggugacaucgucacagugggcgagugccggccuugccggccucugagcaagacagugcaccucaacgugcuccaggucaccaaggcugccagcaccaagaagcaguuccagaaguucugaggcuggacaucagcccgcuccccacaaugaaauaaaguuauuuucucauucuccaaaaaaaaaaaaaaa

SEQ ID NO: 13028 - RNA, 2790 nt, Homo sapiens
uaugauaauuuauugguguguuaccaacaaugaaugcuaaagaaguuugaaggaaagaacagguauggaucaggcaacacagcuuagacagauucuuuguggucccacaggacaaaacuagcaguagccagugaaaguuacaggaacacaaauuucagcuaauuacaaugaagaacuuuugaagaauucgcugauuucugcagauguuggaguaaagccuagaucccccaguccuguguugaaugugcgauuguucgagaugacugguuagucuagauuuccuuuucuucuuccucucucucucucuuuucuccggcucccuuucuucauccuucccucccuucguuucuucugccgcuacugcucuaagaauuuggugcaauugcuuuuagguauucgcagugauuuuuguuguuuuuuagauuuauaccacugaggacuguggccacgagagggcaguagaggaagcuuaucagaauacuuggacaggaguaaacucgugugcgcucuaaucgcgagcagggacuacgcagauccugcgaacucgcugggguccagcuugcaggccgcuuccggaaagccgugucuagaggcugcggaguuacugagacuguguggcgaggaaucaguggccuugagggcaccgagacauugucauccagaaucccgaaaccucucaccuuagguuauuaaaauaaguuaucuuauugccaccccucugauuacccugccagaaagauucucugaauuggauauagaaagcucuucucccguccccaaugcccccaugcaagucgggacuuaccagaugcccaggaucccuaucagggcuggaaguuugagauucaauucagagcaagguucaucuucucauugcaauaauaauaauaacaacaacuucaagccuuauuugacagcuuguuggccuuuuucuuuuuuuaauuuacaagaagaggaaauuugcucccacaaauuccaagacucuagucucaacccuaccagacaagccccguuccuccccacucaccccucacucaaauuacagaugaagagggaggugugcaggaugugugcggugacaggugaugcgaaugggggggauucccugucccuacugcccucacccacucuuccuguguucugagcuccccccuaaccccaacgcuagaccuucuauucccccgggggccaagccagcugggcucgcaaggcccgacucgaauucccgggcccuggcagcauuuuccuugcccccuuggcuacuuaagguggccgauggguccgggcugagcugggcgcaggacaggcagccgagcggccuccggaugccaaaccugcuucuccuuuguugacagcuugcggaggaggaaguccgcgcgggcgggggagggggcagggugcuggcgguggcgggcggugccagcagcgggcgcggccccagcccgggcggacgcggccggcggggaggggguuaacgcgcgcggccucuaugauaaugagcugcauggugaaauagggaggccggcgcucagggcuccuccgccgccgccgccgccgccgccgccgccgccaccgcgggagccagagcugccgggaggagcggcauccgcgccagacuggagcgggagggcggcggagggcaguugcugggaauuuuucagccgagagggcgagcgauccggagagagaccccgagagcuugggagcgguagggcgugcgagcgccgcagccagcggagcaaaccucgaaauagaucuggaaagccaggcucccggaggaaaugggacugugaacgaaccggagagcaagaagggaaggaagcgccgggauugcugaugucagaggagcccggaaagucgcgcuggaaaaaucugaagacagccggggcucugcuucuuccucaggagagacaccgccggccgcccccacacgcccccucggcgccuccgggugcccccugagagccggcgacagcgcccagccgggcugcugcggggcgacggaggacugaggggcgcgcggagcggagaccgaggagcgacuucaggaauacagauaagugucugguggcuugacguggauuuuaaugaauuuggacuccauguggauuuggucgucucccugauuccgagcugcgggcagggagaggggccucgcgccgcccucagcagccggcggcggccgagguagaccgagcggggacggaaggacagaccgacgucgccgagcuggguaagcggcggcugggccgggcgcucggagucggcagcgcccuccgcccucuccccacaggcgcgcacacccguggcggcuucucccgcgcccgccucuuuggggucccggccccagaagacccggcuuggccgcggcgggcgaguccccgcgugggcucggccacuuucgcgggcuggagcgcggcgugcgcgcgaucgcaggcucacuggagccgcugccucccgccgagggcuucccggccggcagcccgccggcuucccgaaugcgggcugagggcggcagcagcgcuccgcggcgcgccuccaccgcgcaccugccggcgcucugcggcuuuggggagcucggggcggcaaggcuguccugagagcuggagcccaaagagggccucgguggcaccagcgagacagcccaaagccacacuggccagcgaucgauuugggggcguucacuccagugccggggucccugguggccgccggcucucccuuccgaucggggacuggagaucaggggaaugggaaaacaucauuugcgcggguuccauaaggcucagg

SEQ ID NO: 13029 - RNA, 2790 nt, Homo sapiens
ccugagccuuauggaacccgcgcaaaugauguuuucccauuccccugaucuccaguccccgaucggaagggagagccggcggccaccagggaccccggcacuggagugaacgcccccaaaucgaucgcuggccaguguggcuuugggcugucucgcuggugccaccgaggcccucuuugggcuccagcucucaggacagccuugccgccccgagcuccccaaagccgcagagcgccggcaggugcgcgguggaggcgcgccgcggagcgcugcugccgcccucagcccgcauucgggaagccggcgggcugccggccgggaagcccucggcgggaggcagcggcuccagugagccugcgaucgcgcgcacgccgcgcuccagcccgcgaaaguggccgagcccacgcggggacucgcccgccgcggccaagccgggucuucuggggccgggaccccaaagaggcgggcgcgggagaagccgccacgggugugcgcgccuguggggagagggcggagggcgcugccgacuccgagcgcccggcccagccgccgcuuacccagcucggcgacgucggucuguccuuccguccccgcucggucuaccucggccgccgccggcugcugagggcggcgcgaggccccucucccugcccgcagcucggaaucagggagacgaccaaauccacauggaguccaaauucauuaaaauccacgucaagccaccagacacuuaucuguauuccugaagucgcuccucggucuccgcuccgcgcgccccucaguccuccgucgccccgcagcagcccggcugggcgcugucgccggcucucagggggcacccggaggcgccgagggggcgugugggggcggccggcggugucucuccugaggaagaagcagagccccggcugucuucagauuuuuccagcgcgacuuuccgggcuccucugacaucagcaaucccggcgcuuccuucccuucuugcucuccgguucguucacagucccauuuccuccgggagccuggcuuuccagaucuauuucgagguuugcuccgcuggcugcggcgcucgcacgcccuaccgcucccaagcucucggggucucucuccggaucgcucgcccucucggcugaaaaauucccagcaacugcccuccgccgcccucccgcuccagucuggcgcggaugccgcuccucccggcagcucuggcucccgcgguggcggcggcggcggcggcggcggcggcggcggaggagcccugagcgccggccucccuauuucaccaugcagcucauuaucauagaggccgcgcgcguuaacccccuccccgccggccgcguccgcccgggcuggggccgcgcccgcugcuggcaccgcccgccaccgccagcacccugcccccucccccgcccgcgcggacuuccuccuccgcaagcugucaacaaaggagaagcagguuuggcauccggaggccgcucggcugccuguccugcgcccagcucagcccggacccaucggccaccuuaaguagccaagggggcaaggaaaaugcugccagggcccgggaauucgagucgggccuugcgagcccagcuggcuuggcccccgggggaauagaaggucuagcguugggguuaggggggagcucagaacacaggaagagugggugagggcaguagggacagggaaucccccccauucgcaucaccugucaccgcacacauccugcacaccucccucuucaucuguaauuugagugaggggugaguggggaggaacggggcuugucugguaggguugagacuagagucuuggaauuugugggagcaaauuuccucuucuuguaaauuaaaaaaagaaaaaggccaacaagcugucaaauaaggcuugaaguuguuguuauuauuauuauugcaaugagaagaugaaccuugcucugaauugaaucucaaacuuccagcccugauagggauccugggcaucugguaagucccgacuugcaugggggcauuggggacgggagaagagcuuucuauauccaauucagagaaucuuucuggcaggguaaucagagggguggcaauaagauaacuuauuuuaauaaccuaaggugagagguuucgggauucuggaugacaaugucucggugcccucaaggccacugauuccucgccacacagucucaguaacuccgcagccucuagacacggcuuuccggaagcggccugcaagcuggaccccagcgaguucgcaggaucugcguagucccugcucgcgauuagagcgcacacgaguuuacuccuguccaaguauucugauaagcuuccucuacugcccucucguggccacaguccucagugguauaaaucuaaaaaacaacaaaaaucacugcgaauaccuaaaagcaauugcaccaaauucuuagagcaguagcggcagaagaaacgaagggagggaaggaugaagaaagggagccggagaaaagagagagagagaggaagaagaaaaggaaaucuagacuaaccagucaucucgaacaaucgcacauucaacacaggacugggggaucuaggcuuuacuccaacaucugcagaaaucagcgaauucuucaaaaguucuucauuguaauuagcugaaauuuguguuccuguaacuuucacuggcuacugcuaguuuuguccugugggaccacaaagaaucugucuaagcuguguugccugauccauaccuguucuuuccuucaaacuucuuuagcauucauuguugguaacacaccaauaaauuaucaua

SEQ ID NO: 13030 - RNA, 7347 nt, Homo sapiens
auaauaaaagccccaauuuggcauacaccgucagaggauucacagaucccaaguuauaaaaaccuguuauaggggccaggugcggcggcucacaccuguaaucccagcacuuugggaggccaaaauggguggaucaccugaggucaggaguucaagaccagccuggccaacauggugaaacucugucucuacuaaaaauacaaaauuagcuggaugcgguggcgugugccuguaaucccagcuacucgggaggcugaggcaggagaauugcuuaaacccaggaggcggagguugcagugagcggagauugcaccauugcacucuagccugggcaaaaaagagcgaaacuacaucucaaaaacaaaacaacaacaacaacaacaacaaaaacaaaaaaaauccugcuauaggcuggugagccgucaaaugcucacugcgcucuuaugguggugauaagaugcuuuuucuccuggagucuuugggacuugcccaaaugcacugaguggacauucuggguuuggagggcgcugauaagcagcaagcaugacagugguuccgaggagcuugggaaagcaguggggaaugggagucugcacacugacacaaauggagagauccagcguuugcuccacuuagcaggggacaaaaauaccuguucuauuacuuggaaaaaauaaaaaaaaaauaaccuuuacaacuuacugauucaaaauauugaaugcuuaugcuaaguuuuuuucuguaacaugauuuccaacuuagauacccacccaggccauaaugauggauucagagaggcagcauguuacauuugugggaauggugaguguggaaaggagucauuagaguuuuauauuaccauggcauaggguuuguagaauuccuuagcuguccucauccaucagggagggcugucuggaggaggagguauuucgcaggccucuuggaaaagcaggaagacugggcugagggagguuuaagguuggauuguuuuuuuuuccugacauuaaaaagauucccauaaaauguguaucuguaccaucaguuaaaaaaacaaaaacaggccgggcaugguggcucaugccuguaaucccagcacuuugggaggcugaggcggacggaucacgaagucaagagaucaagaccgucuuggccaacauagugaagccccgucucuacuaaaaaacauaaaaauaaaaaaauuagcagagcgugccuguagucccagcuacuugggaggcugaggcaggagaaucacuugaaccugggaggcggagguugcagugagccaagaucgcgccacugcacuccagccuaggugacagagcgagacuccaucucaaaaaaaaaaaaaaaaaaaaaaaaagaugaaaaacuucccauccuccaggcuuuuguagcacaucugauauauagauaggcuguuuggaggggaaaaaagccaaugugggcagcacagugcuggcauuucugccuuuguguguuauagguaaauuccuuuaguggagggugagguugagggguggugaggcaaugcuugaucccagugaaugauggugacaaucagcccugcacuggcuugugcuuaggugcuaggccaguaccaggaggcaucacugcggguguggggggagcuccugcaccuugagagagguggggcagacuggggcucucugaggcagccacggcuuaugcauauugcagagaaaggacugggcaacugagguuccaauuuucucaccucacucauuggcuuagcaggaauuuucuuuguagggagguuagucugugagggaauuuuaaaaguucuuucaaggagaagagccucuuccauuuccugcagaguaauguucaaacugcagguccagaggccauaaugggugagaucaauuuagcggguugagaccagccuuuaaaauauauauagaauagaaaauauuagauugcguaguacguaguaaagaugaguauuauuucaugaaacuuuguuucaguuauauauauagagagagugauacauauagauaagugcacauauaugccuguguugggcuacugcauaacauugauuuccuacuaugaaucaggguccagaaaauuugagaaacauuguccuggaaggauuucucugcucuuaguguagacaguggguuccagccacuuccccagaggccaucucuauggagacagauguggugagagggcucuuuuuaaagagcagccagagucagcuucugacagcaugauccuaggcuugucugcagcuguucacccaugccugguguuuccugcugcggaggagcuagggagaaagaucaggaaaaccucagccagguuuaggagcaaaggucaccuucccugucuucucaccaggguaugauucccuagaaugcagcagcauauccagccccuucccucuucucuugguuccuggcuuuauuaacugucucuucgcuuuaaaaaaauuuuaucuuuuagcagcaaauuuccuucuuccccacauaccaaagccauagcaggaagaggaaggccaucccgacugugguuuuguccuuauauucucuguuucucagguucguugccuagggaggguggagucccggcgaucugggggcaggguggggguaggauucguggugcaucagaaugaacuuccugucaccucagugauuccacuuagaucugugauucucuggcuccaucuuuccccccgaagaagaagagccuuucuugggucauaguugccucuccuuccaccagcugcacugaccgaccugcagaguguugacccacuugucguaccucaaauagagguuuaaauuaggaccuuuaaucuguaagaggcuuacagcuuguuggguggccagcugcucuggacucccuugugggcagagcuggguuuuuccuggcucuuuugggguuuagggaaucaugggggucaguggcuuucuggcaggagccacaggcucugggacuaggugggugggaucucuuaugauggaguuggguggugguguguccuuguaaugauggaauggggagcugggccagcaacuugggugcugggccugcuucucuuggacacugagccuggauucuugcugaugugcaguuagcuuugcuggcucaacauguguuuucauuucacagauauucauuaauccagaguugugugcccagcauggugcuaggugucauagggaacacacagaagcaugagaaucaggcccuccucccaaguugcuuauuuguagccuccuuuugaggcuacaaggcuaguccauaucaaagcauucauucauccuguagaccgauagguauggaggggaaguauuauuggagagaccucaggguuuucucaccugagaagggagagagcccugggguggucagagcugggcccugaguggugggauuuagaaagaagggaagaggggagggcuuggaagauaggagaaacagcaugaacagcagcagggggaaugggugaguguccuccugaaaggacuguggagauggccguggagccucuucuugcccacuuccugagauggucauggcuuagugcuagagacuuuuauuccuugggcaauguagacccagcucuauggguucccuguuuuuuccuucucuuccuccucauuauaacagauaauaauaaugauuccuagcuuucagggaacacaucuuguauaccauguucugugugcuuuacauggauugucucauuacagcuucacaacaaccuuagagauagauguucuguaucauuaugugcaccuuacaguuggugcagcugaggcguagagagguuaaauaacuugcccuuggugggugacauagcaaggcaguaguugggugaggagucuaccagggcagccugaaaggcggaacucagugacagcagcagggcaugcuguuaacccacugcuucccacucgucugaauauuagaaucaccuuggaaucuuucagaauuuccaaaucccaggucgauuacaucagagucucuuggggugcugggacacaggcaucaguuuuugaggcuucccaggugauuccaaugugcacccagguuuaaggaccacucccuuaaccuucucuguuuuacagccucugaauauuugacugaauacauuuuuuaucuccaagauucuccaaagcacugcagaggggccuuccuccaguccuacccugaggaugucugucuguccacccaccaugccauauaguaucugagggaguaggaccccugccaccccacagcaucugugacccccaaagagugaaaccuaggugguguggggugaucuuccugggaucaguggcccuucucacucugcaugccaccuagagggcagagccugcuucagagcccuggagaccuccaacugguuucucacaucuucugcucccuggggccccugacuucagcggggaagggagagggucacaugagggcagaucucuucuggacaagucccauuccucucugucugucccugacugaaccugaaauggacacgaagagcagagucguuuggguggcugggaacagcacuaaauuuagcaaaacuguagcugguggggggccggcccagagugagccaaacccagcccugaguggacuagauuuacagucaguaacacagucagcaucaucucugcuugggaaagugugugguuacacaggaucuuccguuuuccaaagcccagaagcuugucagccugucccacaggccucccugacucugucccuugaagacuuggcuccacccccaccacugaugcugucccuuggacuuagucuuccauccaucugucugucucucccuugugugucuggaauuuccacuucaguaccuucaccuucuuuuaugccucuuagccaaugcugccaaccuugacucccaaggcccuggagggcaagacccuagcauugguagauuuucuuuagggcaucuggcaccaaggacaccuuucagucaagguggacaaguggaggaaagccaggagcugggaugguuagucgaacaaguguugagggacugagauguacuuucccuccucccagaaacuuagccacguagaugguauuuguauacccaacaacugaagugaauuaugauggggacacaguggcugugagacucuuggacaguugggaguuucucuuugguuggcugagucucugcccuggugucgauguaucuuggaagagguggguuuugugggauuaaagaguggaggucugugggugacaggacaucuuccccugcuggcucccucucccacuccucagaucugaugguggugacuugucuggaggagcuucuguuuucuuaaugcccugggagauaaugaccaggcuaaauuuacucaacucuuuacaaaguggaugauuacacugagaggccaggacugggaucaugccuaugggagugaaggcuucagggcucuggcagccacuggaaauuuaagccuuggauuuugcugauugggaacugugucaucuccuuggucuucuugguuuucacucccuucacccaggacuaggaucaaacaugauuuguuaguguagggcagugggucucaaccaggggcaauucuguacucccuagcucuggcucccaggggacaguuggcaauguccagagacauuuuuugguugucauaacugggcugcaggaaggguguuacuggcaucugguguguagaaaacagguauccugcugaauauuauacaaugcacagaacaacugucccuacaacagaguuguugguccaaaauaucaaucgugcugggguugagaaaccuugguauagggggacaguuuugcagaaauggccaugaaauggccaauguagaaaugaaauggucguuucauccagcucucugcaucuguuggaaauaacuugaaaccaggaacuauugagucauugccuucuucguucguccacugcuccccucucuccucaguauuuauggggaaccuugguagugaaauacuucggcaucuaacaauauugccuucaggaaguuguuuccaagccaucgcuaaagcuccugugguccaguuucccauagaaucccccuguaagcacacacguaucccaggucaugcggguggcuuugugcagcugugucucuggugcaccuaaauaagccuaugauuuagguguugguaccuuuaagaugaacuuuaagggcaaccaggaagccauuccaaggaggcuucaugugggaaugaucagagucuagccuggagcuguuuuccuucucuuucucucuguagcuaaaguuuguucugccuugcagaacugaguucugcuugcuaaaguucucuuaaacucaggaaacacauacucauugccguggagaacaugauguuauuucccaggugaaagacucaaccuguggccagaugccugaacagccuggugcaucucucaucugccagcaccguucuucugcaguuggcagggcugcuuuaaggccagaacagggaaaugagaagucucccaaagugaggaccuuugcuugcucuagauagugaagggagggucacugugugugaauucuagaaugugcugacuuuuaaaaauucacgacaaguuucaagguucucuccaugugaccccacuaccuggacucucuaaucgucaugucagagggugaaggugugagugacacuuuaugauuuggggaaagaagagguggugggaguggugagagaggagauuggcagggagagggauagauauucucauugggugcauuugacauccuugccuccaguuugcgucucaguguuguuccccuggccacaaaacuuauucaaagucccuguuuuugaggaggcaaauacauacauauauauauauauauauauauauuuuuuuuuuuuuuuugauaagcccaaaccagacaguuuaggaaggucauucuacuuaggaggagaguaaauaacauuuuacaaaugacuuuggaguugccuggguuuuuuucuuuuuaaaagucucccuuugcuaguggaagucacuggggaauggaugauauggcaagugcuugcuguucuuggaguucggguucacuacuccccuucucaugcaagggacugagaugguacuggugggcucaggagccagguucuagauuacugcugucuuagcuggcaacuagggcagucgaaaccaaaagccucagaaguccuguucaaugaggguaaauauuugaauggauugaacagaugaguguguguauauuuagaaacucacacccaguagagaaagaaccucuggguaagcccggcuugcucaucccugcugcaggucagagcacacccaa

SEQ ID NO: 13031 - RNA, 824 nt, Homo sapiens
aacauucgggacugcggcaccuuacggcgggaccaagauuugggucugcgcaggcggcgaugggugguccgacgggcuucaggacuugauggcguaacccccuucuucccccacguauguauuugcugggaucaggggcgcugucucuguguaugugggugcucugucuuucucaccuucuuucucgauuuuugcuauuuauuucucugagggaggguuuuuucccacuuuaauuucuuuucccuagugucagcugcucaagccugaccaggguagaggugagaggagugaaccauccccugcuucccaccugaccucccagcuuuuacccuauuuccuucuaguggacagacagacugguucuccaaguuguuugggugucagcguccaucugucuguccgugcaggucuuauguggaagguaagggagugagaagugccgaaaggaagacagagggacaguuuuuucccagggguugccuuauugaaaggucuggcccugggauucugaggcugguggggagccgaguggccaggguggggugugggcugggagaagugggguaaagcugguagguuugucacugcguaguugggaaaaguggggaauggugacgcagucacuguugcaucugguuaggagcucuauggggacagguagugaggcuccuggggucucuguggccagcugagagggguuaaggaugagcuaagaagggaagcuagcauuuagagauuaaaugucauccuuuuggcguuggaaaguuguuuaccuugcgcucucugugucuccauguuggcucccuuccaguucacaugugaug

SEQ ID NO: 13032 - RNA, 6437 nt, Homo sapiens
aagcaugugaaacggguauaaacuucaacucugugcuuaauucagaauuccuguuuguucuccucaaacuuuuaucuuccuaaagcaucuugccagagacuacaaaggaaaggaacauuuacagagcacuauaaacaugucuuuggacaguaaaacaguauuuauucuucuacacucuugauuuuccaaucauaucuuccucaaggcaauguuucuuuggcccaauuugugcaacuaaacauaaaauuucaaaacacaacuuuuaacagugugauaugaaaugcaguggcagucccugcuuuucgccugcuggcuucuuugaaagaaacugcuuggcuaagggacucaguagagggcugagaucugccugaguauaaagugcuaccugagcuauauuuacuucuuccaucccuugguacaaucaacagcaaauagacaaaaugaaguuaccuuccugagauacauggcuuacuuuguacucugccuuuuaggagaugagguaagacauauacauagauggcuuuuacuagccaaggcaauguaaauggacuaagauucucaugugacuugagguuaucugaugaauuuauucucuucaaaaccaccuacuuuuagagggcauguuuaaccccucucuuuauuuaaggagggagagaaaaacacauguaaccagaauucagaguggguuacucaaccuaagagaacauacggaguucucuuugggaaaacaacaagacuacaguguucacuucgcaccaugaaguggcacuccuguuauggcugucagaguccucucacuucuuaugaaaggaugcaucugauucugaaauuacugauauauucgaucaguuagggauguuuuaaaaagugaaaacaaaugccacacauacacuuucuagcuuucugaaaucaccgaacacauuacaaaaaauagagaauuuacccuauuaacuuuuagagaauuuuccaauaauauucuugguuaaagaagccaaguuugugcauauucccaauuuucaguguucuuguuuuuaugcacaagagccaaaguaguauacacauauuuuuaagggcuuuuuacaaugaacgauauauaaaauacauucuauaguuggugaaagaauaaucuuaagaguuggcauuaaucuuugaacaaaaaagauuucaagccacuuucuuuacaaagaaaauauaauuucauugugaacuauauuucucuaauuuugccaauuuuauaaaauacagcauaucccugcuuuaauacaaccaggcaugcugugcugacugguccaauaaaucuaaguguuauuuaagggaaagcaggcaaucuguucauacccaaauucauacaaguuucaaagaagcaucaaaggaugcuaccuacauucaagccacauugcaauauuagcuaagccacaguugcacucaugagagugaaacuacagaauaacaacuauugaagauuuuaauagagucaaaagaugaacuggcaaaccagguuguggaaucuauucagccucucugcucugcuggagugguugauuuagucugguaaguggcauauucagcuccaccaucugcuuuccugcaaaccaagguauaaagaucaugucaaagauaaauauaauuaaguacagaaauuaaauuccagaagccuauucagaaaaugaacaauuaaaaaaauauaguaaugagccaccaaccugggaaauaaauuauucuuuuaaaauaauuucaaauguucaacuggucucacuguaaaaaaaaccuuccuuuaucccugucuuauauuuuugauccccuccaaaacaagaaauagagcaguagcacacaaaguacuuaguaacuauguccucauuuugauguagggccaaugggaaagacuggagacaaacgcaugcuuuccugaucccuccauuuuaaagcuguagcucuggcacagaaccuuuaaaaagauagugguucuaacuguucaaguaugugaugccucaucuaccccucacugucaagaaaaucauguauuccacuaagagucuccuaaauaacuaaaguuuacgucacacuuuuaguauaacaauagacaucuuuauaaaaccuauuauucuagucuagugcuggccaaagacagaugaugccagucauacauguaauuuaaaauuuuccagaagccacuuuuaaaaacauaaaaaggcaaaaauaauuuuauuuucuuuaaccgaguauaaccaaaauauugagauguauuuuacauuuuuuuggcuuagucuuugaaauccaguguguguuugacacuugcagcauaccugacauuggacuagccacuuuggaaguccuuagcagucacgcauggcuauugaacuggacagcacagcucugggcccucccugccuuaguaaauugacuuuaauagacaaacgaaaaccaaauucggaccagucauuauuuacuaguaugugugccacagcaaacacauugccuuuccaaugucacagcuaagcauguuaauucuggauacuuuaauaacccauuuaugccuaguguuccauuacuggaacgcuaagcauguggaauuuaucuccuacugcucaaggucaucgccagggucugacugcaaaaauucaaaaaauugcaaccucaggcguaaacggguugguucuucuuugccggggaggccaucauuaugguucucuacugcgucauuacuauacuuauaauauugcaguucccuaaggacuguugugaugacagacuuaaugguuuggccugucacugaauucuccaagaccacuauauuuuucuuuucuuuucuuuauuuuuuuuccuuugagacagagucuugcucugucacccaggcuggagugcaguguggugugaucuuggcucacuugcaaccuccuccucccagguucaagcaauucuugugccucagccuccugaguagcuaggauuacaggugugcaccaccaugcccagcuaauguuuguauuuuuaguagaaacaggguuucaccauuuuggccaaccuggucucaaaccuuaagugauccgcccgccucggccucccaaagugcugggauuauaggugugagccaccaggacuggccaccacuauauuuuucuaaguaaauauuuuuuucccauaguaguagaaucucuuucuuuaaauaaaguuuuaaauaaaaauccaaucuaugccaaagauaaaaggcauuaacauaaauuuaaagaaacauuuauuggauauaacaaugaagcuauuuugaagauggcaaaauauuaacuacagcauucauuaaauuaucuucaaauguuuacagauacccugaagcucagagagagucuaaaaacuauuuuccuaguuggcuuuagucucaaaaguguccuaagagacuaagaagauauaguaggcuucccuuauccacgguuucacuuugcacgguuucaguuacccauagucaaauacggucaaaaauauuaaauggaaaauuacagaacuacguuuuagauugugugccauucugaguaucaugaugaaaucucacacugucccacuccaucccucccgggauauaaaucaucccuucguccagcauacccaugcuguggacacuaugugccuguuacucaauagcugucuugguuaucagauugacugucacgguaucacaguaccugugguuagguaacccuuauuuuacuuaguggccucagagcacaagaguagugaugcuggcauauuuuuauaauugauauuauuaguuauuaguuauugcuguuaaucuccuacugugccuaauuuauaaauugaaugaucauagguauacaugcuuaagagaaaacaguauauauaagguuuaguacucucccagguuucaggcaaccacuagagguuuuggaauguaucccccguggauaagaaggaacuacuguauauaggacuggguaggcccagaccgccaauucugguugguauguuuugucuuucccuuuccuccuguaaccaaagacaucacuuugcuuuuacuaagaaauuguccuuccagcuggccuuuguagauccugcucccaaacuuuuaauuauaaccuagguuagggccucacauuauaagaggugggauauguaucuccaucucuucccagcucugcggacacacauucuagcacaaacagaggaauaauuccaguucaguucaaagacagaagguggacaggguccaaggguuuaaggcaaugcaauccauuacuuuucaaaaucugaggacuuuuuuguuuuccuuugauaugcuaaaaauaucccagcccagggaaacugauaaaaugucuuuacagaguuauuuauacguuggaauugaauaaauuuacaaaacuaaguaaaauauauuuugguuucuauaaaagggcauuuuuccuccuugcacuuaaaaugaguugauucugugguuauuucccaguuggcucacaaauucuuacuuuuggauucacagcuguuuuacaagguagaagugagaucgucugauaaaaggacuaggggaacauaacucuauuuaaagccuacgucaaagccugucaguacacauuauguuuucaaagggaaugguauaagaacacaucaauaauuuagcaaagggaacaggaauguaaauuuccucuuugauauuuacugccaauaucucuuugcucagguuauugauaucuauauauccacugaauauuuuucaaaagaaaggacaucugaaaauaaacaacagaaaacagauaccuuuuaaugauaaaagcaaaccuuucucucaucucuccuucucagagagaaguaaauuuuacuucucugugggucucaucaguuagguaugugcugaacagaggaagagaaaacggcugaauaaaauagugacuucaaaccaaaaagaaacgaguagcauaacaagugggauaaaauccaguguaagagaguagcaggaaagcugagaauuagguucauaacuuaagacuuucucauucucacugaaggacuggaaacaugaauuuugugcuagaagcuacuugaacuuugaagucauauagaucauccagcagauaaacagacuggaaauuccuguuuaauauguuuaucuuugaagccauuuugcaugaagugauucaugucaaaauguuuucaaggaauaacagauuguuggggagaaaugguaccggucucuagcacucuugauuuuuuuuuuuuuuuuuuuuuuuuuuuucaagacacagcaucucacuauguugcccaggcugaucucaaacuccugagcucaagccaucggccugccucggccucacaaaguugcugggauuacaggcgugagccaccaaacccggccuaacacccucaauuuugagggaauacauugaguauguaucaaauccauguaauauuaucuagaaaucaacuuuaugacaucauguauuuucagaugucucuggacuuuuacauuaagaagugucuuccuguggcacaucuguuuucaaccugaggagacaucguugcaaaacuuuguauuacauggcgucucauauuucugagauggaucuaauuuuguaaggaugcuuucuaaacuaauuacaaaacauuuuuguaguugcucaaaaauuuuugaaggguuaaaugcucaagaauuuaagggccaacuagaaaaacauuuaaguuaauuugauccuuuuuuugccccaugucacuauaugccccaauuaccugaacugaccacuauuuuuaauaaaguaauugggucagucaauauuaauguaacauuaaaagucaguuuagguuauacaaaauaauaaauaccauuaauggaaaaaaggaaaaacuauuugucacagguaauaaauauauaaauuauguaaauaacuuucacuaacuuagccaaacugucacuuauccagggaugcuuaacuagaguuaaaaaauaaucaugcauuuaaaaaaaaccauuacuuaaauauuuauguaaacaaaaggcaucuguuguucagaagcacagucaugccaugcaauacaggacugaagcaguagcaaagacagggcuguggcuuccaagacuaaaaaguaugguagaagaauuaguaaagaaaggaaaugggaagggaaaaggagggagcauguggaugggaccuguuucggacccacugguauccuauacuguucucagcugagagcuaugaaacagaaaaguggcagaauacuuuaaccuuuugcccacuuuuuaucaaguaauguaaaugauguuggaugaucuuaaaaugacuccuuacacuauuuuuguauuuugagaugaaggcugcagaagaguaauuacguucccaaaucaccauaaauaccaguuuacaagaaauacauuuugugccaggcuuuaacaacaauuugagauuauuugugccugcuagccugcuuccaguuacccccgg

SEQ ID NO: 13033 - RNA, 33532 nt, Homo sapiens
aaaaaacuuccuuauauuucccaguaauaagagguuacuguacgucaaaaacaaaggguugcaacacuuacugauauauuguaguuuaauaaaacauaguuuauacaguucauugaaaaaguauuuuaauacaaacaccacuuauacacaaaaccaaauguugauauucuuguuuuuaaaaauucuugauuucucuaaaacacuaagaugcuaucucaauagagauugcuucacauuuuccaguuucuugaucugugcaugucacauguaaagauccaucccuaaacagacaaaaaaauaaagaacauugcacaagcucauuuuauaaaaacauaaagucuguaacaaguuacuugagggcuuucaguaaacaaggguuaauuuuaauuuucaaaagaaggguauuaauguaaagaauaaacacaaucucagugucucuaaauuuaguaagugucauauguuauauuuagcuaguuguuauuaggaacuuccuuccagaccacuaagaucaugguuguauuucuugaaaacccaugaugacaaacaucuuagguuuaagacuuuauauaagcuccagaugcaccaugcuauuuucaagccuaggccaaggcaaacucacccugaugaauucuauauucuugcuaaguaucguuuauggaguaaguugucuuuuaaguuucauuuggaaaggauuuacuuguaauacauagugauauggauagcuugugguuaggaaaauggcaauagcugaauuuaauuaguacauuuuuuucuuacagauuuucugcagcaauaaagaaacuuacccuuucauagggcaaacaguaacaguuacauaaaccuuagaaaauuauacuagaaauugauaaauuacaucucaaaugagcacagaucaguuucuuagguugaugauagccaaaauaaagaguuccuaaaauauucaagaugcaaaugacuugagauauacuuuucuuuguaaaauauaguaauucugggggcaaaaaauguaauucacugauaaaaaccucuguagguuuuuaauguuucuucuagaaugacaauaaauaaaaaaaucaauaaacucaaaaaauggucaaguaucaaauugaauuuucuuaacaacagaaguuuaauuuuuuaccuuuucauaguaagaacagcuaauauaucacguaauccauuuucuuuuuuaucuaaauccuggaguacaaccuguuuauacaagaacaauaugaagagaauucagcaucuuuacauaaaugaacugauguaucaauuauugcaaaggaccaaagcuuauuuaucacugaaacaaaccuuuuuaaaauagggcaguuuucaauucuccuaccacugaaucagaauucagagaauaggagugaagcuuuguuaacuugaaauguuuccuccagaaggagggcauauaagauaacuaaugcauuugucccuucuaaaugucauguccuagauuaaaaucauuguuucuaagauguacuauuaaucuuggaaaauaaaggcuacuuuucuuuuuugguaaguaagccauucccaguaacacgcaaauuauaauuuggcuagcuuucuauauauacuuaaaaaaaaaaaaucaagcauuuuaaauacauuuggaaaaucaccuacuuaaaaacauggcaaacucuuuuguacaacuaagauuauauuuguaaguaagagaugguaaugaauuuacuauaaaauuccucaguuuccuaaagaaugguauaucaagaaaccagauuuggaguucugcagugacuuuaggcuuugccaaacucuaguuuaauaacuuagguaaguuacuaaguaccuuguuuuacucauuuguaaaauaagguuagaacagaugggaacucugaaagauucucuuccaaauucaguauuacguggcuaacgcuccuccuggcaucuuuaaguuaggauauaguggcagcagcuauggagucucagagaggaugugaagaaaaagguaacagaacugugagagaagagcuaaggaaauacuaggacugccaucugaguucaaaaaccuggugcaugggaagguucuuagacacacacaaaccaauucauguggaagcgcuuuuaaaacuuuaccaauagauuccaaguugguaagucugaggugcagcccaggcauguuaugcauguguguguuuucauuacucuuuuguuggaauuagaaaauaaauauguggccaggcgugguggcucaugccuguaaucccagcaguuugggaggcugaggcaggcagaucaccugaggucaggaguuugagaccagccuggucaacacagugaaacugucucuacuaaaaauacaaauauuagccaggugugguggugcaugccuguagucccagcuacuccggaggcugaggcaggagaaucaguugaacccgggagguggagguugcagugagcugaaaucaugccacugcacucuggccuaggugacagagcaagaugccgucuuaaaaaaaaaaaauuaaaauaaauaugugagcuaaagauauguaucucuuuacacacacacacacacacacacacacacacacguacacguacacacacaauaucucaucacuaauaaacacccugucuucucaaaaaagcuaggcauuuuuagucugcuucuggacuucucugaaugugcauauauuuuuuaaaaaacaauacugcuuugggaggccaaggcaggcggaucaugaggucaugacaucgagaccauccuggcuaacacggugaaacccugucucuacuaaaaauacaaaaaauuagacgaacgugguggugggcgccuguagucccagcuacucaggaggcugaggcaggaaaauggcaugaaccugggaggcggagcuugcagugagccgagaucgugccacugcacucuggccugggcaagagagcgagacuccgucucaaaaaaagaaaaaacaaaaaaaacaguacauuauuuuuuguuaccgauauuuaauuuuuacuauaaaaguaauucaugcucauguccugugcuguuuguaaaaaauucaguauaaggugucaaaagucaaaaaaccccucuugguaccuucaaacuuauuuaccuacugugaaguuucuggaauaugguuuaaguaccuauagauauuuucuguauaaaugccuggauaucugaaaaugcaccccuacucaaauacuaccuccucacacacacucaugcucccagacuuuuuauuuagauacaaauggcauuguaauacaaauacuguucugcaguccgugugugugugugugugugugugugaaugcaacugcauuucucagacauguuucuaaguaaauaacguggcucuacuucacucucuguaaagcauacagagggucacauaguauaagauaugcacgcgguauuuuaaaaaagcaaaccuaucuugucucagaggcagcauggcacaaugggaagagcaugucaugggcucagaaaugaaaccaacgugaggagaaacccuagcuugaccaagaaaauaaaggguauuugcuaucacaggccaacuucuuaaucaucuguaaaacguacacaauaaugugcauuuagcaugaaccaaaaaauauaauucucccauuccacuuaccuaacuaccaagguaggccaagagcacaacagagaagcagucuaaauacccagaacucuuucaaauuagaacugccuauuuuuucccucuuucaaaaaugaguacacagguguucauuuucagaaaugagccuucauaaaauccuucauaaaaauguauuagguguccuuuauauauauacacauuuuguauuaagauauuaaacugaaucuaauccagaaagcaaaguugaacaguuuaaugugucuaacuuuauguauucaccugugcaaacuugguuuccucuuuggcagaguucuucccaucagacucauagaguucaaggcacacugaagauaugcuuccaggggcuugcaauguguguugucuucgagcuggcaaaggagucccugauggaaacagcacugugaaucuacuggcuccugauucguccacacccuaguuagcaggaaacaaggugcauacucuuugguauuuaucuuuacaauugaaaaaaacuucccauuauaaaugagauauauauuccuuauugauaaacaggacacuaggcaaagagaagaaaauagaaauaauccuuaauccuacuucacuuuaaaaauauauugaaacauaccucucucuauauuagcuuaugauuaauauuauaccuaacuuuuauuuuucuaaaaaacuaagagguuagagaaauauuaacuaaaagaauauaagacauaccuuaaaaguaggauuauaaaucuaaauuuaagaccugucaguauacaagguuuuauuguaacaucaugguauguauaaaaacuuauggcaauuaauuuacuauuuuuauguaaaguauagaaaagcuaaacauaccuuaacuaguauacaaaagcuaaacauaccuuaacuaaaauaucucuggcugaacacucuaucauaagagagucuuccaccaacagguuuucuuucccaauaagaauuccugcuucuauagcugcaccaauagggaucacuucaucaggagggauagaauugagaagcucaacagcugggaaaagaucuuuaaucaguugcuguagcuuugggauucgagaagacccuccacaaaggacaaccuagagaauaaaaauaauuuucaguuguuuacuuuuagaagaaugcugugucucaaaauuaaguguaauagacugagucaucuucaucguauguaaagauaaaauacaaaaaaagcccuauauauuaacauguuauguuauacuuaaccuauaaauacacaaacauauauuuaaacauauuauagauauuuaacauauucuuuauucacaacaaaauuuaaaaugaggaaaucucaccauuuauuacaaaauacaguagagcuacauacuugguucaucauacugugcagaagaggcuuaaccacaaauagucacuugaauagaaaauauaucaauauuuuguacuguccaaguuuuuuuuuuaaaaguuugaaucuuaaagcauuuuugugacaaauauugcuauucucucuuagugaaaacuaugccauaaacuuauuugccuuuaccauggaagaauauuaaguuucuugaggaaaaagagcugauuuauaaaacugcauuuuaagcggcugguaccaucugauuaaaucuuucugaagaauuucauauaaaauugcucccuuaaacuguaaaucccuuaaguugcucauugauucauucauugaacacuuaugauuccaugggcauucagaauauugaauuaauauauaaccuaagaagggaaaucaauagccacuuccuauuucacagucuuuacggaugaucucaccgcucacugaggcagaggaccaccugaugaaagcuaggccucuuucacguucaguaugaaguaaugagggacacccuauuaaucuccagguacgagcaugaggaacaucagcuguaggauauuuuguuuaaaaacuagguuuuccuuggcaaagaucuucaaaagaucuguuuggagguaaguaaaaagagcaaucuucucuaaaauuuuaugaucccagguaaauaccaggagaacaaaaaugcagaauaugccuuuucaaauuucucauauucaacaucaaaaaagcuuuauuaauaaguagcaagugguauaccuaggaauccaacuuacaagggaugugaaggaccucuucaaggagggcuacaaaccacugcucaacaaaauaaaagaggauagaaacaaauggaagaacauucuaugcucauggauaggaagaaucaauaucaugaaaauggccauacugcccaggguaauuuauagauucaaugccauccccaucaagcuaccaaugacuuucuucacagaauuggaaaaaacuacuguaaaguucauauggaaccaaaaaagagcccacguugccaagucaauccuaagccaaacgaacaaagcuggaguaccugacuucaaacuauacuauaacgcuacaguaaccaaaacagcaugguacugguaccaaaacagauauacagaccaauggaacagaacagagcccucagaaauaauaccacacaucuacaacuaucugaucuuugacaaaccugacaaaaacaagaaauggggaaaggauucccuauuuaacaaauggugcugggaaaacuuggcuagccauagguagaaagcugaaacuggaucucuuccuuacaccuuauacaaaaauuaauucaagauggauuaaagacuuaaauguuagaccuaaaaccauaaaaacccuagaagaaaaccuaggcaauaccauucaggacauaggcaugggcaaggacuucaugucuaaaacaccaaaagcaauggcaacaaaagccaaaauugacaaaugggaucuaauuaaacuaaagagcuucugcacagcaaaagaaacuaccaucagagugaacaggcaaccuacagaaugggagaaaauuuuugcaaucuacucaucugacaaagggcuaauauccacaaucuacaaagaacucaaacaaauuuacaagaaaaaaacaaacagccccaucaacaagugggcgaaggauaugaacagacacuucucaaaagaagacauuuaugcagccaaaagacacaugaaaaaaugcucaucaucacuggccaucagagaaaugcaaaucaaaaccacaaggagauaccaucucacaccaguuagaauggcgaucauuaaaaagucaggaaacaacaggugcuagagaggauguggagaaauaggaacacuuacacuguuggugggacuguaaacuaguucaaccauuguggaagacaguguggcgauuccucagggaucuaaacuagaaauaccauuugacccagccaucccauuacuggguauauacccaaaggauuauaagucaugcugccauaaagacacaugcacacauauguucauugcgguacuauucacaacagcaaagacuuggaaccaccccaaaugucugauaaggauagacuggauuaagaaaauguggcacauauacaccauggaauacuaugcagccauaaaaaaugacgaguucauguccuuuguaggacgaagcuggaaaccaucauucucagcaaacuaucgcaaggacaaaaaaccaaacaccgcauguucucacucauaggugggaacugaacaaugagaacacuuggacacaggaaggggaacaucacacaccggggccuguugugggguggggguaggggggagggauagcauuaggagauaugccuaauguaaaugaugaguuaauggguggagcacaccaacauggcacauguguacauauguaaccaaccugcacauugugcacauguacccuagaacuuaaaguauaauaaaaauauauauaaaaauaaaaaaaaaaguaaguggugcuaugcaaaaaaacaaagaaaaccaaaaaaaaaaaaccaaccuuggaaaauauugacuuuuuuuuuuuuuuuuuccggagacagagucuugcccugucacccgggcuggaguugcagugguacagucauagcucacugcagccucaaauuccugggcuccagcgaugcuccagugauccuccugcuucagucucccgaguagcugggacuacaggggugugucaccauacccagccaacuuuguuuugggaaauccaagauuaaggugccagcaacacaggccauucugaggucucuuuucguggcuuguagguggccaccaucucacuguguccuuacacaaccucuuuuuugguacauuuuggugggagggggagggagggugguuaagagccagcuuucuucucaugacaacaauaauucuaucagaucagggcccaccccuguaacuccaauuaaccuuaauuacuuccugagaugucucaucucuaaggccuucuaagugaguucaagcaccugagucaaaauggauuaaacucccuauuucuuugagugcaucucaggaguuguuaaagaggguaagagugagagaggcagagaaggcaaaaaagaagaggaggguggggagaagcagcagacacagcugccucugcuuauaaugucacaaccuuagaagagguuauuaagagcaagucaugcucuguggacacaagaagaagggagguggggagaggaaacauuagaaaaggacuaagccuggguuaggggacaggacuguuacacucaguuuaugauagacaccuuguucagaugaugccugauaaucauaugccucugauuccccauagagacgacuugggaccuacugauaaucagugguccugaagaggccacugacagcuccucauccagagaugagaggaugaguuggagccaaguagcuaaggcacuccuuuaagaccaaugccagcaaaaacuaggacugcuccccuuuucaguguuuauguuaaaaggggucaguuuguucagacgauauaggucagguagagaagucugaaaugguccaucuaaucuuucaugcucaguuagcauaaauaauauaaaaauuauaaauuauugcagaaaaaaagaauaccuccucauaaccaaguaaguuauaucccagguauacaaugauaguuccauauuaggaaauuauuaauucauuauauagcuuuaagauacauaaaaacaacgucauaagaucaucucacugguguccaaaaauacauauguaaaaauacaacacccacuucauauuaaaacgccuuuaaaaauagaaaaggccaagcgcaguggcucacaccuguaaucccagcacuuugggaggcugaggugggcggaucucuugagccuaggaguucaagacuagccugggcgacauggugaaacuccaucuucacaaaaaauacaaaaauuauccaggugggugugguggcaugugccuguggucccagcuacuugggaggcugagguaggaggaucaccugagccugggaguucgaggcugcagugagccaugauugugccacuacacuccagccuggaugacagaugacagagugagaaccugucaaaaaagaaaagaaagaaggccaggcacaguggcucaugccugcaaucccaauacuuugggaggccgaggugggcggauuacaaggucaggagauugagaccauccuggauaacacagugaaacccugucucuacuaaaaauacaaaaaaauuagccaggcgugguggcgggcgccugucgucccagcuacucgggaggcugaggcaggagaauagcgugaaccugggaggcggagcuugcagugagcugagaucgugucacugcacuccagccugggcgacagaacgacacuccgucucaaaaaaaaaaaaaaaagaaaagaaaagaaagagcuuucucaauaugauaaaaucuauuuucuuggggcugggugcuguggcucacgccugucaucccagcacuuugggaggccgaggcaggcggaucacgaggucaggagauugagaccaugcuggcuaacacggugaaaccccaucucuacuaaaaauacaaaaaaauuagccgggugugguggcaggcgccuguuagucccagcuacuggggaggcugaggcaggagaauggcgugaacacggcaggcagagcuuacagugagccgagaucgugccacugcacuccaaccugggugacacagcuagacugucucaaaaaaaaaaaaaaaaucuauuucuuuuuuuuuuuugagacagagucucacucuguugccaggcuggagugcaauggcgugaucucggcucacugcaaccuccaccucccggguucaagcgguucuccugccucagccucccaaguagcugggacuacaggcgcgcaccaucacgcccagcuaauuuguguaguuuuaguagagacgguguuucaccauguuggccaugauggucuagaucucuugaccuugugaucugcccaccuuggccucccaaugugcugggguuacaggugugagcuaccgagccuggcugauaaaaucuauuucaaaccaauuaccaguaaccaauguuuguugguaaaagucucacaguauuccccuaauaaaaggaacaaaagaaggaauccagcauucacaaaaauauuuaaguucuggccaggcacaguggcucaugccuguaauccuagcacuuugggaggcugagauggguggacugcuugagcccaggaguuugagaccagccuagacaacauacagagaccccaucucuacaaaaaauacaaaaaggcacacaccuguagucccagcuacucaggaggcugaggcgggagggucgcuugagccugggagacagggguugcagugauguaacauugagccacagcauuccagccugggcuucuguuuguuuuauauuugauugcuaugaucagaacuuacauuuguuuuuggacagagucucaaacaaaagggacacaucuuagagaaaugucuccccacuuacagauacaucuucucccagcacccucaaccaccccauuuuccuauugcccuuguaacacaacuugagaguugucuauacuugucuccaacaccucaccaucaauucaauauuaaaccugcuccaguaaggcauuuaucuccacagcuccccuacaauugcucugacaagccauuccacauugccaaguccaagggucaauccucaaggagguuaagccucacccuacuauaccucuggcaucacagggcagcugcucucucccuuccuuaaggauauguuuuugccugccuuccugguucucuuccuucucacuggcugguccggugccagaugcccuucuagcuugcaaaugucccaagaucccauccugggaucucuucuguauuguggcucugcuucccccauggguacaccuguccaguuucauggcuuuaaagaguacauguguggacaaacaugucuccagcccagaccccucuccccaaauccagaccccuacaucgaucuacagcgaacucuucacacugaggccugagcacuccuucuggggaucugggcccuaguuuccuugccaagcucaccucuguccaccgucucccuggcucacucaguucggccccuguuacccucccugcugcuccucaggcaccacucacacucuuaccugcuguuccucugccugggacacugguagauauucacauggcuuguucuaucacuucacuucauucaggacucugaucaaaagccacuuccucagaggggacucugaccugaaaaaucacccucugucacuagcuaggcccuuauccugcuuaauuuucuucauaagauuuaucacaauugggcauuauuuuaucuguuucauauuaccuguauauccucacuauauuguucguucuaugaaggcaaagacuuugccauagcuacuacuguaucccaggugucuagaaucugccuagcguagaauaggugugcucaauaauuauuuguggguuaaucaguaaauaaguuugaauguaugccuaggaaauucagaagacuccauuaaaaaucaguaauccaaagaguuuacaaagugacaaaauguaagauaaauaagcaaaaucaccagguaucucauuuaucagcaaaaacaaauaagaaaacuaaaguauuaucucauucacaagagcaauaaucccauagcacucagcaauaauuuaacaguaaauauuaagaaaacaaggaaguauuaaagaagauuugaacagauaccaacuuugugauuaggaaacuaaauacuauaaguuauuacaucaucccaaguuauuuauagacaaugcaacugugucaaaaaaugagacuuuauguaaguugaaaaaaauaauucuaaagcucucugaaaaaagaacuguaaacaaagagaacuuuaaaauugcaauguuaacaauuaagguuuacaucuacucagaaaguaaguugcuuuuuggugagcaauuugauaacaaauacuaaaagucuuaaaaucuaggauuuacuccugaauuuuauccuaaggaaauugaggacauccaccaaguuacaaagacuguuguauaacauacacauccaauauacagaagggguguuaugaaggacgguacaucaaugcaaugaaauacuauggagcuauuaaaauugcagcuacagaacccaggaacuuggcuaaaacacagggauuaaccauauucauuuaucuaagcucccuuucacaaaagcccacuaagcugacaacaaagggauuucagaagguaaagauagaaaggcaaaauaaauggaagagaaaucuugaguuugagaugucaacaaauuuuggaagcuggaaagagguaaaucagaugaaguuugagauagccgaaaagaggcaggguggucugaugcauaggauuccagguaccaaacaccacagaaagcgagggugaagcacagaagugaaaacacaagggcuggaaagcacacguguggaguggcugcaccugcccccacccccagcuucucccucaccuaaacagguggccaccugcaccuucucccacaucagggagggaggucgucaacacauagugauagaacuuugauacaaagauacagcacgaaccaggguggggcauggugcugaaaacaagggggaagaagggaaaagucugcacauucaagaguaggaacccugaagcucucugcucucaggccagaaaccugucccccucaagcaagagaugagagaauuucuuccaaaaaaagccaaacucuccucauacuagaaccccagguacuaaaaugagaaggcaacggucacaagcaugaagagcacaggugauggagacaggcagccugaguucugguccuugccucaucauguaagugccagccucaugacugcaggacaaauuacuucaccucucuggaaaccucuuaguuuccucaucugaaaaugaagauagaagcgccuacuuccuggagcuugugugaggauuaaauguuuuaauacauguaaaucccuaucauucacuccccguuccccguaagaggauuacccaucccacucacucccacaacuugguaggugggguauaucucucugccccucugucauacccacugugacacugaaugugaaugcacugacaugcaccuaucuaaucgaaggcccaggcagcugcuccuguggccuggguccuagaacaggaaguggaaaagagccccagcaguggaccugcagccaccugcagcugcccaccuguaaccuaaguguugcagaaaaccgcugaagaguugaggguauuuucuuacuguaccaaggucaacacacuaagaagacaauuucuuauuauuaaguucucaaaagccugugucuuagaaacaucugaagagggaaucucuaacaaaaauuucaaaccuaaaacuauuccgccucaacucaagcaacugagaauuggacugugagagauaaugaaaugagggggcuucaugaccgguugguuaagaaagggaacugaugcuuauuugucacgauaugcaacaggcugugccacagacauuucauuuaacccuuguagcaacccuauagaguaacuuauacuuacaauacuuacuuguaagguaaguauuaucacuuucauaacaagagaaagugucaggaaaugaagcauuuugcccagucuagaacuauuagaaccaugaggcuucauguuuaggugggucugucuccaagcccaugcaccuuccaccacuguuuuacuaccaucauacaacaugccucauccuucacaauccgccucccagccuucaaacaccuagcaaaaugccugccacacuguaaguguuaaaaaaaaaaacaaaauauauacuuauugaacuaaacugcaaaaaaaauuugucacaacauagcagacaucaaaaaaacuaaaaacauaaaacugucaaaguauagacaaguuaaaagaaaaguauauuucauauuugccauacauccaagcaaagcagcuggaggaaacagagucaaagaucaagaguaagucaaacacccuccucccuagcaggaccaaaaccaaauagugaaguaaaugccucaaaggaagacugcugugcaugauagcuaauauuccgauuauguaaaauauuugcacaaguuuaaaaaaaagauuuaaaugauuaaaugggcaaauaauaugagauaaaaauuuacacacaaggagaaacaaaauuaaauaaacauuuaaaaaaauccucuaguaaccaaugaaauauaaagugaaaagaucuuuuuucaacagucaauuggaaauuuaucuuuaaaugcuauaacucagugucgacaaggcuauaguaaaauguauacuuuuauauauugcugaugggaauauuaguuaauucaauucuuuuggaaaguaacuugagguaaaaauagucuuaagcuauuuuuauucuugaccuaguauuuuacuuuggcaaucuacucuaaggaauaauccuaaauaugauaaacgucucuguauaaagacaggcaucauucucuuacaggggaggaaaaaacccaaccuaugugucuacaacaggaccacagugaaaaacugacagugcguuuccuuuuuaggacauuagcaaucuauuucaaauuauguuuaaaaagacuauaguaauauggggggaaauugguuauauuauauaaauuaggcaaaauucaaaacuguacauacagaauuagaacuguuauuaaaaaaacucacaaaacuauagcuagcaaacaaaccuaugcauacaaauuauacaaguuagaaauacagcugccuuuugguauuuugaauuuucuuacaugaauacuuacuacuucaauaaugaaaauuuuaaaaaucauauacauuuuauuuuuauuuuauuugugagauggggucuugcucuguccccaggcuggagugcagugguacgaaucacggcucacugcagcccugacccccugggcccaagugaucuucucaccucagccucccaagaagcugagaccacagacgcacaucaucacaccccgcuaauuuuguuuuuuguagagacagggucucacuauguugccaaggcuagucuucuacuccugggcucaagcaguccucccuccuugaccucccaaaguguuggcauuacaggcuugagccaucgcaccuggcucauuuuaaauguauaaaaagaguauguucaaugaagagaaauaauuuuggggaaaaaaaagaaaauacuaaacauuugaauuuuuuugaaagucuaaaaauauguuccuaagcaaggaacgggaagcagccugguauacuaguuaugaggagacacaggaacaauacuggguuaaaucuuggcucuacuacuuaccgugugaucuugaggaagcuacuuaaucucuguaccuuggugccuucacguacaaaacuaggauaaauaauagugcuuaccuuggggauaaauaguagugccuaccucagaguuauugugaguauucaacaaguuaauauguguaaaacucuuggaaaaagugccuggcacauagcaaguauucaaauaucuuucugucuaugcuuacagauaaaaaauauacuggaaaggaauuauucuguuuugcuaggaaacugaauauauacaaaugaguucaccagagccauuaaucaaaauuucaucaauuuuuccuuauucauuaacacaaucuaagaaaauucuuaaaugcauuaaaauauucuuucaguacccagagcuauuuccuaaauuccaagucugaaacuacaccuaaaauaguuaagaaaaauguaaaagcauuaccuuguugauaucaucugcuguaaauccauuuugaucuaagaguccucugauugcuucuauacacuuauuaaaaaguggagaacaaagaaguucaaaucuugcucuguacacacauacacacacacagaaacacacagacacagggacaagagaaagauaaaacggggcucaguacaaucaaacaaauaucacuuuucuuuuucuugugaagaguaaugccaaaacuuaauaugauaguucucugaaugacagguuuaccauaagaauaagguauuaaguaagagugaugcaauaucauggagacaggagagucuaggucauucaccuacauauauaugaagauaauaucaaauucaagugaaagcccaucuugcuuauggucuacuuauaagcuuccaaaaaauaacaaaucuaaaaacacauacccauauagcauucccaacaauaaaccuacugacccuaaucaaaccaucauuugaaaguuucugccauuuuuauauguuaaaguuuuaaacauuauuucuaauaauuuuccuugacaguuugagaccauguuggacauaaguuuagccccuccguacucccugagaaauugaaugcuggcagauaacaaaguuuuaagaaaaauuuauggucaugaaaaauguacucccuaaucuucauacagaacuucuuaaaugcagaugaguggcuuaaaaaauaauguuaucuauuaauaucuauaaaccuuauagauauuaaagcauacuuuuaugguugaaaucuuugugacaaaggcaaaauuucccuaaugaaaaauuauaaauuucauuuccuucuuaauuacugauuaauaaagcaaauauauaccgaggacuuggacaaacuuaacccuaaggaauucuggaacuagaaaaauacacauacucuguccaaaaagagauucuaauucaaugcaaugccuuuucuaucuuuugaguuguagccugaacucuuucuucaaagaucuggagcauagcuguccaacaggacuuucuaccagucacuagccacaugacuacugaacauuugaacugcagcuagugcuacugaggaacugcauuuuuaauguuauccuaauuaaguuaaauuuaagcagccacagguggcuaguggcucuuuuauugggcagugcagaucuagagucuucaugaaggcccggggaaagugaagaagcuaaacuaaacagaugaaaagagaauuuaaccaaauacagucacuagaauccuaaaaaaauauauacugcagucuuggaaauuuucacuaugcuucaaagucaccuauuauguuguugagagguuugaauaggccguaucauuauuauuagcaaauaugcaacacaaagacuacagcacguccucccuuuguacuuuaucacuuguaggaucuagguugaagguucuaggaugccuuugcacacuccuaauuguagccauaaaauaacagggcaagcaaucacaacuuauguaauuacucugguaacagcuauuuagucugacaaaaacuggaccccaauaaagugaagacauuauagaugguugauaaaucucaaacaaacaaacaaaaaacccaaaguaagaaaauuauaccuaaacaaacauguucuuggaauuuuuuaaaaaaguuuuuugaacuucaguuuuaccuggacacauugcaaucaaaaucuugaccuucauauaaugagucaagaaaacaguuggcacuucccaagguugacaaagaauguuucgcuacuucagcacuguucguuaauuucaucauggcucgcgcauuuccucucacaucauguuugaaggaucuaaauuaaaaacauagccuuugggguuuaaaauuacugggccauuuacaauauuguaacuaagaucuggauaauccuuauuaaaacaauaauaaauuagugaaucaggccgggugcgguggcucacgcguguaaucccaacuuugggaggcugagauggguagaucaccugaggucaggaguucaagaucaaccagggccaacauggugaaaccccaucucuacuaaaaauacaaaauuagcugggugugguggugcaugccuguaaucccagcuacuugggaggcugaggcagaagaaucgcuugaaccugggagguggagauugcagugagccgagauugcaccacugcacuccaaccugggcgacaagagcaaaacucugucucaaaauaaauaaauaaauaaaauaaauuagugaaacaauauuuuauuccggauuuuaguauuucucuucuaaucccucuaaacuuuccuaaaacacucugugcaauuaaaggggucaccucaagaaaaaugaauuaccaauuuccuuaauacucugaauugcuacauuauguaaccaugaacugcugcauuauauaauuguaauaauagacuguacucugaagaaaguagaguagauaucacccuuuuccaggugagacacagagguuaaaggagauaaggagauuuauguaagagcgucaaagucuccuauuuuacccuuuauaaucacagcacaaucacuguuuaauggcauaaaauuauuugucaagcauuaaaaagaaaaaacaaccuacaaguguuucuucaaaaaaauuugacacauacaacaaaauauguaaaauuacauuccacuaucuccaauaugaguucauguuuaaaacuacuuacuaaguagugaucaaugacuucauuuaaacaacaucuuuguaacaaaaagcaguauaggucuuuaucaaacaagugagacauuaugacuuuuucaagacuucuucaaccaauuagguuagucaaacuggcuaaaauaccauuucaauuacacuuuuuuuuuuuuuuagagcagcaguacccaaaguauaaccuuuacauaucugacuuuuguaacauccaaaaggguuagaauuuuagaguaauuauauccaguaacaagacugaaauauuccuagcagcagaugaguaauuaagauaaauauuccauaagacaauaacucacuggaauaugaagauaacauaaugcaaucuucaccagagccaaacuuuuaaaaacuguucagaaggcaaugaagccucagugccuauacacuccuuuaaccagacagaagagcacuacaugaagaauuaaaaucuacguucaugcaguucaguaucugacggucucuuuacacuaagugaaaaauccaagcacacugcacuaggcagccuggccucugcuucuuugaauugccuggacaggacauaacucuagauaugaaaauauccaguuuccaagcaaugaaaaaaccacauccuccuuugcagcaggauaacuuaaaauaaauuaggaaaaaaaauuaaaauaugugaaggaaaaccucaaucagaagguauuauucaggccauuaacacucaccuuuggaacucagaagcuagauacugugcuaagguuucugugaaaugugcaccaccgauguuaucaucaguguuuguugaaagaacccgauauauuccacuguuaacuuccaugacgcugagagauaaggauguuccuccaagcuuaaacaccaaaauauugcuucaagagaagauaaaguaaguuaucagggaauaacauuuuaaaacuaaguuggauauuagaagucacuuaguuuaaucccuuuaauuuacaaaugaggaaauagaaaaucucaggugaauaacuaaguugucuauagucacuuauugacaaaucaagccuagaucugagauguucugcaaccaaaucaaaguucuuuuuuccucagucauguggauacaacuguauucuucugaguaaggaguucaaaacacgaacuuuucaaaguaaaucaagagaucugugauuauagugaauuuuaagagaacugaacauagaaauucuauguguuaaucuuaugcaaguuacuaugcaauugcauguucuguagauauauuacauaugcaaaauuaggagcuaauucccgauuccccauguauuaaaacucauaauuugauauucucagauuuaucuaaaaauaauuuccucaugauguacacauauuucuuugcuuaacuaggagauacgaauaaugaggugaaacaauuauguaaaauuaacacugcaucugaauuaacuucucuaaaguugaacgacuauccauucuauuaagacauauugacagcuauauuagggauaaguauguucuaguauuucaccauuaaaagaagucucaaaaccucaugcuaaauccaucuccugcccugucaaauguauauaacaguaccuauuaucugcaaacaugucuaauaacuggaauugguagaaaaaucagcagugucguagcuugaguuggaaacuggccaggccucgaacuuucaaaucuucccucaaaaaagggacaagacaagggcauaaaagcucaaccuucucucccauuacauucuuucugugcuuuccuaggacaucuuucucaacuauuugaaaaacucuaggcaagagucuguuuuuccauccagaaagguuuggaaccacugcauuacauaauaaucuuuacugauauaaucucuauaaucuaaaauguuuucugcacucaaaaaaccuaaaacugcaaauaugaucuuuaccuuuuuccaguaggggagucuuguccaauuccauaagcaagaagagcugcagacgguucgugaauuaaucgcaaaacauuaaauccagcagcucuagcugcuucucugugaacaauuugcuuucaaugaauuuaauuuaucacauguucaauucuacauuuuuagaaaugaucugcuaaagauuuuauacaaaagcuacuaaaauuucauaaguagaacaugaaguauaaugaucuuuagaagcaagaauauagaaaacaagaaaugaaugacuauaagagaucacuuucuguuuaaaauuguaauguucagagcccauauucuucacaaagaaagcaaaaagcacacguacugaauaagagaaauaaagcucucaaaaauauccauguuuaaaaaaaaaaguucaaaagaugagagucuuuuggggcucugagagucuaggacagguguccugucuucaugcuauccagaacuuccccauucaaaguacuugccacauuuuaacguaauuaucuuguuaauucugugacaucagaaaccaugucuuauuuaucucuauuuauucaaccuucaauacaguguggcuuaaacaguaaucaauacacauuuauugaaugaaaaaaaugccuaugcaaaaacugcagaaagacaaauuuauagaacacuugaaaauuuccaauuucuuuaaucuaguguucaguuuuuaaaaguacauaaggcaauucucugccucagaggcaacuucaaugcccagaaccuugugugaaacucuauccugcagagcaaaggcauaaaagcacaccaauacauuugcauaaugaccuguaaaaacuauaacuuuucuguuuagauguuaagaucuaaggugaagaaauaagcacaaauauuuucuaaaacugcacauguaauuccuacauaaaccuuaauuacacaaaauuaaggcaaagagauucauaaaugucaauuuaaccugguaauuuaaaauguuuccgaucgaaacagcugaagguacaccauauuuaauuuuauguucucuuggcuuuuuuuuuuuuuugagacgaagucucgcugucacacaaucuggaguggaguggcgcgacuuuggcucacugcaaccuccacuuccuggguucaggcgauucuuaugccucagccucccgaauagcugagauuauaggcaccaacaccauguccagcuaauuuuuguauuuuaauagagacaggguuuggccauauuggcuaggcaggucucgaacuccugaccucaggugguccacccgccgcccccccgucagugucccaaaguguugggauuacaggcgugaaccaccacaccuggccucuuggcauuucaucaaauauauacauauaaaaaugaucauuaccuuacuaaauuauuuacaaauacaauuuuaucgccuaagguacuuuaaaauacaauguuaccuuuuacuauauagugacuuuguacuuccuuuaauuaagccaguaagauaaaccccauauacuuacccaagagcauuuuuuugcuuuucuccaaaaucaaacgggacaguaauaacuacaucauuugcaucugagcccaauacagaaugugccguuucugcauauuaaaaaauauaaaauucugaugacagaagaaaaugacaagugauacuuucugagguuuauuaauuuaugacaaagaucucacuuaacauauuucccaauacacuugcuugcccaccccgcccccgugucaauuuucuucucugcgcucugaaaucaugcagcacuucuugugguuuuggugauauauuuggacacagaauuagcuuuccaaacagccuggcucuuaggcuucaguaucaaccaucuucugaauuagacugacuccauggagaauaagcuccuaacgcauccaugugaagacacaacgucauaauguuaguucucuacauuuaaagccugccuuccaacccccaaguucuuaacaucauuacagggcugaaggaagccuuauaaacaaucuauuccagaauuucccaaauuguucgacagaauaccacucagcucagagccuccgucugaacugcugauaaaaucagaccuacuuagucugccuaaauuauuguucacaguauacugucgaucuugaagugccacuauucaccaagcuuacucggccacuaacuauguuuggaaaacucuuauuuggccuaauucauuuauaugacuuauagggaaaucacagucagguaaggcaagucauuuaaccacgggcacauacccaguuagugccccaaccaggucgacaguuuauauguccuuacuuaucugugcaaucacucugcuucucccaagaucuaaaaauaccucuaacuuuuuuuuuaaggucaacuuucaaaagaucauuaaagguaacuauuauauaucuuuugcuaaauaccuuucauuuuacuaaauaucagucuggcaacaucuucuggguuaacaaauuuuguuucuucuccaguaucuauuucauaucguaauuucccauuuuuuucaaugaccuauaaaauaaauuacaauuaugcuaaauaaauaauuuuuaauaaaaaugcaaaguuucaaaucaacauuccauguuaucaccuugguaauuacucuauguaacagggaagcaauaacagaaccauacucacuaaacauuuacuuuccgcgauguauuucugagcuuguggaucacuggagcuguccauaaagaaagauaaagauagcuaaguauuaaaaucaguauuguagauauauaaaguuuagagaagacuguauuucacaauaucacugaacaaauacuaaaauauuaacaaaguuauuaagcugcuuaauacuaaaagucuucaaauauuacagaagauagaaauggaguauuuauaaggguuauaguaauucuacuaaaguacugaucuuugcauuugaaaauaaauagcuuucuuguucuggcugugcuauuaauaggugcuauauauuuugaggugacuuuucauaauauccaugauuuuguaucauaguuucacaccuaugauucugaagacccaaccacugagaugagaaaguugcaaacuaaaggcaaaccaaacuagcuaagaccaucuucguugcuugguuucugaacacacaccaacuccagaaaccaaaagguugagcaaaacuaugaauguuguuuauagaaaggugcagaguacuaugcauaugcauauauauacagauauaagcaacuuaugcagacuacaaaauguuuucacguacauuaucucacguuauccucacaacaccuaagugggguguguuuggcagguauuauuuuagagauaaagagcuucagagagggacaauaacuuauaagcuaacaaggggcagagucaguacgugagccuaggucuucucuaucacgcuacuauuauucauacuuuagcaggcugccucccacucaucuuguaaaugaucacaguucuucugucccuugagcgggauagaaaucucugauucuuggcuuaaugucaucuagaaauuaagauaaaauagacuaguauccuuucauuaaacccuucuuccaaggagcugugacuauucuauuuguuuaauaagagaaguugaaaauuaauaguggcuaauugcugaaggguuagagcaucuggagaccuuaacuuguuaagaggcagacaaacgggguuuaaaauggacuaauuuggcuuagaacucuggaauacuugcagguuccucauacuuccuucucugucaccuaaaauaucaauaggacaagagguaaguagcuugcccaaagucacacagcuaaucaauggcauaacuggcuggcauucagaacuucaauacaaaguuuaguauucuuuccauuaaacucuuugcuucuuccuuuuccuaaacucaguauuuaauauuaacuauaucccaaacacuuuaagaauaggaaaaauagauaaagugugcucauagcggguuuugcaccaauauuagaauuucagcaugacacuuacuaguucuguuuucuuuagaauuuaagucaaccagaacaauuuauacuguugugcguagguugucuaccacccagacaagagaauuugccaggaaggauauuuuacagaauuuacagaacucuuaagaaauggaaaauuauuucucaacugcuuuauaaagagggccgcucuccucugaagacagaaagcacauauagcuccgagggcugcagacaugcaagacccuuagcagaggagaaagcaaagcagagaauggaggcaacaaaggaccacagacaucaucacaaaguaguggacugacccacaacuacauacaagugaaaacuuuauuuguccacaccaggauuaccgaacagaaaaacaaagguggugagaaguugguauacauagcaccuuauuuacaugauggacuugaggaggcaguuaauccuaugguuguguaucacaaccuuuauuagcaaugccaucuucucuuccuccuccuacuugaauaucccuuacggucaacagcccacgggcuuggcacacaccagcacuaaugugcuccagagucuuuccccuacuuguuacaugacagugccuuacaugucugaaagugcucauacauucaucuguuccuuugauccucacaacaccccugugagguagguaggacaauuaugaguuucccacuuuauaaaugaggaaccugaguuauggaaugcuggaaaagcuuuucuaaggggguucaaguaguaaugguugggucuaccacauaggcagauuccuggcuugcuuucuugcacacugucucccuguauuccaauuucccuccccuuaauauuuuuagccuauuuuucuguguacuuauucaagaccuuucccuugacuuuuauucccacauuaggguuacuuuacccauugaauuucacaauaccacauccaaauauuaauuccaaugcucuucuucagcacuccuuucaucucaaagaaaucccugucuuaugcacuuugcuaccauuaauagauuuauagaauacaggccuaacucuccgucaaguacuucuguguuuccagaaaaucuaccuaccuaccuaccuaccuauaauugacacauaucuuuccauauaauagccuaagacaauugagaaugaauauagcuguauccauuucaaugccuuaaauauaugcucuuuuaaaguaaagagucuauaugucugguguggcacuuagaaguucaugagcauauuaauaaauauuaauaccacagaaugcuaccuuaaaauuguuaccaguauuucaaauauacauaugcugcugugacagaaaauauuacaauuaaaauuucguuuucauuuugucuuuuauuaugcuauuucaaauuuuuuuagagcuggaagguacuaggaaaaaaaaaaucuaauacaaaucccucaauccggagauaaagaaauugaggcaugaauuggcugggcacgguggcucacgccuguaaucucagcacuuugggaggccgaggcagguggaucaccugaggucaggaguucaagacuagccuggccaacauggugaaaccccgucucuacuaaaaauacaaaaaugaguugggcauguuggcaugcaccuguaaucccggcuacucgggaggcugagguugcagugagccaagauugcaccacugcaccccagccugggcaaaacagugagacuuuuucucaaaaaaaaaaaaauaauaauaauagaaaagggcaagugauuugucugaugaaacaaacugugacaggauuccaauccaggaauucuaacuagauuccaacauauucuaccacaccagccgccucacaccuccaucccuggcuuggcagagcagcucgcuugccgucuacucaugguucuggguacgcucccacugcugcucugaccauuucuccaccuauguccauuuccagcauuuagcuaagcacucgagccugcaagauagaaaauaaaaccucccccaacaugcccacucuuuguuauuuuuccaacuucuagauuauuggaaaacuuuuuaaauccuaaagauuccuauuuguauuccuaaaaguacuaaguaaaucacuaaaagcuuuaaguuaguuuaaugacagagaguaaugucuucccuucuagaguaaaucggaaguguggcuuaucaccuucaucucuccccagugugugucugggguguggaggaggcucaucuguucacggcuagugcuuaaaaggagucaucuauugcaggcaaucuuuauccacaccauccucuaguguucccaaaguuaaagaggaaacaaagcuguucucuuccaccagaugccauuaacuacauaaacuucugucuacaacaucugaggaaaaggaaucuuggaaagcuccucaaaaggaaacguuucuagggcuugcccuguauaacauacuagacaaaaaaauaacagaaaagaaugaaaucagcuaaaaagcggaugggaaacugauauaaucugaauuguuuccacaauguuccaauggcaaccgaaacuuaaagauguaauuuaggcauauaaagggacccaaauaauaugaaaugcaaagaauuuacauauauuuaauauuuuauaaaauggccaguauuuuauauugaagauuaucgauauaaaccguaacacacaauggcggcucccuggcacuucuuauuuccuuauauugauaggagacuaagaaccaguaaaaugaaggagagaaagacgguuugacaaaacagugcuuacuaguagauaugucagauacacagcaguggaaauguaagagauuaagguacaaauacagguugugcuuauagucgucuaaugagccacacagggauuuuaaaaauuaagauuucaaacuccaugaagcagucaaguuagaccagcaaaggaaagauucaagcaaugaagucacaguauauauccauacuucuguaucuuguaaaccaaucugccuuaccucagccaaggccauaugaauuaauaacuuaaauguguacagugcuuuuaaacuuuuaaacccuuucacaucuaugaacuacgugauccucacaacaacccugugagguaggcagggcaggaguuauuauugauccccauuuuacggaugaggaaaccacuggagggagguaaacugcuucacaucugugacaaagcuaggaugaaccagcugucuagaacguggcuccaucguuuucuauuaggucaccccuggcauuucugaaaggucuuccauuugguggagaaucuugggaaaaugaacuagcaauuauuuucauacuaucuggauauaaaugguucauccauguuuuuuucugaggacacagaaaaggagccagggauucagaaggcagguuugggaacuagacuucuaccaguuuaggaagcagagccuuuuguaauugguuccuagcuuuugguauucgaaaucaaccucugaagcaauuuuucaaggccuagcugaaaagcaccaguugccucuuccacugcuguugccaaacgucugacugcgaugacagcaucccugcggagcucauuggcaguaucuugcugagcacuggccuccucaccaauagcaaucagccuguccaguuuuucuuccucccgcuuugagaguucucgugccaaucgccuguuuucugccaacucggcugcgauaguccuggccacugaccgccuucuucgccuugcccaccuuggagggggcucacuggucaagggccuauccccaccagaaacaaaaccagcucucgaagaggagacuggagucugcgguguggaggcuaccccaggagugcugcgguuggugcuggugcaggggcugggcuccccggacacacccagucuggccauggggcugcucugacagggagcaacugcaccucugaaaaggcugugggagcugcuguagcugggggucccuugagagcacccugaaaaacaaagcaacaauguugcaaagagaacauuccugcuaagggaaugcuuggagccagcagcagagcugagacaaauuauaaaacuaugguuguuccuggaaagccucuuuccaccagggacugggaagaauccauuuccuuaaucuggacaauugugaccuguuugauuucaccucuaaaacuucucccuugccuuccugaaccccuuuguacauagcuauccaacccacucuagaccuacaauuuccugacuaccaguuauuaauaaugccagaacuaguuugguucuagagagcacuucuagguuuaaaggguucuaauaccuuauguugccaggggcauagcuuuugaaaaccuggaacccuuuagcuuacuauuagguuuuugaaaaggugcguggggcagaaugaggcagaaacaggaacuaugcugaagaggacacuauccaaacagacacagcuaaauguuuagagccacaagacucugggacccaacuccuucacaugcuugggaguuaccugcacccgaggauucaucccaggaguccucaaggucacugguuucucguauccggucacugauucuuagcugacaauccucaucugaugccuuaacuguuuucaagauaggcugaugaucagcugccugaguccuuuuugauuuuagaaugccgguucccucuuccccuggggcgucagaggccacuaaguucugaucacagugcuuggcccaagcagcauccuccauuaaguugucugggucagucacuaucugauuucggagaagcugauccaacguaucauaaaauggacagugugguggcucacccauacuuguggcaugggcaacauaggccuuuaaauauaaugccuucagaacuuuaaacuuggagcggcacugacguucggugcggcggaagcccuccugcugcauucgcuuagacacagccugauagacaucugcauugugaugcacagucuggaggcgcugaauauacucugccucgccuaguauggagagaagaguucgugucuccugucuggaccaccggaugcccgcacugcuauuggcacuggccauuguggguuggaaaggagggcuaggcagcuucuggacagcaaggugcaagucugaagguguggggaagcucugugugcucucaggauaucuccaggaucuucccucucagggauaauugcugagaagccagguccaaggaccgcauuucuggcuggaaggccacaggggaaugagaguuacaggaaggguguaaggauaauuuuggcagcaaguuaaguggugcuaccugugaguaggucauaaacaggcaugaggccaagacugagauagcccaacuuugggaguucacccaggguagacacggcaccaagaaccuaauggcuugguaacaaaaaggccaaaugcuuucauggcugagaguugguacaacaauggaucuguaaaaaucacccuugucuggugaguagaugggcugggagggaaaaucaccuggaccaugaggcagcuaacgcuaaaggaguccaagcaugaccacgguauagcaaucugaaagaugcucagucuuuacuaaucacagcacgcuguggcucuguguuacccaucugacugucagugugggccagaaaagugaguuuaaguugcucugcuaauacaaauuuuuuuuuugcacaauauggcagaagaaagccacauaauuacucuaaccaugugcccucaaacagcagcauaaaacaaacaguaacauauuguuggcuaccaggggagagaucuauggaaauguucuguaucuggacuauaucgaugugagcaucuugguugugacacuguacuauaauuuugcaagauauaaccacggggagagguggugaauccagcaauguguuugaugucucuguauuauuucuuacacagcagcaugggaaacugcaauucucucuaaauaaaaaguuuaauuaaaaaaaucauauuguuggcugcucagugauuugggcuugaagacccaucuacgauucuuuuuucuagacuuuaugaucugaaaauauuugacaccaacuuauauuuaauaugcucgguacuaaguuuuaucaauagguaaaaggauauggggauguauuuauugucacugaauauugaauucucuccaaacaacuauaguuuuuggcuuagugcauaaguauccugaggaaaaagauuaauaucaaguucaauuuaauugaacacagguaagagacagaaaauaagauaaacagguaagagauaccugcauaaauuuaaucuauaauauccaauucuaaaucaacaccaggacauuuuuacuuaaauucucacuaaacaaaguugaaagaaaagaaccuggggccgagggugaggagaccugaucugcagucuuacccaguuuacccccuaggauaaugccacaauuucuuuguaccuugauuuucucaucuauaaauggggaaugauaguauuugcguugccaauuuuacaaggauguugagagaauuaaauaaaauaauagaugugaaagcacuuugaaaauuuaaaaacacucuaucaaguauuacuacaguagugaaaaugaaaaccccuaauuauuauagcaaucuauaauuugaggagacagaagucuggggaagcaagccuguuuuaaucuucuaauuaaacuuacaacagaugauuaaucugauucuuacauaagacguuaauuuagcuguuacucuaaugauuaaauuuguaagucaaguggaaaaguucguucccagaaagugucacaaaagauccugaggaagaaaaucaauagugucuacauaaauuacgaaaaauuguaauagauucagcaaaauucaaccacauugucaauaagucuucaaauucccacaaaaucuuugaaauccucucaguuaaaaaaaaucuaaaaaugugaacaauccaaauuaccaccucugacgcaaauuaccaaauugaccugucagcaagaaacuaacaucugagugaaucccauaucagagaagauccaacacuaagaaucaaaagacacugccuacuggggguacucucuguaaugacucagucauaaaaagcaaugaagaaacaaacuaugcuguuucuaauuucuuuucacauuaugcuuagaauuuaugaacauguuccuauuaccauauuuaaaaguaucauuugauuccauaccuucugcccaggaucugcuuuacuuucauuacuguauuugaaauauuucuuauucuacuuuguuuugcugccaauccaacaaucugaaaaaaaaaauaauauauauauauauauauuacaauguauguaauuuuaaauuauuucagaaguacaaaaauggggggacuaguaccucuucauuuucugaguaagcaacaacagcuggaguaacucggucaccggcaucauuugcaaccacaccagcccggccauccuagagaaaaaaacacgaaauacauagucucauuagacguauucagacgugugcauuugugcaccaguguuacuuugccaucuguguggaaagaaaaacugcuaucucaauauuuuaaacuugcaaauuuaauuaccauuuaauuuccucguuuucauagaaagccuauaauuccaugaagaacugccucauguuuucagucugcucugcaaagucaacaauugaaucaaaaguaauaacaaccuuucuacacacaaaacgaaggcuauuauuacguuaccuuuccuaccucucuuccuucuuaccauuaccauuucuuuuuuuuuuuuuuuuggacacggagucuugcuccguggcccaggcuggagugcagacugcagugccagaucucggcucacugcaacuuccgccucccggguucaagccauucucaugccucagccuccugagcagcugggauuacaggcguucccggcuaauuuuuaguauuuuuaguagaggcgggguuucaccauguuagccaggcuggucuagaacuccuaaccucacgugauccgccugccucggcuucccaaagugcugggauuacaggcguaagccaccgcgcugggccccuuucuucccauuucuacaaaugaaguaguauuauucccuuuggcuuuuccuaacaagucauuugacauuuaaacgcgggacuaguggcaacggaguucaugauuaucguuucuucugccuccccacugaugagagaaaggccacaaguccugucaggcucucacuuccagaaaggccaccucuguagaccacgcaccaucaacuggcuucacagccaggcagcuuugcgggaccaucagccccagcucgacugcagccuccccgccccuccgggaccuagacguucgggcccagcucagcgcguucugcggcccugcugucccagagaccaccgccuccaaguaccucgcggccacaacuuucccaggaccucccacccgcgggaauccugaggcccugacgucagcgagaccccuuccggcauccagaggccaggacguccccgugaccucccccaaaaugcucgcagccccgccguccccgggaccccccgggacacccagcggccccgcugucuccgggacccccccgggcacccugcagcuacgucgucccugggaccccuccgggcaucccgccgccaugacgcccugggaccccgcgcgucuacaucgccgcgagccuccgccgcggaguagacgacuuuccggaggaaucgccaggcgcgaggccgggccugcccggcccuucgcuccggaguguccucgcggcaacgccacuccacgacaucccuaggccggcgacacgccgcucucaagccuguggaugacccagcgccagaaaaccggguggccgucaugaagcccuagcccagcuccgcagccccucaccuuauagacggccacacaggcugaggugcagcccaggugaacuccgauggccgccaugaggcagcagggacggcagcggcaggaaugagggggucccccaacagcaacagcuaccggccgcccaacggccccaucaggcaccgcggagcuucacguucccgccagcccccugcguccggucgg

SEQ ID NO: 13034 - RNA, 1382 nt, Homo sapiens
ugggaaaaugggguggcgaggcugggcgcagagaggcuggggcugcggcucagcgugggcuccccuggugcgcagcagcagcugcgaggagcucacugcgguucuagccccgccgcagcugcuuagacgcagguuuaacuucuuuauucagaaaaaaaugugguucagaaaagaacccaguaagguugaaccucgaagaucagacacggcaacaaguggugaagcauacaagagaagugcuuugauuccucugguggaagaaacagucuuuuaucuuucucccuauccuauaaggacucucauaaaaccuuuauuuuuuuacuguuggguuuacaggcugugcauuuggaucagcugcuauuuggcaauacgaaucacugaaauccagggguccagaguuauuuugauggcauaaaagcugauugguuggauagcauaagaccacaaaaagaaggagacuucagaaaggagauuaacaagcgguggaauaaccuaagugauggccagcggacucagguaucauagcugcaaacguccuuguauucuguuuguggagaguaccuucucugcaguggacagugaucugauauuucaaaucuaauccagccucaaaaguccguuguucuccaauguugcugucaacauucaaucauuucuccuuauuucacauggcagcaaauauguauguuuuguggagcuucuccuucaguauagugaacauucugggucaagagcaguucauggcaguguaccuaucugcagguguuauuuccaauuuugucaguuauguguguaaaguugccacacgaagauauggaccaucacuuggugcaucucgcgccaucaugaugauccucgcagcuguccgcacuaagaucccagaagggaggcuugccauuauuuacuuccaauguucacauucacagcaggaaaugcccuacaauccauuaacgccacggauauggcaggaaugauccugggacggaaauuuuuugauuaugcagcacaucuugggggagcucucuuuggaauaugguauguuacuuacccucaugaacugauuuggaagaacagggagccucuagugaaaaucuggcaugaaaugaggacuaaugcccccccaaacaagagguggcucuaaguaaaacugggauugcacaguaccggugcaccugucuuguccugccggagagccccaggagacaucggcccuagagugaucauggcuacguucccgccuggaagacgccagcaucuggccucccacuguuuucagcuguguccccggguccgugucuuuucagaaagugaaaaugacauaguugugacguaaagguuuacaucuaguucguaaaaaauaaaaaaauaaaaauaaaaauaca

SEQ ID NO: 13035 - RNA, 94406 nt, Homo sapiens
aguuuaccuauuucauccugagucacuuuguagcgacuuguauuuuucuaggaauuuuuauuucaucugcauuuccagacaaaguugcucaucaugguuuuguaugcuguuuuuaguuuugggguaucuacaguuaugucuccauuuuuauucccagucuuuuuuacuuguucuuucucugugugucuuugucucucagccugucacuuaucauuuuggacaaaggucuguuauuuucuuuggucugucaaagacaaggacaguucuaucauaucuuuguauuucuuuauuuuguccuuguaauuauuuguguaugaaaugauacaaaugauagcaaauggcugaagcaauuguugcagagagaaaugagcugagaaaagcaggugccugucaaaguacaguuuccugcaauguguguuagcuguggacuuagaaaaaggaggccaccagaacaagcuggaaucuuggacaggguaaguaaggaaggacagggcagguuguucugagugcugauggcaacugagagacgaacaaggagaauugcaaaaccuuuccagaaacugcccucagcugcccaaggacucuguccuuccaucaugcauucauucucucuuuuuccuuauaaaguuccaacuuuuauuaauauuauccagcuaacacuaacauuaguuaggauuuuaguucauguuaaauuugguggaacaaauagaagaauguuauuacuugaacagcaguuuuaaaaguccaguaaucauuagcaguucaaaugugugggucacacacuucucuaagcagaguuaauaaguaaaccuucucuggcacgauuuaacauuagcugcaguuugaacuuuacuucuaagauuggaguggaucacacagcucucucuuccagacaagccuggggagcacaacaacuaaagcuggaacuuuuuauauaaauaaggacuuauguauauaacauguauauauauuuauacucauacauacacacacauacacauauacacacauguauaaggacauauaaauguuuuauauguaugaggauauaaauauauaaauauauguauuuuguggcugagagugacucccagcuaauaacuagcaaggaaaaauuuaugcauauauauuuuuauacauauuuauaaaugaaugagcuuagaagaggaccuugagcuccagacgagaugaacuaugagcccugccaagaucuugauuuugauuuugggaggccuucagcagagaaugcagccgugccacuucuggacuacagaaauaacuaugaauucauuuacuguuaaguccagaggaaacugaagcuuuggauaaguuucuuauccgaggucaccaggcagaucucuuuaguccuagccuagccuuccuuccauucuuccaugaacuuauuuuauugcaauuaauagaaguuaggugaauauauauauauauauauauauauauauauauauauauauauauaaaacuggcauucaacuaguuauuaauaauauaagcauuccaaaggauacuucccgcuaauggaaaugucuguaucuagagcgaauaucagaaagaagaaaaaaaaguuggagcaaacuguagaauguucacagaaauuuggccauuuguauuguaugucaguuauuugaauuaggaaauuuacagaaauuaucuucauauugcuuaauugcagagaugguuuguuuacucauuagugucgaccauuaaguuaccuuaauauuuuugacaggaugagcgcuuaaggauuuuguuccccucucuuugcuauuuagagauuuuaguuuuaauacacaggaagacucucaggaaauccuuuuuucugguuuuggauucauguaaagaaaaaaacguaaaaugcagaucuuugcaucauucaguagucguuuaugugaguaacagcuguuucucucgauucuucgcgaugugcaguuacaaguuagaaccaccauuucauagagucccuuugauuuuaaaauugugaacaaugaaaagcaaguguucuuuaaaaacgaaauuaaguguuuuaggcaguacauauauuaaauguuuggaaaauaaaacucuccugaauuuuuaaacucucuagaauuggcaaaguacucaguuacauuaugaaauacagcucuguuuuggagcuugcaaaaugcuuuuguaguggauaacuacugcaggggacaauacucaucuuuacuguuggugcuguuagcauauuuaaugaaguaauuccauuccugugaucacaaaugcucaugcacagaggcucuuuuaaugaaacagcuuaucaucugguuucuagcauguucuuucagauuugggcauaucauuuugauccuuccuaaguacuauuaauuuaaaaagguaugcaugugcuauauuugcuuggcaaaccacacaacuuuucacaaagauuuuccacaaaugaguucucuaagucucuuuauugaaaggcauuaucuuccugaguuauggaauauuacauuaacgucauacaacaauugugcaaaacaguuaagcaaaauaaagggacuucuguuauauuuacaugauuaugcuauuuaaaugauaaaauuaggaugccauauucuuuuuuauuuuuuuuuugaaguggagucuugcucugucacccaggcuggagugcaguggugugaucuuggcucacugcaagcucugccucccggguugaugccauucuccugccucagccucccgaguagcugggacuacaagcgcccaucaccaugccuggcuaauuuuuuguauuuuuaguagagaugggguuucaccguguuagccaggaugaucucaaucuccugaccucgugauccacccgccucggccuccggaagugcuggaauuacaggcgugagccaccgugcccggccuagaugccauauucuuaacuucguuuuccuuucccuauuguuuucaguauucaggucaucaggggucaaugaagacuugguaaccacugaacggaccaugugggaauucgguuauuacucaauaagaauuccuucuuaggccugguuccugguuuacugcugagcucugcaugugauaccucuccaagguuuccaccuucugccugcccucacauucuauguuuauauuaaagagcaucugucuguuugccuguccuuccaucugucauagaauucuaagauagccuccacaauuccuggccucugguauacacacaacuucuccaguuauucagucauacccuaaucuagcuauugcugugaugggauuuugcagauguaaggaaggucucaagucaguuaccugucaagauaggaagaugaucugggugugccugaccuaaucacaugagcacuuuaagucugagucuagagcccuagauggccaagucagagauuggaagcauagaaggauuugcugagacacugcugacuggaagauggggagggccacaugaugagguuucugggcagccuuuagccuuuagcagcugagaguagcucucagcugacagccagcaaagaaacuggguccucaguccuauaaccacaaagaacugaauucugccagcaaucugaaugaccuuagaagaggaccuugagcuccagacaagaugaacuaugagcccugccaagaucuugauuuuggcuuugggaggccuucagcauagaccccagucaugccauuucuggacuaaaaaaaggacgagucaauauguggguguuauaagccacuaagucuaugguaagauguuaugcagcaauagguaucuaaaacacugauuuagaacccaaugcaccuuaguugcauuauagucccaaagcguuuguuguuuuuucuuucccccaucuuuuucuuauuuaaaccaaaaacaaauaagcagaaauuaacuauuuucuuugaccuaucaauugaggccaugaggccaauaccaauguauuguaucugucuuuguggguuuuauguugaauaccaaagugcuuuugucuuaucaucagaaagauuucccuugagacuauuguuagcaccuguuacuuugcccuccauucuguaguuccucaugucugauucagaggaagauuauuugcaaggauggucacaagaauuccuccucuccuaguacagcacucaagcccuguugcaauaugacuacugcuucuaccaucaaggggggucucuuucuccaaaucuuggauuugggcugaccuugugacauuuuuaaugguagaauguacagacuucuaucauucuucuagacccauaacgcuagagcuccaggggccuuaccacuuccucuuucgcccuccuggacggggcuguugugugaggaaguccuaucuagccugcugagaggccauacaaguggaucugagaugccugagcugacagcugccaucaacuucuggacuuugagaccacccagggcaagccagucccuggccaaccucccaguugacugcaaacacaugacagagccaagcuaaugccacauggggcagaaauaagauaucgcagcugagccuuguccaaauugccaacccacaguauugugagcaaagcauguguuuuuauuuuaagccacuaaaguuuugaggcgauguguuauacagucauagauaauugacacagaaugagagagcguggcuuaaaaauaggauuuuaaaauuaagauuuuauuucuuuuugaauggauuacgauucaaauguccacguacacagugcaaaauuuaagauacaaaagaguauacaugucaaaacaaauuucccuccuugagggcauuguuaaguuuuucucaucucuuuggagcucuucagcauggugguuuggguguaaaguaacaauuuuaagauuacgcaugaacaaaaugaccaaaguagacaauaaaaaagcaacacgucuuauuccagauugauuugcuuuguaucauuuuacguccccaaauagucauuucugcuuuguucgauuuuccuuagggaugaauuugcaagaucuccagauguccaagcuaaaggaugaggucauaguggaguauaugggugacccuguagguugcugcucugaaauggaaaauuauuauguauguuuuccaguaaugcaagaucagagaaucuaucaccagugauggguuaaaugacucagaaaccauucagcggaguguucccuuuguaauguaagggaaaucaguauuuguauugaaagcaaaucaguaaagacccucuaagccaccugauaaacugugucagccccagaacaaaaucuuaaauacagcccagcaggcuauuuaggccacuaguucccuugacuuuuuccagaguccugucuacauucagaaugugaaaucuacaguauaucagacucgggcugagggucugguguugccuguuauaacccugggaaguacgaggcuuauucauucaacaagcaucuaucacccacagagugauauguugcagacacugugguggaugguauggauacaaauggaaauaucaccauagcucauaaccuuugaguuuuuauuuccugggauccccccacaguggcuccaggggucccaaaccaaauuggauacuugaucuuaccugaauuaaaaucccacuaagauucccuagggaugugagauauucagccuaaaagagcagauuuaauauauugauacuggccuccugucuuuuauuugaauuaauaaauucaaaguaaauauuugcucuuauuuguuuuugguuuaaaagaaauuaugguaccuggugcaaaagguagcaucgugacuuugagccuguaggcauuuauaccccagaguauggaacgagccuuuguuucuauuucucucacggggcagggaaaagaccguggucacuuaucacauucacacacucugccuguggccuugcaucacagauguuuguccaggcuacuuuguauggagaagucaggcucacugcugggaugggauuuagaaucuugaauccaaugcaucuuugguuagaaucucgaauccagugcaugcuuuuucuauucaucugauggggcugcuguaacagaauacccuagacugaguggcuuaaacaagacauuucauuuucccacaguucugaaggcuggaaguccaagaucaagauggcaguaggguugguuucuggugaggccucucuuucuggcuugcaguuggcggccuuuucauugugucuucauguggccucuucucuguguuugggcagagaaagagagaguggggaaagggacagaggggaaggagggagggagagaggaagagagaaggaaggagggaucuggugucucugccuccuuauauaaggccaccagaccuaugagcuuagggucccacccuuaugaccuuguuuaaccuuaauuaccucccuauagguccugucuccaaauacagucacauuggagguuagggcuucaacauaugaauuauagggguaugugguacacaguuuaguccauaacacuucccauaugccagauauuacauuaggcaagaggguauaaagauauguauauaugucaagcaucaacucugggcucacagaggcacauauuuacgauacagugcaauaacgccaauaccaugucggguaugggaggggcagaaaagauccauuuagugugagcaggucaggaaaggguuuccagagaagacugauucucagagaggagaggagcucuuggggauuggugaaggucugcuaggcagaggggaagcccguggaagagcaugacaaggccauauauucauuauuucauccagucuucaucacagagcagggccacuuagcaaauacggcacucuggcugaguggagccuuggauguuugcuggggagcuucgacuugaucauguagcaggaagcaggcauccacuaaaguguuucaagcagaggaggaaacugagcaucuugcaccuggaaaguucacuugcaccccagaaaguugagaggaaaagcauguguuagaccagaggcuggggccaguuaggaaaccccugccaccauauugugacugagcccaaaggcaacaguggcggugccagcagagggggagggagauagccaggaauugugcacacugcacaaaccuuggaguugaugccaauguggggagggagagaguuuaggcuggauccuagguuuugguuuggugacugguggagccauuguuaagaacagaaacacaacucaaggacgagagagaaggaagaaucauaggaaacaccauguauaaaguucauggaauucagcuuccucagcugggaaggaguuucuuuaaguucucuggcagggauuccaccccucaguggguuccagggacccagggauggccagacccuuacuuggcuggcaggcuguggcuuagagcauggugugugauagguaucuuuggaauaaguaauuuguuuaccaaaauccguaacugaugugacuuuucaguaugacuaugacccaaacugucuuagucagaaaaauuuccccauaaauaagcccuuagucaucuguugccaagacaguuaaaaagcuuuugaucuaaaauccacgaaccuguuguccuuuuugcuacgcugaaaccgauaacuguuucagucccugauuuuguaccugcugugauucaaguagauuguaaucucagagccuuaggguuggccagaaaagcacuuguaagagagcugaagaaaaggagaucagagagcaaagaggcggaauaaacccuuucuuucuugcauauuuaaauuuccaauuacccuuugaugaagggaggggaggaaaaugggugaaucuccaggucaccggguuuuggguccuggcuugaccguaaauuuguacaauuacaacaaaugucuccuuuuccucccugauucugucugcguuuucuuccaagaggaacuggcaggauuucuauggggacggccucuuagcaucgcagacuugccggggagacggagcccggacacccaggagcgagacgcucuuggguacuuugugugugagacagaauaagagagagagaugggggugagcacagagagagaaagagaaugaaagaaugagacagaggagagagaaagaaugaaagagaaugagaaugagggagagaaugagagaaagagagacaaugagagagaaagagauuaagggagagagaaagagauaaaagaagagagaaugugugugugagagagacagagagguagagggagagagcgagggaacgagggagugagaaaaaaggagagugagcgccccggagcuuuguggcugugacccacgcggccgccuucccacuuucccggucauccggggccgccgcgcuuucccuccagcccucgcucccaccgagucccggaggccgagcgcugcagccccggcuggugccccucccggcgcggaugcccggccuuucuggaucuccgcccgacgcgcgcgagccguggaaggaaggcgggggcggggcugccagggcggggcgcguugggggcguggccuugccgccccgccccuccccgccccgccgcuuaauucggacgcgcggggccgcggggagcgagagccgcccugcgccggacuggcuugcgggccgggccgccgcccccggagccgcccucgcgccgccucgggccgccgccgagcagucgggccgcugggcgccgccgcgggcgccgggagcgagcugggagggagccgcgcgccuuugugcgcgcgccgagguagguucgccucccgcacuuacuuuccacacaaagacgaggggcgcggggaggcgggcggcggcccugcccgaccccggcuccggggacccucucggcgggcgggcggccgggcgggugggggguccccgugcgcgggagggcagcgggcguacggggaccacgggucaccccgcgcggcgcccgggaggugccggggcucagggcgggcacgcggcggggccgugcggggggcgccgcggaggcgggggccgcugcggggaaggggcccagcggccgcccggcucauuguugccuucucggcgcugccgcgggggagcccuacccggcgcggugugcacugccuggccgugugcgccguaugcccgcccucggcgccccucgccccgcggcgcccggcguggaccgggucgcgccccgacgccagcccccgccaggcagacaaagccggggccggggagguuugccccgcgccgacgguggccgugacacugacuccagucugcaaguaacuuuuccucuuuugccucuucucuuucuccccuguuccagugaacccagcauauggggugguguaacacacacaaggaguccuaauucaauuuggguuccguaauuucccccaggcaucuuuaggucccuuggagguggcacugauggguauggccaaguguuaguguuauguaggggaugguguccaccacuugugaaaucugcaagaggaauuagguugagaggguaaacuguagauuucauucucugcugcaagguaccaagccugcuuccuuccucccucccaaagauuuuaggcaaugacagcggagcaaaguuacuugauaggaugggugcgauuuugaggggucaaagaaaaacggaaugagggcuguuggacuucacauucuuaaacuugcgauuucuugcuaucaaguacaucgguuuucuccuccagccacguuuuccuaacaucacuuuggaaauucuaucuauccaaguggcuuuaaguugaaauagugucugggcuaccuguccagagaagauuucuuagcgcugcugguuuccgguuuaaaacuuuucaugagaaaauuuuauauauuaauuaaaaaauugaaaauauauagaaaaaaaccacucauaugcucaccacccaaacacacccuaaggaugaaggcaucuuugcuuaauuuaugacuuggcagccauaguguguuugugugugugugugugugugugugugugugugggaaagaggguggggugguaaaugagagcauuacugaccagccacaucagccuaaaauauauuuaaucaugauaauucuacaauauugguaugccacuuacauccaagauuaauacggacaaguuguuuugaaauauauuuucuuauagguuugcauauaaccaccuguacagaagggagaagaaagaaacaggaaaaacaauguaaauuuccacuuuauuuggaagaaugggcugacaaaaaaguuucauggacuauauuuuugaauucaggagucauuugggauugacuuuugucuuuaaaugaaaucuuuaagcuuuaaaaauauuuuaaagguaacauuguguucugagauucauaagaaauaugugauggaaaggaauucuuguuuguggaacaaggaauagcagugauuguacaaccgggugcaugcuggcuucuuaaagaccuugcacugagaaaguaaaauaaggguuuuccugagaaucgugaguuguguugaguguguauguucuuuuaaaauaaaaucguucuuuagccacagauuuggccacuggacgcuuuugucauuacauacuuuuauuuuccucuuguaacauuuuuggacuuuugaauucucuaauaugcaaaauagaggucuuugagacaaccguuuagaaguagguugaucauuaggaugaugcaauacauuuugaaguuagaagaaucuacaagaaggaaguuguggcuguguccacucaggugcauuuuuguugcaguuccugacacucggggcgcuuuaaucugcacacacgcucaggggaguguugcggugcaguaguagccugugagugaaugagucaugcaugcagucugcucugaugaucggcauuccuucaggagucgugauguguuucugucugcaaaagucaaacgaagcuccaauaggaaaugucacaaucuccuaccccaggggacuggagauccccuuccuugggugguuaaaaauggacuugauuugcgcuucugagaaacugacaugugaaaucuuguuccugaugugggaggauggacgccgucauucauucauucauucaucgaaucuuuccuuugacuguuaauuguuuaaaaucucacaaguaaagguggaaaagaguuuuacugauuuucuuugggaaugguggagggguagaagacuucucuccugauggaaagaggaaagaugaggaauauggcuuaauguuauuccuaacuuaccuucugccccuucccuccagaauucugugugcaaguguuuuaaggaaaugaguugggaguuuggguaagugagaucuagauuuugggcauuuguagaaguccccggcuaucugggggaguugucacucuucuuucagccuagagaaggugacuaugggugcuagugugcuguggggcacacucgggggugggaaagcugcuguggagugggauguccucugugugcaucauggggucgaguguggccuugggaugaccucaugagaccuugcugcauuuccuuguauaguucccuugucuaaucauggccuauuuuugcuuuuccuucuugaaacaaaccauuuuucuccccuuuuccuuucuaguucaagaagggcugggccugacccaucugaaguuucccucacccuaaguacuuaggaaacgugcugaagaggaauggacagucuuacccaucucauaucccuaauuccgguaccccaucagugaaagaaagaaagauuauuuggcaagcuggauuagauugccauuuaguuauggugcauggacaaggggcuauuuuaagguugaugggggaggcuuugcuugucauuuacucuccauucaccagacauucagugcccgucaugugccaggcacuggguuuacugcuguuaacaagacuauaaggcaggugaggaggauauuuaaagaacugggcuggguacaguggcuugugccuguaaucccagugcuuugggaggcugaagcaggaggacugcuugaggccaggagugugagaccagccugggcaacauagugacccucaucucuacgaaaaauuagcuggguguggcagcgcgcuccugugguugaagcuacucaggaggcugaggcagguggaaugcuugugaccaagaguuugagaccaggcugggcaacauagugacccccaucucuacaacacauuuuuaaaaauuagcugggagugguggugcaugccuguagucccagcuacccuggaggcugaagcaggaggaucacuugagcccaggaguucgaggcugcagugagcugugaucacgccagugcacuccagucugggugacagagugagagccugucgcuaaaaaauacauauacauauacauaaaaaagaauuauacaaaauuacacaaaaauuguuuaauuacaguuaagagcugggaagggaaagcacugcuuggugaauuaagguaucucagaaagaaugaugucaaugccauugaagguggggguuggguuucugaugguggaaaugucagggugggugggugcggcgggccauggagcugcauagggauuugccuagcgcccaucaguucagagccugcugguaggggcuuagcugaacagaugagguggacuguucaguucugucuggaauuuggcugugggguucggacacuuugucgcuugggauugaagguggaucgggaaaccguaugguucugucccaguguccuugcugaagguaaaccucauggccaguagcccugggaagccgguugugguaggacgugguguccugagcuggccuggauuccagaagugaggacuuguaucaugcaaagggcacccaacuacagcugugcccaccagagguuuuguugcaaaugaaaagauaagaggaauuuguggggaaagagugagaagacuuauuuaagaacauuauucggacucagaugagcuguaggaaggaaaacggggagagagaugcagaaaaaggagguaauguugcuuugacaccaggugaacucuugacuuugggacugacuuuuuguuuuuaagugaaaauaaaucuuucagcuuuaaaaauauuuaaagaguaaaauugaguucugagauucaugagauguaugugauggaaaagaguuuuuuuuuuuuuuuuuguagaucaaggaauagcagugaucccacagcaggguacacgcuggcacugagaaagaagaagggcuuccccacaaagagggaguuguguugaguguguauguucuauggaaauagaaaucauuauucagccgcagauucuacauucuuuuauauucccugaccagagauguuuuaccaaaggugugaguuaagcauaucuuuuuuuaaaaaacuguagagauggggucucacuauguugccccggcugaucuugaacuccugggcucaagugauccuccugccuuggccucccaaagugcugggauuauagacgugagcccccaggccuagccuaccaaggaugugaguuaagcacacgugaauaguccuaaaacaggcccuguggucuguagugguguugggggcguguguaagucacauggguuggagacaauaauguuuccuccacacagcaaagucuugggguuucugcuguggcagagagacugggguguaagaacagcacccccuuagaggcugugagagggcaggggacccucugggcugcucagcaggccucuuccugguggggcugcuuaaguccuuagcagucgggagacuuagaagucuugaaguggggggggacacugagccccagcaacccucagguuauguauguguugucaagucucccguagaaacaagguagaaaaaaugcagguugcagacuggcucuuccgaccauggcagguuuaggugcaugagguuagaggguugugccuccucauucucucucuccuuucuguugucagugcugacuugaauuaugcuggaacaucuccaggugacagcccugccuggccacagccugggccagaggaguggaguugcugaacggagcaaggugcuguaggggaaagguguggagcugugagccuggccucucagggugaggauccaggccccagcucuuugaccuccagcaagucccguaaccccuugagcucuaguauucucaucugugaggucgccuggguuauaugcaccucccaugcaugguggggacauguggucccugagauuuggcaaaugagggguguuuaugcuguuaugccagugcccacagccuuucaaaaaauguucuuuacaaaauguuacugcgauaagagcacuuaacaugagaucuaccuucuuaacagauuuuuaagcguacgguguuuuauuguugacugcaggugcaguguuguagggcagcucucuagagcuuauuccucuugcugaacugaaaccuugggcccauugauugguaacuccccauuuucccccacugcagucccugacaaccaccauuccacucuucaagucuaugaguuuagcuacuuagaugcuucaucuaagaggagucacaugguauuuguccuucugugccuggcuucuuucacuugguccuccagguucaugcaugcucgugcuuguggcggaacugcuucuuuucuaaggcugccugguauuccacuguauguauauuaccacauguguuuacccauucaucuguccuugaugguuaagcugguuccacaaaacuccuagaagaaaacauaggggaagagguucaggacacuggucuuggcaguaauuacgcggcugccacgcuaaaagcacagucaacaaacccaaaacuaaaccagauugcaucgaacuaaaaagcuucugcacagcaaaggaaacagucaacggagugaaaaggcaaccuguggaauggggaaaaauguuggcaaacuacauauccaauaagggguuaauaucugagaaguuuaagggauuuccgcaaaucaacaguaaaaaaaugaagaacccaacuaaaaaaugggcuaaggacuuagacauuucaacucggaguuuuuuuuuauuauuuugucuuuuugagacagagucucacucugucacccaggcuggagugcaguggugccaucucggcucacugcaaccuccaccuccuggguucaagcgauucuccugccucagccuccugaguagcugggauuacaggcaugugccaccacgccuggcucacuuuuguauuuuuaguagaaaugggguuucaccauauuggccaggcuggucuugaacuccugaccucaaaugauccgccugccaauccucucccaaagugcugggauuacaggugugagccaccgugccuggccucaacucagaguguuaguaaugcagccggcagugaugucaagaugcggacacagggacacuuggaggaugggagcuuugucccuuguccccaccugcuccucaguaucucuucaugccuucaggagaguuuuaaagauaacuggguuuucauauuagaaauagccuguuuuauuccauucuuggacaagaguuuuggcauuguuccuaaagugucauaguaaaguguauaggaaagagggcugucauuacugugguauaagcuuuucugugccauuauuaauauaugggacagagcauacuuugugaaaguuaaaacucacgcuuuauccaaguuuuaagguaucuggugaaugcuaaugaguuuacaaaaauuguacagucuuaugaaaucuugcaguauaaauaaucacaggugguuugugaguguuuaauguagauguaucaaaauucccauguccuggaggaaguugagaaugccauuugugcauaugcguauguagagggggcuucauaauauucuuucccuuguaacuugauucuauuugaaacacauaaaacuggucaggguucuuuuucauuuuuucuuuuuuuaguggaugugcaggguaaaguaguguaucggaaagagagaggccuagacuugaaagauuuucagacuuuuaagccuaagcuugccaugaaugaguauaugacuuuugagcaugucauuauuucuguuucccagcgucgucuucuauaaaauggaaauagucacacucaccuacuucuuagaguugucuuagggugagauagaagccugcauucuuuaugccugcuuguccuucuagggaaugcucuggaauuggaacagcaugugggccaccccuuaggauaggugacucuuagaaggugagaggaggcagggcgucgggugugcaagagaaucagcuacaucaucuuucagguuccugcugcggugggugaauucuguuauucugugcccauggaaugggaggugucauagaagucauagacaucagacguagaguuugaccugagugagucaguugcccucuugggguuugcauauucuuaccugugaaaugcaguaauaauacugguaauauuauuauuaucaucaaugaacaguuuuuaaucaucuuauaugugaccaggcauggugucaaguucuuuaugacauuucuucauucauucagcaacuauuuaaugaaugcugccauaugccagucaucguuccaggcucuggggaucagugggaucacgggcuagcaugguggcugggacagacagacucccugccugcauggaguuuauaugcuagugcaugacagaagguaaacagauacauggaugaggugauucccauggucagugcuguaaagacaacuaagucaguucagggggcuggagucuggugggagagcagguuguguuuuuauuaggaugaggcuccuccgaggaggagaauuugagaucugagugaggcaaggggaugagccucgcagaaacaagugcaaauaucagcccaguggcuggcaggagcuugcuauggaaggaauggccagagggccugugugggaggagccagcggccagggcaggaagagagcugugcagugggguccaaggaggucuggcaggccacggugaggacguggcucaugaggaagccacaggagaguucugagcagggcgugcaggagauggaccuuguauuuugucagugugucccugugguuguggagggccacggggacugcagagggccaggaauagaagcagggagaccagccggggugccgcuggugagauggauuggaguugauacaagagagaaaggcauugugggugacaccugcucuuuuggccucagccuuugggugaaagauggugccauugauugauauggggagacugguggaggaugagcuuuaugauguucacaucagccucuggacuuaguguuguuuuauucccauuuuacagauguggagaccaagggggagagaaguaaaaaguuugcccuaggaccuggccaacaaggugaaaccugucucuacuaaaauuauaaaaauuagccaggcgugguggugcacgccuguggucccagcuacuugggaggcugaugcaggagaaucgcucgaacucaggaggcggagguugcagugagcugagcucgaaccacuguacuccagccugggugacagagcaagacucccucucaaaaaaaaaaaaaaaaaaaaagguugcccuaggaagaagcugagccagaauuaggauccaagucugaucuaugcccaagucuugcguuuucaaucauuuuugcuggacucuguacauaucugcauuuacucucauugcgagauugauacgaaaguaccugcagaaaugcuugggagauguaucuguuuuguuguuagcauagcuuuauugcgguauaauuuauauuccauacaauucacccauuauauguacacaguuguguaauuuuuaguaacuuuauaagggugggcagccuccccccaguccaguuuuuagacuuugcagucaguucccccucccacccccagucuuaguuaaucagugaucuuuucucuugucuguagcguuuugccuuuguacagguagaaucacaguguggccucucucuugggucugguuuuguucauguagcauaguguuucugaaguccauccauuguugccuaagacaucugcuuuuaaggaaccuucuuagaguuugucaucuaucauaagagauacccugugcugaugagaaaaagguccacugagaugugccuuaagaugagaauaaaaauaacaguggccagcauuucccgagcauuuguuauaugccaggcacaguuauggccauuauuuucugugauuucuagaaaucaguuguagaggcaccaaccaaugcaguuccaugagaggugccaugaucaguguuuuucaacaagggagguuaaaagcuugcucgggguuuuaagagcugggaucagacuugggccuucuucucauggagcugugucuuuacugcuucuucacacgcccuucaccauguguuugaggcuugugucuucguagccucacaaagagauugggauuccaguuggagaaugcauuugccaguuuuguuuuuuuuuguuuuuuuuuuuuuuuuggcagggucuugcucugucauggaggcuggagugcagcagugccaccauagcucacugcagccuugaacuccugggcucaagggaucuucccaccucagcuuccugaguagcuaggacugcagagcgcuucaccacucuaauuuuuaaauuuuauauuuuguagagaugaagucuuguucuguugcccgguuggucuugaacuccuggccucaagcaauccuuuugcguuggccucccaaaguacgggugugagccaccgugccuggcugaaaauuguaguuuuaaggggaauauuuguacugaauuuuuauuuuggcauuaccguauggagaugauagugucuuaaagugauccauuugugaaguauucuuaggcauagugucagaauggcaccaaauuaaaaacacauaauuaugucaucaggcagagccuguguguuugaguuguuuuaaauguuguguuuaccagaaaugccauuuuuguacagagugccccaaggcuguuacccuauuaaugaauggaauuuaauuaggcaucaugcauuuuucaacauguuuaucuaauuguauuauguauaauacauuuuacucucgaacaguucuauaucuaaacgguauuuuuuccugccacauauagucuauauuggaagauuucauaguuuuguauugcagaggaguucuuuguauaucccaagaauucugaaauuuuggaaaagauuuuaaacaccuuacacacucaaguagcuugguaagagcugguuacauaauuuuagccaugauaagcaauaauuuucuuuuuuuuuuuuuugagacagauucucagucucguccccuggcuggaguacaguggugugaucucagcucacugcaacccccacuucccagguucaagcgauucuccugccucagccuccugaguagcugggauuacaggugcccgccacugugccuggcuaauuuuuguuuauuuguuaauuuuuauuuuuauuagacaugggguuucaccauauuggccaggcuggucucgaauuccuggccucaagugauccgcccaccucagccucccaaagugccacugcgcccggccagcaguaaacuuucuugaauaagaauuaguguuacacuggguucuaccccugguugcugguagaacaguuuuuacuggugucacaucuuccuaaacuuucucaaauggaauuauggugucguuaaacuuauuuuucacguuuaguauguuuuucucuuuuaaggauuuuuaauuauaauuuuaguuuacuaguucaaaguagcaaacaaaaaagcuuuuuauguuagaauaccuaguuuuaagaauaaaaauuaagaauuaauaauauuaaauuuuaauuuaaaaagacuucguucaaaucuuuguugaucucuuuaucuggguaggaccccagggaagucugccauuuuuuaaaauauuaacccgcugaauggugggccuuugaaaugagugaaagaggucaaccauuguuccauauuuguugggcaauuccaggcagugcaguggccaguuagaaauccucacgacuugagcuggaagccugggggaaaguaggauuugggggcagagguagguacuggaauggugcagugaagaagcuguuaucuuccguugccaagggacucuguucagcuuuaaucuguguccuggcuggacggugcaugucagcugcccaggcuaccagugugcagggcgcaggaguuagaagcaggccccagucuguuucuuuuuccauuccagaaucgcuucugacuggcacaugccuugaagagaggagauauuaucuugcaaaacugauccaaguaaaauugaaauugcagggaguaaaaauugggcuguacauguaaugcaugcacuuuaugcaaguuaugccucaauuauauauuuuuaaaaagauacacgaaaaacaaagccaaacuacaaaaccccuggguagaaaugcaggauuagacacuguuaaggaugcaaaaucuaagccaccuguuagguguugucucuuuuucuccccuuucacuucagaggugccuuguuuugauucacgugauaaauugacucuggacagaccugugauuuuaugcuuuuuuaugugaauggcuuucccaugaagccucagaguugcuacgaaccugcuggcaaaaauuuccagcaaaggaaccuguacauuuccgcacuaguagccccaggaacugccucuuccuuugccaaagcugaaucaucuuaccugaggguuucuugguccugagcuggguguggcccagccauucauagccuaguuucugugcugggcccugaccuuucaacucggggauggcugggcaugcaguuugggaaaucagauggcacgggaucggggaagcccagggaucugcugaacuucccaccuccccagcauugauuucaucccuuauucacuuagaaauggcuuuucuuaaggaccaggauuugaacaaagucuguccaaugcauuugaugguuaugccuuuuaaagcuguauacauauagaacaguuccuuuacccccaccccuuccccccaugcuauugacuuguugaaggaaucaggucacuuguuccguagaauguuccacauucuggauuugggugcuggguuucuuuuaaacucaucccacuagucccuguauuucuguaaacuggaaguuaucaugaaagcuugaucagauucaugugcaguguuuuuggcaggauuaauuuguugguaucaucuggcuuaacguugccucagcuuaggaaaaggucugacugucucacguguagugauucuaaaacugagcguugggguccugugguggguggcagcuugacccuuucauuuccucaucgaucuuucucccaaugccguuagcauucaucgaugacuguuguuugaauuaauuauuucauuagagauuguugauucuucucucuuaaugagauggcagugagcaugagaugagauuuaaacugaccaggguaucggggaaaacugacaacauugauacagcuuaggggcaucuacagaauucacagaaaaaagcaaagauuggcuuggcucuugcaguuacugugagcgccuccuguuauuaaaguuaauuaccguuugcacggucuucuguggauguuacccugucagguuaauuuuguuauuuaagucuugaguugcagcaauauuaaauucugugcauaugugcuaacucucuuuuuuauguaacuugggugccuguucaccuaaguuaggagagaaugaccuagguuuaggagguagaauuccccgugauggugcagaccaugauagagaguaucuuuuucaauugucauuuuaaauuuucugacuuguaaggagacauucaugcucagucuuuucuuauaaaagaucagucauugaugaguuuaagauaacuagaggagaaugauacaucugaaauaguuuuguguuuucuucugcaaacauacggaagaaauggaucuuuuuuuuuuuuuuuuuuuuuugagauggaguuuugcucuuguugcccaggcuggagugcaguggaacgaucucggcucacugcaaccuccgccuccuggauucaugugauucuccugccucagccucucaaguagcugggauuacaggcacgugcuaccacacccaucuaauuuuguguuuuuuuuuuuuuaguagagacaggguuucuccauguuggucaggcuggucucgaauuucugaccuugggugauccgccugccucacccucccaaagugcugggauuacaggcaugagccacuacgccuggcugagaaauggaucucuuaauggcaccucucaacuucauuguuaagaguguuuggagaggguagauacuugaauuguuucuguuaggaagaaauugagaguuccuuuggaagaagcaugaucguagcgaaugaauuuaauuuacauaugcuccaucagcaccaggcugcacggugacauacuacauccgcaguuugauuuugggacaacuuccauacuugaaggcuaccagaauggaaauauauugauucuaacuaucaugggcaagccugucuuuugccacaauguguuguuugaaaccuauuuguuaaaaggaucauuauaaaguagguucuaggauucccauagucacagucucauucugaggagucgugcuguugaccaaacacuugauuucauauaaaucauggcugugaccaauaaguccuaaaagaaagaugugaaaacuagaaacguggaagaguuugaaaucauaaauguugcuucuguugucagagaggucuugagcuuggagaagccauagaaaugaagaggucaucuaaucaagauucuucauuuuuggugaauaaaccaacgcuuagauguguuaaauugcuugcccaagaccacacagcuaaugauuuguagaguuggaaccaaaacucauccuggaauaaggaccauuaguacguuaaguguuucuuuugaacauguuaaaugcuucuuacaugcaucauuuuuggauccucaugacaacccugugauuuaggacuguaauugguuuuauuuucugaggaggauguugaggcauagagacauugaauaucuugcccaggaucacccaggacugagauauauucacugcaaagaaugugcuuuucuuuuuuuuaauuuuuaaaauuuuuaaauuuugcuuuauguucugggcuacaugugcaguacaugcaggauucuuacauagguauacaugugccacggugguuuggcgcacccaucaaucugucaucuagguuuuaagccccgcauacauuugguauuuguccuaaugcuuucccuccccuugccccucaucccccaagaauguacucuuauucacccuaugguguacugccuucugauucauucagucauucauuucuuccuuguuauuauuauuacuguuuaaaauucauuauuucguguuaaaggaaugccuuauuccuaacagcccagaaacauugccuuucaaggacuuuccauauacucuuaaaaucuauauuuuuaaaaaccuaccagcucuaauuauugcagauauagucaguggaaaucacuagcuauaauaaauguuauuugaauaauugguaauugugccuggcuuacuaguauuugaaaaagcuuucagauuauagaugguucaggacucuuauaagaugucuagguaaguuugaacugauaguuucuuucuuuugauaaauguccuaugccaaccuacagcuuuaaaaauaauuccuuugaccauucuuuuaaaaagucaccacuuacucuuuuuuuucuuuucuuuuuuuuuuuuugagacagucucggugugucaccuaggcuguagugcagugauguuaucucggcucacugcaaccuccugggcucaagugauucuccugccucagccucccaaguagcugagaccaccggcaugcaccaccacacccggcuaauuuuuguauuuuuaguaaggaugggguuucaccacguugaccaggcuggucucgaacuccugaccucaagugaucugccugcuuuggccucccaaagugcugggauuacaggcgugagucacugcgcccagccucaccacuuauucuuuaaauucuuggaaacaucaugaaggaaucaacuugggauggguuuggagcccuccuucucucucuucuuccuccuuuucacuccccuucaguaacaguaacauccuggggagcucugaagcugagauuucauaaagaucagauguguuuuugggagacagcguguguggggugauggguggggaggaguggaggugagaagucacccuguggcaugggagaggauguuugauguugauuuucugagugucagccuccuguuucucaggacgguugguugacugucuuuuucucuacuugcgcugcccacaaagagccagaugugggugccuccggggguuuaugggacccacuuaccugugugaagcuggcuuacagagaggggagaauggguagacccugguagcguccagggagacuuucacgugggcgugguuuguacucugacccacuggugacuuuaaacaauuugucaucaaauaccacaguuggcuuugcagcuaucugguauuugugccuggaguagguuuguuuguuuuguuuuaaaugcuucuaaauuacaauucuuugugagcuuccuguuuccuacuuacagcugaaauaugugaugacugacucuaccaggacugcuuuuuuccccuuuucugcauuugugcuggaaacagaacagcuugcacgcacagccuggagcauguugccugcaugugcuucuugguggacgugagcacauggcugacuaauuucaaaaaccgccuauuuauauccucuucagaagcgcugucagacauuaggcacucucucuacuaacgucacgucgauuaauauggauuuuaaaauggaaguaaauuauuuuuuacucaugggugagucauuagauagucuuuuuuaaauauacaucccaccauuucucucaagggugucacacugguaauugucccaugcuggaguuuucagcaguuaucauaggauugagugcaggaggaggcuguggagaacaccuaacccucugauuuuauagaugaaaugacagcccaggguugcugaauuacugagagcucaaagcuccuuggugcaaaucuaggacuagagcucucuccucccguagcuucgaauugagcacaguguccuuuacugucacccaccuugccucacccuaccuaccccacaugcuggcacuugccaccacaaaagaauaaaaacaaggacaggaaacaaaacuuccuaguugcuaggguuguggugacgauuuuauagcagaaaagaaaauaauguuuaagauauguaauccuaaagaaacugucuuuuuuuggauguuuguguaagacaaauucuuauucauacuaauggaaagucuuaaaaacauuaaacaugaaaaauaguuguucauaccaugaaaauaagccuaggcauuuauuuaaauguaugagaacuaucuuugucgacugugucuguuguccacauuuugacuucuagggcuaagcaacuucccgcgauuggauaaauaugggaguucuuucuaaauaaauauaugagaauauauuucugugcauaaauacaugagaauaaauacaugaguaccugcauugugucuuacacugucauuauccucaggcuuuuuucagauguauguugucauuuauuaguuccgacacuggcgcauuagaaggacgaugaacuuuuugcuagauagaccuagguggcaugucguaagugcuuuuaucuuggugaguucaaguuuucucaucucugcagugugacuauuaucaggcaggaaaagcaccuggcacagugccuguacacaggugugaacagagguuagugucugcucccccaaggugguguugugaugugaugucauacgugauuguuuacacucucaccugaugggcgagacuauuccauucucauaggacucaaugagagagaguuugucccaggauuggggugaauguuucaccuauaucauccucuugggccuucuccaccugaaauguagccuaguuugauaagcagugguagaauacagagacagguuaggaaccugguggggguagaggguccauacuggagcucugggaucuaauuggagaguggaggagcgacccugggcucaaagguauggcugucuucauccauuugggcugcuguaacaaauaccacagacgggguggcuuaaacagcauuuauuucucacaguucuggagguugggaacuccaagaucaaagaugcuggcagauuuggugucuggugagggcucccuucguguuuuguagaaggccaccuuuuugcuguauccccacaugguggagagggagaucaucugccuggugucucuuuuucuaagggcacuaaucccauucaugagggcuccacuucuaugacuuaauuacuuccccuaagccccacuuccaaauaucaucacguugggauuagggcuuaaauaauaugaauuuaugguggaggaggaaaaaauauucaguccauagccauggccaaggugagcagaggcuucaagucuaugggcaggcaggauucucaucucauauauuuuuuucuuuuauuuuuaaaucuaccacagagacguucuuugcuacagguaggauucuuaaaagcaaagcaguguucugaagagaagguggguuuucaguggccugggauggaggaggauaaggaggaugugaguuguagaagugagagugaggcugaaggucaggaauugaacuagcacaugaggaauucgggucaggaggucaccaguaaccaggaguugacagugaugcggacucagugcccuugcccagguauuuuguugcuugcuggguuccuguuuaugcaggagcugauugcuggcugggagcaccccugcacgcccaagcaagagggauccagggucagcaguuaguggcaggagaacccccugagggugccuuguaugcagggagagugcauuuccuguuugguuugggacgagccugguccagguguaauuaguaacagaggcuuccuccuuacucagcaaugacugcuguggucgacaauuaauauggucacccuacucacgaguacuugguugcagagaaguauuuguuauguguaugagugaagauccugaccaaagauuugaccacacaagguucuguggugaguccaugguuuaccugucucaugggcggagcuuggcugccucucuuuguguacuuguuauuugaauuccaaagaacguucugcgccacacuuuucagagcucuuuucucccaguguguguuuuagauggccgucuguuuugucauugauaagcuaauucuguaaaccucagggcagcugcacaugcagcaucuguaauugcaccucuguaauuggcuggagugcucgagagacuguacuugcuuuuccuggcgccccccaggguccguggcuucaccuaaaggcuugguggcagggacuggugagagagggaagaggaagagaggagggagaggauucuuggucuucuacucaucagccugguugacaggggcugggaaagucugauucuuaguugacugccgggaagauggggcuugcgagaguggagggggcugaggugggguccagguguuacuaguggaggguguccagguucuuggcauuuugaacaaagaauuggacaaaacgcacaaacaaagcaaggaaagaaugaagcaacaaaagcagaaauuuauugaaaacaaaaguacacucuacagggugggagcgggcugggcauaggggcucaagagcccgguuacagaauuuucuuggguuuaaauacccucuagaggugucccuuugguuacuugguguacaccuuguguaaaugaacuaauggcucacuauuggucugauugguuauuugaaucagcaagaggggagcaaucagaggcugaagcgaaguuacaaaguuacacccugugccaacaucugauugguugcaggaagcaaccaauuacaggcugaagugaaguuacaaaguuauacuccugugcaaaugaagacuuggccugugaccagccugauugguuggaagaggggaccaagcagagguccuuucaguuucaccugccaugcagaaaagguggggguugcaaggggaguggccuccgguccuuuuguuacauagguguggaaaguugggguuauccuuuugauuuaguucuaggaagucagugugaaucggccuuagguucccugccuccagccccuauucuccugccucacaggguccguaucuuggagcuguuuauaauuguagggagagcacugcacguguguuccugguuuucuuuuggugugguuucuccaucccuuuugggaggaguugaugcacuuccuugaauuucugcaccaacuauuuuauuuggaucacagcaucuuacaggcuguugucauguuuugagacuuuuuuguuuauggugaaaauggagcgaaagacucugagugccgagggccauggggugcgaaagcauaauucucaucggcagcuggaccucggagguccuuuuccaccuugggguuuuccccuggucacuugguuauacacugcguuuuuccauaucugguuggcaacucugaggacagggacccuuggcauccucaucuuugugucucuuuaggguccuauagggcuuaagugcuucuuccugagucauugcugcuacucagcugagacaccaacgagcuacccagaucagacccagaguguugcugcuuauuuagguggcagccucagggcugggcaucaggagggccugucuugcuuggucccuccaucagucuuucuuucggacccaguaugucucagcaucuggaucugccggaguagcuaggaacuccuacugaaaggcaguguuuauuucuguguuggugucauuuuagucccacacuuccugaacucaaaacccucuuuccuaagacuugccaugaaacacuccuaugaacaacggugaccacgagucccuuucggggagagugucguuuuguacuuuguauugugucccaggcccuggauccugagggguggccuugggucuaggagagcgcucaacaggguucgccuauagaagauucuuccggugaauggacgaacuuguggccuuguccagugguuucuuuuccuuuuucccuguaguuuccuuccacugucaacuuuucccccuccuucauagcagcagguguuggcaaggacgugcccagauuaguuaggcccagccucuucuucuuccuccguccccacccaccuuaccuuuaggacugggguggggugaugugucuggccacaacuuccgcgaccacuuuuuaaaaaaauuaaaaauggagagccacgccacaugcuugugacuuccacaggugaaagaauacucagcucuagaagggcggaggugaguggguggugacuucccgcuaaggugagcuuggguccuguuuucagaguucuguggucugugcugcgguccugcgcuucaugucaucugucacuaaggugcagcagcagcuacuuucccugcaguaucuucaucuccgacucugccccgcgagggcccugacucucaaauaagacacaggcuguccuguuagccaagcagaagggauauguccucuucucucucccuggguaacuucugccagaugaagaauuuuccuccuucugguuucuuuaguuggagaaauaguaauaguaugauuuaucaggcucuggaaugagacugccgggcccaccuuccaggucugccguuuaccagcuuuggcuuucuuucuuucuuuucuuuuuuuuuuuuuuuuuugagacagagucucacuguuuugcccaggcuggagugcaguggcgcgaucuccgcuuacugcagccuccaccccgcuggguucaagcaauucuccugccuuagccucccaaguagcugggauuauaggggcacgccacucugcccggcuaauuuuuguauuuuuaguagagaugggguuuugccauguuggccaggccgaucucgaacuccugaccucaggugguucacgugccuuggccucccaaagugcugggauuauaggcguaagccaccaugcccggcgaguuucgucuuucuuaucaauaaaauaauagugccuccuucauagaguuauacaguaauaaaguugguguaagaguagugugccuccauggaauaaguacucaguacaacguuaaaacauguggguaggcugggugugguggcucacgccuguaaucccagcucuuugggaggccgaggggggcagaucacaaggucaggagaucgagaccauccugguuaacauggugaaacccugucucuacuaaaaauacaaaaaauuagccgggugugguggcaggcgccuguuagucccagcuacucgggaggcugaggcaggagaauugcuugaauccaggaggcggagguugccgugagcagagauugugccacugcacuccagccugggcaacagagugagacucugucucaaaaaaaaaaaaaaaaaaagaaaagaaaaaacaaaaacaaacauggguaugugguugcaauaacuuacacuucgaugcucugguacuguuuuuagaaagaccauuauuuaucucccagagguguggucacaguuuauuaucuaaucaggauuagagugaauuguuugaaaacuuaguguauauuuacggggauagcaaagaaggauauuugaaacugaaguauccuagcaaccuuggaucccuuugguaacccauggcaaacaggcugcugcugcuauucucuaugguugaagacaggguuuuauucuuaugugccauaacugggagugucaacuuuugucacaaagaaugugucaacaauaugccaaaguugaaacugucaacuugggcaagcauccuauacaauuuuaaacaauaccaaauucuguacagcugucuccuuaugauaaaugggcauugauuuuauuuauauuuauuuuauuuuuuugagacauggucuugcucuguuacccagucuggaguacagugaugugaugugaccacaguucacugcagcccuggacuccuggacucaagugauccucccaccccagccucccgaguagcugggaccgugggugugcaccaccacgcucacuugaguuuuacuauguuuuuguagaaacagggucuugcuauggugcccaggcuguucuccaacucuugaccucaaacagucauccugccuugaccuuccaaagagcugggaguacaaguaugagccaccgcgccuggcugggcauugauuuuaaaacugcuccugguguggacaccugccggugauggcagccagaauuagaugucugcugggaacauccugauggcuggaugaggcuguggcagggauggcucugaacgaacgucuuucaggccaguuaauuuuuccacugcauuugguggccuggaacucugacacuugaaucaacugcuucuugaguuguggaaugcaucugaggcugagccugacccggguuccagccgcuucccucguggcacccuaccgcagccacauuggccucuuugcuguuuucccuaagcagcgauucaggugcuugcccagggccucuguguuucuccagaucccugucaggaaaacuugggccaaaugugcugcagaggccuccgggccacccuuuauaaaugcgacaucugacgcgcaacgcucucuuacucagcucuuguuauuuuucuuccgagcacugcaccagaccgauugcagauaugugcgugcucauuugcaaauugccuguccuccuccuccccuggcccggccgcuagaaccuacauuucauagacuuuggguuuuguaucugcuguuuccagcagcagagacuugcuuuaguucuugcucugauuugcuguaacuucaggugcauucagccaggugagauugcuuauugaacuuaccaaagcaacagaguaagaguucuggagguuuuaaucacugugcucucaauaagccaacagaaggaaaugaucucugggaagaacguucugcagaauacauuacguuccaucuugguaugaaguuaggauccugggaggccaagugugaggauccugcuagcauuuucuuucagugaauuaaaaugauuuaaagagcagugaauuaaaggcuaggcauaauccuaugucuuuggccuuuaacaguuuuuuuuuuuuaauaaaacacagcuauguguucaguaugcuuuuauuuggcaugaaugaauaaaggcuuuuguccaugcuguagugcgcuguuccuuguguaacauuccauguggaaaacuucuuuuagacaaucauaccaugauauuuuuucuuuuccuugagaagauggauacuuauuuuuuuuucuaagaauguauaguauguaccuuuuuauuuuugguccuggcccccaggaaacucaaaaccacacuuaauacagagaucuggaaauuauauuagcccuuguguguaccacuugcuguuucuuuuguaggguggccuugacuuacuuacuuuuuuuuuuggcacggagucuugcucugucgugcaggcuggagugcaguggcaugaucucggcucacugcaagcuccaccuccuggguucacgccauucuccugucucagccucccaaguagcuggggcuacaggcacccaccaccaugcccagcuaauuuuuuuggauuuuuaguagagacaggguuucaccauauuagccaggauggucuugaucuccugaccucaugauccacccaccugggccucccaaagugcugggauuacaggcuugagccaccgcacccagccuggcuuucuaauguuauuuuauuuaccuaguugaauguaugacuuuuuuuuuuuuuuugaaaugaagucuugcuguaacacaugcuggaguguaauggcaugaucucagcucacugcaacuucugcuuccuggguucaagcaauucuucugccucagccucccaaguaucugggacugcaggugccugccaucaugcuuggcuaauuuuuguauuuuuaguagagaugggguuucaccguauuggccaggcuggucucgaacuccugaccucaagugaucuguccucagccucccaaaugcugggauuacaggcaugagacauguaugacuuuuaacacacuccaaaucuuuuuuggaaggaacuagugaaugacagaacaguuuuauccuccucuuaucuccuaauaugggguauugaguaacaaacuugguuuugaaauucuguugcccuugugugcuuuuacuuggguaaugcaacuaacagaaauuucuggauuugcuuaaguagaauuuccauuucuuugcuugauaaagcccaggguugcaauuuuagggcaguuaccagccagguagagagguaggaacgguuuugagaugacccucucacugguuuccucuguuuauucuaauugugagauuuugguuacuuugcaauagaggguuuagauaugcacugcuuuacagcaaccggguaacuggcuucugaagauugaauauacgguuucuucagcauugcuguuuccaaaagaguuuaguuuguuuucauucauugacuuagugccuuccucuguucaaggaauucuacuaauugguauggguguuuccaaaugaugcuuagcuggccgacccuucuuuggagaagcuuacauuuaaaaaaauuaauuuucacaauugguaugucaaauugguaauuauuucagaagcaaauuaagauaacaucuuagaaaaucaauuuauggacuugagccgagugcuucauacaacgaauggguuuuuucuagguguuugucaccgggaauuuuccugagaggcuuguauauauuaauagaaaaggaguguagcuuuuuuuucucuucguuauaauuuagguaaagucuuacaaugugugaacaaggcugucauuuuuagcuugcguuugaacgaaaacaugcuauacuuuuuggagacccugauugaguaaucaguacuugggguagugauaaaccacaggugagcuaacuugcggcauucuuuagauuaaaauuugaucgucauuguuuguucccaacaaugauuugccaggaaugguaugcauacuucucuucugccccauucuuccuuguucuaaucucuucuuaaauaguucuguuuuucuuuugcugaacaggaauucccaaguaaauaauucuuucuugugaccgagggugcaguuggugaggucuucuugccuucugaauggccaguagcugcuuccggacuccggaaaauaugucgcaaaugaagacugcuaucacucacucuauaaacaggaccagaaagugagcaauuuggcaagguccccucucucggcaagucugauggaucucuuuuuuuuccccagugaaggcuugucauauuuauaagccaguaguguuauuucagaaucuccgaaggaaaugugccuccgugauagggaagcaacuuguuuauucuagacuuuucuucacuauauuucuaacguugaggaaauuacucaaagagguuuggcagagugaagacagaugagugagacuggauugaguuuauggaauguauuaauucaacugauguuuguucaacuccaaaugaaggauccagcauccagggcacagauaagugcaggauauucgcccucagggaacuuccugucauuagggaggcuggcaccugcuugcaguuaacagaaauguuagcguaguugcucauucugcuuggaagcggaguucguuaccauuucauuuaaugaacuuuuccaaauggaaagaaagcuuuguacccgcacgcccuggcucuggauguggagguugagagcccugugaagcucuuauuuaaacaugaaaaugggugucagcuuuaggacuaaguuccacugggaagaacugggggaagggagccauuuuuagguggcauuagccauaccaccuuuaauaaaaaacuucguguaacucaauguauuuccuggcuggcugcaguuacagaaauauuaacuguccuaaaauguuuaucuuaaagagaaacgacuucaguauuagagaaugcacagaaaacuagauuauaaguaaauacuuuuguucacauuggggguuaaaaacauugggccugcuucaucaugguuauuaauguggaccuguguuguuacguuauaagcagagguuuacagaucugaguuucaaggcuuggcacuuggaaaugagcugagauuagcguuagagaacaaggccucuccugccaucuugggagcugaaaucccaggaucucaaccugaaaaucaggggcuaacacucugauauugaucuguauaccuucggaaauacaguuuuuaaaaagaaacaauuuuuaagacuagaacauuuuuuuuuauuucuucguacuaugcaaguuuauauacguagcuguaaaaggcaaacguaagcucgcuuuuuuaaagauucacgugaagcuguuuucuuuccgugaacggaagaguuugacagagaaacaccuugguaagcacacaucgagaauacguuauuagaacaugauucuuucuccauugggccccaugaggccaagcagaaaaauccagcaauagaaugcaaauaugagcaugcuuucuuuaagauguaucauaaacuguuuucugucagagaauggaaggauuugacagagaaacaccuuuguaaguacacaucgagaauacgcaauuagaauauugucucaguugggcccugugaggcaaggaggcauauccagccauaaaaggcaugcauguuuucuguaagauuucaucauaagcaguguucugucagugaauggaagcauuugaauagagaaacuucuuuguaagcauacauugacaauaugaagaaacaauuauugaucaaaaaagccaugcauuauuauguauuuuuuccauucugcuuguaaucaguguugcuguuuuuucgucguguuuaauagaggcaacacauuacugaucccaaauacucugggaagauuuaaucuaaaauaccccuucucuauucagggaucuaaucauuucuguucuuaacuagguuuucauugguauucucaacuuuucuaauaaaacgguuuuugggacuugcaaucuucuuucauuuuguaguaaguagccuuauuccuguuuuauagauagaaaaaaauaaaguacaaagauguguuugcacuguuagaauucuaaugccacagaauacuacuguaaauguuugguuccaauugugccaguuuuacuaauaucacauaguacagaaagccauaauuuugugagaguuuucccacuguucacugcuuucuaacucaguggcuuuuuguuguuguuguuguuguuguuuuugagauguagucuugcacuguugccuaggcuggagugcaauugcgugaucuucccucacugcagccuccgccucccggguucaaaugauucgccuaccucagacuucugaauagcugggaugacaggugcccaccaccacgcccagcuaauuuuugaauuuucaguagagacgggguuucaccauguuugccaggcuggucucgaacuccugaccucgugauccacccgccucggccucccaaagugcugggauugcaggcgugagccacugcacguggccaacucaguggcuuuuuaaaaaaucguggugaaauauacacaacgagguaaaccauuuuaaccacacugccgugcaaccaucuccaccauccaucuccagaacuuuuucaucaucccaaaccaaaacucgguaaccauaauacaauuccuccccauucccuucucccagccccugggaagcagcauucuacuuucugugaguuugacucuucuagggagcucauauaaauggaaucguacaguacuugucuuuuugugacuggcuuauuucgcuuagcgugaugucuucaagaccugucuaugugguagcauguaugacaauuuccuuccuuuuuaaggcugaaaaaugccuaauaucuguguuguauggauagaccacauggcuuauucuuucaucccuugcuggaucugacucaguguuuuuauacugagggucacagcccgcauuuuaaaacguaaaguagauuaggaaaugugugcccauaugggguauuuguauuguuuugugagcccgugcacacaugugucugucugcauugugauguaaaauguuuuucugguugucaguugcuguuagaaaaguuuggaagcuguacccuaaagaucuuuuagauguuagguuucccuggccccugugccugccugagcuccuuugugacgugugugguauucccuugguguccaggccaucacacagugcuuuuucuugacuguguuuguauugcucuccauugaaaagcuucuuggccgggcgcagugucucauaccuguaaucccagcacucucagagguugaggcgggcagaucucuugaggucaggaauucgagaccagccuggccaacauggugaaaugccuucucuacuaaaaauacaaaaauuagcuggugugguggcacgcucuuguaauccuaguuacucaggaggcugaggcaggagaaucgcuugaaccugggagguggaggcugcagugagccaagagugcaccacuacacuccagccugggcgauagagcgagacgccaucucaaaaaaaaaacaaaaaaacaaaaagcuucuuuagcgugugauccccaguacagggaaguacaagcuacuuaaacuagaaauucuaaaaaauaugccaccugcuuuauucagugcaagaagcuuaaccccuuuagugcuuauuauugacucauacagauaacuuaguuuuaugagcuacuuucccaauggucgguaaagucaguguuuucauuaaaggucaguaugaaagacuguuaauaaaggaggucauauuucuuuuccugguguguucuccgauggggcacacuguacccuaggguaauaugauuuuuggaauaaaacaggccuggauucaaucauccuguuauuugcuagcuguggccaauuauacacgaauuacgaagagauuucaccaucuucauacagaauuuauagggccauauaugacuuguguuggggguggagaugcuuuggggaaaagugugaauguaauguuauuaaaaaaucaaguaauuuuauuuccuacccuucauacuaacaguauaauuucguaauucuuuuucuaggaguugacugaaauguacuaauaaucugugagaggucugugugcuaagccuuuucucagucucgucucuuggccaauugugguccauuggauaaaaacaguaugucuggccugcuagucugaugggcugccaagagguggacaguugugaucagccacaugggcuuuguucugacacuugggugacgguggaagcuccugauuggcaggaacucugcaaguguaugugggagcaguguuucccaaaugcuguuugcccagggcacauuuguacugguuugcaaaauguccuacugaagauccuuguuaauaauguguagguuaaaacaacaacaaaacuaggguucaguuuugagauauuggauagauuauauccaccgugcauacauauugugaugucucaggguacagaauguaaagaguaacaguucacucuuacagauucaguugggaauaacugugucaggaugccugaggaauaucaccuuguuaucuauuuauuacauacuaauucaagauuuuuucucaggguggcaugcauauucaguaguguuuguguauuguacuaaacccuguucuuacugaacugagauuuugcauuuuuuauaagcagagcuuggaagcugaacccuuaagugucuacccuggucuuguggcauuucauguugagagcaccaaaauauucccugugucaugggaaggguagauuaugagagaaagagcagauaaacuccugggcccuagggugguuuuuuuuuuuuguuuguuuguuuuuauaucauguauccacaaugaucauuuggaaggaauccaagugaaucaagugugagucaaacagcauuguuuauagaugcuguuguagucuguucuaugcugccguaguggaauaccacagacuggguaauuuacaaagaaaagaaacuuauuuacuuauuuauuuauuuugagauggaguugcccaggcuggagugcaguggggugaugcagcuuacugcaaccucugccucugggguccaugugauucuccugccucugccucccaaguagccgggacuacaggcauauuccaccauguccugcuaauuuuuuuuuuuuuuuuuuguauuuuuaauagagaugggguuucaccauguugguugucuaggcugaucuugagcuccugaccucaagugauccuccugccuuggccucccaaagugcugggauuacaggugugaaccaccacacccagccaaaaauguguuucuuauaguucuggagacugggaaguccaaggucgagggccugcaucuggugagggccuucuugcugcaucaucccaugguggaagguggaagggcaaaagaggaagggggccgaagucuuccauuuuauaucccacuuccacauuaacagcauuaauccauucaugagguggagcccuuauggccucaucacuguugcauugaggauuaaguuucaacaugaacuuugggggacagagugaaaccauagcagacaguuuucagagcuuuccaccaagccuguuucucuccacagugcacugacugagcagggcugcggcacugggagguagcuggugucugccaugcacugggcuuggugcaggaguugaaauguacuugugggccagaugucaccaagugggcgucuauaugugccucugcaaugguaauuccacucuugcugcuuugguauauauuugcuauuuccuaauaauauaguaauaacaaucuagaacuggaaggaaacuccuuguuuuagaggggaggauccuucagcccagagaucauacagauauaguugggcagaguugggacuggaacucaagucccuucugcuugucguuuuuuuccaaucuaauauauauguauaucuacauacaccuauacauaacauauauacacacacacucuaauauauauauauauauauauaaauuuuuuuuuuuuuuugaagagauggggucucuguguuacccagguugaaaugcaguggcucuucacagaugugaucauagugcacuacagccucaaacuccuggguacaagcgauccucuggaguagcuaggaccacgggugcacaccaccgcaccugucuuccgccauguuaaacauaacccuuccccauagaaaauucuuagcacauuuuauaaagugggcugugaugccaugaaucccagccucaggagggccauucugauuggucucaggccuccaugcuguagguguuguggugaugcucuaagaagugcgagaacuuguccuccuccaauuggagguugacucacgcaugcuuccugcagucagguugugugaguguugcaaccugguacccacccagggcuggagagucugcgugcauauuugcuuacaaguagaggagcugauuuuuguacagacaaguacauuucaccagugcugccagcacguucucuuggucuggaaggucaguaacugguaccagaguugguacgguuuguuuuucauuguuugcucuggcuucugugccggaugaggucauucaguugcauacaguuccugcuuucagaaguugcuagaguguuucucuuugaacuugaacuguggcucuuuugauauccagaaagagaguucuuuguggggaugguuaauucuuguuuugggugcuuuucuucaccgcucuaaggaacuaccacagucagaaggugcauucuuacugcgaucuuuuuauuugcuaccuugggcuuaaggagccugccuauaucuacugaggugagguuaggucagucucuguaaccguucgucacuuaggccuugaugggugacauggauggggaugacuuccugggcuaacucuucucuugcuaaaggaugauuuuucaccaccuugaaugcccaugauuaaaacauaaacaagaaaauagauaucugagguaagaauaaacacugggacuuuucuauggcuguugaauaauguaguccuucucuagaaaauguugugugaacuuagacuuguuaacacaauagcagacuuguaugagacuaaauaaaaauuauauguuguuauagugagugguauugaauagugugucuuugccaggaagagagcuuuguaauaggcugugucuuguguaguugugaacuauuuuuuuuuccuaaaauuucuucagaugccaaccaugucugucaaacucuggaugagucgccuuuuacuuagcuuuuuaagaacucuuuuuggauucacuaacuuuuaucugcauuauuuuauccaugcucuauuaagugucuaggauccugauaauuaugcauuuucucugaagauaucuauuuccaguaaaauuugacuaucuagugaagauuguaggccugauaauauauuuugaaguacuuguuaugaucugaaugugugugucacccccaaaaaugcauauguugaaauuugaaccccuuauguuaugguuuuaggaggaggggccuuggggaguccugagaaugggauuagugcuuccaggagaagagacaggagagcuuuuuucucacucucccugcuguccaccaugugaggacacagccagaagguggcugugugccagucaggaagggagcccucaccagacacccgaucugcuggcaccuugaucuuggacuucccagccucuagaauugugagaaauagacaaguguuguuuaaggcccccagccuauggcagcuuguuauagcagccugagcuaagacauauuugauuuuagcaaaauagcacuugauuugaaagcauucugcucauugccaucaccuccuccuucacaguuguggauuaaaaaaaaaaaaaaaugaacacaugaccacaacaaaacacugauaugugcugaguuuaauuuacuucuuuuuuuuuugagauggagucucacucugucauccaggcuggagugcaguggugcagucuuagcccacugcaaccucugccucccagguucaagcgauucuucugccucagccucccaaguagcugggauuacaggaacucgccaccaugcccagcugauuuuuguauuuuuaguagagaugagguuucaccauguuggccaggcuggucuugaacuccugaccacaagcgauacgcccaccucagccucccaaagugcugggauuauaggcgucagccacugugccuggccuuuaauuugcuucuuauuccuugguuaggauuagggagagaaugucuuggguggccacuguggaaacagcauuuccaguaccugucgguacuugucuaaggagauuuaaugcucuccuuccucuugggcagucauucucacaguggcuauggcuugucuugcuacauacacuguguaaccacccugcccugcugggccuugguguacacagauauuggguaaaaaucuaauguugaccuagauaaacaucacacacacacacacacacacacacacacacacacacccaccacauuuuuuugguagguacguuuucaaugucguuucauuucagaaaaaauaugggcuacccuuauauuaacauaggacacucaauuaccuuguaugcauucacauuuauuuacauacaguuuuuuucuguagcaaugauaaaugcaauccuaaguaauauuggcuuaauauuuggaugcuuuaauuuauaaaagcuuucccuuucuauggcucaugacagugauuuauauauuuauugguagcucuguuuuagaaaagcgacugaguugcuggguguuucugcccuaguuucugguuuccgggaaccucugggcucgcccagccugccugguuggcuguuggcugaggcuggccaagguucuugaaacuguugacaccugugaagcucucuguccaucucaguaggcgcgagagucccagaucuuguuuggggaagcacggccuugcauugaggagggagaagggaagaaagaacuugauuauuucagagaagagacagaggaaccuugguuucccucaaggucuuaagucuggaguaccugucacuucugcugaccugugagcugacugugugagggcuccaccccuccaguccuggccuauuuccaucuuucccaaaacuugagaggaagguuacacugaacagaaguaccuguguuguucuugaguugaggaauuuuuuucugcuauauuuuuuucuaaaugaugcuaaaguuuuugcuggaacaauauguugagucugucuagcuuccggaggacuuagaucaccacauguuaugaucuuaacguaacacaugugugcaugcaugcaugcacacacacacacauaugugcacaaugcaaacugcagcucaccacaacacaacauguacccuccccuuccuuucauggggauaggauaacucgaaucuuccuucugacuuuuauugucaagaaauauuuucuacacucucuauuucuauaucaguuguuggcaguuauaucugcaaacccaugaggguuuucuggauucagauaacacacaucauuuguggaauaugaggaauuuaaggagacucgagggugggcaaagauuugaauaaacaucagaacgaggaugauuauuugugaaacagaccuuugagaauugaguuccaagagcaacagaccuuucgaugagaaccaaaaaauucauucuguagcucagaaaauuccuaacuucauuucuucaggauaaacaugucauuauaccaaauagcaaucucaguguguuaaaaucuaccuaugcacugugucccacagacaucgucagaugccagcucuccugguguugccauuuauuauguugccgacgauucugggauuuaggaucccaccuucaugcccugucucucccccuccuuccagguuccugggacugcucuuugccucccccuuccaccccacccucucucccuuccccuccagccucuuccaccaggugcugugcuccugccuugggaucagccagcucccaugcugccuccuuccccaguaucuucaccuccuggucuaacccagagaucagccacccuucuccuacccgaguaucuucaccuccuggucuaacccagagaucagccacccuccuccuaccugaguaucuucaccuccuggucuaacccugagaucaucagccagccuccucuuaccugaguaucuucaccuccuggucuaacccugagaucaucagccagccuccucuuaccugaguaucuucaccuccuggucuaacccugggaucaucagccagccuccucuuaccugaguaucuucaccuccucgucuaacccugggaucaucagccagccuucuccuccaguaucuucaccuccuggucuaacccugggaucaucagccagccuccuccucccccaguaucuucaccuccuggucuaaccgagagccacucuccgaguucagugcugccuuggcucccuugggaaugggagugcaccuucucccacccuguaugugccuugggaucuggaggcagggcuuagguuccugcccucauggccacuuuugggucaugacccuuccccucgcugcugcuuugagccuugucucagucguauucuguccucuacccucagugcuagcauuucguggucguagcuccucauucguuccuugaaaguuuuggccccuggcucacagucaucugcugcaggggucaguauuugucaaagcucaccggggacuccauggcagccggagcugagugaccagcagccugguuugccugagacuggaguggcagcaggagcuuuuugggauggggauguucagucugaggacuaaggaguuucacaggacgcaggacuuucagugcucaaacuaggaggaggagguuacccuaaaaagacacuguuaauaccaggaaccgcuucugagcugaaauccagagauccuacucaccagaagcuucuguccuucagcucagcugacagauuacaauaagaacaucagauuuuucccauuccaggucccuuuccaaccccucugcuccugcuggacuuugccucugcuuuugaauuccaacauuucagcgaugcgcuugucaacgcacuggaaucccuuacuucacucuccugggggauugggcggcccacccaugccugucccuggacuucugaguucugccagagaaaguuacacaguugccucucuaugauccugaucucugccucaccagggccucaacacugccuggaaaucaaauuuuccucaucaacccucuuccucuccauaaugacuuuuccaaccuccuccacacuucuuaaaucucuagguucauacugagcccaucccuccuccucucauuucacucucggcagauuaucuuuccacagcucacgggacagucgugcgaaggccauucucugaccuucccacugccccuuugcaaauccgccugcucuugggccuguacuuuucucauuuuucuguuuauagugaaagaggaaucuuauuuauucucuagaaauccauuucugcaccaccauucucucccaccuccaauuuauuuauuuuuauuuauuuauuuauuuaauuugagacagagucucgcucugucacccaggcuggagugcaguggcacgaucuuggcucacugcaagcuccgccuccuggguucacaccauucuccugccucagccuccaaaguagcugggacuacaggcguccgccaccaugccuggcuaauuuuuuuguauuuuuuaguggauacgggguuuuacuguguuagccaggauggucuccaucuccugaccuuguguuuugcccgccucggccucccaaagugcugggauuacaggcgugagccaccgcgcccggccccaccuccgauguaaaccucucuccugguauuuccuucucaugagcauuuacaagugcucaggucucuccuaucuuacgacaaaaacagaacccaagcucuucuuggaacucuccucuuucagugaccacuuucucuuuccuucucuugaugaaacauuuugagagcauguucuacuuucugccuuguacuauuaccuacugcuacacagcaaaugauugcacacucaguaucauaaacaaccuguguugguucccucaccaguuccguggcucaggagcccgggcacagccuagcugguuucugugcuucaggcucucaccaggcugcuguccaggugggcgccagggcuguggucucaucagaggcucgacugaggaagaguguuuccaggcucccucaggucaugggcagaauucauuucccugcaguugugggacgugggucgccugcaguuccaugccgcacagguccuuacuuccuuucagcuggcaaggauggaagauugcagcaugauggcuucacaggagugacaucucaucaccuuugcuaucuucuguuguuagaagcaggugacaggugaacaguagguggagaggaaugugggaucaccuuaaagucacuguguuaccuacuuauucuuucauuccccuuucacuccucaauccauuagauucuguuuuuuaucucugcuacuuuagugaaacugauaccagagggucaggauuggcuacaaaauuuucugggcccagugcaaagugaaaauacaggguucuuuguucaaaaauuaagaauuucaagaugguaacagcaaagcacuaaacgaagcguagggccccucaggcaugggggcugugaaggucccaugcccaugaagccagugcugcagagaggccuuagguccgcccugcugcgaguuccacagggcccucugguuguguuccugcuuggccucucagcagcauuugccagcugggauuuaccacuguggagcgcauccuccucugugaaacaucccccugcccucugagcgccugagacacucuccccuggguuuccuucucucgcucgauuauccccuucagccuccuuugcagccuccccuuccucuccccaccccuuuguauuuggguauuuugaggacacuuuugccacccugcugaggaauaucagcaguuucagccgcuucguuugcuguaggauuuuggcugucauaucuacguauccagcccauaccuaacuugugagcucaagcaccuaugucagugcauccuuuauagucuugcaugcuuugcagguaucuaaaaugcagugagucuguaacacauuuccuuguuuucucugauccauugaacugguucuuccucaguguccucuauuucagcacuuggccucauucuuuccccggggagucuggguuuguaucugugugcuaaccccaggcuugagucccaucuuucuucuggcucaucuugugcuccaagcccaugcgccuaugucugccgaggguucuccccuuggacugcauuucaucaaaugcucucccuggacuucuguggucuguucucauggugaccucggcuuccucuguuaaaacccagcacacuucauugcuacuccuuugucgaaugccugcuucccccaguagaaaauaagcuaugauaaauaaguccacgaggcagggaguuuuacugcuuuauccucagugucaagacauaugccuggcacaagcuguacacucaauaaauacguguuuuaaugaaagaguuuguuuuaauuuucagcccaauuuuuuaaagaauuaaauugauuuuuuagagacagggucucgcuauuuugcccaggcuggucuugaacucuugggcucaagugauccuccugccucagacuuccaaguagcugggauuacaggcaugagccaccaugcccagcccagcccaauuuuucaagugugaccauuuuguuguuuuagaacgaaaguguagaaaauacuauauauggaagaguaggacaaugguauaguaggauuccuguucuugagauauuagaaauaucuguaauguuauaauagguuugggccuuucaguuggauuguuaguaauuagaaaguaaagcuguaacaggaaauaaauggguguuuccuuauuucuguugcgaucugggcacuaacagguggaaggaaacuggugccauuugcccugcagaauucacagaauuaacuugugcaauuugggugggaggaagucaaaauaggugaugauuaaccauggagaugaguguauuucagauacugucaucugaaucaguuugcccuuaccacagcaaaaauguuuuuauaauauuuuaucuuuuuuuuuuuuuuuuaaacaaauaaguggugagguagucauggugagagaucugcaucucugauucuugggggcacuguuuccucacaaaccugcaguaucugcuuugaaaacuauuuugauauagaauggugaaauggaucaaguauuugggggccuaauuauucagagacuaaauguggccggaagaggaagaauucuacccaagaaagcugccgcugaucugcucaacgucucggagcagucuuuuuuuaagcagaagucaguaacaagcaaacacaaugucaauggauuuauuaaucuguuaaacucuucauucuguuaccugcugggucucaaucuuuuugaccucaggaccccuuuacacuguuuuaaaaaaguauuugagaaucuuaaagaacuuuuuuuugguuauaucuauugauauuuuacuauguuaaaaauugaaacugagaaauuuuaaaaguucacucaaaaauaacaaacaauaauaaaccuguuacauacuaauaaaaaggccauuuauaaugaagaauaaccuuacuaaaacaaaaaaaaguaugagaugaauguuucacauuguuuuauuuaucucuuuagugauuuuuuaaagugaaaaccaaaaaaaaauuuagugagaagagcgacauuguuuuccauuuuugugaaucuguuucauaaccagcuuugauagaaaauagcuguguucucaugucugcuucuguaaucagucugucgggguagguuguuuugggggucauguaugcagaaaaucuaguuucacacaguuacaucauugggaaaggccagagaauugaaauaaccuuuucagauaauuacggacauucuuccuugauaccacaccaaaaccugaugagugguagugucugaaagguuaguuacaauauucugaagccauagcaaugaucuuuccuacucuguuacauuaaaauuugucuaucuugcauuuugaauaggacgauagaggaauaguuaagucaccuauaauacauucauguaauggcagauuuugcagccauauauugaaaaaguuauuacagguaaaaugcuuacaaauguaauaaauuaucuauuuaauaucccaauuuugcuaaaaaaugaaaagagguguguauuguauuaguugaaaggaaauguaucaaaauauaaauauuuuaaaugaugcauucaugggggaaauuuucuuuauacuuuucuguauuuuccaaauuuugugugaucagcacauugcuuuuaaaaucagaagaaaaaaaauaaguauuuuuuguuacgagagaaaugucuguuaaacuguuucccucaucuguagguugccuucuacguguaaaaccccaguauuuccaauuugagugguaacaaagaucuguuuucucccucaaguuuuuauuuguuuaacagacuaucguaaccuuucuguggcuguuuuaagcuucacaguuuuuccgcuuuauuucaguaguaauucauugauugaauagacaaguuuugacuuguucaagaaaaguugcauaaauuaaacuuucacauguagcagagacauaauuugcuuuuucucauuucuguuauagcucaggcaaguucuauuucuuaucuaagugaaauggcaaaagaauaucuuguccuaugggauaacagagcuacucucaugguugagaaauaacauggaaauuagcaugcaaucgacuucugaguuauugugucugagcuguuugccaguggugugagugucacaguuuuauggcuggaaguucaaguggcuucagaaaugcaaagggcagcucacaucuggggauuaguucccugcuuaccccuggauuuagaaaggauguuugcaacuaauaauguggcugacgugguauugucguaaaggauugcuacuuccagaauuuugucuuuuguggacaggccuccaaauuugaugaucaucuguuuuccugcaaguggaagauuucaucauguuuguauuucuuuguuuuacauuucuuaugauauaguugauaauuaagaugccuacagaagcuacaaagcacccacaaagcaggaaauuagcaacucugccucuaccacuuguaguaaagcuugaagacauuaucacugacuucuccagcugaauguauuguucuguggcuuuaguuaaaugugucagugacucucaggguuuagaaucucucccaagacuguuuaggaaggugcaucacccuuugaaguguagacugugauggaaaacuacuuaauugcauauucuaauauuguuuuagauuaaaagaccauucuguccucugcuuaaaacaauugaggauauuauauuugagggcaucccuacugguuaauaucaucauuacauuugaaaauguucaaauuuacuuuccaucacuaaguaugaguugaacuuuuuggaguagaaaaugcacucuaaggccgggcguaguggcucacaccuguaauccuaccacuuugggaggccaaggcggguggaucgguugagaucaggaguuugagaccagccuggccaacauggugcaacccugucucuacuaaaaauaccaaaaauuagcugggcgugguggcacaugccuguagucccagcuacucgggaggcugagggaggagaaucccuugaacccuggaggcggagguugcaguaagccaaggucaugccacugcacuccagccugggugacagagugagacucugucucaaaaagaaaauaagaagaaaauauacucugaguauaccuaaugguuuauucucuuuuauuguugaauccacuauuuacauuucuuucuuucuuuuauguauuagacuggacuaggaaagguuuacagaucuaaauaaggaaugaggaguguuauuaucauuguauugccaugaccacaaacugcggggccucucgcccuugcccuccccccugugguuuugaggguaggaagccuuaccauaacccaguuccugaucaugccgccucccugccgcuuaccuggucaggccucuucgcugucccuaccuaccccaggccucuguguuugcugcuccgucugcccaaagcucuuucccuugguagcccuuggcuaugucccucacuuccuucaggugucugcugucuucucagcgcgguguuucaugaauauccacaauagugcacccugccacuccauugccuuaccuguauuucccugcauggcacuuugcacggccugauacuauauuucccucgguuugucaguuggcugccugccccugaaugcaggcucccaagagggcaguggcuuuguguccuuugcugcuaggcccauguuguugugaacagugccuggcacuuaauagacacagacuaaauacuugaugaauuaaugggaggaugaauucaccagauucccucuugugggugacucuacacaagauggcauuuacucgccagguguccggcucccuucaaaagacagagaaugauggcugguuucguuguagcuugacucaguggcacacccugugccugacacccaguugacagauguguagggaacaaaauuaugacgggauggccacacaguuggcuguuuguacucauugcugccagcugucucccagaacagucaucugcucuguagggggagaaacagggacaugaaaagcccuggaagguugucaggaagcaauuuuaaauuucuaauauguaaacaucggggcuuuggcauauuuugaaccauuuugaugauaggaauggaggugguaggagccacccugauuaaguucuuguugagaauaaacuggugcaccagacauuuacauaggcugaaucaauguugauggcagccguguuuuuaauccaugggccuaaaacagugucccucauaccugucucuugcugaggccccugucgcaggugagccaugucugacuuccgagccuuccaucgacugcucaguccacgucuucagcccuauuucccaagcuuaccuagugaguccuccuugacucaggcugguuccuccauuguuucugccaccugcaggccauuggugcuccuugaauacccuguggugucaucgcugacucgugccuccagggcuuucccgcucugacggcucuguguuuccuauugcuucauauagcuugcuucugaauuagcaugcgauaugugacacucauauguuauguaucuugguuuaguuuuuacagaaagaugaaagacucuuaaaagggaucuuggaguuguucuuguacaucuuuuauaucuccuaagccuuugaugggcacuuguuccaaaugggaaagaaaaaaaagaugaaaaaaaaaauaagccacccagaaugcagaugggacaaacuguugguguuagagcaugguggucacccaggccuagagugugggguacacaaggaccacugaacuaaaacucucugauggucuggaucaggcuauugaguagagcaacggguuguagagugccuggcacgcagguugcaaugagauuggggaagcaaggguugugcguuuguuaauucagagauuguaugaaaauggaaagaauuaggaggagguugagguuuauacuaguauuauucucuccacauuuagagaaggcucuuacaguuccuuuaauccaauacuacacaaaaaaguccucugagaggccgggcgcgguggcucacgcuuguaaucccagcacuuugggaggccaagacgggcggaucacgaggucaggagauugaaaccauggugaaaccccgucucuacuaaaaauacaaaaaaaaaaaaaaaauuagccaggcgcgguggcuggcgccuguagucccagcuacucggagaaggcugaggcaggagaaucacgugaacccaggaggcggagcgugcagugagccgagauugcgccacugcacuccagccugggugacagagggugacuccaucucaaaaaaaaaaaaaaguccucugaaaacugagugagaagcugcgggcuuauaggacugaaguuuggugcugaaauugcuuaggggacccuuuucaguugccuccucuuuuuuuuuuuuuuguaagagaaccgggggauuuaaaucucccugguaugguuuccauuagaauggaagcucuuuggcaggucugccaggaccauuuaucaccuugucccugguacucagaccucggugcuggcaaagcugggcucaugaaggcuggcugcgcagguggguggcuggcucacgcgcuugguccuggaggugggggagaagagaugguccaccaaaugguucuugcaguucuccccguccugcccucuggacauggcuguguuguggcacaggccguguuguacuuguggcugaucuugaucgauucucuucucugcucccugugcuggagcuagacaccagguguuuuuuuuuuguuuuuuuuuuuuuuuuuugaaguuccacaggugauuuugaugugugagccgugguugaaagccacagcuggacugcguuggaagggaaauggaggucagcuuaggccaguugguucacauggaaaucaacaaaaccagcguggcuuugaaggauguauaauucuguuacucuuuguuggacccacacaacucagcaguugaaauuuauuauuaguuuuuuuuucuccugcguuuucaucuccuaauuugggcuccccuucauauagagcuuuuggaagcaaguaagaauucaaguucaucaggcacauuuucacuacaccuggcagaacauauuaagguguuguguuuuauaaaauccagccagaaacuauagguggucuccagcuccacacacuuagcaaggccccugcucaacuccccacccaaccccaguuuuccaguccuuccugcguucaccagaggcacagucaggaucaccuuagacgcugaguucagaaauggagaaggaauacaguuaaaaaaaaaaaucaagaucaggugagcaguagccagauggcuucuccacacaacucucuuucuggaugcuucuggaaauugccauccaauuuuggucauucuuuuggcuguauaauaauucaaacggugcuuugugaauaaguuaccuuuuaaaaguuaugcauuuuagcaucuauaggaaggucaaggaauuauuuuacaccucagggugaaauaauuuaauuagguaucuuguuuacccugagucuucugaaagcuagagggagcaaauuggagcuuuugaaagagugugugugcgugugugcguguaugugugugugugcgugcacguaugugugacugugcgcgugcacguaugugagugugcgcaugcacaugugugugaaugugagcacgugcacgugagugugugcacacacacacugguggggaggcaggugaugauggguugugucaugaaugcccaagucuggcggugcauuuaauggaguaguccagggaagcaggaggaaacugaggaacagggagggcaagcuugaggaauuaaggaauuaccuggacucacggggaggagcucaaaagacgaauucgaucuuuuucuaaaaacauuuuaaacaguaguuugccugacuccaaaucaggaagagacagcuuuaccucaucucuccugccuccuagccugugggcuccauuagcaagggaugaacuaucgaguaagagcuggcacucuggcaucagguagaccuggcugggaccuggcuggguccuggcuaggccccggcuaggccccuccaauggcaucaccaugggcaggcugcuaaucccccugggccucagcuacuccuccgucaauaaggauaauaauaccucccucgcagaacuguugugaagguugagaugaaauaugagaguguuuaaagcagugccugggaugcaguaagcacuucgaauguuaaccaguaguagcagucauauuuuuguggauuaccugggaaccaaaccaucaucauugauauaauuucuauuaccaguuuuaaacaguuaaaugacaaagaaucccauuuuaaucaagacauuacaguagagcacagacccaaccugguuggguacuuaguagggagaaauagaggcuagaaauuaauaauuaugcccaauaccagugaacagcuguuuucgcacugugaccaguuuaguacaaauaaaaauguuuauagacugcaucuuuucuccaugcacaauuuauugagguauuucaucacuuuaacagaugauaauugaacauuuagaauuccuagccuugaagauccagcgagguacaaaccagaaauggcccuggccccuagguagcuaaauaucuagaggggagaagauaaaaaacacacauggggcuggcaauaaauuaaacaauuacagauggugagaguugggaaacaagcuuaggacagagacugaccacggagggacccguguuggauuguugauccgagaaggugauguugaaauacagacugagaaggugaggaagagccaggggucaggagaagugugggaagggggcuggcuugggagggucaugcgcuccagguggggacaucaugugcaccaagacaugcagcccagaaagaguuugguguguuccaggaaugaaggcaggccuguguggcuaaggcgcagggagcaagguggcggagagacuggcaugaggcaugagaagcaggcccaggucagaucagguggggagugagggccgcugccagggcauuggagaagcuauugagaggcccugacaaucccauggggggaaaguccauucuuagugcacguuuccugcuuugaacuuuuucuauucaauaacgaaaaccugggugcuauauuuguuuuagccacaaaacuaucuggguaucuuugagaaguggcacuugcugagguggccuucuaaaucuuugccugcuguuccauggcaggaugccuugugaagccagguguggcuuguggccuagauggaccagggagaucucaagugaggggcaguagcacggagcacacaguaggugucagucaagucuaaacguugcgcacggcuuuguuuuguccagagcugagcucucguuaggucggggcuugacaaauaugaauauuguggccugggcugcucucuggcaugcugagugcugacugguguauuuccuuuuucagccagagaauccuggucaagcccugaacaguccagaaacucugaggucagcauuucuagaucuucugugcauuugggaggagucaccauugaugacuuuaucaauuguaaauuuccgauaucaaauuacuggccuuccagucagucgguucugaugacaggaaggacgagggcucuggaaagucacuuuaagcuagucauuguuagucaaauagugcuguuuuuguauaucgaguauugagaagggaaugugcuuggucugucuucucucucugcuucgucaccugccaguccugagggccccaggcagcagugcagcuuuaauguggauuccuauggaucagagguguccuagggcucacguuguuauucugcauugcacuugcagccagguaaaaucagauuucuccuguuuccccuuuugggggugggguguguggauuugaaaggccugucacguguggccugauugcacugcccaguguguguguguguguguguguguguguguguuaaagaugucugcaaguuuagcacuggccuguccugauuagugaggaccucugauugccuaggccagggcucaggugagaauacuuugaugcugagggguaaacuugccuucugaaggcacagagccuccuggguggcagagcaaggacugggccuggcguuucugacguuuagaccuguguucuuugauaaagccaugauguuuaauuguggagaaaaugguucugcagcagaugcagugaggaaacaaauaaugcccaauuuuuccaagucacugaaucaaaucuuuaucucagaagugaacauuuuaagagaaaacaaaauuuauuucuugcuaauggcgugggaacaacuuauuuaaaaaaaugagagugagcaaaauaaaacuagauuaaagacagaaguaaaauguuuagaauaguuuguuuuauaaucaggcauuaaauuaugucagugggaguaugauuccaaguucauaaugucaucacuacuuaauuaaaauaauagaugucuuuguaagucugcuuuuguuagauaauauuauuuaauccaguagucaguuuuauaaucaauguuuuuccuugagguaaaaaaacaucguaugacuucaaauuauuaaacaacuuuauaauaacaauguccuguuuccugaacauuuauaaauucaauuuaugucauuuaggcuuuaugggugcuuuucuccaagucaagauuaugacuuugguuauaaaucccucugguuugagaaaguagugauuucuuaauacuuggaagauaguuuuuauaauaauuaguuguauauuuauaauguaaaacaaagagcucaacugcuuaugacuaaucugagcaggcaguguuguguacugcugcuaugacaacuaauaauuucggucugacauugacagguaacuuguuagaccauaggagcuugcauacucacaauuguucuauauuugcuuuaaaaaaugccugaaucagucaucagaugaugguguauuauugacauauuuuucauccacuugauuaaaugagcuuuugguugauauacuucugugaacuucauugaccacccaucgcugcuucugcucacccacuuuuuugguagaggauuggaggggauagcauuugucaucuaccuuacacaggaaagaaagggacaguguaacccuguuuugaaauguucuguugaaacuuauuagcugcuuggugcugguacuuccuguuuccaaaaccaauguuuaugcaacgcuacacuccauugugagauuauuuauugccuuaagcagaacuccuggcauguuugagacccugccccucucauuuguaccagauccccaagucucaacugguccaguccauuucacaccagcaguaccagccuucaucccucuccugccucccuucuguuggguggcaaagaccuuguuggguaaauaaguuuaaucuaaugguucucccagcucauuccuccugcccagucugaguuccggcccuuaugacucucugacugucauugucuuggcuuugaauuaccuggcaccuuugcccugucugagcaaugcuagcacucaccucccuuccuuuaguaaaccuacucaugaugggugucauguuucucaugccugcagugcugugaacugcagugccauaagguaggugggaaguauucgugggggagguguguuuguggaguaaggcagugggaggguagaggaaaaggagauaaagaaaaagcccauuucuaacucucugaacaggcgaggccagcuuaucugagaugccugugaucaggugaguccauaucuacuauacauuaauuauauaugacauauguguggcagugagccucuuaggaugggccagaggcggcaaaccuugcagcaagccugggaggugaagacaaggaaaaacgggcucagaaagcuaccugagcccccugaaccgcuuuaaaacgagucagccuguuugaagccuggcccucccauuauuaauuguuaugaauuuuaugaauuugggcaaguuucuuagccucucuggcccucagaaccuaccucagaguguuguaaaaauucacugagauaauggcaguuaggacugcccagcucaaagcuaauauuaguuaaguaauuauuuuuguuguuuuugcugcugaacuaaggccagcugauauguggcagagcugggcugaguuucucagacucuaaagcuugggcuccuucugcgagucauacuauuacuguugccucaucuguuuuggucaguaugaaaagugccucaguucuuagugucuccccuacucuuuuugcccaguuuccuguguggugggguuaaauggcccuugacugguuccugguaccagggaccagagaacuuccuucuuacccauuguuaauuugagcuaaggguguggaauuuuguucagcuucuuagaaaauuaugcagauagaaugauugcuuuggcauuaagaaacuuguuaacugacuuucacuauguuuuuuuuuuaaaggagaaugcaguugaaacuaauuuuguggauagagaaacuguuggaacugcuuuacaaaguauuuuaguaaguguggggaaauuuacugucucggucaucuuuauuccucagcuuucaucaugauguaggggaaaaacuuaccugugaacagauauaauuauugaagucaucuuuaauuuguauucucucccucauucacacacagguaaaaagaguugagauuauuuuuuaacaauuggagaagguaguuuaaagauuagguggaagagaagaugaugucuuacuaucaguaauauuaacccaaauaaaacuguuuaaauguuucccauuuggaagagaucaugacaggugguauagagcaagcucauccaauguacauugcuguuggacguuuuugugugcuuucgcuagucucaagagagcugccaaauuacuguggcaaguuuaaguaagugaauuagggcaggauuuuccaagcugcuaggcagucuguuagugggucauaaaauuaguuuagugggucacaacaagcauuacaacgaagugaaauaaugacuuuuuuuuuuaauggagucuuacucugucacccaguacaguggugagauuuuggcucacugcaacccuuccaucucccggguucaagcuuuucucgggccucagccucccaaguagcugggauuacgagugugugccuggcuaauuuuuguauuuuuaguagaaauggaguuuggcuauguugcccaugcuggucucgaacuccuggccucaagugauccacccaccuuggccucccaaagugcugggauuacaggcgugagcuaccacgccuggccaaaauaaugaacuuaucacaguauacagcauguuguaaaggcuauguauuucuccuggaaacguugacuucauuuuuuuuuuucauuguuggguguguguggguaguggaucacuguauauagauaaagugcguuugaaagccuccgaucugagauauuuuagaaaguuuaucugaguucuuuagagcaagucuaauugugcagagaaggaaagugcuuauaacugagucuuucuuagcuguauuuccaucaccauugaguggauucaccgugacccauuuuaggguucaggacuuuggucaucacaguggcaauguuuugcaacauccuccuuccuucugugguucccaccaagaucuucccaagcaucauuucuaggugggagggucacacauagccaugccgguuaucacaggcaauuacacagaguagaugugaucacacagaccguccuuuucaaauuaaaaauguuuuguuucucuaaggcugucauuuuucuuuucucuacacuaaauaaaauaguucacaauccuuuacaauagaacuacaccauaugucacagaaggcaggucuccgagaggcuaaauguguggcaaaaguagacaggaagcacaguccaaccgcuguaggguugaaauaugaaaagcuagugucacaggccaccaagaagguucugaagccuuuuugggggagaacuggggagaauuugauaaagccagaaagguacaaauagggacuauugagacuggcauuucaguggauuaaacuauagaaggagaaaaagauauuccuuaacauuggugauaauauguuguuaucagguauaaugauuuauaguaaugguaauacagauauuuuuuuuuccagagcuaauacauuuuguaaguggaaaauaagguuuaugucuucaauucuaaagauucauagaugaaauuaggaaaauaguguccuuaaaaaaaaaaaaaggaaaauaguguccuuccuaauuaacaugucccauguaccacuguguuuauguacuuucuacuauaaacugaauuuuaaaaucuugaauaaaguauacucacaaauaauuggaaucuuacucaguuugacauuuguaagauuaucggccgggugagguggcgcacaccuguaaucccagcacuuugggagaccaaggcgggcagaucaccugaggucaggaguuuaagaccagccuggccaacauggugaaaccccgucucuacugaaaauacaaaaauuaggcgggcauggugggcgccuguagucccagcuacucaggaggcugaggcaggagaaucgcuuaaaacugggaggcagagauugcagugagccgaacuucaucucaaaaaacaaaacaaaacaaaacaaaauuauaaaccaaaauguagagaaugacuuuuagauuuuguucuuucaacucugaguugccucggaaaacuuuuaaaagaauugucucauuuuucauggccuuugugcuacauuuuuaaguacuuaauccauuuaaggagguaaaacuauccuacuguaauuaagcuguucagauuaauuuuuuuaaggcauaaaggaaguaguuagcuaugaugaucuguauuuucuuguuacauaauuauuuuacaauuguuccucucgaagugaugagugauuuccucuauaaccagcugucaguaaaagacaaguuuucauuaugaguauguuaacguguccuuuguccuuguccuuuucauuuaguuaaaguaaccaguagcuccuauuuaugugaacuugaaaaagguacuguuaaaaaaaguucugaccuuugugauaagagcugugagugaagucaaagcugauaggaugcuggguucuuggguaaugaauccuguuacaacaaaagaaaugaaagcaugacaacuuggguaacucagggaaagaagccgauuucuccauuucauguggacuucguaucagguggagcauuuacuuaaggggugccacgccaccuuuuucuguucuuucccugagucauacugcugcuguaggauuuaaaucccucgaugguguguugagacuuugggcaaacaucacuugaccauagaguuauuagguaguaacagacuugauugcaaugcaaugaauugccagagugaguaacuugauggaggauauguauugguucuuggggcaaaaguccucauaccugacagccgaggacuagagcugcagacucagugguagguggugguuguucucacagacuuguguaguggggaaggagugacuauuaaggcuuuguuuugagagagacagacagagaauugacuugaggauggacgcuuacaaaguagacaugagauuacugcaguaguccuaaaugauccuuaaaagcauccuguuggagucaagauaaaucggaucacuucacuucuauaggaucuggauuaugacugaugucucuguuccucaucacuaaaaugaagugguauuucucgaaggccucuuuuaacuccagaauuagaugaauuuuugaaauguugaauauuuucuaaaacagccuccuuuccauucccguaagaaaaacgguuguuaugcucuauagacauguggcacccgaugucuggguauuuaccagugagcucuuuguuuuuaggcuuucaucauucuguguuccuuguuugccaaguaggaugcucacuugcaggaugcggucauuuucccauucagcuuuuaaguuuuccugugucuguuacuguccauacagauagugaaaggcuucagcugaguccuguggggagaucacuucgaguuucuggguuugggugugcugugauggggugacugagaucacugucgguggugaaugaacggucucauggagcugggguugcccugcuuuuguuuacucgugacucuacagggcagccugugggaaaauggcaaggcuuggcguccuggaaccacaagccuccagagggaguugaauuaaugugcagaguugaaucagggaaaguucagaggcaguguaguuuacucccuuauuccaguacccacacucacuacaaauguguuuacauuuaaacuuuugccaaagcccccuuaguuuaaaagggaggcuucacauaaauggaaaagcugaggccaaaaggccuaaacuucucucaucuuuauugcuuauugcagcuuuuauuauagaugcugcgaguacucagcacuucuaagaaacuccgauugcucuuguuucccuuucagcuuggagcugggauccagaguaguuaacugaggggccucgcaagccccuugucaggaggauggccugccuuugaaggcaguugacucuuguaugugucuuagucucuuuaggcugccauaacagaugccacagacuggguggcuuaaacaauagauguugguuuccucacacuuguggaggcuagaaguccuagaucaaggugccagcagauuggguuccuggcuugcagacagccgucuucucauuguguccucacauggcauugaggcuggagaguacagggagagagauugagaaagaaggagcucuggucucuuuuccucuucuuauaaggacacugaucccaucaugugggcugcagccucaugaccucaucuaaaccuaauuaccuuucaaaggucccaccuccaaauacugucacuuuggggguuagggcuucaacauaggaauuuuggggggacucagcauucagucggugugugugugcgugugugugcgugugcauguguacuuguagaggaggguugauuguccaccugacagccguugccauccccucuucccugcuggaugccaauuugcauuuuucuggcacguuuugcggcuagaguggucaugugacacuguucuggccaaugaggcgauggaggaaggcccccgggggcuucugggagugccugccuucgcagcuggagagagcccuccucaggggcugucucugccuucccuucuucccauguguaucuggggcagcugaggcagggcuaggagaagagcccagguuccuccugccaccuccaagcgaugaagcagcccugggccaacuccagcauucucgugugaacugcagaggagcccugcgcuuccagcuacuugcagccaggugcuguuaccuacgccccacgcacccucacagaccuguguacaagggcacaaguaccuccccuggagcuggcaggaggugcagucggaagagcaucuggucccugaggccucccugugccucccccuggacccccaggguguccguguucccaguuguugacccucgggugcgucugucgcgucugcucucuucuccuccaggcagggagcuccuggaccacgucuugcuccccucucgaucuucaggcccacccugugcucccccguaggagacauaguaacugguucagccaaccagguuaacucaaccagcgagcgcuguggguccuggucuugcugacagcuguugcuuuacuccuuucuuguuuuugguguccucccugcgaagccugcguauugguuguucacagaaagcccaccagguggucugaagagagggaagugggaaaacagacuuuaauuaaaagggccggggccauggaaauagcuguucucuaggguuugguuagagacagacaauccuccaaagacccagacagagaugugucccuguccucacgcucaguuuucauugcggaagcagaaaucaaauaagagccaacuuaaauucuuuuaauuauggaacauuuuaagccuacagaaaaaacacaucauuguuaccguuguuucuggcauuaaggucucuuuuuucuuuuuaagagugaaaaaugaaguuuuccagacaaacccuuaacuaauucaguauuucaaaagugaaauacaggcugaacaucccaaaucugaaaucugaaaugcucuaaaauucaaaauuuuuugagcacugacaugcugcuuaaaggaaaugcucaccggagcauuucagaguguagauacucagaaauauuccaaauaugcuaaaauuggaaaagcuuugaaaucugaaacacuucugguguuucggauaagggaugcucaaccuguagugagugagugguuggaaguuagaacauauucuucuguagaaacaaaccuguuugacccacaauuuggccaauauacggagauuugagaugaaaaacuuacaaaaugauagaaugacuggcugucauuuuaccaguaaggaaacaaacccagagaagugaagucaggauuuagguuuguggaccuuuuauuuaagguucuuucuacucugccauacguuacuagugacuucagacaacagugucgaaucucaucagccaaaacccaccaggaacacaacguguaguuauacagaaguuggcuucguuuagcuugcuucugccggggccaguguacccagaagaacccugggacuauuuuggaaaggcagacuugggguuguuguuggacugggugauuugaagguggaauuagggaaaugggaccagaucuggguuggauguggccaggaggcagaaacaauucagugauuggguauccaacaacuuuuaucuaggagguaggagauuaaaguagaguuagaguggccaugcaguaaagaauuugcaaucauacauguuggugagaaaagggggcaucugguuauuuuugugguaguaaugugggcccaucuguguccguuuuugagcauucauuauguucugaugggaauaugggggucagguugucaauuagacuggucuuuacuuugaaggucgguaggguugaauuuaauuuguucaccaacuuacuuaauuucauucugaaugcugaugcuugaggaauagguuuuaauggagcaagaugcagugggaaguagggacuuagaggaugucuaaauaaccgugucugagcagucacugguuuuuaaacauuguagcugcucaaugguaauaaugcaaauuuuaaaaaaggcagauggguaguuuucgccuagcuugagaagcuuuaaaaaucaucaugacgacuguacuaucuuaaaacgugaucagcuauagaagcagauaaaacugucgagcuguuauuaaaguguacuuacaguugaaacauauuagucuucaaagaugccauccaguuacugauccagagguaauguuaauggugguguuacucacggugccaaaacacccacagaucaguagaaaauguggacagucaauuuagaaaauuugcaaagcagucagaagugagaggcaguguuggguagugaagaguggaccagacuccaaucuugguccuaguccgagcuuugccacugugugguccagaaugucuuugccacucucuuaacuuagucauuucaucucucugggccucaguuuccucaucugucauaaugaggaaguugaacaccuggucucuguguuccuucuaaaguuucugucauuaagucuguuugaagauagucucuucuuuugaaaguauuaguuuguuuggccaguugggccaggucauaaauauuacggaauuauuagucagcucuugaagacaggaauguuugagggcuuugaaagcuagcccagcaggaagcuuuucguggucuguguauuuuccuuccucucaggaaugauuaggccgaaaucaaccaucuucucaguccauccucuuuguaguuuccugagaugaaugaccgagguguuuucuccucagaaaauaacauaggagaaaaauuccaagggaggucucuuuauucaggaacuugcaauuuaggaauuaagugugauaacuuuauuuuaccaauuuuaauuuugugacuauaacauaauauaaauaaggauucuguuacaugcaaauuuugaaaucaugcaaaaaccaaaaaaggaaaagaagucaaucaaaacuuguauaauuucaaagaugguggccaggugguuuggaagcugugcaugggauugccacauggccucuccccucuagcaggcaacaggugccuuguguguuuagucaguaucugcugcaugucauugcugauggcauucaaguuuuugcuuaugugugcugguauuuaauguucacuuagaucuaaauaucuuuuuuuagccuucaaagaugucaaccagguauucaucaagagauauauuaauggggauguuagugauagagcccaggacacccccagcccccagaucaauagcuuuguaacagaagcgcuaaaccacuaugaaggugaucagacaacagggggaugcauccugccauuaauuuagcagaaagagcacacguccaaauaggagaguuaaaauagagaggugcuguagcaaaguggcucagagcauggacucuggagcuagcugcaugaugcugcuagcugccauuuaauuagccuuguagauuuaggcaagucaccuagucucgcugggccuuaauuucccuaucuguaugauggaauaaauuuaaugucuacugcaaagguuaugugacacuuagcaaacaugauaaaacacagguugccgggcccaccccccagagacugacucacugcaucuccgauauuugcauuuaacuaauuccaugauggugccgaugccucggacccugggaugacacuuugaggaucaccaugcugugcauuuguacacacagacacacacguaggcauuuguuuuccaaaguaaagggcauacuguuuggagccuaauguuuuucuccuauuuagugccuugugaauauuuucccuuucauuauuuauucuaauaauggaugauuuuaagcugcacuguauuccauuauuagauauuuaaauggcuuccauuuuuuccgcuaucauagaccaugccggaauaaauaucauucuguguacacuugucuacaucucuguugaugucuuuaggguaaauuccuaaaaguggaauuacugcguucaaggguguuucacgguaaggccuuuugcuacacauugccaacaaauucuucagagaguagcagaaauuugucuucuuacaaguagucuaugagaguagaugcugauuuucuaaauguaagggaauaagaaaaacuucaugauuaacuuuuuucacguguauuugggcuuuggugggaguaggcaagaagaauauccguggauuuauagaguaagcaaaaguaugucaggaaaaacuaggaagaauagggcugaacuguggcuugauuucaggagaguuucugggauucagacuugaauuaacugaaugaugcuguaauguauaaguguugguauaggugauuuuaugcaaagaagaauaaacauuggcuuacuuuuauuuaucguauacgguaugggugacuacugcugcuaguucaagggucuugauuuuuuaaaaauguguuucuugacugugguagcugggagccccaggauacagacuuuugguuaaauaacaucugcuccacucugccuucccgugugggccucucuaacccugggccaagcaguugagucucuccucggggugccuggagugaggguggauacagcuuggguaauucagcaucuguaccuaaaaacuuacucaauguaggcuucauguaaagaagucagugguucuugggaacaggggugagugaauggaggcgaaagguggggcccuccacaggucagucaggcccucagggugggacaagagcuguagggcucuugguuauaaaccugugugguggagaccagcaggugagccaaacucuucuuuauuaucagaacauuucacuaauaagggaucucaagggucaucuggcacagccuucucuuuuugcagauaaggaagcuaaauaauuuauuauuucaguuaagcuucaccauaugagaguuuuugguuuuuuuuuuuuuuuuuuaaaguuuuuaggaucagauagugaaccuuggaacagaauuggcugcuuuuuguuucuuuuuucuggaagugcugaacuuuagagaauuguggcugcaugguagacaggcaaaacaggaaggacacagugcagcugagagcgaggguggccuguggucucucguuuggccuggagaacgggcugauuucaacuccuccugcacugcuccugagucacggguccuacaccaccgugccucucucccgagcucaggaggccgagcucaggacugcaugcuccuuccugaguggucuccaaaggcuucagaguggccuuggaugaagagcugcucacuucugugccagucauguuuuuuagaauuuacguacuaguuuucuucuugcaauucaaaaaaguguuuuuuuucuuuuccuuuuaguaaagaaacacguaugacggguuauuucuuuuaaaaagcaacagcuccccugaacaccaaacugugccuuuuaccacugggugacacuguuagaccacagaacgugcuuugcugguaaaaucaagaguccuugaauuucagauuucaucaagcuacuuuacauaggagagagaaacuccaaaucacuuaauagucaucuaucaaauguuauuugauaaguguaauuuaucaauuuuaaggccaaugaguuuaaggcaaucaguuauuaaagaaauccauuaauugggcaggauuuccauugcuuagaaguuuuugcagauuaaugugcugcauauuaaugaacuaauuauuucaugggaauauuuaugcaagccaguguacuaauauaucuauuucucaccagacaaaagucuaaguuaucuuucuuuggcaaaagacucacuguugauacacagcaauuaauguuacggaguuuuagugaggauuuuuuugagccaucuuaaaagcacgucuguugguuagagaaauggguauuugguucucuguacugguauguguuaagaagauuaugucuuacuauuucugagcucuuucaagaucaaaugaagacagaauuguucaaagcguggguugaccuccccuacucaguuuuuggcuccuuuuggaaaucugaugucugcccuucuaagcguaaggugagcauuaucuggucaguuucagcugaccacuaugugacugagauguuucugagguuaagaauugagugcgagucaggcccucccuuugugggguuaacaugagaaagaagacaacuucaaauuuaauuuuaauagaaucagacuucaguauccuacaagagguauuaauggaguccugcaggaguguaaaggggaaacacugaggaggagccagggaagacuugguggggugaguuccuucauuuggguacucuaaaccgcccguauuauccuguucauucaauacuuuuuuuuuuuuuuuuuuuugagauggagucucacugcauugcccaggcuggagugaaguggcgcgaccuuggcucacugcagccucugccuccugcguucaagcgauucucgugccucagccuccuaaguagcugggacuacacacaugcaccacgaugccuggcucauuuuuguauuauuauuauuauuuuuuuaaguagagaugggguuucuacuuggccaagcuggucucaaacuccugaucucaagugaucugccugccucagccucucaaaagugaugggauuuacaggcgugagccacugugcccggcccauucaguacguuuuaauacggugcacacagugugacauacagcccagggcuggggaaggcaauaggagguaagaugagagguuugcuggccucuggaggucagccagaggcacaaggagucggcagcuccagcuuucuccuagcucuucugugucugcuagucacugugaggccacugcuacuuuguauggcuuauguacaagccauugugccagagcauaggggagaggauggaagucacucagaggucuuuucccuucugcagagauugacuucuguguccuucaaggggagacaguguggaaacgugggaaauuagcccacaggcggggaagugccugaggcaaggggcguccaguggagucuuccacagcaguucaaacaguaggacaugucuccggaggagaggccccgggaagacucggggaggcaggcugugagcuggucuuugcaaggugccuggaguuuuacuggcuggggaggagggauuucugcccaggaggaaaucggaagcagagguggagaugggaacgugcacgggcuugguguguacuggcugccuagaguugaugccagagaguuaagaaccacacauuuguaaagguaauugaggacuccacuaucgagaagggggccacagaaggccaagcaguuuagcauccucuccugaggugaccagugaugcucggcuugguagcccugaucugauuaaaugaguuagcucauuggauuugacugaggaugcagccggauuagagggaaaggcaaccggaggggauggaggccauggagaagccaagugcacaauucccaggaugagggaugagcgacuggugauagggggcgauuuucagaugcguuuauggaagggaacugaugaucgauucuguacuuaggguugaaaccugugagauagaaccuuugggagaaauaaggaaguuaagggaagacugcgagggauuguuucucaguggaagaauggugugugugcugucgucucuguugcuuuugagaaacaauagcucaaacucaaauucgccugggaugacuucugcuacaguguaggcccuguggggugggguuggcucuguccuuucaguguccuuuccagcaccugggcagugucuggcaccucagaggccuucaauaaaucgugaguaaaggggagcucaacuugacaccuguugauucugaggugaacauuccaguacgaaguuggaauuucagagccagagcuugggaagucaggaacuaucuccacacacacuuuagaaacagcucuuguagcagaagggguaaagguguaugggguuuccagaggcaugaucgagagaagaggacagggcuguggcccucugccuggacugcugguggcguuaaagggagggaagaggaagugugggcagaaagcugggggagaacagggggaggacagagggagggugguccaggggcugccuucgcaucagcaaggaaauaccagccccagacccaggagaggcccaggagagugucaccaaaggagggagcccuggauggccugagaaaacccugccggguguggacugucaugcggauagaaacaugcuguugcugugaauauuugaaggaugacauuuguugucuguuagugaccacggaucacagcccuuggggacagacauugagggccagaagcacaggcacuucuuaccagaaaaaacaccugacaggccaagugacacugccagcuccuagguagcaguuggucuggggaacauuagccaagguccuucucagggugaaauuucucuggaauaguucucaggcccagccauugcccuaggaauaagcucaaaugcaccucuuugguugauaaacauucugugcuuuggggcuucagaugggacugacuagggcugggacacccagagcugcagaguggagcaggcucugccugugugucacguccacauggugaacauggcagacgucuggucgcccuucucguuucuccauagaugugcugcuguuggcugaaccuaggggacauuccucucucccaccagguacuacucacaggaugaggguaguucugcagucuaccagggaauucuagaaucugcacaggaguagaggaagugagggugcaggguuugugucuuaucugcaguccuaggacuuucaacugggugaaaaaagucaccaaggaucagccucuugccaagacaaggggcuguuauaguugucugugggcccuugaaggauuuuauuccccccuuaagccauuuuuaccuccuucccugagccaggaauugaaugaaucuuuguuuauuuuaaauuaguuuucuucuaucuagagacuucuuguucucacacccuagaguauuuuuguuuuuguuuucauuuucucucuguauuuugucuucagucuuuucuaaguuuguuugaauauccaacuuccuggcaaaacuagauuaugugagaacugcuuuguuuuuuuuuaacuuuggcuuugaucaugauauauuuggacaauauagaaaaugccucuuuuuagccaagaugcagacuuuggggagguacaaggcugaagaaauuuaguugcaggaguaauuugcuaguuugcauggaaagcagcccaaacugucauugcuugaccaucagccucacuuucuucugacagauaccagcugggucuuggguacccaacuuuggcacaagccucucugagauccugcuccagucauuuucuuucuuccacagcacuuucucccuucccuguccacacuggaaaaaugagcagaggccaagauuggguucaucauuauucuuuguuuaaacuaguguacuugcgguauacggucauucacuuucauguugauggaacauuaaguaauggagaguuagaguaaugaauuaguuuguugggacuguuugccuacuuuguugagcaucugccacgugggcaaguacuguggaugguagauguuuuccaugaguuuucaagaaugcugagaccaacucugcauaugcaaguguacuagcucugauuuccaguugaggaaucaagacucagguuaaauaauuuuauaaaaucaauaauugaugagugaccuaaccagggauucuaauucaagauggguggucuucaagccugaugcuuuuuuccauuaugcuguauaacuucccauggacuauggaugaaaugacagaauugucauuaugcagcagcaaccaagugacuuguggauaguaauuuuaauagcuguugaacguguacucuuacacaugcagaggagggcaugcaccaaaaaaguguacugauugagggugaauguuuagaggaaacacaccugugucaccagaaucuguauuauccagaaacaaucuuuuccagacccuggaagccccauugguacugccgucuauucacucccgaaauaagcauuauccugacaccuaacaucaaagguugguuuugccugauuuugaacauuauguacauggacgcaugcaguauauacucuucugcaucuugcuuuguuugcuuaacguuguauuugugagauucagcugugcuuugcuugcagaauugccaguucauucucauugcugcauaguauuccacuaugucagcacaccgcuguuuacuuacccauccuacuguuaguggacauuugaguugccuccaguuugggacuauuaugaauggccugccauuaacauucuuauaaaaaucauuuauauugauauauuuuaaugaaauaugucuuuccugccucccaucucacuuuaaugucauccuuugcaagauguuuucuguuugggaucguaaagcugugauguuagaaagguucuaaaguccuguugagagacaggaaaucauucuguuaaagucaaaucugguucguccauccaucaucccagcccauggagugccuaagagcuuccuuuuggaauuacacagacucaaggucaaaucuugguccugcucuuaagcagcuugguaaccuugggcagcagugacagcauuauuguuacuaauuuauucuuauucguugccagugacagcgcuaauagcaggugaugucuauugaaggcuuacuguguuguaggcauugcguuuggugcauuucauuuuuuuuuuuuuuuuuuuugagacagagucucacucugucgccaggcuggagugcaguggcgcaaucucagcccacugcagucuccgccuccuggguucaagcuauucuccugccucagccucccgaguagcugguauuacaggugcaugccaccacacccaacuuuuuguauuuuuaguagagacaggguuucaccguguuggccaggauggucucgaucucuggaccucaugauccgcccgccucggccucccaaagugcugggauuacagguaugagccaccgcagcccagcaguugcauuucuuauuuacucuucauagcaacccugugagaucugucaguccuuuuucauuguugccuuguuaaacuggcgaaggcccuuacccaagaucacacuuagagcaagugaggaagcuggaaugcagaugcggguugccccacccaaacccaugcucuugaagcugucagccucauuuggagacugggaagucaugaccccugccucaugggccguaugaggaccaagugacaggggaagcuuacauauacccccaggugacauggacaccagcuccaagauggauuccuuucccugcaucucucagaauggccagcugcuuuuggggugugcuuugacuacagugcaggaaggcggagugggcauggcugcuccacucuggcuguccuaaggaaagcggaccugccauuccaggucuggacaccucauuaguugaggaggugucgccaccuauuggucguucccaccucacucgggccagcuucugguugcuguaguguaggcagaugucugucggauguuucuugcccuccuuaguugucacucccuccuccucugccauuuucuaaauauaaaauaugugccuuauuuguaaaaauacauuuucgggggaugaaaaaacugaugagaaaaugaguuugauacuuucccaagagcaucacuguuuggcauuuguacaacaacauauuggcagcaaauuuauugaguucgucauuguuuuaaaugaccauccugggaagccacagaggacugucccguagccauaguggagcuuggcagaguaugaaacaauaacgucucugcacuuacgcugaugacucuggugggacgucguuucuaagccuuggugcaccagguugguggccacagaaauccccugggcacuugucuguugccuggucuaagauggaaauuuuuagguuugccuuagggccaggcaagucaggaguuugugaugaaaccaacugcacuuugggaaaaauucuuaccggaacucaggcuccugccugucugggaacugugggugcugagagagaggcuuuggaucuaagaggugucuuucccuuuucaggcugacccggccuggaguuugccgccuccaccuuacguaacuuggguuucucaggguauugccagaggguuggcagaaucuuagagacagcuuaggaaacagauucuccaaaaguaucuuggaauuacuuuuaacuuuccagacguuuuagcaguucaaaagguuguuucacuuugguuggugguagcgcaccuguaaacuguacacguugccacgugccaagagauuguuuuagaaaggauucaaguauuagugcuucuagauagaauuaggucuuauauauuuagguaaacaugaaaacuagcauaaucuguaaauucugauuuuuaaaucuuagaggauuagguuuugaauucaucucuuugauguagaaauaugcagacauggaaccagagcagucugcuggggcaagccagcuacggucuggguuuguuuuaucagcccaguugugaaaguuuuccgagggaaugguaauucaccucuggaaagcagucaacagaaguaccugggauagccagagagcugggcccggagugaacuuuggaaagggaaaaacaugaaaagcaaggacucaaaauccaucuguaagcaugggauuucccagugcucugggauaguagagucaaauaaugacuuccguguguugcucaguggaaauuaaagguagaauucucaucaggcagcauuuuucagugcauagugugucugucugaaauacaauucuguuauuacucaacagcuugaaaaucuuucagugaguccccuccauucagaacagcacgagaggcccuugucaucaggccugucuguuuccugccccacucugaacgacuggagccauucagaacuucaugcagcaccuuggcagugugauagacagaccuuuuuagacuuuccagaagcuucuuauguuaguugcaugaauagguccaagaaccauugaacguugucagugagaaagucugugggucauucaacugaaguuacaguuuugaagaaaucaaagcccagagaaguagaguuuccuauacagaguuuuccaggccucuaaauaaaguauguaauguugcugguugcauaguugggcuuauaauagcuucuauugaguucucauguuugugccagggauuagagagagucuuugcauauacauuuuacucaguuuuuacagcauucauuuuacacauaggagagcugggggucagggaaguuaggauuuguccaggaucucaaaccaguuuuauuucuccuucacugagcugguccugguuuuccuuaauugacuuaauacauuaaaaaaaguuacuuugaguaaguuacuugaccagugaagugacugugacaagauuaucuuuguguuuauuucuagaaaugauguuucaugucaguaauaauauuugcuugcaaaguacuuguaccucuagacauuucuaccccaucuuuacucucaggcuccuggauuccuuguugcucagagaggaaauguaccuggccgcucaaccccacuuucugcacuacaccuuauggcgguggaauccaaauggcucagggacacccucugucguuagcccaugccuuuguuacuucauuuaaguaaugcuuucugaacagguccaaggggucaaaagaauaggaacauaaaccagacauguucuuugcagugaagagaggauaagauuuauauccacauugcuauaauacaaggcggugguugacgaauuacuaggaaaaaagaacaaagaacaucccauagaauuugggaaggcgucagggcagaugcggcauuuauuuggaucugcuggaugcgugaguuuggcuuuguggagauccggggcugcggugggaaaagccucagcacgccuucggagggugcagugcugcuguaagcaugcugguggagggaaggcggggugugaggauguggggagcaagaacauuuguuucagcuugaucggaagauaggauuugugagacgcaagaguugccuuauaccagaguuguauuuuccagcguugguagcagugagcaggauggcuggcagagggaagagagcugugaagaaggucauagugaugguuauugccauguguuagucacagcuccagggcggggugucacugagaagcagcuggaacccagaucccacaugguucucccgccaccaccacugcccugaguacaaagacucaaggaggggguugcuccggcccguucacccccuuguuacuaaaugaccauuucccagaccccaguguggccuuugcaugaggagcugcagggaccaugccaccuguucugaggacaggcuuaaggucuccaugcuuaacucagacugagaggcuccugugcacccccuuuuccagcuccaguugugaagaaggacaaaccagugaaaaagaaggaagauguuugccccuguguugacagcauauacauauacuucaccacacugucccacggaaaaacauccuccugggcugaaauccuaaaugcacuacacgcacuucugugcagccacaagugucugaaaagucaaccgcagccccccccuccugcaccggcucgcagugcccgugucucucuaauaggagacaggcuugggugccccucaccccacugguccuaugugagaagaaagauuuccaagcaacuaaaucuaaagagaagucagaaaaacaucccaagcuagggccuguuuccuagauucagaacuaaagucauuucauucugugcacuggaagcucaaccucccuccuggcaacaaggcccaagucauguuugcaccucaacacugacguccaggaaaggcugagugggcaucuuaugcugucucuaguugagggggaagugggagugcgggacagaggaugaggggacggaaagcggagggcaggcaaagccugagacugcagagggccagucagucagguaaacgagagcgagucagucagguaaaggagagcgagucacccaggcuugagcgcuggcugcacuugcccucucaaugucaccucuuucaugucgaucagacgucucagacucgacacguccuagauccacuugcucuuucagccucccgucauggcaacuugagccuucugguugcucaggccggaaaccuccaagucauccuugauuccucagugcuuuucacgccucguguccaguccuucaggaagucccagagacuuuaccuuuaaaauacaucuugaaucaggcucuccgccuaccuaugcugcugcugcgugagucuaaagcaucucucaccuggaugaccuuugcaucugccgcccugccugccugcagcccguucuaaaccugggagcuggaguaaucuuuuaacucaugagucagauaccgucauuacucugcucagaaccuggaaaugacuccccauggcccucagggugaagaccagaaugccagcacugguguucaaguucccacgcucuauauccucaccaucccucccuccccugcagccagccucgcgcuuugccauuccucaucccccccaggcacccuccuacccuguggccuuugcaugcgcucuucucgcugcugaucacggcccgcucuucugucacauucccuccagcuccuccccaaauguaauaacgaggucaaggucagaggcaguugucuguuuggguuuggcaucguggagauuaucuauggugaagggcagaaauacggagccuuuuauggaaguguguagccuucuuggucuaugauuaacuagaaggaaacugcaguugauuuuucagacacuuguggcugagcagagguguauguagugcauuuaggauuuugccgaggagcacguuuuuccaugggacaguguguugauaucaggcuggcugugauggguucccugagucacccucugcgagguuuguaauucucaauucaguucagguugcaggcauucuuguuguuaaaagagcaaugcaacuagugucugaggaauguuugguguaauuuauuauauaugccuuacuguuugauaauuuugagccuaaucauggagugauauuuaagauauuuaaacaaauguugcagcuacauuauuuuucaguugacuuagccuuuggauuuucauucucuuuauuuucacauuaacuuuguaaagauguugcuuugguuugguggacagaacauaacacggggaggugcugggggcagggucauacuuuucagcagggcagcuaggaggucaggccucucugagaaggugacauuugaggaaaggccuggaaggauacaagcaggaugaagcccacaaggugcuuaaggaaggagacagugagcagugucacaggccagcgagcaccgugcugagaacuagaagccuuuuccacuggcacagggucagcauugauauguuuguagcauagauugauuugcugaggcugaaggauuagcaguaaaggaccuggguccggugccuauugaccaacaagugaaacaacaagcacuaaaacuuagagaaaucgcaguuagauuuauuuggagccaaguuugaggacuuacuuaagccugagaacacagacucaguguagacugagaauggguuccaaaguaaguuaugugaggcgcaauauauauacguuucauucccuuuccuuuucuauuuuguuuuguuugagacagagucucucucuguuucccaggcugagugcaauggugcgaucucggcucacugcaaccucuugccuccuggcuucaagcgauucuccugccucagccuccuaaguagcugggacuacgccaccacgccuggcuauuuuuuguauuuuuaguagagacaggguuucaucauauuggccaggcuggucucaaaccccuggccucaagugaucuagccaccuuagccucccaaagugcugggguuacauauaugagccacugugcccagccucuuuuuuuuuuuuuuuuuucuuuucuuuuagagauaugaggucuugcucuugcucugucacccaggcuggagugcgguggugcaaucauagcccacugcagccucucaacucuugggcucaagugauucucccaccucagccuccugaguagcugagacuauaggcauguaccacuaugcccagggcauuuccaauguuuuuuaaacauauggggucuugcuauguugcccaggcuggucuugagcuccuggccucagugauccucccacaacagccucccaaagugcugggauuacaggcaugagccaccuugcucggccuuguauuuuguaacaggggaauacauguggcacagcggugggcgaagcaggcagugaagcagcgguuucaguccugugauugugauugguggucacagaggcugugcauaagauaaauaagguaaauaugcagcugaguggguaggagaaagguuaggcaucuuagagucugguggagggugacugauuccaucccgucuuuguucuguaucugguaaacagauuuaugaccaauaaccaucagugaaauauuuaacaaacuccaguaagauaggcaagaggccagcuuuaguuuauaggccccucuuuccugacacauguguccaacugcagccauugugggccaguguuccaauuuucauuugaacuuucuuuuuuucugacauacucaagugcuuguucugaggucgauauggagacaggguggcaggaagcauccuuugugaccggaacccaaguuguggcaguggcagugauagaagucaggccacagggcucccuggccuuagucaugggcaagacgagaccaggccaccauucucuucccugccccagcccaguuacauuccaagcgcuuuagaauauuuaucagcgaugccccagaguggacucaggaggauggcauguguuagcauacugagcacagcucugugggccucugcaugugugggaaaagccuuagcaaaaacugcaaaugaguguuucucaucuuucucuuucagacagcccaccugaggauauugaccauaaggacucauaucucauuacaagaagcaucauggccgagccagacuacauagaagaugacaauccugaacucauuaggccucagaaacugaucaauccuguaaaaaccucccggaaccaucaagaucuucacagagaacuucuuaugaaucaaaaaagguaaaaugguuucuugagcauauuuuuuuuuuaagaggacuuuuaagaucaugauaucuaauuuuaauuguauuuacagaggcuucaaagagucuuugauuucuugcacuuuguuaaggcuuucuuauuccuucucacauccuagaaccggguuaccccuccgugaggcagauccccugcagguggccaucacugugguggccagcagugcuuccagacuccugcagucacggguucccuucugaaauggauguguauuuccaaauucggauggaagaggcuggauuaaagauagaagagaauguccuaaguagaagagaaauauguucuuaaauuuaaaaucucugaauuuucuccuuacacuggggaagguguaggaaucauguaauugccgccuacuccggcauuugucaguaguggggagaagucucuagaaccauauuagacuuaauagauaggacacucauguuuuuguuuguuuggggguagcauuuuaaaagauuauuaucauagucuuuauuauuaauuauuuuggaggacaggaaagcauuuaccuucuaucuacuuugcaaacuccaucugugccauaaaucauuauggauguuggguugcuauacucugcuuuuuaaauaauuugggcaggacaggagacuaggagaacugaggaugaaaggcuauuuuuuucaauuuaagaacuaggaagcuucauuuaggauuauuuucagaucucguaggacuauagaugacucauuugcccacucuuugcuaagcccuggugaaaggucucccacugaacugaaagauacgcagaucaaguuuagcauuaggguaauuuuuugcagggaggccuaguuaaacaaauguuuuaaagaggaucaaggggcauuuuuauggcaauucucuuuccugaguacacuccagcuagaaaaaaugacuccuaucuaucccaggaauuauuuguaaauacguuucucccucuagagugugagaauguggcuuacuccuguuuuauccccagcauauuaguaggaagcuguuggauuaauguauauuaaauugaaugcaaauaagauuuuagcuuccaucugccuuugucacacaauagaagaaagaauauaugaauuugguauuauuauggccaaagcaaaaugagacuaucaaguuccuaaaauagaccacagaauuuagaagccauccuauccugccugggaaaucaugucuucauuuugguggaaagcucgucaguuuaguaggcuccgaaauagaauagcaguugucacucaaagauuuucagauuaucuucaccucuuuggccucaguucccuuaucuauaaaguguaagguaggagacuuagcuguucucuaagaaacauuuuagcucaaauuuuuucuucuaggaaaaucuaugaaagggcuccaagucagaauaaaggucagaguaaaaccaacauuugcagaauaaguguucucuaaauuauaggcuaugaauuauucugcaaaaauauauuuaguaguuugggucauugcuguaaaaccuacagauuugugcaguugagucuguuuccacauuuuuuagagaaagggcuuccauucugucugucuuugucuggccuguucuucuccuuguuugcccagcucaacuaaccugagacaaugcuggguuucccuaaaguacuaugguguagagaggaugugggcuuugaggucagagagaaaugauaugaaucuugguuuuaccagaacuuaacuuuaccuaccuuaugaucuuggccaagguauccccucuugagaucuguuucuucaucuauaaagugggagauaauaguauuuuucuuauaaaaauuaaaguaggcugggcaccguggaucacgccuguaaucccaccacuuugagaagccaaggcagguggauccacugaggucaggaguuugagaccagccuggccaaccuggcgaaacccugucucuacuaaaaauacaaaaauuagccgggcuugguggcacaugccuguaaucccaaccacucgggaggcugaggcaggagaauugcuugaacaugggagguggagguugcagugagccgagauugugccagugcauuccagccugggugacagagcaaaacucugucucuaaaaaaaaaaaaaaaaaaaaaaaaccaaaacuuaaaguaaauaauagcguguaugaaaaugcuuaacauaauaagugaucacuuagucacaucuaucuuccacuuccuaugugacaacaacuggaauuuccuauugcuuuuucucccuuuucuuugaaggauuuuggucugguuggaaauacauuaaaaaaaaaaaaaagaaaaggcagauuucaaaaugaaaugaaaauauaucucaucuuaucucuuaagaguuuucaagguaauaccaaacuuguuagaaauacagugauuuuaaagugagaauuucucaguuucuuuccuuuuauucaucuuuuauuuuguauacuuuuuagagacugggguuuuuauuucuaaauuuuagugccaaacuauaggauacaucacaucaauacuguguguguuugguuaaugaauaaccagucuugauuacugcaugguauuguaauaaaaauccauuugcuuuucuguaguuuauaacaagucuuccuacauuuugucucaucuggugcucuuucuaauagcccaguguguguuaucuucagguuacccucacucaggugaguaaucucaaggugacugguuuaaggaaucaucucaagauuacauaauaguuuuuugaaauaguguuuagaaauaaaagcaaguuuauguggagacuuauaccuuugcuacgcauagcuacaaauuuagcucaaagcucuauggcaguucaguuuuuccaguuacauuucagagauuauguguuacaggcugagaacaagaacuuaagagaacaaguacccacaggucuucuaacugcgaaaccuaugcucuuucuaguguguaauccuauuccucuauuuacugucuuuggaacccagcuuaguuucagguuaaaagucuuugaagccucuaggucugacgguuaaaaccuugugucagguucucacuuuccacagguguuuucaguaguauaaaaaggcagauuucaaaaggcuuuuuuuuuuuuuugguuaaaagauuacuauugaagggaucuuuaaaaaaacaauuaagaagggcugggugugguggcucacgccuguaaucccagcacuuugggaggccgaggcggguggaucacgaggugaggagaucaagaccauccuagcuaacacggugaaaccccaucucuacuaaaaauauaaaaaauuagcugggcguguuggugggcaccuguagucccagcuacucaggaggcugaggcaggagaauagcgugaacccgggaggcggagcuugcagugagcugagauggcgccacuacacuccagccugggugacaaagcgagacuccgucucaaaaaaaaaaaaaaauuaauauuucugauauuauuuagagagauagauucugugcucuacaaagauuacuuuuuagaauaaauaggucaguuacuuaaacauaucccuaaaauugguucuuuggcuuguauauuuugaagucaguggcuucuuguuccugguuuuuagcugacauucuuuuggcaugcuuuacuaguugaauaguuccucaauaaauacuugcugcuguacaacauggaaaaagauaggggcaguucuagagauaaaggauacaaguauuuguguuccaauccaugcagguaaaaaugacuaaaccagaaauguaaaugaggcaggccaaaccaaagauuacaagauuaaagaacaagggcugaaauucaggcccagcgcggcggcucacgccuguaauuccagcacucugggaggccgaggcaggcagaucaccugaggucaggaguuugagagcagccuggccaacauggcgcaaccccaucucuacuaaaaauacaaaaaaauuagcugggcgugguggcacgcgccuguagucccagcuacuugggaggcugaggcaggagaauagcuugaacccaggaagcggagguugcagugagccgaggucaugccacugcacuccagcaugggcaauagagcgagacucuguccccccggaaaaaaagaacaagggcuaaauucaaaucaaauuuucccuguacccuaagaaaaauaauuaggccgggagauguuugacuaagugaguaggcauuguucugugacggucugagccccagaccuuuccucuggaugaaugcugucccagguaaugaaaugacuucacuuauuaauauauagguacacagaguucagguagauguggaaugaauggggacucgccccgucugcccuugaauguauuuagugguuuaugugaaauguaccuuucaaaguugucuguauguuucauacucugggggugggaauauaaaucauugcagccuuuuuguagggcacuuuggcaguacucaucaaaauaugcgaugugcagaugcuuagccagcaacuccgcuucuaugaaucuagccaacagaaauacuuguagaagugugcagcuauaaauguccacagaggcucagagccucauuguuuuuaauagugaacaguuggaaaccaaauagaugucugucaguagggauguggcagaauuguggcauguuuauauggguauagaaaguauggaggaacauagacccaacuguugguaagaguuaucucuggaugcaggaauagguagggguugauggguacagggucucuacuuugcauaauuuuggggccacuguucacauagaacauuugcgauggaguggugcuccucgauucguuuaauggagaggguuuggaugugcuuuugcuuuuuauuuaacacauggguauauuacuuuucuuuuucugcaaagagcacuuauuaauuuuauaguuuuuuaaauuggcuuugcccgcuucaguagucacagguagcuaccugaccgagaagccgacuugggaauuacuguuacucgugggugauacugucauaaagggguugaaaguacuuguuagcuguauaugucagaauugauuaaagagaaccaacuauucuugugcaagggaugguauuguaguuaauuaugacauuuggagaaacuaauuucugucugucgacacuaucucuguuccauuuagacuuagagacuuacaugggcaaugcuugacuuuuugcauucagcacagaaaguuaaguaauccacugugguaaaauauuaacuaaauuuauaugacuucuugacugcuguaaguagagaauauuuaucauauaagcaccauuuuccugaauuuuuuguuacuacauauuuuaucuuacugucacuauuguguaaaaucuuugaaaggaaaaugaauacuguguaauaguuaaacccauucauagguugcaauagagugucagccaaaugugucauacaucaaaucuucagcagcuuuugcauaauccaggagaauugaauaauaguugaaguuaauuuugccagugaaauguagggaaagaaaaauguuugaaauuuaaauuauucagauagcuaaauucuuaauccuaaaauuuaaaccccuuaauucugucuguaguguuauaucaagacuuuuugauagucaugaaacugaguaaaacuuuauucagauuacuuaaaaacagcuuuuccugugguuaauaacaccuuuauuuugaacagaguacucuuaagcaacuuauauugugcugauuaaagauuuaaucugugcauauuuuuuauccuguuguuuauuuaguuuugauaacugugaaauaaaccauaauuaaaucacaaaagucaccugccucuuuuguuucccuggaaauuuggccaaauuuuuuuuaacggaaaguucugcuaaugaaaauugggaaauuggagacauauauuauuuugacuguguguccucugucauuaaagauggacuauacuagcugggugugguugcugaugccuauaaucccaccacuuugggaggccaaggcagguagacggcuugagcucaggaguucgagaccagccuggccaacauggugaaaccccgucucuacuaaaaauacaaaaaauuauccggucgugguugcgggcaccuguaaucccagcuccucgggaggcugagggaggagaaucgcuugaaccugggaggaggaaguugcagugagccgagauugugccauugcacuccauccugggcaacaagaggaaaacuguaucucaaaaacgaaaaaaaaaaaaaaaaauagagcugggcgugguggcaugugccuguggucccagcuacucaggaggcugaggugggaggaucgcuggggcccaggaggcagagguuucagugagcugagaucaugccgcugcacuccagcccgggcaacagagagagccugucucagaaaaaaaaaaaaaaaaagauggaauauaccgauuuuuacucuaaacaacaacuuugaauuaaguuuuugugauuuuuaaaaacaucuagauaggagagaugccagaauuuuuagaaauucuagaugaaugaggaaguaugcaauugaggauugguuuacagaugugauuguguggacuuuaaagggaucaaggugagugugcuguugaauuucucuggccggagcacauauauuggaaauuguuauuuaacaguugcucagaugacuccuaguugguuagucacgguaguugauaggagucguuuagagaacaacccugucccuugucuacagauuagcagucaucagcagccggaccaggaggugugugggaggugcucaggcccauccuggaguccgggacagagucagcagugcuuguugccugcaguucagaaaagccugaauuacuguuccaccacaugccugcgugcguagcaugagugugugugcgcuguuaccuacacccugugcugccugaaauugaaagcgcuuuuccuguucggugguuuguccuauuuuuauuuuaaauuguccugguaaauuuuaacaucaaguugagauuacuuaugaguuggcagagacuggcuaagauaagugacuaaggaagacaauaagaagaaaggugagcuggauaauccagcauucuggaaagccauaggagaaauccuaaggaaauagaaaaggcaaaucuuaagcuaacaguuaaacagacagauauagcacuagagaaaaugcuaagacaugucuuucccuugacuucucucgaauauuucagauggaggguggcuaguucauggccuguuuggcuuguuucuccccauuuggagagaugguagccuaauuuaucucucagaaauguaggacuucccugaaggccgacuugcuuucauuguaaauaaucaacuacacaucugaaaggguuucgguggaggagcacgggacugagaauuaggggauuaagguucugcacggccauguccuucaguaacgguauaaccucagaugugccuuuagauguacaggaacccccuuucagucugaaaaaugaagggugggaagguuuccagggccauuuuacugucuaagcuggucuugaggcugcauuuagugcauaagaucaggggcuagaggccaggugugguggcucacgccuguaaucccagcacuuugggaggccgaggcgaguggaucccgaggucaggaguuucagaccaaccugaccaacauggugaaaccccaucucuacuaaaaauacaaaaauuagccgggcgugguggugcacgccuguaaucccagcuacuccagaggcugaggcaggagaauugcuugaaccugggaggcggagguugcauugagccuagauugccugccacugcacuccagccugggugacagagugagacucugucucagaaaaaaaaaaaaaaaucaggggcuagauuuugggaagccuccccuccaugcagagcccccucauuuccugaccaucuccgucucugucaugggcacccaucacagucaucguacgcacauccccacccucacugcccuccuuugcguagccuagugucuugcacauggcacguggccaauacauugucauugaaugaauggauuuuauguacucuuuggagaucuccucuugccuuucuuucgugcuggugaauuucuuagaucaccauguugccugcuguagccuaguagguaucauacuaauuuuguagaccacuuuuccgugguugauauuguaaguuaaauuucuguucauaaaaaauguagccauuagauuaacguuuucuauuuuuguuaaugcucuuucgcaggggucuugcuccucagaacaaaccagaauugcagaaggugauggaaaaaagaaaacgagaccaaguaauaaagcagaaggaagaagaagcacagaagaagaaaucugacuuggaaauagagcuauuaaaacggcagcagaaguuggagcagguaagggggauuggcuggaagcugucuuuuuuuguuuuugucuugaagaauguuggaguguuggagcgggcaggauuuaccagacgugccaguguauacauuuauaccaugaaagaaauauuggagacaaaugucagcaaauggggucaaauauguucaaggcagggacaagaauccuacugaggaccuaaaagagaucccagaggcaaaagcaaaacagggacauggcacugaauucacacagggugcuggaguaauuuaaugaaauucacuuucaugaagacuccagagcaacugcgcguugacuccaggauuuguuuccuuagcccugucuuuucaauucuugucaucucgugguccuauuugcagugacagccaaguggcuucuguuucugugcacaauuacccagacucuauccauccauuucuuuaaaagugggggaccaggagagaauuuauucuguggggaaguaaaguugucagggacuuugaaaagagagaagaguauuuugaaaggcugcuugguuuguaaauaauuuuuccuuuucugaaugucauuuagcuugaacuugagaagcagaaauugcaagaagagcaagaaaaugcccccgaguuugugaaggugaaaggcaaucucaggagaacaggccaagaagucgcccaagcccaggaguccuaggcugaggcugcaccaagaccucgugugucaccccacagagcugucugugggugccuucucaaucucagggcaaaagccccuggagaauauuucagccagcagagaauuuugacuugcaguaggauuugguuugauuuuccuacgaucuggguggaugccuugccugugacaguugcaguuccuauucgccaaaugaagggcagugccccgcacguaaguuggaaugauggaccuguguucagagacuuaacagaaccaacaagcaaaacaagugagaacaggaaaaaggaagaggacacuggaaucaauucuugagaguugcacuacuugguuuuucuuccauuccaaguuucgugggacccagagccuuuuuucuuuuaaaagcuaaaaaacaaguguuuaauuccucuuuuuguuaucuguuagauaauugagaucaccuagaaaugcguuuaaucuguucacucacuguaaauuuugaggacccagaauugucuuguuuaauuuauacuuucaccccuguugcaguuaacaccagagaaggaacgugaaugucgagcacagccacuacccuuguuggcacuuaauuuagaaauagggugagaaguuuaaaagcccaucuugauuuuauuuucauuccuuuugguucucuguguaauaauagcaggcuacauagugacauuccaguuccaagaagguacauccuguccauucauuaauugcuuugauuacuaggaggguuucuguucaguuuuguuuuuaaaugucuugcugaucuaguucuuucagauggaauaaccuuccagucccuuagagaguggaacuaguccauauaacccagcuucaguagcaaaaguagaagccgccacaucuuuucauuucuccaagaggagaguggggaagguucccaugaccagcugggcagucaggauuucucuaggcauucuaaugugaaauaaguguagacugcugucaaggaggcuucaucagaagauguauagcauuugaaugucuaaugauaaugcauaucauuagaauccaagcuuugaaaauuucugauuaaugcucauguauuucuuuaucuuuguuuuuccuugugaagaaagacuuucaccacugucugagugaugaugcuguugauaaggaugaugucgaugacuacuauauugcaucucucaggaacagcugaugggaagggaggggcugcugaguucccuuguucuagcuagcagcacgcuccucagagagggggccgaguuacagacagcagccgcauucucaugcaaaauuaguuuuaaacugcuagugugggcaucgguaccuuuugccugggugauaccgaagaauuguugaggauuuaguaugcuccguagagacaguucagccagucauuucugcauuggagagacuucucauacuuucuuugaagacucauagaaagcuggaucuagagcuuuugaauccuuaauuagcacaguagaaauuagcuuucuaugggaaugcuuuaguguuagcaguugacaauuaggcccauauucaaucugaaugggaacaaaaguaaaugcaaugauaauauacugcuaguuagagaaacauguuaguugauuauaccugaaauggauuauuuaucucaucagcaaguauuauuugaauaaaaugagaaaugcuuaagaaaaauuguugcucuacaguaauuugguuucgaagaauggaaugguaacuauuuuuucccaucguucuuuugagagaaggaagugugaugacugaugaucuugaaaagcccauuucugauugcacguugacuggaauucuuucuuugugucuguggacuagcgaugcuguuuguaaaaugaagauucgggacuggcucauaucuuuuuaucuaacuagaugucagaucuugaaaucuguauucucgaagcaauucugccacuugaucguauucacaggggcccugguaggcuccuuuagaaggaccauuucuguuccuagagcuuaacuagaauucauucuucacugaaaaaaaaaaaaguuacuuaagaaagcauuucuuuccuaaucucacucaaaucugcagaauuauuuguaauuaguaauacaaaaucuggccaaaaggagacuuguaaauagcguaaaguggugucuuaugcuaaacgguggaauguauaggcagagaagcucuuugaaguugucagaugagcugggcucacaagccugauucaaacaggcugucggucuccucucaccccuuaauacugugcagcccaaacuccuaggacucuugaacaucugagcaguuuugugcuuugagccacuuuuugacaaaaauggcuccauuuuuccacagcgugguuuucuuaaaauaguuuaauguuuuauagucucauaguaguaguguugcuuucuaagcuauaacagucgacuuuauucuucuacucugaaaaaucuugacuuguuugaguguauauaauauauauaaagggagccuuaauggauugguuuucauaauuuaauauuuuuuguauuugcucuuguauaauuguuuuuaacggaaaguauuaaagaauugaggguggaauucuuagaaccaaaguuauucuuaauaaaaaucaccacaugcuuggaccaugcaac

SEQ ID NO: 13036 - RNA, 404 nt, Homo sapiens
cucuccgccagaccgccgccgcgccgccaucauggacaccagccgugugcagccuaucaagcuggccagggucaccaagguccugggcaggaccggcucucagggacagugcacgcaggugcgcguggaauucauggacgacacgagccgauccaucauccgcaauguaaaaggccccgugcgcgagggcgacgugcucacccuuuuggagucagagcgagaagcccggagguugcgcugagcuugcuugcucgcugggucuuggaugucggguucgaccacuuggccgaugggaauggucugucacagucugcuccuuuuuuuuuguccgccacacggaauugagaugcuccuuuaaauaaagcguuuguguuucaaguuaaaaaaaaaaaccaaaaaaaaaa

SEQ ID NO: 13037 - RNA, 1382 nt, Homo sapiens
agaaaccuuacauccuugacccuguaggaaauguuucguuuuauuccgauuuuaguuuaagaaacugugacaauuaaacagccuuuuuguuuaaaaaagaaaguguaaacaacauggaagugaugauuuuuaauuacauuuuuaaaauagcuuccaauauuaacugccaguauuguagauuaaaacggaguuucuuaaagucugggguuuucauuagcuugcucuaaacaaugugcuggcauugcugaccucucauuagggauuuccuugguuccauuuccuggugacaggugucgcggucauccccgugcugcagagaacacuucacuaugaguguaucguucuggugaaacaguuccgaccaccaauggggggcuacugcauagaguucccugcaggugagucacucaacaucgaauugcuucuuagggauguuggccugaaccaggguaaagccugagaacugcaaagcucagcucugcaguuuuuaaucuguccuugugguuuuaaguaaaacuaaaccauuucguagcgaggcuccuccaggcccccaggacaccccaacaacccucugaacccgugaaggcgacacaaggccaccucccacccaucccaaccuccucuuggcaaugcugccuccagccuuuuuuguuuguuuuuguuuuguuuugugagacggagucucgcucuaucacccaggcuggagugcaguggcacgaucucggcucacugcaaccuccgccuccuggguucaagcaauucuccugcuucagccucccgaguggcugggacuacaggcgcccgccaccacgcccggcuaauuuuuuguauuuuuaguagagacaggguuucaccguguuggccaggauggucucgaucuccugaccuugugaucugccugccuuggccucgcaaagugcugggauuacaggcgugagcccuugcacccugccgucuccagccuuuugaguaauugcccuuccccuucucagcuuauuugauuguuugucauuagccaucugcuaauggaaauuuccaaugauaaguaggccaggcuuuuuuuuuuuuugagauggagucucauucugucacccaggcuggagugcgguggcgugaucucggcucacugcaaccuccgccuccuggguucaagcgauucuccugccucagccuccugaguagcugggauuacaggcgugugucaccacacguggcuaauauuuguauuuuuuguagagacaggguuucacuguguugcccaggcugaucucaaacuccugaccucaggugauccacccacuuuggccccccaaaguguuggaauuacaggugugagccaccacgcccagccuaggccaggcucuuaacuccaagaaauguga

SEQ ID NO: 13038 - RNA, 1382 nt, Homo sapiens
ucacauuucuuggaguuaagagccuggccuaggcugggcgugguggcucacaccuguaauuccaacacuuuggggggccaaaguggguggaucaccugaggucaggaguuugagaucagccugggcaacacagugaaacccugucucuacaaaaaauacaaauauuagccacguguggugacacacgccuguaaucccagcuacucaggaggcugaggcaggagaaucgcuugaacccaggaggcggagguugcagugagccgagaucacgccaccgcacuccagccugggugacagaaugagacuccaucucaaaaaaaaaaaaagccuggccuacuuaucauuggaaauuuccauuagcagauggcuaaugacaaacaaucaaauaagcugagaaggggaagggcaauuacucaaaaggcuggagacggcagggugcaagggcucacgccuguaaucccagcacuuugcgaggccaaggcaggcagaucacaaggucaggagaucgagaccauccuggccaacacggugaaacccugucucuacuaaaaauacaaaaaauuagccgggcgugguggcgggcgccuguagucccagccacucgggaggcugaagcaggagaauugcuugaacccaggaggcggagguugcagugagccgagaucgugccacugcacuccagccugggugauagagcgagacuccgucucacaaaacaaaacaaaaacaaacaaaaaaggcuggaggcagcauugccaagaggagguugggaugggugggagguggccuugugucgccuucacggguucagaggguuguugggguguccugggggccuggaggagccucgcuacgaaaugguuuaguuuuacuuaaaaccacaaggacagauuaaaaacugcagagcugagcuuugcaguucucaggcuuuacccugguucaggccaacaucccuaagaagcaauucgauguugagugacucaccugcagggaacucuaugcaguagccccccauugguggucggaacuguuucaccagaacgauacacucauagugaaguguucucugcagcacggggaugaccgcgacaccugucaccaggaaauggaaccaaggaaaucccuaaugagaggucagcaaugccagcacauuguuuagagcaagcuaaugaaaaccccagacuuuaagaaacuccguuuuaaucuacaauacuggcaguuaauauuggaagcuauuuuaaaaauguaauuaaaaaucaucacuuccauguuguuuacacuuucuuuuuuaaacaaaaaggcuguuuaauugucacaguuucuuaaacuaaaaucggaauaaaacgaaacauuuccuacagggucaaggauguaagguuucu

SEQ ID NO: 13039 - RNA, 4795 nt, Homo sapiens
uauuugcuuucaauacauggggacccaggacgccaugcaugaaagaggucuccaaacggguacacauuuuggcaaacaggauaaagugauccaaaccugguaacacaggaggacuauuuagguaggcuaaguccagauuagagcgguauuuggaacgcaagucuaauauggagucuccucagcuccuuuuucggugauuauuccaugcagagugcauaaaaaugaaagaggcuuagacauugcaaaggaaaagacgaaccaagauccagauucagagcccuuaaaauuauccacuggccacucacaaauagcagugagcaaauacaugauaugcuuucaaaaggcaacuaguacaaauagaauucacggcaguccuccgccuuucucucgcuggcucucucuuucucccaaucucugggucucgauuucaucucccucuuccucuuuagauucuuuuuccccccuucucuucuaagguaaggaagcuacuugauucagagcauaauuauugucucagccagcucuagaaacuagaaaagcgugcauuaaaaacaaaggacacaacaacauaccuuaaaagcagcucuucauuucucauaguaacagcggauuugggacagcgcaugcuucuauacugauagucucaacaaaagccaguucagaaguaugcucaaacaucaaugccacagucgcugcucacuaacgcgcccucuccucccucucucucucucucucucucucucucucucucucucucccucucucucugucuucccacucucuucccuagucaaaugcugaauaguagagcaagggggcuccugcagauucacuaaguagaaauaauccucucugacaaguuauguugucuaugcauauuauuacacuaauacacugugcugccuauaggggucuugucugcauucacucaagccuggcugguauuacuucuccuaauuaccaucuuuaaaaauugggggaacaaaaaaaacaacaaccaaggaacucauuuaccuuuuucuuacacacuuaauagcaaaaccaauuucccaguugccuuuugcuaucaaaacuaccagcaagcaucgcagaugaguaaccacagauugggaugggucagugugcuaaaaaggauuuuugccucucuuuucugggacacugcauucacaguuggauucaucugcuccucuugucuuguccucaggaagagugacaaggucaagacccuuagccccacccugagucauagaugcauagcauagagaucgaggauuuggaaauauuuuaacucugugcgcaccagaauucucacaaaucagagcgucauucaccuggaggaggguaucuaaaggaggcaggcaaugcaaagauuguuugguggcacuggaguccucaucgacacaggagcaucaucugcaaaagaccaaugaguugcucuuuucuaaaauaagaaaaaucugcuuuccuaccaggcuucgcauguacaguuaaccagggaaauauacauuguacuucuguuuauuggaauuagaaaaauucuacgcagauuagccaaguaaaauaacaacacacacacacacacacacacacgcgcgcgcacacacacacaggaaagaagagaugcuaaggacugagcaauccgucaucaaaagugcaagcuaaggcacuauuccaggaggugugugcugaccugaagccaagaaugcgcucagcuuggauggaacaacauagaacagccucaaacagacgugggucacugaauccuggucccgcucccauucuccaacaugcaccucaguauaaccuggacucaaagcauuacuggggauaauaauagaggaggaaaguaaugguggacucuguuccccaccuauuugaagaucuggaacacacuccaauuucuugcuaggucucugaccucugaacuuggucuugauccacagcuagaaaaaugaacauguucucugggcagggggagacgaagguuuuuaaaucuccacugcacagaaaucuugcaugauguaucagcuggacuauggcaaauaagcgaaggauagcacucaccaucccuauuucuagagggcaacaagaaggcgugaugagucacuugacaaaaaucagaucaugaaaugagagccuugucccuaaaacaaccccauuuuuuuuuuacauauucuugcuucauucuaacauaugaaaguuacagugaauauauaaaaaugaacaaccuugccagcgaaugauaucauauaaaaucuaagauguucuuuugaaguaagaaaagcaucauguaaaugagcuuggaaccagagagaucuuagggagaaacaguuugagcccauucgccuugugacuugugcucggugcuggggcagaagucucuuaaccucucuguggcucucuuuacuccagcgguuaaaugggggcaacaaaugcuaauuuauuuuaaagcaugugaagagcuuguagugaaacuggguguguucagucagcguaaauauuauuaaaaaugggauaacuggacugauaccagccaccgguuuuguccauuagagaaaaguaaaaauacgcugcucggacacaaagcccuuuuugcauauuuccaugcaguuucuaaugggggcuaaacuaugaagcaagcacuaacguacaacaauaaugcaguugcuuauccaaagguaaauucuuaacauuggaagcccauguuguaguauauggggcuguuccuacagugaaauaaauuguggauccaugguaguaaggacuggaacugaaccaaaccauuaaauauuuuauacucucuccacuuccuuuuuagucuacggauguaaauaaugagaacgcuauugagguagaguuuaguaccugucuaaacgccacuaagaugacagauugagggcuuuacauccaccaugugcuaaaccuggguuauaaagaugaguaaauaggaagaaaggauguaguuuauaacauguacauaguguauauaguaagucuuugaccuccccaacuccacauggaauuaaucuuugcacuucuuaaugcacccacuagaauauuuuucccuuaucugauaauuaauacauauuuguuaaauaaaggaaugaauuuauguuuaaccacuggaaaugugaggagaggacuauuuuauuuucaaaaaaauuuuaaaugccauuucucuaacaacuaugugaaaaaaaaaauaaccuugacguuucuuauucuaauucaggcacuggucagcauagaugacuacacugagauauuccuuucaugcuauuguguuuuacauuucaagaccuuuucacauuuagcaauugauuuaauccccaugacaacauagugggcaggcaccgcugguuccuuaacccccuuagcugcagaaauucaaguguaggaaguggcuggagugacuuaccuggagaagaugcaauaaugauggagcuuaggcgcucauucuaccgacugcugggccugccccuuucuacgacaccacaugcaacccaaugcccccacugugcacagagauccgcauacucgccccagcaaagcauaguuuuuaaggagugcuuaguguaaugaaucuuacacuucccuaaugugauaguaauaaccuuaggggauagugauacgguuuggcucuguauccccacccaaaucucaccuugaacuguagcucccaaaauucccacguguuguaggagggaccuggugggagauaacugaaaucacaggggcgguuuuccccauucuguucucgugguagugaauaagucuuaugagaucuguugguuuuauaagggauuuccuuuuucacuuggcucucauuuccucucuugccuguugccauguaagacgugacuuuugccuuccgccaugauugugaggccuguccagccacauggaacugugaguccauuaaaccucuuuuucuuuauaaauuacccagucucagguaugucuuuaucagcaaugugaaaauggacuaauacagauagauaguaaguuaaugaaaaauugcuuaagcaguuucugacuuggauacuaguaucaaagcaauuccuuucaaacuuuauuccaaaugaaggucgaguugagccuagacagacuaacaacuuuugggggcuaauuauuaauauuuuuugggaucaucugcaguaggagccaauuuuuaacaauccugauuauuacuauauuugguugguagggauuucuuuuuuuccaaaaaaaaagcaguaauuaacaaagaacaauaagaaaaucuuagauuguucggaugcccucuauauccaaaaagauguuuuugcuguauaaauuacauuuuuagcuaauaaugcaaacuugaugaagaaaaaaacuagaaaaguucugcaaugugagaauauuggcagugagcuaagaaucagccagcuucuuggccuuuucagauuugagcuuucuaaacaaauuuaaaaggugaaauuauaggugcauuuguuucuguuauagguaauuuccagaagaaagagcuaaauuuccaaauacaacuuaaugauucuuaaguuuuuuuucugcuuucugugucuugucuuugcauuuuggcauuuacauugcaaaaguaauagaaaguaucauuucaauggaaguguuaauacaaaauaugccagagccugacagaacagauucccucuuugauaagcaugggacaguacacaaaucuagccugccucucaaauccuaaaagaacaauccaggaauguggaggcaucaaggacauuaaaucuauuuagcugcuaguuucagauacugagaacug

SEQ ID NO: 13040 - RNA, 1699 nt, Homo sapiens
cuuucgcuugaccucuccccgcccucaggucccucccgaccuccccgagccgggacggcugaagcggccggcgggagccccggcaccccgggcgcacucaccguggugggucggaggguaccucugcaccguggcccugaccgaguuuccguaguagggcgggacgugguugccuugaccgucgauguuaaaaagcacauccaccuccuccggcagcggguacugcgccgcguccauguaggaguggcugaggcccggguggugcguguccgggugcugcccguugagcacggcgggguggugguggcucacccagcgcggcugguccgccgucaccuccauggccucggcugugcucgcgcccucucgccgggcccggaacccgcgcgcggggagggagggcgguccgccugggaggucggggggcuccugccgucggagggucgggggucguugaaugauuugcuuucgguggggggaugggaaggcugggaagcaaaggugagcaaaggagaagguuuuuuaaaaauuaucuuggaggggucguuuagcaaagagaagaaggggaagacaaaaauccaaaaacuggguacggcagaauaaaacgggaccagguuguaaaaaggggcgacgacucugcaauucugcgagccaggcuccucugcaccgggguccucagccgcucggaggcggagucccuccucgggucaccugcaagggagagaaugggagaccuggaugagccccugaguugcuggaguggcacaaccuccccucgcgccgcccgcccgcccagcgcacccgagacccgcacgggagcgcggggacacggccgcggagcccgcagggcucucggggacgucccugcagcccggcucgcgggagccggggcuggcugagcaacuuggagggcaagucccagggcugacuguuacgacuuggagggcaagucccucccucggggacaccggucccgggaccguccucucagccccuagaaaaccuccaaaagaggagaguugaguuuuuaaaauugauuuagguccucccaagugguugggggcaaaaaaucaaacuuaaaaaaaaaaaaagucaccaguaccaaccuggguagcgaagagcagagaggaggaggaggcggcggcguacgaccugcucggucagauugcguugcucgcucugucucgcucucccuccgucucucucucuucuucucucucucucucccucucucaguauuuuuuuuuuuuuuuuacagggaaugcauucuuucugaaaguaucaagacggcgccaggcagcucaguguucgcagacagcuguggcgcgacgcaacuuaaggagguucuagugucauccgcgccgggggggaggagccuggcgcuggcgaguaggggacaggauccccggcacaaggaaacugcaacccaaacccgcuccaggacuucuccccccgccccgcgcacccccgccccuccucccgccccuccacugaccggaaaggggcgccgcagagggcggccgccggcggaggggcggcgggcagggugggcgaggcccgcggggcuugggggcggacgggagggaacgcgcgcucuggcccuuuaaauguggccgcggcuccugccaauucauucgggucggguggacgauuccgucccggugcagccagccugccccauucaugaaguucauuucga

SEQ ID NO: 13041 - RNA, 5702 nt, Homo sapiens
agggaaaaggaugggagggggaugccgaggagggagggccgaggucggccucgggacccacggggaaggaagggggaagggagcgaggcuggagaggcugcggcgcguggccugaggcggagagccgggcugcggggguccgggccaggccaggcgccggccugacccgccucgccggcaagagcaggccgggcuuccuccucccuuggcgggcgggggagggaaagggggauccuggccggggguaagggggaaaggugguccugauucucccugugccaccgccacaaagcugauccuggccuccugcggagaagccugagcgccuucccgcagaccugacgcgacccccucccagguaccugggccucggccuggucuagcgaguccccuuccucccaaggagcagccggcggagcucggguggaggaaagcgaggaggcgaccaggaggaugccgccgccgccgccgcagggcccggggcuucugcagggcgcaaggccucccucaccaggguaaggggcuggcgaucaaccuggacgccugggaccuugggagcaagcaucccgcagccgagcaggcgacggcgcggccaccgccuagagaggagccggggcccggggcggcgugcgggucggcagcagccggcuuggccuauccgaaaccccaggccuggaagcggcugcuuuaggcgucaaguugagcgggguauguguguccucuugggaaaaaggugagaaauggagccggacuuucuccacucgguagggguuaagcuaccacacacacccccaaacacaugcccacgugcaagucccucccacccgcccucccaggggcgaagagacccugucccaguggaaguggggaaacccagucggguacagaaagcagaggccauggcgcagagcggaggcgcggcuuucuggggcucagcccuagggcuacagacccagggcgcggagaugcucgcggccgggccacccaccagagccaggcaaccggcgcuuccaggcgagcuccgcggggccgaggugccgggagaagcggccccgggcgcccgcgcgcugcccgaccuggguaacaggcaaagcggagccccggggucgaaguccuaaaguuacuaaucccgcggagggggagagagcgugccucgggccgcccggggcggucauuugagcguguuuacuuaaagacuuugcaagcagagcgcgcgcgaaaucgucggauuuccagcgaggcagcaaauauuugcaggcagaagaaagaagcggagccgagccgagccgccgagucccuccccccggagccccggagccccggcgccugccugggcggucccggccgcgcagacagaaaagaagccgggaaucugcggggcuggggggcggggagcgacaccaaaggccagaaacugcagcacggcccgaggcccuggcgagcugggccugggggaggagaagucccuucccauuccagcucgaucaaucuugcugggcugcgaucggucaauaaaaacggugugaagcggccgcugucgcugugagucuggggaggaaguggaggccaaaggugucgaggccggcgccaguaccccgcaccagccggguccgcggccccgcggucugcacgucgcaggccgggggccagagcuuugccggcagccgagagcggcccggcggggccuuuaauugggugucuccauuuuaauagaggccauuguuggagcaauuagagaaagacaauaaccgcccagagacguuuaauucgauucccugcgcccgccgcaguacgcaccggggcgcucuggaagaguggccgaggcugcgcggaagggaggguccgcuuggggaggcgccggcuucuuuccuugcuugcuuugccuucggugugggaauuguaaagggcgacuggggcaagaugaaagcggggcgagggcgaccugagccaggccagggccggccucucuagcccacgccgggcgcccgcgggaccgccgcgccuuucgcggcgcgcguccagcuguggccgccgcggagguccccagcgccuguucaaaggagagaagccggaggaccgggccgugaaaacuggccuccuuccuccuuagccccggguccccauuucugucacccgaaccauguccauauuuccuucccuauggugggaggaggggcaaaggagagaucccggguauuggagcgcgcacaccuccgucuccaacccagccagccucaccgcccccuccuccgccucggccccuggauuagguuacccuggccgcgcaaggguuucuacuggauaggacuauagcacagguaaagcuguauaaacagcucgccggcugccgggcgggaggguuaugccggggacacggcuccaggcgccgccgcuggccccggcugcgcgggccacaccgcggggagcccgcugcggcagggcgccccggaccgcgcagguuaaauacauauuaucucugucucugccacucgggcccccguuuucuuucccuugcgagcugaaaugcggagagcggggagcaagaccuaaacgggaagaaaaggcagucgggcagugggcaauacugguugaggaucccggcccagcaaggcuggcucucuucaaacaaaacccagagagcagggaacuugggggaaagcagagaaagagggacccuaaaacucacuggcaaugggaagaugauggaggcgggugcguccaaggggcaacucuccucgcggcucccacgcccacgcgccccgggccaggagucuaccuuccccgugaaaugagcuaucguuuuggggaugguaugugauuugauuuacccuuuuuucuuuuccuuccuuuaguucuuuuuucuuuuucuuuuuucuuuuuuuuucuguuuguuuguuuguuuugcuuauucaucgaucaccguuuaaaacucggaaggaaacccgcccaggccaggagagccgcgagccguggggagagucaaaaaagaggagaugcgcugggagauuccccccgcccccgcacuccgcccccagcccggccccggccuccacuucgagggauccugacccucccaccgccacuaccaccuuuuccccgguugagaaaaccccugauuguagcgagauaaaaauuggguagguaggggugcagcggaaagggggagacaggaagggagagggcaggggauuucugcuuucggguuuaacaacucacacgugaggcgaguggcaguuggggggagccccggguugggugggagagaaggaacucgccuugagggugaguggaaaggaauuggagucacccuggaggaaaagugcccuuuucagcucucucccucccuccuggccuuggcagguggggggacaggugggugccacgggaggaaaagaagggguggaggcagcccagccggcgucccugggucucccgggcuuuggacaucuuacccugcccccaguggcaucagugacuccuagccaggggcuugcuacuucuagacccgaccucuccuccgucccagggggccgcucagccacaccgcuauagcacccaggacuccggccccugcaccaaggaaaggcuccagccuggcagaaauucacccauuucaaggcuuggcccaccaggccuuagcauugccgggugagguggggugcacgcgguguucagucuggccagucggagucaccugcuccacucccccggccuggucacccacauccucacagccacccagcuccugagcccccuggccaaccacagccccaacccccagcgcuggccucagccgagucuccuccgucugcuucaguuuggccuuuuaggaggagaaggagggcuuuaucuggggacuauuguguuuugacucaucuagauuagccuaggagcuggagugugauuguagcgggacacucuggcaggggauguguucacagcacggauaggaaaagagggggagggggacuccauucagaucuuggagacaguagaggcgcgcuuuuaaaagcacaaaccguucuugucuuccuuuggacaugcuagagaccaccuggugaaaaaaaaaauccauguuugugcccgacucagaggugcaaaggaggagguuuggcaugcgcacccuucucccggccucccuuggucccggacugcccccuacccgcagccccucccuccgggcagcucagcucuaggcugccuuccaccucgcggacccuaagcaauuuguuauauaaaacaaaacagcaaccagacgcaugugccuguucuucacuaacgccagcagaccggcagcgacggauacccgguggaccucagccgggacgccucgggcagcagcuucuugcccgcugccgcacccaccucugcaccccagcucgggucagcccagcagccaaagcaaaagggggauuccucaguuugcucccuuggaggcuacaaagccucucucugguuauuccaaccguuaaguaaaaaagaggugaugggaaagauuuggucugcacacaaagauauaccaggagaagaaugcacauuuauguguaaaauggcuuaggcaccaagaaugagacaucacuucagugcagccuagaaauaguuaaaaauaaccgaaugcuagaggacagaggugguuuugggaucugccccacacuccuuaucaggaucccuaauucccugccaccuccuaugguuccaggacgcaaacugcuuuaaccuccagaagagggguuuucagccaccuggcucccaccuaccugccgguuccccaggcacucugugugacccagggcaacuggacaacccaaaagaaaaccccuaccaaacaaugcucagggcuucccacucccaucccuucucugcgccccugacuguccccaccucguuuaucuucugcaagaaggcaggguguaaaugucaaauaaagaaaaaugcagcuugccagaucuccuugcuuuugguggggacagaauagccccagugcuggggcuggcagagaucucuugugcagaguggaggaugggcccguggauugcagccgcuccgcauuuucuaagcccugcggcuucuugggccagggacuuaaggcuuuacggggcagcuggcugggagcugcaagcagggccuccugcuugaucccaccgaaagacuccauaaucagacccccuaugcgacccgacacccaauggggucuuggucugaacugacaccacgccccgacuggguucaaauggguagaaaacaauuccguucuucugaauggcacaaacaugucaugguaagccccugacacacacacacacacacacacacacacacacacacacacacacugccagccauuugggcccccaagcaucucauuuacagaugccuggauggacucaaccugccuggcuagacccccagcccacccacugcuacuaccacuaccuucucggcagcagccgcuaggcagaggaggcuuuggaaaugcuacuucaacauggaucccuuuaaaguucuuaaucucccaucugcgaccccagcauccuggugagcauggacaauagggaggagagaaggaccaggaaauaugggaacgaagccgagggagaugccgcacuuuccccccugcccuugccagaaucaccggugucacuuuccucaggcacccuguugguguccgagagaaagaaaaggcauguaaagcagcuguccug

SEQ ID NO: 13042 - RNA, 5702 nt, Homo sapiens
caggacagcugcuuuacaugccuuuucuuucucucggacaccaacagggugccugaggaaagugacaccggugauucuggcaagggcaggggggaaagugcggcaucucccucggcuucguucccauauuuccugguccuucucuccucccuauuguccaugcucaccaggaugcuggggucgcagaugggagauuaagaacuuuaaagggauccauguugaaguagcauuuccaaagccuccucugccuagcggcugcugccgagaagguagugguaguagcagugggugggcugggggucuagccaggcagguugaguccauccaggcaucuguaaaugagaugcuugggggcccaaauggcuggcagugugugugugugugugugugugugugugugugugugugugugucaggggcuuaccaugacauguuugugccauucagaagaacggaauuguuuucuacccauuugaacccagucggggcguggugucaguucagaccaagaccccauugggugucgggucgcauagggggucugauuauggagucuuucggugggaucaagcaggaggcccugcuugcagcucccagccagcugccccguaaagccuuaagucccuggcccaagaagccgcagggcuuagaaaaugcggagcggcugcaauccacgggcccauccuccacucugcacaagagaucucugccagccccagcacuggggcuauucuguccccaccaaaagcaaggagaucuggcaagcugcauuuuucuuuauuugacauuuacacccugccuucuugcagaagauaaacgagguggggacagucaggggcgcagagaagggaugggagugggaagcccugagcauuguuugguagggguuuucuuuuggguuguccaguugcccugggucacacagagugccuggggaaccggcagguaggugggagccagguggcugaaaaccccucuucuggagguuaaagcaguuugcguccuggaaccauaggagguggcagggaauuagggauccugauaaggaguguggggcagaucccaaaaccaccucuguccucuagcauucgguuauuuuuaacuauuucuaggcugcacugaagugaugucucauucuuggugccuaagccauuuuacacauaaaugugcauucuucuccugguauaucuuugugugcagaccaaaucuuucccaucaccucuuuuuuacuuaacgguuggaauaaccagagagaggcuuuguagccuccaagggagcaaacugaggaaucccccuuuugcuuuggcugcugggcugacccgagcuggggugcagaggugggugcggcagcgggcaagaagcugcugcccgaggcgucccggcugagguccaccggguauccgucgcugccggucugcuggcguuagugaagaacaggcacaugcgucugguugcuguuuuguuuuauauaacaaauugcuuaggguccgcgagguggaaggcagccuagagcugagcugcccggagggaggggcugcggguagggggcaguccgggaccaagggaggccgggagaagggugcgcaugccaaaccuccuccuuugcaccucugagucgggcacaaacauggauuuuuuuuuucaccagguggucucuagcauguccaaaggaagacaagaacgguuugugcuuuuaaaagcgcgccucuacugucuccaagaucugaauggagucccccucccccucuuuuccuauccgugcugugaacacauccccugccagagugucccgcuacaaucacacuccagcuccuaggcuaaucuagaugagucaaaacacaauaguccccagauaaagcccuccuucuccuccuaaaaggccaaacugaagcagacggaggagacucggcugaggccagcgcuggggguuggggcugugguuggccagggggcucaggagcuggguggcugugaggaugugggugaccaggccgggggaguggagcaggugacuccgacuggccagacugaacaccgcgugcaccccaccucacccggcaaugcuaaggccuggugggccaagccuugaaaugggugaauuucugccaggcuggagccuuuccuuggugcaggggccggaguccugggugcuauagcgguguggcugagcggcccccugggacggaggagaggucgggucuagaaguagcaagccccuggcuaggagucacugaugccacugggggcaggguaagauguccaaagcccgggagacccagggacgccggcugggcugccuccaccccuucuuuuccucccguggcacccaccuguccccccaccugccaaggccaggagggagggagagagcugaaaagggcacuuuuccuccagggugacuccaauuccuuuccacucacccucaaggcgaguuccuucucucccacccaacccggggcuccccccaacugccacucgccucacgugugaguuguuaaacccgaaagcagaaauccccugcccucucccuuccugucucccccuuuccgcugcaccccuaccuacccaauuuuuaucucgcuacaaucagggguuuucucaaccggggaaaaggugguaguggcggugggagggucaggaucccucgaaguggaggccggggccgggcugggggcggagugcgggggcggggggaaucucccagcgcaucuccucuuuuuugacucuccccacggcucgcggcucuccuggccugggcggguuuccuuccgaguuuuaaacggugaucgaugaauaagcaaaacaaacaaacaaacagaaaaaaaaagaaaaaagaaaaagaaaaaagaacuaaaggaaggaaaagaaaaaaggguaaaucaaaucacauaccauccccaaaacgauagcucauuucacggggaagguagacuccuggcccggggcgcgugggcgugggagccgcgaggagaguugccccuuggacgcacccgccuccaucaucuucccauugccagugaguuuuagggucccucuuucucugcuuucccccaaguucccugcucucuggguuuuguuugaagagagccagccuugcugggccgggauccucaaccaguauugcccacugcccgacugccuuuucuucccguuuaggucuugcuccccgcucuccgcauuucagcucgcaagggaaagaaaacgggggcccgaguggcagagacagagauaauauguauuuaaccugcgcgguccggggcgcccugccgcagcgggcuccccgcgguguggcccgcgcagccggggccagcggcggcgccuggagccguguccccggcauaacccucccgcccggcagccggcgagcuguuuauacagcuuuaccugugcuauaguccuauccaguagaaacccuugcgcggccaggguaaccuaauccaggggccgaggcggaggagggggcggugaggcuggcuggguuggagacggaggugugcgcgcuccaauacccgggaucucuccuuugccccuccucccaccauagggaaggaaauauggacaugguucgggugacagaaauggggacccggggcuaaggaggaaggaggccaguuuucacggcccgguccuccggcuucucuccuuugaacaggcgcuggggaccuccgcggcggccacagcuggacgcgcgccgcgaaaggcgcggcggucccgcgggcgcccggcgugggcuagagaggccggcccuggccuggcucaggucgcccucgccccgcuuucaucuugccccagucgcccuuuacaauucccacaccgaaggcaaagcaagcaaggaaagaagccggcgccuccccaagcggacccucccuuccgcgcagccucggccacucuuccagagcgccccggugcguacugcggcgggcgcagggaaucgaauuaaacgucucugggcgguuauugucuuucucuaauugcuccaacaauggccucuauuaaaauggagacacccaauuaaaggccccgccgggccgcucucggcugccggcaaagcucuggcccccggccugcgacgugcagaccgcggggccgcggacccggcuggugcgggguacuggcgccggccucgacaccuuuggccuccacuuccuccccagacucacagcgacagcggccgcuucacaccguuuuuauugaccgaucgcagcccagcaagauugaucgagcuggaaugggaagggacuucuccucccccaggcccagcucgccagggccucgggccgugcugcaguuucuggccuuuggugucgcuccccgccccccagccccgcagauucccggcuucuuuucugucugcgcggccgggaccgcccaggcaggcgccggggcuccggggcuccggggggagggacucggcggcucggcucggcuccgcuucuuucuucugccugcaaauauuugcugccucgcuggaaauccgacgauuucgcgcgcgcucugcuugcaaagucuuuaaguaaacacgcucaaaugaccgccccgggcggcccgaggcacgcucucucccccuccgcgggauuaguaacuuuaggacuucgaccccggggcuccgcuuugccuguuacccaggucgggcagcgcgcgggcgcccggggccgcuucucccggcaccucggccccgcggagcucgccuggaagcgccgguugccuggcucugguggguggcccggccgcgagcaucuccgcgcccugggucuguagcccuagggcugagccccagaaagccgcgccuccgcucugcgccauggccucugcuuucuguacccgacuggguuuccccacuuccacugggacagggucucuucgccccugggagggcgggugggagggacuugcacgugggcauguguuugggggugugugugguagcuuaaccccuaccgaguggagaaaguccggcuccauuucucaccuuuuucccaagaggacacacauaccccgcucaacuugacgccuaaagcagccgcuuccaggccugggguuucggauaggccaagccggcugcugccgacccgcacgccgccccgggccccggcuccucucuaggcgguggccgcgccgucgccugcucggcugcgggaugcuugcucccaaggucccaggcguccagguugaucgccagccccuuacccuggugagggaggccuugcgcccugcagaagccccgggcccugcggcggcggcggcggcauccuccuggucgccuccucgcuuuccuccacccgagcuccgccggcugcuccuugggaggaaggggacucgcuagaccaggccgaggcccagguaccugggagggggucgcgucaggucugcgggaaggcgcucaggcuucuccgcaggaggccaggaucagcuuuguggcgguggcacagggagaaucaggaccaccuuucccccuuacccccggccaggaucccccuuucccucccccgcccgccaagggaggaggaagcccggccugcucuugccggcgaggcgggucaggccggcgccuggccuggcccggacccccgcagcccggcucuccgccucaggccacgcgccgcagccucuccagccucgcucccuucccccuuccuuccccgugggucccgaggccgaccucggcccucccuccucggcaucccccucccauccuuuucccu

SEQ ID NO: 13043 - RNA, 1620 nt, Homo sapiens
aguaguuugcgggcaagggagaaaaaggaccgagguaaaagaggguguagggcacgcuggggguggaucuacccgcagcaaacaggagacaaugagagagauccagacacaauucagagcggaggagcgguaggaggguguggagcugggagcgaagacccgacucccgggcugguggcgggaaguuagcggauaaggaagaggcacccgaaggaugacuagaguuuggagcggcaguggaagcccagggacgugggaggccgaggaaacagcagaucucgaggcggggugcgggaugcacaccccggggacgcggagggacagggagagcgaaggugucacccuugacuugccggggcagcccucccgcacccagcccgguacucacagagcucagaguaccgauggcagccccggcccagcugcugcagauagcgcugcagcacguccgugaggagguggcaggcgcugagcugcaccgagucccagcccagcgccuggcagaucugcgccaccgagacccucaacaacgaccuggaguaacucucgcacaucccgcugcguggacgccaccgcagcccuugcugccacugcucuccagccccgccgccagaccuuagcaggguccccgauucauccucuagggcuuccgcggcggggaaagggucccccggacccccggcgaccaccucaaagccccagcagcacggagcgcgccagccugagagccgccauuuuggacucgcuccgccucccgcuggacggccgccggggcgaggcagcauaagccgaaugccgagcgcggcgaugagaaagcuccgccccuugggagcggaacgauuccucgggaucgccucugaggccuggaagccggccggaagcgggcguggggcgcgcagguggaggaggcgcccagggcggcaggugcuggggcgcucaccugggggacagcggugacgaaaacgccaguguuuuagaggcaaacgagggaucugggauacgacauugacagguuagagaguuagcacuaauaacguuagucauauuagagaguuaugugcuagagagaaguuuggggcgugggaacuuacggagcucgccaaacgcagaccugcgcugguguugccucagcuaaaaaucuguguauugagcugcuugccacugcaaagauuaaauaaaguccaagcuguuccgcaugcccuucaaagcccuucgcaauagggcaggaacuaggaggacucugugccaaauuaaugggggccucaaaaaacucagucaucaagaucgauaauauuuuaacaguuuuuuuaaaaaaauccaaauccaugccauaaacuccugacucacucaugucauucuaaucccagcccugguuccaauaaaacuuuuuuuuuuuuuuuuuuuuuaaaaaaaacagguaagcugccugugggcuauagugugcgauuugagcaucgcggcugugaccuaucgggggauggggaccucggcugccuacagaggccaaaccgagccuuaaaccggugucgcaggccgaguguccugggaacgguugccuaccccagagccuucucccagcuccauccaaguauugccagaaaucggauuuagggauaaaua

SEQ ID NO: 13044 - RNA, 36019 nt, Homo sapiens
uccacauuuuagacuuacuuagauucuuaucucucugcaauaauccuaaugcuaauucacuuucucagagguguccagcgcaggaugggcuuagaucauccguggaauugcuuguucuauaagcuuuaguuacuuugaugacuggaaguauguaaguucagagacaugcauuaaauacauguuucugguuuuccccaaaugacccauggacagauaggugccuguauuuauuuugugucaaauuucaucuuauucauuuaguuggagacauaguuaucugauggguucucugggguaaucauuuagaacuccugaacuuuagcaagaagcuguaagaaaguccaaguucuuuuucuuaaaacuucaaauaagguuccccagugagucuggggaaggccaugacauugucagaaaagcuguuccguaucugugccuccgagguuccugcacggcacugcugaauggccaauuugcugcgaauacgcaucgaucgucugaugcacggcgcucugcacugaggacaccgugaagaugaaccgugguucauuccagggguuagcugaguucugaaacuggaaagugaacgaccauuuaucaguaggugaaacagaacugugcuggaacacagccagcgggaguucaauuaggcagaaacaaaucggggggaaaggaagggauggcguucugcauggggcucaggcaccaucuccuuagaaacggcugcugcaaagccgccgcaauaaaugcucugcugagucuguccacagccccacccgguagagaggccacuaagggacaaagccaggaaacucuggcagcuuucucugccacagaaagugaacugguagcagcaaagcugguuuaaauacaucuuagaacagaaauagggaagcuagcuucuuggggagcuguucuguguucuuggcuuguuuguguguuuggcaagaaauacaauggaaaaagccucuccuaucaaacacaaaggaugcuuucauuaagucauccuuccuuuucauuggaucaaaugguuuucaaaaaugggauuucugauucaauuaaaugauguggggaaaacuugggagcuuccaauuaagcuuauuuuccucuccuuuaaaauucccuccccccauuuuucuggauguuuuauaauguaucuacuauauucauacaauagugcauggucauucucuuuaaauaaauaauuaugaauuuaauggggaguuuaggcuugauuauuuuuauuuuauuauuuuuuuacagguagagauaugaggcaauaaaaauuuuuggugugguggcucgggccuguaaucccagcacauugggaggcuaaagcaggaggauugcuugaggccagaaguuugagaucaaucuaugcaacauaggaagaccccugucuuuacaaaaaaaaaacaaaaacaaaaauuaaagcacuaggucgggugugguggcucaugccuguaaucccaguacuuugggaggcuaaggcagguggaucacccaaggucggaguucgugaacccccugaccaacauggaguaacccugucucuacugaaaauacaaaauuagccaggugugauggugcaugccuguaaucccagcuacucgggaggcugaggcaggagaaucacuugaaccugggaggcagagggugcagugagccaagaucacaccauugcacuccagccugggcaacaagagcaaaacgccaucucaaaaaaaaaaaaaaaaaaauugaaacauuagccaggcagggugauacgugccuguaguuucagcugcuugggaggcugagguagguggaucacuugagcccaggaguuuaaggcugcaguggguuaugaucaucccaccacacuucagccuugggugacaggaaaagacccugucuccaaaacaaaacaaaaaaaaaucggagaccacuacuuuagaauuuagaaucagaaacaugcuucugccacuugcuccuuccuacuuaagaaguggcauucagaggcuaggaggcucuggauacugggauaacuggagcacugugauaauccagacaaaaguuaugguguguuuugauagaaaaauacaaaaauaagaguucaaggggaauaaaaagaaagauucaguguaaguuaugaauauaagcauguaaaguaagaauaggaauuaaaacaguuuuacauuucagguuauguaacuauuuacucagaaaauguuuuuuuaaaauuacccauuuuccaguagaaaacacugguauaugacaucccucaacaguccaccccugcuuccaguuuccuuuaugaaauagaacuuacugugaugaaaagugaugauuaacauaagugguuacaacuauacuaggaauaauagugacagagaaauacaaacuguaauugcuuuuguuuuucaaggaaaaagagucauuuuucagugauuuucaagcauuuugguuugugucaccuuuaaauucauaaaacauuauugacaauccuagcguuuuucuuguauguguguugauauuuaccauauuaaaaauuaagaccaagauuucaaaaugacccauuuuaugggguggggagguccccacaucuuggauuccaauuccuaccucugcagagaacugcagaguggcugagugcauggcacauucagcuugcaaauggcuugccuaacccaucgggugcgccucggccuccaguucaucucccuuuccggucguuugacuuguuuguugaacaggguauuuuuauacugaauucucccucggacucuguagggaaaaucaaucauggauuguguggccguggaacauacacggcccguggaugagcuggcucauggcucgucacagagucagcugucuacacggcgugauugaagcuuuacgugggagugcacucggaccccagguauuuccuccuuuugugugucauggcacccagcuccucuccagccugcuguuuccugugcugacuuaccaagucugaaucucaggcuggguucccucaaugaggugugcuccucugugaccuccccacucccuauagccgcuccaccuuccucucucaaauucaagggcugcccaagcugcaagcucauugagcaguuccagaaaagcuuaaaugggaagaacaaugacagggaggcaaaacaccugcuugcaacucaaacauguguuuccuuuagagcaucugaauacauggagcucuggucacugccugggccuggagacggggcagggaaucagacggggaauacaguaacaaacucgagucacugugcauuugaagcaaggcguugauucaacacgccaagaugacgggugguccccagauccuggauccagaggcacuaaccacgccuacuauacagugagauacaaagaaguguccugcaugcucccuuggccaucggggccagaccaaguguuuggauuuugugcugcugauucugaaacuccaccuccaauccucgagaagucucccugcaggucuacuguuuggcuaugaucgaugguccccaggugugguguuauuucauuuccaguuuaucacguuaauauuuuacacauuauggggaauccuggaaugagugcuguucuacgcacacaggaaagccacaguuaaucuguagaagguguuccagcagcuuauggagcuuugguuucuaaaagacuaaagugcucaguggacugcagauaccugaaacaaugaggauuuuuuuucuuguguuuugauuuuugcuuucaggugggaacccauuuuucaaaaggacuaauuugaguugugguuggaugcaaaccuuggcuggaaucucccccacugauccugucguucucuugugauugcuaacaguuccacgcggcacaaauaagccaaggauauugcaggcgcgaucugaaagccggagcaacaugggaagagcaaaaaggucauuuuucuucccugccacccccuccauuuucccuggaugcuccuguggacugaaagcauaaauugcacugcucagccccugauggaucacugcacagcuggggcugggaggcuggagggaggguccccauaaucuccuuuucccaggcucuguuccaauuucaucuucgucccauuuuacaaacucuucccuuucuuccuaaucagaguuucgucuggaaugggugccggugcuuuuccacugcaaaagcaacccaggcaauuugcuuuagagguuggagccaaggucugaggaauugagacaagaaaacaucccaggguaguguggaagugcagccuucucuauucccagccuguugcagacagccgugccaucuccuacacccacaggugauuuuuuguuuuguuuuuguuuuuuguuuucuguuuuugagacagauucuagcucugucacccaggcuggagugcaggggcgccgucucugcucacugcaaccuccuccuccuggguucaagugauucuucugcuucagccucccgaguagcugggauuacaggugugcaccaccaugccuggcuaauuuuuguauuuuuaguagagacgggguuucaccaaguuggccaggcuggucuggaacuccugaccucaggugauccgcccaccucagccucccaaagugcugggauuccaggcgugagccaccuugccugggcagagguguguucauuguuguuguugcuucuaucagguggcgaacgccaggcauuaccaugacuugggcaguacaccucacucugagcgacagugcccuggaaagaacaugagccucuagaguccauugaacucagcuuugaguuccagguucugucacuuauuaguggacaagucauuaggcuucccuaagucuuccauuucugauucuuaaaaugaggauaaaaggacccaccucgcaggguugcuggaaggguuguguuaagggugccaggcauauacuagguuuccaaacaaugagcuaguccuauguccagacucuuaaacuaugauggguuaaaaauaguaaaucauauuuuuuuucauuaaaaacaauuuuuuuuuagagauagggucacccaggcuggagugcaguggugugaucauggcucauugcagccucguacacaagcaauccucccaccucagccucccaaguagcugggacuacaggcaugugccaccaugccaggcuuaauuuguuuuauuuuuauuucuuguacauuuggggucucacuguguugcucaggcuggucuagaacuccuggccucaagcuauccuaccaccucggccucccaaagugcugagacuauaggggugaaccacugugcccagccugaaagaauguuuuugaugaaauguaugauugaaagauugacuucgacccucccuagucuuuaaaugucuuugugcaguauuuuacuguguuuagguucugcacacauuuuagaaccugaaaauuccuaugcaauuaucuaaccuuccuguaugcaggaggaaacugaggcaugggaugcuucagggucggccgugucucugcccacuggccuugcccccugcuaucuauucugccuucugccucugcucuccccagcacucacacugcuggccguguaucacucgacccagggacuccacguucuaacugcugcaaauuaguaacccacagaaugccacaccuaaguauaucaaugugcuccauguguaauuacuaagaaugucucauuuucugaccagguuagagaagagggucaccgcuauuuuguuuuguuuccuuacggcuguaguagugugcuacuccugccuuggccucccaaagcucuggaaugacagacuugaggcacugugcccagucagauuuuuucuuuuaguuggagggcaaaugagaaggagaaacugcaaggcugggggcgguggcucacaccuguaaccccaacacuuugggagucugaggcaggaggaucacuucagcccaggaguucaagaccaaccugggcaacaguucuacaaaaaguuuaaagaugagccgagugugguggcgugcaccuguagucccagcugcuuggugaggggcugaggagggagaaucacuugagcccaggaagcugaggcugccgugagaugagauugcaccacuacacuccagccuaggugacagagcaagauccugucucaaaauaagaaauaaaaauaaagaaaaggaagaggagcugauacacuguuggguuaauaauuccagggcuuagacaaggcuaguuugaguauuugaugaauagaucuccccaucggcagaauccucgauaucuaagaagcgccccauguuuugugaacaugguccuuccuggggcuccuguguuugcccaguggagagacaaagguccacauaugacaaauuaacaaauaaaauucaaacuuccuuggcuacugugauagcccuugccaacguuucaagccacaaaaugagaaacacacacacacacacacacacacacacaccccuugccaaggcuuauaaaaacugugcaguaguuacauaaaguuuccaagcaagaaguuacuucauaaaccaaauuauuugugaggcuuaaaaaaaaaacaacgagaaaauauguuucuugcuugaaccaauucccauguuaaacgucugccuucaucacucauuuuuauuaccagucuaaacacagacuguuucaauggaggccauuuacagcauacaauaaaacggauucauuacucauuuuccucuuauuaucuuucaauugcuguagcucucagcacugcauacaguggacauuagguccaaguagacagugcauuacacgaucucaauugauggcaaucccuaacacccuuaaacacacagacacgggagacgcucugucccugauccguucccuugcgccgcuuuuuaucacacucauucuauuuucgucucauuaaacuuccuauuuuucacaggaaguucucccucuccuagucgauaccacgucucccucucagucugcacccaucccaggccccaugcaguuugcuuaagccauuucuucuuaaaaaaaaugcacacacaaacacccaccacauuacucacguaauuaaguauaauuucucuagcaacaagcugacaacagcuauuaaaaguggaguuggagauugaaucuuggcgcggccugcaagugauaguguucuggaugacaggcaaugguuaugucaugauccgaacagagauaagagccccaaacgaugugcuggcuuuuauugcauggauuaguaccuucuccccaaaccaccuccaccuuccucugggcugauuccgcuacauucauccgggugcuauuuugauacuucaauguagcuugcuaaaauuggaauuaauuagcugggcuuggaagcgcaggcccauaaucccagcuacucaggaggcugaggcagaagaaucacuugaaccugggaggcagaguuugcagugagcagagaucacaccacugcaugccagccggggugacagggcaagacucggucucaaaaaaauaauaauaauaauuuaaaauuggaauuaaugagguucagaaaaauagggucuggaaaaaaaagcccaguggcuuugguaauucgaguuaaugccccuuuacuuauagauaaaaauauuuguuuuuauugauaauaaacauauggcagcuuucucgaugaagcucuaagucauuuauaaucucaugguuccugugggcuuauuccugaucuaguuaacuaaaacauaggagucuuacacaaaccuggguuggauuugaauucucaucuaccacucagcaucuaugggacccugaauaaguccugccaccucucugugcuucuuuucccggucggucaaaugaguauaaugauaccccgucuuucagguuguugagaggaacaaaaaaagauaauguccauaaaacacauacuucagugcccagacuuuauuaggugcuucauaaauauuagcuauugugucuguucacacuaguuauuagguggcuaugaugugacaagagcuuucauguggugucuuugugaauucucacaauacuguaugguugggauuauuauccccauguuccaaaugggaaaacucuuuaagaaguaaguuucuaguauguguccgcugcagaucugucccgucuccaaugccuuggaucuucucaacgcaguacugugcaugcaggaacccgaaccuuggguuuggaaggcauugaagucuaugcuguaaauagcugguccuaccccaaguuuuggucugugguggccacguccaggcauuccugagccaccucccagucaaugguggagcaggacugucccagagauagucuggagcaauggaaggggcucauccaagugggaacuauguauuaaugguuaaagcaauaggagacuuggugcaagcuuccaagggaaguacucugaggucuugggugauuuauaauauugggggaggcaggggaggcauuaacagcagaaggcacauacaaugacauugauauaaaugauugcaugucagagaaaaaauacugucagggucaccuucagucaugccacuuaauucugcuuuuucaugauagaaacugagcuucagaaaauguggcagggauuuaaaaugauugaaacagucauuuccuuaaaagguggcuuccugugucaaaaauuaaccuagcuuugauuuccacccuugaauaaaucuuuacagauaagaccacucucaaaaauucaaaaugugcacaaaugaacagcgagucauuuugaguggaagggacaucuggcagcauuuggauuuagagcaucccucuagaaauaucagugacuuaaugacucaucauuugaaagcaaugcaguugggucagauggaguuuuagcagcuugugucagcaacugauccuauuuuauaggaaguggaaaggggaaaaaagaggaagaaaaaguggaagaaagaguugggagagucuacuauaaaaauccaggcuacauuccuuugcguuaucaaauucuguagucugccuugccuaccaacaucgccuuaagcuacugcacuaguccuagcaauagcaaaacuuguucugcccuuguuucucucccuuuuuuuuuuuuuuuuugagauggagucucgcuuuguugcccagguuugagugcaguagugugaucuuggcucaccgcaacuuccgccuccuggguucaagugauucuccugccucagccuccugaguagcugagauuacagacacacaccaccauguccagccaauuuuuguauuuuuaguagagaggggguuucaccauguuggucaggcuggucuugaacuacugaccucgugaucugcccgccucggccucccaaagugccaggauuacaggcuucagccaccgcgccaggcuauuucucuucuuaggcucaucuuucggagcaugucuuacugcauggauuugacauauguguuugucuucucagcuauacaaugaacucuucucagauugcuccacucauccuucuuucaucucaaacuccaucuugauaucaccugcugcccucccccaccccccuccaucugguccacccugucuccucagugggagcugcccugcaaggcccacugcugcuugcccguucucagccuccagaaugaccaagaugacaccucuacagcucagcagggaaagugaaacucagaggcaaaaaugaaaaaaaaaaagaaagaaagaaagaaagaaaguugccaaggccacauagcuaguuuuggagccagaaugcaaaucuugaauucauguguucggauuaguuagcuagcuaauuaacauauaaauaaaagccuuucugauuccaaaacucaugcuuuuaaaauuauaucccacagagcacagaaaacauauacuaguugaauccucccaugguaauucuaaccgaagguuuccuccuccaacucuuccucuaggcuuagggccaugguaggugccaacagaaguagcugaugagaaugugauugcaauuagugguggcuauuaugaguuccaguuuaacggagaaaacacuucuauuggcaaauauauaauggauugaaauauaccaacaauaaagaauagggaagagggcugggugcaguggcucauggcuguaaucucaacacuuugggaggcugagacaggcagaucaucugaggucagaugcucaagaccagccuggccaacguggcaaaacccugucucuacuaaaaauagaaaaauuacccgggcaugguggcacacaccuguaaucccaacuacuuggaaggcuaaggugcaagaauggcuugaacccaggagauggagguugcaauuagccgagaucaugccacugcauuccagccugggcaacagaacaagaaccugucucaaaaaaaaaaaaaaaaaaaaaaaauaggucugacuuucaauuuuccuuaaaucaaaaaucuaugaaguugaauaucuaacaagaaacaauguuaaucccuuuauccauuauucuuauuuccccaacucgaaaacccauauuuucauuuucaaguucaauggaggcccucacauugagccaauucccuugauccuuugauucaaccagccauucucucugaagaaugggaggugccagggugguaucaguacagucacuaaauauuagauguucugcacagaguguuauaggacugguaugguucggggaggauuguucgucaggcuggcuccugccuuuuuuggguauccuguuuguuacuuagccuuuucucuuacccacuccucagugccagccuuccuaccuggguuccccaggaguggagcaugcggguaggagagugccagucugcauucacaaagaagagggcuuugccaaccugaagacaccagcucaucugauggugccuuuuccuagcuguguggccuuaagugaauuacuaaaccucacucacucuuugugucuucaacuguaaaaaugccgauaauaacuaccucccacgguuugggggggaauucaauaaaagagugcuuguaaaaacuccuggcuuucacaaacagacaaggaaaauguaguagauuuuuaacacauuugcuuccuacuuucuuucuuucaaaguccaacauagcaagagaugcaaauguuuucuaaucccaaaaugaaaacguauguuagaggucgggugcgguggcucacgccuguaaucccagcaccuuaggaggcugaggcgggcggaucacuuggggucagggguucgagaucagccuggccaacauggcaaaaccccaucucuacuacaaauacaaaaauuauuugggcgugguggcgggugccuguaaucccagcuacccgggaggcugagguagaagaaucgcuugaacccugggagauggagguugcagugagcuccagccugggcaacagagugagacucagucucaaaaaaaaaaaaaaaaaaaaaaaggaaaaaaaagaaaagaaaacacaugcucacacagcggcaugcagauauaaucucauguccuggcuagcccaguaucuuuuaauaauauauuuuaugccuaacucagcaagggagacuuggagagugaaucaauuucucuuuaugauaccuuaccaaaggagucuguugaaaauagguuaauagauuuucccgaguguaaccagaauguggaaacaaaaccggacuguuacgaagaaaaaugaagauuaaaaacagccagauuccuaccugccuucaggauuucaaacuuuauuaaccaaaccguuuucuuaauugcauaccucguuagagaacuguaggaguuauuuauaaaacacuuaggucuguuuuuuaauauggcguggauacgucugcaacaugccuaucugugugcacguuuucacgggaucugcuggucacuucaacaaggaaggcguuuguucucuucuuuucaaaugcaaauaucugcagcggcuucucaugugcuucccucguggagcacggcugcucucucuuuguuuaugcuaauguaauaaacugucccuagggaguucuggcuaaacauaauauuaaauagucagcaacauaaucaauuauuuuaccagcaggaauggcuuguuuacuuaaucucucuuuuaaaaacagucauuucgaaaaaggcauuuaauaccuuacuuauuuugacagcgucaggaaacuccauuguuaaacagaagcauguuaaaucaaacagaccuacauacaagauacgucagcuggauugacuuuuacagcauaaagcuguaaaaacauuuuauaggagggaaaaccauagaacagcccuggaagcgacacuguguggacaaaagcucaacccagaugaaucaaagacagaaucggacauuaaauacccaauuucauuuuaaugcacuauuuuuauaggacaggaguacuuggaaaugaaacgcuaaugaugggaaagaguauuaagaauuaaugaauauagggaaaagaugaaaagccagagauucugaaucaguaaauguaucgguugauugauuuugacaggugccguuuaguuuuaaugauuucaaauaacacuucguaguaggauacuaaaaauccugcugugugaggaugugugcaugguaauaaaucuuggcaauaugaguuucacuauaaaucguaggggccacaucuuccuuaagaguaagucguucuucagauuuguagaucagcgaacugaaacuacagaggucucucaacuccuugauuuaauuucuugaucaucauuauuuagcucgcauuuagaauacaauuucuuucugaagagagcacugaggacuuuaucuucuggauaauauuucaaccucuggucccauuuuuuuuaaugugacuucgauaugucaguuagcuuuuugccucaguuucccaaggaugcaaaauagggagaagaauuuccuggugaaagaaauaauuaacauaugcaaagaacuuuacgaucuccuuaugcaagaacucuucaugagggaaaauguuaugcguuaugcuguaugagauaaaagagaaaugauugaagauuucaaacacuguggaaguuauugaagaauacaaaaaacaugccagagggagauaauuaucuucagaaagacauauaucaccagacaggcuauaauacagugauggaagaaagauuaaaagggaauucgaugaagccuucggggauuugggucccaugucaucagcaagacuccugggggacuucuacuguaaaacucuaaaucaaaugugauccagaagagugaauaaaauaucaguaaaucgaaaucuaaaacgugaggcuagccaggugcgguggcucacaccuguaauuccagcacuuugggagcgauccaggcaugcggaucgcuugagcucagaaguucaagaccagccuggacaacauggugaaacacugucucaacaacaaaaaaauacaaaauagccaggugugggggcgaaugcccguggucccagcuacuuaggaggcugaggcgggaggaucccuugagccugggagguugaggcugcagugagccaugauugugucacugcacacuagccugggagacagaacaagacccugucucuauaaaaaauaaauaaaaauaaauuuaaagcauaaaauguaaagccucuagccaucuccccaaaccuuuucauggcuucuguuuucuuugggccucuaaugccucuucuaugugccauaauugguacuuaauuauugacucagacaccuuuucccauccuuccuuacagauucgaauggccagacaauugaggaagguacgucgaauuccucucuccaucacucugucccucuuugguaauagauagaaguucuaucuuuucacuuuacuuagugugugggaaccacucuugcucacaagaugacuugguguuucauaaauauacaacccacucuaugcagaaagcaucacacuuucaucgaguauugggcaguauaauguuucauguuguugagaaauaacagaagccaaaagguucuuucugaagaggaccccgagagcucugcuccugggugcgaauuccagcucuauggcuccuuccccagauggcgucaacagauccucuuacguagacuugcacagcgacccacuugggaggcucguguuugaguggauccgugugguccaggaaaugccucaggcuuuccacuuuuuuccaguaaugcugaucauuuucuaguuauaggaaauuagaaauucucaaauaauaagucacucgagcaagaaaaaauauucuuuugaauaaauccuggaugaggaucacugauuuuagaaacuugaaacucacggccacuucaagagauaaacacugaauguguagucggggcggcaaugugaguggcagugcuggguacacacuaagagcucaaaaaacacugcacagagaggaaugcguugaaagagagagacccauacauacuguuacaugauacgggcaaauccaacaagauucucuuaugcaauccggauaagaauucagguuaccagaguuggaucucaaccaccauuacuaaaaauucaaccuugauacaagguaacaaauaucacauuuuucaggcugaguauuguauacaauugugcucucuaagcauacagggagcuauguccauuuuucuuuucuuuucuuuucuuuuuuuuuuuuuuuugagacggagucucgcucugucgcccaggcuggacugcaguggcgcgaucucggcucacugcaagcuccgccucccggguucacgccauucuccugccucagccuccugaguagcugggacuacaggcgccggccaccgcgcccggcuaauuuuuuuguguuuuuaguagagacgggguuucaccguguuaggcaggauggucucgaucuccugaccucgugauccacccgccucggccucccaaagugcugggauuacaggcgugagccaccgugcucggccgcuauguccauuucucaauuugcuuuuaaauauaaauuaaucauuaaccccucccaaggcauuagaagugagacaaacccuguuuaaaaacucuccaauuaccuucucucccauggauggaaauaugcaugcugcugcuuccaaaaggaaaaaaagaauucuucuaauaaauaccuggcugauuugcaacuguuuggaacaucaauugagaaauugaaaugauggauaaucauaauguagagcgaagcugguccauuuaacauucaucuuuuuagaagagaauuacauuuucaauacggcaguaauuaucauaacauggagaagacagccuaaaaauuuuuuuuuuccugcaguugcacuggagaauuggaggaaaaaaguugauauuaggaaaauuacccuuacuaagggaauacauuuucccaagaaauagugagggucuguggggauaagcauggcuggacauuaauuaauuauggacuucaguugguuaugcagaaacugaaguuauuccccauuuccguaucauuguaauccccacuuacagccacgcacauuacuaacacacacaacgaucaguguaaaacaacauguaaaacaauuuuguauuugucccauccuaguuucccauuuggauuuuagucuugucuguaucaagaauucgccauguggccgugguggcucacgccuguaaucccagcacuuugggaggcugaggcagguggaucaccugaggucaggaguucgagaccagccugaccaacauggcaaaaccccaucucuacuaacgauacaaaaauuagcagggcaugguggccugcgccuguagucccaccuacucggaaggcugaggcggggcaaucgcuuguaccugagaggcagagguugcagugagccgagauggcaccacagcacuccagccuggaugacagagcaagacuccgucucaaaaaaaaaaaaaaaaaaaacaacagaauuugccaugugagcuuagcuccuuuacugcacucaguguuuucaucaucguuaaagcaaggagauuaaaauagaucaguguuucucaaacuuucaggugcauuugaaccaucuggggaucucgcuaaaaugugggcuugaauucagggggucucugggguggggugcaagagucugcauuuccacccagcuccaaaguuaugcuaaugaugccagucugagggccacauuuugggucauaaugggaauucacaaguuuccuuucaucucuauguuucuuuagaugacacagggauucuuguuuuugucaucauguuguuugaauuguucauggaguuuagcucacuacuucucaucuugccuucucuuaucacccugcaaaggcccgccuuagguuuugcuuuuaauuguuuauaguguguguuuggcaucucuaucagaugcuggacacaguccauuuuucaugaaagccacaagcuuggaaaauaauacauucaacucacccaaguugcaggccacagaccaaggcauuuauccaauugccucacgcuccagccacauucccugugauaccuuuccauguucuuugaguacuugauuaacagucaugaaaugaaaaauauucacuguguuuccuuucugucacuuggacuguaguugucgccugccagugaggcagcuuuugaaaguuuucaggugaaagaguguggccauagcagggcugagauucagagcucucaguuccacuggugaugcaagaccauucucuuaggcacaacgauagccaugugccuuauuaaagcagugggucuauuuuuaucuauacgccauaaaacacuuucagaugccuaguugaaagguacuggguuacuaacauagggcuaggcugccuggaccugggacccagcuuaguucucucccccaugggaugaucuugggcaaauuacuaggguggugcaaaaggaauugcaguuuuugcaaaaaagaaaaaaaaaaaggcaaaaacugcaacuacuuuugcaccaaccuaaugcuuauucucucugugccuugguuuccuuaucugugaaauaggaacauuuuucacaggacuguuaagaagauuaaguggguuaauucccgucaaguacugagaaguauacuuagcgcacagugagugcgauacaggcaucggcuaacguugcgauucaagauccaacuauuaaaucuuguuucagaccauaucacuuacuuuuccaugcagcaaguauauauuuccugcuugcuguguacaaauuauuauuuaacaguuacuuaaaucuugauaaauuguaaauauuagaaauuaaaaucuuauaacuauuguauuauauguaggcaguauggaggacauaaaauuguguugcaccucaaaaaaugugcagucuggccgggugcgguggcucacaccuguaauucuagcacuuugggaggcccaggcagguggaucaguugaggucaagaguucgagaccagccuagccaacauggugaaacccugucuccacuaaaaguacaaaaauuagcugggugugguagugcaugccuguaaucccagcuacuggggagguugaggcaggaggauugcucaaacccaggagguggagguugcagugagcagagaucacaucacugcccucuagccugggcaacaaagccagacugugacucaaaaaaaaaaaaaaaaaaaaaaaaaaaaaaaaaaaaaaaaaaaaaaagugcagucugcuaggcgccguggcucaugccuguaaucccagcagcacuuugggaggccaaggcaggcagaucaccugaggucaggaguuugagaccaaccuggccaacaugaugaaaccccgucucugcuaaaaauacaaaaaauuagcagggggugguggcucacgccugugagcuacucgagaagcuagaagccaggcaggagaaucgcuugaacccgggagguggagguugcagugagcaagauggcaccacugcacuccagccugggcaacagagugagacccugucucacaaaaaaaaaaaaaaaaaaaguacaguucaggccauguaauuccagcuacuagggcagcugaggcaggaggguugcuugaacccaggaauuuaagaccagccuaggcaacagagugagacccugucucuuaaaaagaaaauuguagucuuauggggaagaaaaacauguacuuaaauauauguaauauaauaauaauaaagaagggcuauuaccuacuaaggaguuaaguaacacauuugguauuuccugcccacugcucuaucgcaaaacaaaaaagaaaauccaagucgucguauuauuguuucaguccuuccauuuuauuuaacaccuaaagacuuaauuuuaaucuugcagaaauuauuuuuucaaaauggaacuacuauuauuguuuuucugauuauaaaagcaauauacggauaagcauaaacuaucucaggaagauuagggaagacagaaguaacagugauuaccuucuggaaggcacuacaggaaaagggagccuuaauuauuauuguuuacucuuuuguaugcuuccaauuuuguaccauaugcagguauugucuacuaaaaauaaauauuuuuuuaauuaacagagguauguuuguuaugugacacaugguaugaaaauuauaaaguagaaaguaauauuacuuauacuacuaccacguacuuagcguuuucacaucugugauuccaggcauauauaaaugcauuuuuuuacaaagacaagaucaugguauacaaaauguuuuaaaaaugcuuuucaggucaaaaaaauacauaucuacaacaucauucguaaugaugcccauauuauguccuauugugugcagguacuuuaguugauuuaaucaacccugucuaggugaguauuuucaacaguucugugaugaaaacccuuauucgugcauauuuauguaauugucuuguuauuuucuuagacaauacuuacagaaguucaauaucugggcaacggauaugcuuacaaaguugaaauuuaaaaaaggcauagaaugacuaaagaaaugagucauuucuccccaggugucccuccauggaacagaggugcauugugguuuauauguaggaacuaaagggauaauaucucuugucucccguggcuggaagggaugaggguuguuuaccuccagcaucaucuauagauugccagguaggaacaugguggaagggaugagauugggucuuggagauaaacuaugguugaugcucccgguugaauuucauuuuugugucucugcuuucuggaaggaaaucccuuacuccacucuugaagcuuugaguuauuucugagaauggacucaugcgcugcuaauguugaugucauaguuaauguuuuccuuaauggcaaggggguagguagaauuggaaggggaucagaauagcucuguagaucucugagccuggaugacacuuagcaucuaaguaggagagugaaauagaaauuauuagauuuauaaggccuaauggcaacuuuaguuuuuuucugucucuuuuuuaauacaaagaaauuuggagugcaagagguucaauccuucauucaagcuuauagagccgaugaaaggcugaacaggaagcgaaugcaaaccuaaauugugguucagcauuaccugcaugacaccauguaaacccaauuguguagaauuacuguacgcgaucauggagaauuacuaaagacuagacauuaacuagcagaauuuacaugaucacauuuuacuaaucuauguaguagucaucuuuaguguagucaaugcuccuguuucucucuacuuacaaugaccuauaaaauaagaguaggaacauggcuuacauuucaaccaucuugagauguagaucaagcuacuuacaucugaguuggaugggaagcugguuucuugcuauuuacguuggucaguuuuucauuuaggaucuugcuuuuacugaacggggcaacaagugaaaguugagugucuccugcugcugagcucuggucuuccaauagagcagaguuacugggaagguuugagcugacauccagcagugacccuuaacuccuggagguuccugcaugugucaguccuaauggaauucacuggguuuuuaaaggauccacucucuacaagugcggguuuauaaaugugggauuauaaucagaggacuauuaagguaacuaaugaggcaaggcuuggaucaugccugcaaucuacuuggaaaucuauuuuuaaaaaauuugagagcaaaaaguccuucaaaacacuuuuuuuuucuuuuuuuggaagcauagaaagucaagggaaaaaggaagacaauuugcaacucuggccucaaauccuuuuuggaaccauggcaaggaucaaacaaaugagguuguuuuuucauaaggcaaaguguuucacugcaagacaucucuccguuucucccaugcuuauguacaagagccuuccuaaaccacaaugcacacccucgccucucacucaaguguucugaaggcguguugcacuugaauauguuccugcuuuguguacaaaugcagauuauaugaaaucuaucauuaaugcaaaacauucaugucagccuuauucagagauaggcuuuguguuugugauacuucuuuccucuuuuauucaacaaauauuuacuaaguaucuacugugagccagaucauguucuauggguuggggauacagcuagaaauaagauagagucccuacucucacgguacuauuguagugggagagacagaacucauaaggaaaaagcaacgugauacuggugaugauaaguaucagucagaaaaauagagcaggguauagggcccugggggaugaaguguuugcaaauauagggugaucggagaagcugaaaccugaaggggauagaggaacaagcaagccagcaucuugagcaagaguaucccagggacagaaggcaguagaugcaaggguucugagaaaggagcacagucugccugugcaaggaacagcauuagaccucgacuggagucgccccagcagcgccagggcgcaaguuuacuagacaaagcagcuggaggggaagcggguagcagaagcaaacaggccgugccgaggacuucagcuccaccucccgucgggugggaaaccacugcagcgucuugagccaggacuagugugaucugacucacuuuuugagagcucacccucuugccucugugucgugaaccaaggguaggaugugagaguagacucagggagcccagugaggaugugccugccaugagcucauccgagucugggggugcuuggugacuugguuuagagcggagcagugcucaaaagguaaaaacucaaaaauucagugcguguuuggagguggagcccaaagcacucagcagcaucuguugaauagggcaccaccaucuguuuaccgaaacaagacuagaaugcaguagaauugucagaaauuauuacuaaaguauaguugucacugguguggcaguuuauaaauauauuggucaauaaaaaaaagaaaagauaguugucuuuagugacugauaauaaaagaauaugguauaacauacugugaagaaauaccagagcagaaaacugggauggagugggccacugaccguauugggguuuacccccucaauucagcaauauuaagaauauugagcacaguucacauugggauggcucguugaagcuggcaaagcugcagaguuggccaugagaacgacuuugagaucuuuccuucuacccccaggguucuccaguuugagagucuccaggcaagccccagcaucccccggauucuuaugucacuaaaauuaagucgaugaaaauagccuucuuauucaaagcaucugcagcucaccccugcagcuuccccccagcaggaugucuccuccugucccagaaugacaaaacucaaaguaaauaaacccaggagugcaaacaauggauauguggagcacgucagucacucggaagcugcauaaacaaccuuugcuuucaaaaaacaaaaucuucauugucccuuuugguccaagaagcucagaacguaauggaacuguaaugacuuucauaccaucuuuccagaaaugugcacaugauacuaucacucucauuuacagaaagggagagaaggagacguaucaccacguaguuuaccuucaggucaaugccaaagccaggaucuaauucugcaaacauucguggagcucauucuauguaccaaugacuauggucuaucagacucagguucuaauuuucagacauguauuuuuucacuacuaaaaaauugcuaaacauuuuuucuuaguuggcaaaaggaaugaagaaaaaaacaccugguauuuuuuuaaacuggaaaauauuggcucauucaacaugguuuauacuauuuagaggcaagagaaaaagagauggagauauuucugucucaaauaauuuccuggcuuuccaaauuuuccuuucuucauccuccugcucccccuccuccuuuucuucugcuucuucuccuucuccuccuuuucuuuagaugcuaaaggcaugccaacaaaagacucaggagaaaugccagccauaccuuaaaguucuguagcucuguacuuccuaagagcucaaagcaguuggaaacaagagaacacauacaaaagcaaauggugucuagcacgaugauuggaauaaagcaguaauaagucgcaaugaccccgaugauagcauugucuuacaacaugccccagguaggaaggcaccaagguaaccaucauuaucagugucacuuuuccugaggacuaucuuugacaaaaauagauuaaguuguuuguccaaauucacaugaaucaagauucaauuugagucuugagacuuuugcuagucucuuccauuucugaauuccagguuagccuguuccuaugggcuagaauuggaaacuuauuuuauuauuaaagggaguguaaaaaaauguuuuuuagcacccaacucaaugcucugcucuggucacugggcauauugcaaccuucuaauuccucucaaucccauaaaguaagagguuauuucuuuucuuuucuuuuuuuaagauggagucucacucugucgcccaggcuggaguauaguggcgugaucucggcucgcugcaaccuccgucucccggguucaugcaauucuccugccucagccuccugaguagcugggaucacaggugcaagccaccaugccuggguaauuuuuguacuuuuaguagagacggggucuuauuaugcuggccaggcuggucuugaacuccugaccuagugaucugccugcuucggccucccaaaguguugggauuacaggugugagccaccaugcccagccaguaagagauaauuauguccauuucacagauggccaaucugagguucagauaaauucauugacuugcaaauaaucuauuuaggggcaccaugggauuugaauccaggucucuucauucuuuauucuuuuguucacuacucuggucugcaguauuauucuauaacuacucauuucauaggaauuucuuuuuaagagauggaggucuugcugugucacccaggccuagugcaguggcacaaucacagcucacugaagccucgaacucugaggcucaagugauccuccugccucagccucccagguagcugggauuacagaugcaagccaccaugccuggcuucguguaaauuuauaacaauuuguuuaggaauaugcucucacucccauugucugcuuuucaaauuggucaguaaaauuagcuauccuuucaggguuugacaaagauuaaguuucaugaaaguaauaaagcauugguauaugugaaggcuuuguuuucaaugaguacaauaugacucaaggccuuuuaauaucuuaugaaucagcugcuagcuacauucuuguuuggaauauuuuauuugcauugucaggaagauguaacuauugacuaauaaaacaaagaaaauagaaaaagccagaagggaaggcugaaagagcaauuacagagggugcaaguccauggaaauguagaaaacaaaucugggauaugaucugauuuauaaucaauauagaauuauuggccgcauauugaagaguacuauaagcuuauacuaaaaugcuacgaacgauguguauuuugaacagguggcagaugaguagauggggagauggaggaggucauacuucugaagccucuguuaagugccagccucccucucugaaagagaaauuuagucuuuauaauauuuugguggguaggguagggguaaguuuucuuaguccuuuuuuuuuaaacagaggaaacugaagaggguaaggaagaggaagagacagggaaaaagagagagagagagggaagaagcaaaacuaauaauggcaaagcugggaucuaaguccaagaucaucugucuuccauguacaggcucucuccacucuaacaugcggccucauggugcacaugugcauccagcagaaccauggggguuuccaaaggccucuggugaauuuuguaaaaagauaauaaccacuggcuuuuaguaaugccuuaggguagcucaaacuucaaucaacacgaaugauuuugacucuuaaauaacaugaacaugagaacauauaugugccauguaacgugaugcaguggucuuagaccuuuuuggcaccagggacugguuucguggaagacaauuuuuccauggaugggcagugggggaugguuuugggaugauucaagugcauuacauuuauugugcccuuuauuucuauuacuauuacauuguaauauauaaugaaauaauuauacaacucaccaugauguagaaucagugggagccguaagcuuguuuuccugcaacuagauggucccaucugggagacagugacacccaaaguguguuguuuauguccagccuacuccauaaucucauuucgguggcugucacugcagaaaacccugcuucccaaagauaggggguuguagauggaagcaggcucuucagugcuuuuguggcaaucugaggauauuccccuuugacuuuaacccagaauguauggagauuugaaguugucucaaacauacuuauaaggccaccagaugcagcuguaugauugaaguauaucaacucaccuguaaagccugccaccagaugaagcuuaauugucacuugccacucacccauaggguuuugauaugagucugcaagugauuuauuauggucucugugcagucagaccucucugcuaauguucaucuguauuugcagcugcucccagugcuagcaucaccacaucagcuccaucucagaucaucaggcauuagauucccauaaggagcacgcaacuaagauccuuggcacguacagucugcaauaggguucaugcuccuaugagaauccagugccgucacugaucugacaggagguggagcugaggcgguaaugggagcaaugaggaguggccguaaauacugauaaagcuuugcucgcucacuggaccacugacauaauggcucugcuacucucuagcugguuaugucaaacagcuacguaacuccuccagcucgugguuuucucaucugcaaaguggguaugaugacagcaacuaucuccugggauucaaugagguuaaauuaagacaaaugaacaucagcacuugguacagagccuggcauguagugucguauuguuguugcuauuaucccauuccaaauauccucaucacuuuuuauucucaaacuuaguuccauucaggccacagucacaauuccuucuauuuucaacccauuuuuaaaaauuagcauuggcauugcucaugagcuugcccuggcccuccuuugcauuuuagccuuuucuucuguugcuaaaugauccauguuccuucaaucuuccgucccauacauuaucuuuagucucuggcaucucuacuaucauaaacugugggaauggaguuuagggaaaacgugcccaggcucuagagucagacuggcugaguucaaguuugggcuccaacacuuacuagucagguauccacaaccagauggcuuaaucacucucagccccucccucaguuucuuugucuauaaaguggggacaaugacacugccuacuaaacaugcuugcugugggguuaaaugagguaggauacauaaagcucuuggaagagggcuuggcacagaguaugugcucaaucaauguuaacuguuguaaugaauuccauagcuuaaggaauugugucauuagcaaguguacucuauuguuugcucagaugcauuuguauauuuucuagauuuuuucauuugugcuaucccuaaggaauugauuucugauucggcauaacugcaaaccaagaaaggaaugaaaggugaauaagagcacuuaaacauuggggucuuucaguugcgugagcugcucuguuuccauugguuuaaagacauagagaaaacacaguuccacuaaccauccugugcuugaggaguuuuuauguaggugagaucagagugaugaaugaugauggauggauucauuucaaguccauuacagagccagcuuuacauggacguuuacaugggauuccugaucauagaggccacagucuagugaggaauaggaagagggugacacuuuugccuuccuccauugccaugcaagccacccaagcaccacagaacagagaaauggcuucaguucaguguaaggaugaauuugccaagaggagucaaagguggaaugagcuaucucuggagggagugaagagugagguguucaagcagacugcauggucauuuguagggauaaugauaagguuuggcuguguccccacccaaaucucaucuugaauuacaauccccauaauccccauguauugagagagggacucagugggaggugauuggaucaugggagcaguuucucccaugcugcucucgugauagugagaucucaccagaucugaugguuuuaugaggggcucuccuccuucgcuucacacacacacacaugcucucucuuucucuuucgcucugucucuauugccaccauauaagacaugccucuuccccuucggcugugauuguaaguuuccugaggccuccccagcccugcggaacugugagucaauuaagccucuuuccuuuauaaaucaauuacccagucucggguaugucuuuauaacagugugaaaacagacuaauauagauaauguagaggggaguugggcaugagagagauggcagaccaggugaccuuuguggcucauucaaccuaagaaucuaauuaaauucagggaaacuggguuugaucccuuggagaacgcuuggauuugcuguauguguuugaacugaccacucuguguuuucucccaucugggaauacuggcacuucuugcuuaaguuagaaguuacaaguuaauagcuuaugccugugguguuaaauaucaucaaacuuuuguauaauuuauucuuucuuuccaauggagccaagacaauaucaagaucuuuguacuuacuuuuccugcugucuggagcucucuguucaaaugccacuucccugacccacuuucauaaaaaacgucauccucccccaacaccauacuugucauugucacuuccuguaccucccccugcuuuuacucuuuuccauggcacugacauccacaugacauauuagauauucauuucuuugguguugaucuguccuugaugaacuauaagugucauggaacagggcuucaucugucuuguucacuguauuucagauccuacaacagugccuggcacacaucugguccucaguaaauauuuguugaaugagaaaaauguaagcagagauugguuuuuauuuuucauuaaucuuccucuauaucuaauuuauguaaguuucucuucaaaaaauugauugaaaaaucuuuugaguuucccccauccccaagguaugaaauuaaaaugaaaaucuucaagaauucagcaacgauauccauuucagaggcacuuacaaggguuaaaaaaaaucaaucuuuaaagggauaagaaaaaaaccauagugcuauauuaaaaacugguuuaagugacucauuuuaagaaaaggaagcaauguuacuuuucaaagaaacauguaaguacucuuuaugucuaacauucaaaggaugaaugauuugauaagaauacaauucagcuuauuuguagcuagggcuucuaagccaucaucuauaaucaaauauaguaagaaccaaauucuucccuuacuacugauaucuguauucuucaacguucuuuauuuaaaaaaauaaaauaaacaacaacaaaaaacuaucuaaaaaaucuaaaagcaagucaaugucuguuuccaguagauggcacugcaaaucaagucuuuguagaucuacuaacuaucacuucuuugaucaugauaauaaugauuuauucuguacuaagaucaucuaaagcagcuuacacagugaaaacaaauaggauggcgaugcugaagcuacaugaaagcugagauaguccagcucccuaauacugguaucucuccucuuguauaccauagccgggcacuuauuaagguagugggugaauguaacaaauuguccacugugcuuauucauggaagugcuuuuucaugugggauuuuuggucgcuuguuuuaguuuguuuagucuauuuugcaguauaaauucaaugggacucuugaugcuuuuacauggugucaaauucaaccucauucaggccaguuaucauucacagaggaaauacugcucuagggucacagacccacaucucugaccugcacuguguuuaugguuguuuguugaggcaugaucuugcucugucacccaggcuggagugcaguggcaugaucauaguucacugcagucucuacugccugggcucaggcaauccucuugccucagccucccgaagaguuggggcuacaggugcaugccaccaugcccagcuaauuuuuauuuuuuguagagacagggucuggauauguuguucaggcuggucuccaccuccugggcucaagugauccuccugccucaaucucccaaagggcugggauuacaggugugagcuacugcacccaguugggguguguguguuuuugccaauagauacccucagucauaaagggguaaaauuagaaaguguaaaugguuccagacaacucaaguuccacaagaaaaaaccgagaugcaaccuguguuucaaugacagugacaguggaugaggacucagcuuuauguguaaagaaauauacauuuaaaacauauuuucaaaccauuuaaaagggauauuacacauaauacagacuaggaguuaugaaauguuaucauauauguaaaaaauaccuggaauagugucuggagcaaaguagauacuaaauaaauccucugucucauuuuugcugucuuuaaaagggccugagagccagucccugcucgguaacucuguccuuuaaaaggccucugucauuuaaucucucuggacugcagcucucaaaagggcuggaacugaggccacaaagucuaaaauauuaugccuaauacacaguaagauucacaaaugaagggcgugauaccaugcauccagauguacaagccagcagccacagaaguugggaaugaauuuugucaugauguucuucucaguggagaaagaagccauuagucaaaacuggaacauccacaagcaaaccacgucggcucuuucaauaaauguccuaggagaguucagaccucauguccuuuuuuuuuuuuuuuuuuucucuugagacagagucucgcucuguggcccaggcuggaguaaaauggcgcgaucucggcucacugcaaccucugccuccuggguucaagcaauucuccugucucagccucccgaguagcugggauuacaggagcaugccaccacaccuggcuaauuuuuuuuuuuuuuguauuuuuaguagagaugggguuucacuguguucccugggcuggucucgaacuccugaacucaggcaauccaccugccuuggccucccaaagugcuaagauuacagguaugagccaucacgcccggccuucauguacuuuuaaaaauaugcccuguacccuauuauuuuuuucucuuguugucaaggaagcuugaaauuccuucaaauuauacaagagucaaucgcaauaguguguuucugaaauuucuauaaauguaugagaaggugcucucuuagguggugauauuuuuugaaccaauacacaucacuacacucacugagaacucuaguuauuuucacaagccaucucaauaaccccaggcuuuucucagaaggacugucauagauacacucaccagagcccccacacuuuuaugggcaacacaaaacucauacaguaaaugcaaaaacacaauaauaaucaaaagaaggcaaaaauaugaccugaaugguaccuucacugaagggcagugaggcaaagaaggcccuaauacccuuucccuacaaauuccuuuacuuaauucuuuuuuaucuucugugaccucagaauuugauugcuauaucaaauuggcagaauaccauauaaagcaauuuauggcuuugaggugggguagauugcuuagcacuguuuaggucugaaaggaccucacagaacaccuaguccaauccccucauuuuacccaagaggaaagaacggcucagagaggucacuggacuuacagaggucacacagauaauuagcgaugaagcagugacugaggucacuggacucccaauacauuaaccauuaagugcuuuaauuggggauagaagauaaggaaaaaaggugaaaaaauaaaagacagaguguauuuagauuuacucuuugugaccuuaggauccugauggaaaaauacuaucuuauguagccuaagaaaaaacaaguuuugguuucaaggcuccaguaaagagaagguuguacaaauucuucaaauauuugguucuggccucuuuuucuccuccuucugcuuuccuguuaggcuaguaugucuaaugguucauuagggagucucuauauuaagaaagcauaaugguuuaucuucuauuuucuuugguucauuuccuuuucccagugggaagugauaacuuaaacauggacuagguauguacaaauugaacauuuuucuuggguacgacuaaugcaacaagauuuaaguaaucacauguccuaaauauaaagagaauaaauaguacacauauaauuuuucaacuccucugcaauaguuuuugugauguaaugcuuaggaauauaaggaaaaugagacaaaaacuuuucaauuguuauuuuauauuucuaauuugugcuguaucauuagacaaauggaauagcaucuaaauauuuuacaauuaaccaauuagccccauuuauguuaaagaauuccaaagucccugugaagggauaacuugaucuguagagugaugaaauucauggcuuaagcaaaguuuaggagugaaauaauaucuauaguuagugugaucaaaggcuuauuuuggccaagauuuuuaguaaauauuaacaguauagagaaaaaucuuguguugauaaugagauuuucaugacccuguuugagcuggagugcauaagccuucuuuacuuuaaaaaagcagucacaauuuuugucagugcguuauccuuugcugacuauguggaauuuuuuccuaccuuuaauugauuuagggugcaaccuacaucuggguauauaucccuaaagugucugguucugaaauaaaaaugaaaguggaaagguauugaagugggaugaaggggccacuugaauugccucagggaaucuccuaaccaauuuucauuugccucauuggugcccuuggauaaaagagaauggaggucgguugcagaaaagaaaaucaaggaaucuucaaaaagucacgugcaaaaagcaacacaaaaauaggagggaaggaguuuuuuuuuacaauaacaaugccaccuuugugugcugcgacuuccugauuauauuucuuaaucacgauagguaacccucccccaaaaucaccauuuuguggacccaggagcaaaauuauacggggucuacguacccaaaacauuaaaaaaauucaacuccuucggaguaaccagguaagauaaugaacgcagucauacacuguuugggaucagguguucuucugcauuugcuuuuauuuggaugaaagaauguuucgugcacaaugaugaccuaaaacugguaaacaagccuggagagagcgcgguggcugguugcagcucacgucuccacgacuccugcagaaggaaauuacguucuccccuucccccccgcaccccuaccccuaccccaagcccccgggaagcccugcgcuggcaccagggcaagcgccugucggcucccgggagcuaagcgaggccgcgcggucugggacgcaaaugggagggagcagccgcugucgcccugcggggccagggccacuggguaggcgcagcgcgggccaagagugggaggcucagggcaggggauccgcacucggggccauuccugccgcggcgcgcccugcgcuucagcagugcacaggguggggaccccucgaggacaguggugcgccgacgggucucucggccccucccuuuccacaggccccgcuguguggugaaggagccagaagaggcgacuuggguguugagacccggggccaaaccguggagagugucuggagcccacacuccagauuucuggacgccgcagucaguccagcagguucuaccuggagccgccucggggcucaaccgggaggcagcggggugcaggcgagaggguuaaugcgcccgguucgguugguuugaggagucucugcuuucagcgacccacagggcagagagcccagggcuccggcuugauguccccaacagcuggggacuggagagcuggaggggucgcagacucaggcuagaguuuaaagugcgccgcgcggcgagucgcuggacucuucugggucucacguggcuccugugucacauggagugacaggccggcggaaggcgcuuuagucgucgcccagcguucuccaagguguaaggaggcaggaucuucccauacuggcggcgcagggggccucacggcugcggacgcccgcccuggaucucucagcucggcagauccuuuggguggagaggcgcucuccagggucgcggcgaaggagagcggcuucucggcacgucccuccguauuucuucuagaucagcuccggccccaccguccaggagagggcccgccugaggaccucugucugugccgcgcguggucagccccgguccccucacuccauggcuggccccuagcccuucagagcggacaccucuccuuagggaugcagggcgaggaagggcggguggagcugcgaacccacggggaccuggaggaccucuuggcccccuggagagggguacuaugagagggauucaugggacacagauuugggggacuggguaauuuuacccccuuuggcaaccauaaaaacccugagcaaacguguccauucgcuauuucgcagaaauauacaaugcaggcccacacaggcaucucugcgaggcccccuaguuaagggcgcagcguucuucggaagcucuuggucuugcuaccagggcgucaccggcuuuuccgcacuggggacauuucguuugggcucugcgcagccguugcaccuaaggcccugggagcuccgcguuccuccccaggcgcccgggacaaagugcccgagggcuccgcagacguccagcccugcccggggcucacggccgccggggcucuccaacggaccgucgagggccacguuuugcuggggugugagcgacgauucuuuucccgcccuaugaggcccgccacuagcuaggugccccaugagacgccguggcgagcacggcuaccuggcagcucgcccgggcagccccaacuuaauuuccugccccucggggcaccuuucccucgaauagcucuccucggccccuccagcccugcccaaggggccuggaaauguucgcagcuucaagaaaggcucuauuuaagcacaggaugggguggggcgggcggggccaagauugcccuggggauugaauuuaucuccgcucccagcgauccccggcggauaaagcgcaaguuugugcacacggucgacugagccauuggaaacccagcucacgaaccgcagccagggaaacgggaguuugcccaguuguccuugcggaggggugugcggaaacgcccgcgaugggaacuuucugcagaucauguauggagggagcucacaaaaaggaggaaggggagcgcgguggggaggaggccgcgugggcguggaaggucccaggguccugggggugcccgccugcuuaggcgcagggaauggcgcggagcuggcuggggaaggagccgaucacgucccgcaggcuaauuggcuuaagaaauuuugcaagcgcuggaaaaggucguugaaggaguucgcugcacgcgcacgcacacacauacacacacacacaaaaucuuaaaaaaaaaaaaaaaaaaaaaaaaaaaagagcgccgagcaugcgcacagagaggaugccauauuggaaugagcuguagugggagccggaggaccggagcgggcgcgcgagggaggcggcgggcggggagcgagcgggcaagggcgggcgagcgagcaagcgagcgaggccggugcccucccgggcggcgaccggggccuggguccacgccgagggcaggacgaacuucaccagguaggacgccgcgccggcugcuguccccggcgcccaggcuggccggagagcagcccuucggcccgcagguugagugcgcuggucaggggcuuuuuccagccuaggaaaaaaaaggaaaaaaaaaaaaaggaaggaagccugagggagcugggguuggagguggcgggugggggaaggcuggggagggugcaggggagcgaaagagaagggcaggagaagaaagcgacugcacuugagcgaagcuucaaacuccucugugcgcuccagguugucauuuuugcuucccggguccccuucgccugcgucuccgggcucggaaaagccgagccgugcgggaguccguccggaguugcaaaguguccuccuuccccgggcgcagccuguccccucccgccgcccaccuuccucguuucugcacucauuuuagcgacgcagccgccgcugcuaccuaccccgcgcucccgcgucuccuccgcgcuggggucuccccuuucuuuugguuugggugggagaaaaagauggugaggacggggaaucggagaccggcauggggguaaaaaucgugcagacauucggaaucgcucccuuggaaacauuugccugagcaacugaaauaaaauuggcaguaguaguuuuggagcgugcuccagcgaggauggucuuuuuguucauuauuuucucuuuaaaguaauauccugucacuuaggggcuuuccgguugucuccucuuauucgacccccuuucaaaauugcugacuugagcugguucuggaguuuauuuuuuaauaugcgugcguggguauguguauguguguguauguuuugcagaaauccgccaaaaugcaacuguaggaacugcgagauguauuuauugauuuugaccaggggcggugggaaggggcuggagggagcugggggauccuggagggugggaaguggcugauucucgguggccggacacucauccagagccugauccguacucguguuuucuuggaagcgccacaacugcggggaaggagucuuuagaaaccgugccaguuucaauauggcgggcuaagguggcuuuuaaaaacugaaaauaaagguuuugaggugggaaaaaacccagcugaaguuuccaccccuuaguuucgacucucuuuggcuaccccaggaagcgcuuuagcgaauuaaguggggaaaaaaagaaggaaugggcuguccgguuuuuuuuuuccgugguuagagucugugugucaaguccauugcuaggggggaaagggauggagaagugccccuggcccggaccagggcaccgaaacgcaacugucgugugugccuguggauuagugugcaggccugcgugugcgcaguuuuuuugggugug

SEQ ID NO: 13045 - RNA, 919 nt, Homo sapiens
gcagugaguuuuaaauuuaaagauuccuuugugcucccugccuagccuggagcuauugcugcgcucuuggcaacauccacccggcugagcccagcagcccuugcccuggagacagaaauugcccccuuuuuuuuuuccuucuuuuuauuuuuuuuuggcacaggguguguugagacagguugaauagccacccuggaguuuugccagagccacaagaugaggaaggucaagaggcagaagagagcagggugaggagauggggguggaggagaggaaguuugacaucauguggcuugaauggcucaaaaugcugaaaugccagcauuaguucaagcaauuuagacuuucaggaagccuggccuuucccccuagagucguuuguuuaguccugucuggugggcuuggcuggcggauuccacaaacucaugaugaaaaaguucuccaggcagaacagagauguggccuccauuccuacaggguagacaaucaauuccaagggcccagcaucuccuaugaacccaaggucacucagaucaaguccccaggguggcaaaugucuggcaucaaucggggguugggggggcggacacugaguuuaguucaaggaaguauugccagauuuuguguguucuucugugccacugauggauuugaaugaauuugaacaugcugcacgguuugacgcacgucagaacugaaagagaaggcagaguccaggugaagagcaggaacguggccagauugcccaaguuagaauggggcucuguuacuagccagcuggagaugucggcugcugacuugguguucucuaccugaguuuccucauucaacacugaaucccccggcucugcccuucuuucaucuguagccccaguaccuuuuagcaaacuauguaauuuacuuguuugcuauguuugug

SEQ ID NO: 13046 - RNA, 27875 nt, Homo sapiens
auuuccaaaacauaacugggcacacauuuacaaugcaccugcuagguuuugaauucauuugucauuucugaucuacccuuaagacuaugcuugaaucucugaaaacaaaugcuagauucaugauuucuauacccacauacuccauaaauccaucacaaacccuacagucugauuuagccuacggcaaaugauucauccaauaggccaugguauguucacaauucuucaaucuuauucagguuguaaagacguuuuucuacgacuggagucacuaagaauuucucuguuagagaaagcaucauuuucaccuuuggcacacugccaagaugauacuuuacuacagaauuuaugaaacuacaauuuaguaacuugcaggcuuuauuaaaagaaaaagaaaaacaaagaauaauuuaauauaaccccaugucccaaaacuuucuaguuuuuuuuuuuuuuuuuuuuuuagugcaagaaaugcugcaucauugaagcacuugagaauuaccaugaaaucuaacaaaaaaugucaucaacucaggaguaauaauaaaaaagagaaacaaccagagaggcacacagauuguuguuuuuuuaaaaggauuuuuauacuauauuaaaaaaccacaaaauaaaaaagggaucaaucaacauauaucuuagaaguccuuccaagagucuugguaugcaacagccauggaggcugugaccuuuuuccuucuuuucucagccugcaguucauuuaaggaucaccggagaugacucgugcucuaguucuuaaaaucaaacuuguucugccaaauccaagacccugaauuuguccaaauuguagaaacaugcuuuuaccacccguccaccaaaauaccucccauucaagucaacaaccgcugaaaggcaaacaaaagacaguuaauacagguauccuauaagauaaagguuuaacuuuaauuaaacaguaacuuuacuuguaaagauuaaggcuguaaauucaacuuuuuuauucuuuaauauuuagcuguaccacuaaccuuuaauugcugauucaacucucucaaauucuaaaaauauccguacugcuucaucaucaggggcaccaggaaucuggaagaaaaugagagcgugaugaguaaaggcauuugagauugcauugaaugaguuuucucuuuuaaaugauuucucagaguggauauucuaauuaucaucauauacagucaaguaguugucaaauaccaaggaaauaaguauaauuuguucaucaucaaaaacguacugaaugccuguuuuuaugacaggcauuguuaggugccaggaacacagggcuaggcagucucugaccucauaaaggcccugugccagcugaugacguaaacaaauaauuauguggucaacaaacagcaacaggauaaagaaacagaggaagcagagcuuucagauuaaaaaggcuggugcccuaguggccuuucacaucaggucucauuuugacuagcucugucuagcuuuccuagcccucuguaauuccacccaccuaagcacuucugcuaauccccaacaggcccauccauuccauuuugguaguccugaucuucacugucuccuacgagccauuaucccaaucagaauacccuucccugcaaaucccaccuguucguuucaaagcgcagcccauaucugcuauugcucacaaggcagucuauuuuuucacugaucuaauccuuuucucaacuccugaacuuagucaauacuaccuagucuaguaacugaauaucuuucaguuauuuuauguguuucuucaacugaacacaccacugagaguacagagcaugcuuccuguaauccaagugcucuccgcacagugcagugcaugugagaggcacuaaauacucaccaaaugacugaaaccaaaggcaugucuaaggaacuaaacuacugagcacgcuagaaucaaggucuucagucaucauacugauccucaaucaugaagcauuccuguuucuucaucaaauaaaacuugaaaucauugucuuuauguuuaaaacuguaauaauugagcaagagaaguacaaauaaccaacgccugucaccuucugcaguaagaauguuacuuauagcauacccuguccuguuuguagaaaauguuuuguaaugugccaauuacaacuuguguuauaaacaucaaaagaaaacacucuuacuucaaauaucacacauuuuccaacuuugccauauuuuucacauucuuccuugguuucaacuuccaagucuucauccaccucucccgcaccaaccauguucuuuaaacacaaaaauaaacaaauucaaguaccaaguauaacuuacaaacaccuagcagagguauauaaauaugacuuagugaugguaaauguucucaaucccaaacgacauaaugaaaaauuucauccccaaaguacccaaaaguuaguauuucuuaaaacacuaaaacauauauuaagccuguaaagaguuacaaaagcaucuaugcaagcaccaaaauguauaaacuaucugaagcucuagcaauuucaaauauuuaauuacucacugcagucuuaaacacuguacuuagcaaagagacuuacacauuagugaaaaaucuaaaaucagccuuacgugggaucugcccaaaguauuauuugcaaaaguaucauuuucaguuuuaacuuuuagggggagcaggguaggcuggggugacacacacaaaucuaggcaggcagagagcuugcuuuccucagcuucuuacccuuaguaagaccacuuuaguaggacacuuaaguauuucagucagcggauuugaaucugacuucuuggaugcaucuguaucaaaacauaccauuagauguguuacagaacugagcagcauaucauuagauguguuacagaacugaguccuacuuacaauaauuaauuuaauuucaauagcgauccccaccauuuauguccuaggcaucuacacaauuggucucugagcgaaaacacagccuuaucugcaauaaaagccucugcuuugcuuuggcauguuuuuacaauagcaucuggauguuuugagccuccaccauuacuugcaauuuuugcucaucucacuucccaaagggcugacagggcaugugagugauaauuccuauaggugaguugacuuggagcaaacguucaaggucacgggcccaggggaauaugcaguuacuaauccagccaccggcugccuuacuucagauaaccucacaagucgggacaacuguugguuucuggcacucaccugucaggcucgugauguauccuaagcugugcaugaacggggcugccagaaaaguuuucuucuuucuuuagcaaaggaaguucagcuaggcugacucaaacuuaauucccugauuaaaaugcuaacauauguuugucucuuuccugaauucccucaacacagaacagacuguaaaaauuaaaugaaaauaaaacaccaacuaggcaucauuuaccaagagacugcaacauaacaucagaucucgcaaagcaaacaaucuguaagagaaucagaaaucacaucuauacugaaagggcaaaagggaaaaguagagacgaccucugagauggagauagcagguauauucacugccacacuauauggcucuguccuucaugcucuaaacacauaaccaagauuucuuccugaggacuacucauuuucugcccaagucucucaccaucuuuuccuccacaagccuucaucucucuacgucuguucugaaaaaauaaagaugagccucaggauuccugguuucacaaaacggaaguggcagugcaucauaugaacaggacggccuguguucuagugauggcagggccagcccucucccucuggccacacgccucauugucccccugcugacacaugaggaucaagacuggccaugucugauauggauggggccaguccuuucccucuagucacacgcuucccuggggacacaccuuucucuguggcgucgcccacgaugaucuugccgccacgcuugcuggucuucuccacugacaaggcagugcucaggcccugcucaugcuuccccagacccuggcccucccggaagccguacuucugcaugaucuugugcgccaccgugccccuggcaggagaagaagggaaaggacucuuagccuugacaucgucaacuggagauagguugcauuuuuccaucacaacaaccuccuucuggagagagugcaugcuccacaggggcuucaacaaagucacucauuaacuaggagugggcuauuagauggaagcuguggggaugugcagcaugaaagaaauagaaaaagcuaugaauaaaauccagaacauccuguugucuuggaggggaaaugucaguuucucugguggagucuccucagugcccugcuaggaaacacaagaccuuuugugugcuccggaccugcacugccacauagcuuaugaccacaguuuauuaaaaaguggcuaucaaaaaguaaguaugaaguuucguacaaugaagaugaucccauuuuccuaaauagcacaggagaguuuccaaugacagacuauacaaaugaaagaacccuuagagaucaccuauuuaacaaaugagaaauaaacggaggccaagauuagcugacuagcuuaagggguggacuuagaaguaaugcaagacgccauauuagaaauuauuuguacaggcugggugcaguugaucacacuuauaaucccagcacuuugggaagccgaggcggguggaucaccugaggucaggaguucaagaccagccuggccaacauggugaaaccucaucucuacuaaaaauguaaaaauuagcugggcaugauggugugcaccuguagucccagcuacuuggcaggcugaggcaggagaacugcuugaaccugggaggcagagguugcagugaggcgagaucgcaccacugcacuccagccugggcgacagagcgagacuccaucucagaaaacaaauaaauuauuuguacagcuguuaaugguagagcugaaacuggaccccacaacucucagucacugcuuucuguaacaaccaaauggcucucacacugcgcucugaggcgcagcaugggucugaagggcaccccaaccccaugaccacugcugcuuagggcuuaagccacaaaaucccgcuucaacuggaacugcaccuacauuacuucuuguauuuaauucccuuaacauuuucauuugaacaagcuauucuagggcuaaaaagaccagaaacugcugaaugguaccaucuugcaucuuuccuaagcacaaguuaaagauguaauuccugguuaaaagcaaauucgcuaaaaagucaguuuuuaucauaaacagggaaaacaaaacaaaacaaaacaaaaccagcuucaugucuguccaacccuccaguacacaaagcuuccugcagccacggccauguccuaugucugcaccauccaacaucgucaccacuugcauguggucacugagcacuugaaaggagacuagugaguuucaaccccacucacugucucaccggcugcauuucugcuacaggcagcagccagcagaugcaacacagcacagaacaaagccuucaugugauacugcuucaugggacagccgucucacaggaucaaagucaacaacacagaauauccucuuaaccaaaauguuugccaagcccagcacaguuuaaaaaaauccccaagccccaccugagcgucagccuuacagucaaauuuuauaugcuggcaaacaugucaacuuguaguuagaaugaccccgaguuuuuuagaccaaagguuuagaaccaugaccugaaagcaaauggcccacuuuaucaggaaaaaaaagguaucaccugcccuuuggagacaguaagucagcucugauucauaugagcuauuuuauuugcaaacguuaugaaggcaaauguaaacauuaaucagguucugugccugucuaggaaaauaauguucaacaucaaaaugagucaaaacuucuacugggagguugcuguuuugaacaagccccaucauuacacuggaacacgcuccacacgauugaggcagguaccgugugaccugcacacaccaaggguccugaauguccucaguuucaaacaagcugcaucuauugaaagggcuaucaacgcuucacacugucucucaaguccuuagauaagaacauuaaaucauuaccccauguuagcgaggaaggaguugcuagguccgguuggagaucucggucugucuuguuccucguacacugggggaggaauggcugcuuuggaagacugugaucgaggucuugaguccucuucauaaggaaaaucucgggguacuauuggagaaaaauaaaguaggcucaccaaaauacuauagaaaacacucugaaaccucacuuguaucaauuauuuaucuugaacaaauuuaaccuacuuuuugguuuaccacaaggagagaaaaacaccaaaucaauuuuacagccuuuauacgacuuuuuuuaaaaccacagagggaggacgcuacuuuccugauucuaacuuuccuuuugcuauuucuaucuccucaaacgucuuuuuuauaucuuacugaaauguuauucacccuuuaaaaucuucuugaaugaauauucuugccggaaagauguucuguauguucuaaggagauacaaucuggccaucuuuugacuccugcaguaacuugggugcaccugucuagaccccgaccucacuaucucaucagcucauggcccacaaagguguccgagguuaggggcuacgcacuggagcgguggcuucaacccuaguuagaugaaagucaguaggacgcuuuaagaccauccagaugccugagccccacucccagagacuaguuucaauugggguuuauuguuugucuguuguuuucacauaauagguauuucauaauaucuuagaaauuaucuucuuuaaaagauaaagaauucaacaaguuuuaaaaaguacuauaaaugagaauaucugcuugggauaguuuaaguaugguccaauccagagaaugggaaaaugaccuagaugauauucagaaguccagucccaacccccaaauucuagagcagaucacugcgagaaggaacagugggugaggguguuuuggcaacgcaaugacacgcaaacccaccugcagugaaauggaacgggaagaaaaaaucuaaucaaggaaggcauugccaccuuguggaggaucaugaauauaacagccucuaaaccucugaguuaaaaaacuguaacgaucugcuguuuuaacuccaaaugaaucuaacaacaaauaagaaauguuaaugaaaucaaagugaauugcauaaaaaagagauggaucccacugcaugaaauccaagccucagagccuggcguagaaaggucucucucugcaggagggcgcugcauucugagauccaggugcggccucaggugacagagccaggcaggcuugcaggccguuucccucuacgcucaggaaaccugggggcccaagcugagaucccccaugguuggguuaaagaccuguaucagaauaaaagaggaagaaacagaucuacuuacacucuuugucuuucucuaccagagaaguggguggggcaauggcagcuccgcccauaccugcaaaaccacaaauccaagcauuaaaggagguuuccgaugccagacucccaaacgacuaugacacaccauauaucuaucacccaccccccuaagaaaaaacuaaaaaaggaggaccugcuacuucagaugaccuccugcuacauaugaacaaaccucugaugcuaggauuuaaaauguagaaaaguggcaacacucccucagauaugcaaaauuguuccuucauaaaaggaacucaagagccccacaauguagucugcaaaugaauuuuaaggcaaaacaauacaaccaagagaaccagcaguuacuuaaaaagagaguaauguaacuauuuaccgagagcaauacccauuaggcccuuuauacacauggccucguucaggcuucacagaccucugaaguagauauuacugcauccaguuuacaaauaagagaaugaucagaggggagugaaucaacagaaagggaguaaacccagcucccugcguugccauaucucccccaccacacagcacgcuccuuuuccagugugcaaaccacuggaacuaaacacauauuugaaagcguggguccuucuggcuccugaagaaacugcugcguguugucacuauuccugguguauuuccuggacaacgaauggugaacacaaacaaaccaaaagagauaagacagaucuuuuuaucugguauccgacaacuggaaggagaacaucaguggagaccacaaggaauuuugcauuaggcauaaguccuaacauauauggauuacguauacauaauauuacauaauacauauguauuauggcuuaaucaacaaugaaauaaaaacaaaauguaaaacuuuaaaaauugauuacaaagucaugcugcaucagcacaaaauguuugacaaaagaaauuauucuggcuggacgcagugguucacuccuguaaucccagcacuuugagaggcugaggcaggcaaaucacuugaggcuaggaguuugagaccagccugaucaacauggugaaaccccaucucuacuaaaaaugcaaaaaucagcugggcaugguggcacacaccuguaaucccagcuacuugggaggcugaggcagaagaaucauuugaaacuaggagauggagguugcagugagccgagauggcgccacugcacuccagccugggcaacagagcaagagugucuccaaaaaaaaaaaaaaaaaaaaagaggccgggugcaguggcucauaccuguaaucccaggacuuugggaggcugagguggguggaucacuugacgucaggaguuugagaccagccuggcaaacauggugaaacccugucucuacuaaaaauguaaaaauuagaugggcgugguagcgcacaccuguaaucccagcuacucuggaggccgaggcaagagaauugcuagaacccaggagguugcagguuguggugagccgagauugcaccacugcacuccugccugggcaacagagugauuccaucucaaaaauaaauaaauucauucuucuaaagaauuauucuagaaauuauucuaaagccaguguccaugcauuuugauuaacaggacuggaugauauaaaauccucaaggagaaauaugaaccugaguaaaaccuucuucuauuuccuuugaaauacuuccaugaucauuuuacuaaccuugucacuaggaccuagagugauuacugauucugaaaagcagauuagcucuaauaaguucaguuaaaaaaauucagggugauuacuggaaaucugcuacuaaucacauuaaaauaagaacaucaaucugucaacaacuauacauaugaugggcaugccacuaccucccuaucaugagcuacaaggucaaacaaagucuucucauucaaagcuaucuaguuccugcugguguuuaagaaaaaaaaacaaauguccuuaguauggaaagcaugccuccuuauuaaaaagggcagucaauuuauaagcuggaaaaaugagaccuacaaauauucaaccuauauacugaauuccaaaagaaguuaauaaaaaccaaacauuuggggauuaacuaagauagcggauaugaaaugugucacaaugcccaaaacagacacacucaauguuaacuaugcuuccccccuaagagaaacaacagaguggauucagcaucggccaacuggacugugcugcagguaaagacagugcaggaauagauuuuaagcuagucccaaaguauccaauaaauaaauguuagaaagugguugugaagcucaaaggaaaauacauaugaaaacccaauauaaauuaaaacugugacgcaaauguguauugcugggauuccagaaagaaaauuacccaaaucaaugucaaaugaacuauuuaucaaacugaaaagaaaaagcacauaguggaauugcacuuccaguauuuauauauguuuaagacauauuuguucaugccuuacuucuuuuccuccucucucgcucauaaucuucaucuucaucagaaucuggaucuggucuccuugcaaacccacuugcuucaugucugucuuuacgccuucugugauaacaaaggaaauaaauguucaucacagaugaaccaauuuagagaccugaaccugggaugacuuccucuugaccagaagauauccaaauccugucacaaucaacuaugaaguugcagggguagaggggguaggaagcauaacugguaaaagacuaaaguagauaaaaguaugaaaagugagaaaaauucaagagauaaauugaaccaauaaguauacgagagcaaccagcaugaaaaaaaagguuccuugacauugaccucuuccaauguuaaagccuaucaacauaguaauaguucaaucauuucaauagucuauaacacuuucacucaugaaaugauucaauaaaugggaaacaguauauuaauauuuaauacauguuaacuauuugauaauacuaaauauuuuuaaaaagaacuacaaauacauccuacuacucguacuuugcaaaaacauaaauaaaagcugcauaugaauuuuuaaaaauuccaccuggcucaaaaauaguaaaguuaagaagaauauuucaaguacuuuaaauagcugugauuuuacaaguugagaaucccuuauuccaaaugccugggaccagaaguguuucaaauuuuggaauauuugcauuacaauuaccaguucagcaucccuaagccaaaaucccccaaugcacauuuccuuugagcggcauguuggcauucaaaagauuuuggagcauuucagauuucggauuuuugaauaagggauagucaaccuauagcagaguaucagcauagaaaaaaauuuucaacaucagguuuauaaguuauuuuucuaacaacucacucaaaauauacacuuuaggucuucagucuacaggugaaguuugcugugauucugagauguaacagguacaaaucguaaaacaguuugauuccuuguagugacugcucagaucacccaugacaauuaacuucagccuuacagacagcagcgacgcucauucguuaacauuuuaaugaacauuucaacuguaaaauauccccaaauccaaaggaagccuuacuuuucccuuucuucuauuuccuuuugucuuuccagcucccgcugucucugucguuccucucuuuggcgcuucacuacuuucucauaaucauuaggaaacauagggucauauucgucagcuaagggaaucagaacuuccccugcagaaaacccacugggaacaggauccugaggaagguaaaaacagcaguaagaauccucuuuauaucuuaccaguuuacucacaggauucaggucaaagcguaugggagauaaaaggacucugaacaucaucuagccccuuccucuguuuuaaagacaaagaaaacaaauaccagacaaggccacgugccuagucaggugguagcagaaacaggacacaaaauuucaccucuuagauuaguacuauuucuauaauacucuauggcauuuuuccuggaauuccuaaauaagccaccaccagcuaaaauauaaguuacuaguacuuugagucaaaaaauuagaauacuuauaguaaagcacugaauacuuguuuuuauagaucucuaugacaacuuaaaaaauaaaacaaccaugaacaccacaaucauucuugcagucaucauuuuaacagaauaacuucagauucugauuacauggagauaagaauauauggagaucuuagaaagcaucuucuuggucuuucuaauccucugaacacaugucccuucccagguaggcugcauuucaggcacugaguuugacacaaggggauguaaugucccuuccagcaucauaauuuuuuuuaagguucacuaaaaucagguuuagauaacacuucguguuuucucgucuauacauucagaaacuuggucuacucuuugaaagaaaagagguagccaugacaaagaaauuagcaaaacgagaggcagagcacagccaguauacuaggaaauacaugagcagacacagaacuuuacccuaggcuggcagccucggucuacacguggugcuggaagcccugaccccacuuuccuaaaccuucccacacuuucuccuguuaguguucuuagcauaauucuucguuauuaucuguaacaauaagaugccuucucugguuuugaaagacaccucaaacaagcacagguuaggauuaguguccccauuuuuuuuaaaacacacaugcaaaacaacaaggauucauguccuugagcgcccagucuguaccucuuacaggagguacaauguccaacuguaucaaaggcaagaaggucguuuguaaacguguuuccugcuugaacacagaacugacaaaaucaagacagcuuacacgccauauuaacagaccuaaaucgaacaguuccuguguuucaugguucggugugacauuuugcacuauaaaacaaacacuucaccauuuccuuacgacgaaauaucaggaaaugcuaugauccaaugaauaagagcaauuaggaaaauaacuauaaucaccucccaggcccuacccacuggaaaauguauuuaauguagggcuccuaaagguuaguuauacauuuguauucauuuuauaaaagacauuuaaaaaauacaaaagcacaugaagauuucuuuucaguuauuauuuagagagaaaaugacaaccagccacucaauuuaucuaacacaauuaucacaacgugucuaagagaacaaacugucaauaugaagguucauucucugacacuucaaaauuucaaagaaaaaaacuuuuacauauaaacccugcuaugcuuaacaaugaaaucaaucauccuuuucuaaaugcugcaaugaauaaagugauuuguucaauuuaaaaaaauuaaaauguuaauacccucaaugcugaggggggaggaugggguaaaauucacccucauaugccugaggugauacugugcacugcugggaguaaacuggugccagaacagauuggccauaaaaauggcugauaucuuaaugccaccucagaaaaucuaagaaaauaacccuaauuacauagaaacaucucuguaaagauguucauuagagggccgggugcaguggcucaugccuguaaucucagcaauuucggaggccaaggcauguggaucguuugagcucaggaguucaaaacuagccugggcaacauggugaaaccucaucucuacaaaaaauuagucaaaugugguggcauaugccugugguccuaacuacucaguagacugagguggaaggaucgcuugagcccaggaggaggaggcugcagugagccaagauugcaccacugcucuccagcguggugacagagcaagacccugucucaaaaauaaaaaccacaaaaagauguucauuagagugguauuuauaaaggcaauguaaaagcaaaucuaggugguuuuacaguuagggaauacuuguguaaauuaugaugcauucgcuuaaugagaauuaaaaacugaucgugaaaacuauguaacaaggaggaaaaaggcuuacucauuaaauaggagacuaauauuauagguacuagaaccaauacacgauuacagaagaaacuaugaaccaguuuuuaaauuagauguagcaggaauaaacuagguaucaaauuuaugggggaaaaugcucaaugacuaggaaucagcaaaaaaacaccuccaccauguggugcuuccccuccagaagaacuaccagcccucaggaacagcacccgcuccccucagaaaaggacaacucaaggguaagcugcagccacagacuggcccagaacauaagcaggacaggcaggagacggagcccaacccagaacagugacgugaaacagaugggcaggagugugcccuuugccccagccugaugcagcccuucccacaggugguggggaggacaggcgcgccuugcuaagaaacugucucgauagcacuauuauuaaucuuuuggucauuuuucaucaagcgguuuugugcaauucaugaugcuguuuaaaugaccacagucauuauuugaacgccaucuguggaaagauaaauguauacuuaaauuguggguauaauuuuaacuaguuuauucacucauuuuaccucauuuugucuaguuuuaacuaugauuuugaguuauccuuuuccagaucuucuucauccucaauaacccaauuuauagaguugaccacauguuuguuuuuaagcauauguaaaaucacuggaaucauacagguuagggugguagaaguggguuuuaaaaccccuuucucuguuuuaauccacaauaaaucaguaaguacuaacacuguuuaugauagcaaaaaauagaaacaacccauauauccagcauuaaaggaauuaaauuauaguccaucuauauacaagggaauauagugaagccauaaacgugaucauacaguccuguauuuuuugacagagucacaacguauuaaguaagaaaagcaaguuagcagaagguggaguaggcacaggauggaaaaauauuacguuuuucacuuccggauuguaugacugaagguaauuuguuuuucuuucugcguaucucuaguuucugauuuuucuacaacaaacuauuuaauuucaaauagauacauuuuaaaauuggcaaaacagaaguaaaaauuagguggaaaaugauacuaacuugguuucaaaggcccaccaaggaggccaucuguuaagaguaacucauaugcaaaauaagccacaugggaacagagacacguaucaagcucacaggcaggcgcgggcuuaccuucagcccagcugcuacaugcgguggaguguccacaauuugccggucaucugaggagccaccucgcuucaggucaaugacuggggcgaggacuguacuuuguuucguccuuuggcucuaaaaucaucaaaaacaaggaaaacauacugaaguuucaaauuaaaauucacacuguuugcaacaaagauuuucuuucuggucccugcaacaaaccuuugagauaugagaaaaccauaaucucaaaacaacagccuuuuaauuuauuacuauaaucauauauuauuuucuuucagcuuuuucaaaaacaugagauuuucuccauuucugugaaagguuuacaguaaacuuagucacuuucaaaagauacuuggggauaagaguuuuguucccuccuacuaggauauagaauccuuccuaucuccuuuauuaugaaucuacaaaaaaaaguuuuuaaaagaaaaucauuucuauacauucaauuauuguuaauguucuaccauacuucuugcccuuacaccuguauuuuuugcuagaccauuugaaagaaaguuggagacaucaugacacuucaccccaaucuccugaaaccguggacauucuccugucagauuacuaccccuaauaaaaucacuaauucccaugucauuucccauccaguucacauucagauucuccaagauaucccaaaaauguccuuuaaacagcugauuuuuuuuuugaaccaggauccuaccaaaguuccugaaaugcuuuugguuuuuaagugucuugauuaagaacagucccucuuccccaucaucaucaucaccaucaucuucaucuccucuuccuuuuuuuccucugacacuaucuuguaaaaugcuguuuguucuagaucugucuaauaacuaccugguuauuuaguugagcuuguuccucuaugccuuguaauuccugaaaccuggagguuaaaggccugaucgaauucaggguaaagcuuuuaggcaggaacacuucccaggugaggcagugugccccuuccugcaacacacagcaggcacacugcgucaggccgucuaacagcaaugcuaagguugaucauauggguauggugguaaccauuagaucuuuugauuagaaagguuuaauuuuucucuuuugcaauuuaaaguguuacaaauuuucauuaccacuauaaaaggcacaaaauaagccuucaucucucuugaauauaacaauacuuauaaauuuaagcaaacaaaauuuaauccaauuaacaacucacaaaguaaauacgaaaguuuacagaacggaagggggauuuauuagaaucacauauuuucuuucuuucuuuuuuuuugagauggagucuugcucugucaccaggcuggaguucgaucucggcucacugcaaccuccgccucccagguugaagcaacucuccugucucagccuccagaguagcugggauuacagaugcacgccaccacaccgggcuaauauuuguauuuuuauuagagauaagguuucaccauguuggucaggcuggucucaaacuccugaccucaggugauccacccgccuuggccucccaaagugcugggauuacaggugugagccaccacgcccagccagaaucacauauuuucuauuauuauuauuuucuauucaauauagaguuggcccucuguaucuacagguuccacaucuaaccccaggcugaaaauauuaagaaaauaaaacaauacaacaaaaaauacaaauaaaaaaaccaauacgguauaacaacuuuuuacacagcauuuacauuguguuagguauugcaagcaauccacagaugauuuaaaauaugggaggauguguguuaguuacgugcaaauaccacaccauuuuauauaagggacuugggcacgcuuggauuuugguaugggcagggggguccuggaaccaauccccuguggacaccaagaaacaacuguauuuuuucaaauggagauacaaaugaaaccacagcuucaaauuuucucuaccaaauaaauaccuuuacagguuuggcuaggccaaucuaguauucugaguaacuaaacagccuaagagaaugcaaucuucacuucccuuaaaaaaaaaaacccacaaaacuaacuguacauagcaaucucaaaaguuuuauaaaguuaguagaaauaacuucacaagcuaccucaaguuuuaaaaaucuauaugaggccgggcacgguggcucacaccugcaucuucccugcaaagcaaaaguuacaugaaaucuacaaagauuuuauaaauguacuuuuaaaaaaaauuaaagagaaaaacgagguuuugcuaacccuccuuacauuuggaaugaaaccuuguuuuaaaaaaaacacaaaauacuggcauccaaaaaaucuaaauuugguaaugaugaauuuuaaaaacacaaaaaaaccucucuacaauacugaacaaucaaauguaagcacuuccauguaaguaucuauugaugugguaaagggaaaagaaaaaugaguagaacuuuuaagaaaaaaaaccuguguauuggccggacacgguggcucacgccuguaaucccagcacuuugggagaccaaggcaggcggaucacgaggucaggaaaucgagaccauccuggcuuacaaggugaaacaccgcaggcgcaguggugggcgccuguagucccaguuacucaggaggcugagacaggagaauggcgugaaccugggaggcggagcuugcagugagcugagaucaugccacugcgcuccagccugggcuacaaagugagacuacgucucaaaaaaaaaaaaaaaaaaaaaaaaaaaaaacaaaaaaccuguguauuacggaaauuuucaaacaugaaauuagagauuaauauuaauucuuaagucucuacuauccacauccaguuucaacaauuaucaacucauggguaguucuguucuucccucccuccccugcccgggacugaauuguuuagaaguaaaucccaaaaaugacaucaucuuaucgguaaauauuucaguacacaucucuaaaguacuuuuucucaacuuuaauuacugccuccccagcaaggagccuuugacuaaauuuucucccgcacaugaaauuuucacaccacagauacacugugcacaacacgagcaagguuuuuucacccccaaaaagaccaauauucgcucuguuuggggggauauagccuccauuacgaaugcauacucuagaacauaaagaucucuaaaguaguaaacaaaccauaauaccauucucaugccuacauuuuaauggcaaauauccagucgacaacuagguuuuuaauguuuuacauguuauuucaaggacauugccaauacccaacauguacacaacagaaacaaaagcaaucagcauccagacuaccuaugccugacgccuucacaaucaaccugagcccucaauaaguugcacgcagcagcuuagguauucuguggagcuucuucccaaagugcugcuuccaaacuaccuccaccaaaccaguaggaaugcuacuuaaaaauucccacuccuggggcuccagccugaacuacaguuuaccagaauaucaggaguaaggcuacaaaauuagcaccuuaaacaaguucucacucaaucuuagaccuccacuacuuaaguuugaaaagcagugucacugcugguucagaguacuguuuuuuuguuuguuuguuuguuuguuuuugaaucggagucuugcucugucgcucaggcuggagcgcaguggcgcgaucucggcucacugcaagcucugccucccggguucacgccauucuccugccucagccucccgaguagcuggcaguacaggugcccaccacugcgcccgcgguguuucaccuuguuagccaggauggucuggaucuccugaccucgugaucugccugccuuggccucccaaaaugcugggauuacaggcgugagccacugcgcccagcccccgcagaguacuguuuuucuucauuccuaccccacgaaauguuccuauucccaggagccaggaguagcaaaguggccuuaaacuccucauuccucucccccuacaaaugcuuaacaccauuuacccaauacaaaggcagaagagcaagcugaaaccaaauuccuugucauccuaaugaggaacccacucuggaggccucugcucucaugcucugggcuugucuuuaccuuugccugagugagagcugccuucuucaccugaagcugagacugcagaaguuugaaguuuuuggaccagccuucuguuuuugagucacuggucuccacuccuaggucaucguacagggacaucuuuucuucaguuuaaugcugaaaggcaaaagggguggggauuaaagaaugcacaauucaauaaaggcuuuucauguuaaaauaaguaucaugaaauuuuagagguaaaagguccaggaccuuucagcaacagaggcccaggcuccugguaccauuaauguagggcuauuccugauacaugaagcuagaccauggauuauuuuuaaaauaagccucuaaaauucauuuuuccaucuauaagaucaugcagucaagugauccaugagugaaauccuucaaugcuagggcacauaaugagguaagaauuggaacauuauuaauuacauauauccaauuuuuaaaaaauucuauuuaugucagugccaaaaaguagaagcuuuacaaaaacaccaauuagcagguugauguagcacaauuagcuacccuuuuauaaagaaaaaauuuaaacguacuccuagggaaaaaaaugacagaaaugaucucuuagaugugauuuugucaauuacaauuaucaaggggggaguagacugguuacaucuuaaauacucugauuuccucauaucacaccaaguggaaaucugucaucuuuaaugauagugauuacaaagagacaaucaacaaucugcaugugaacgagcaacacacagcuuccgugcagaacagaggaacacguggaaacaaaaaccgagucagcaggcgcaaagcaugacaugcaaugcagcaucggcagcaggucccaugaaagcccagcacugcacagacauggaugcugggguuuagggaaucaaucugcccaaggccacagcggaagccccuuccaacccagccaggccaacuccagagcccucgccagugaaccccaacugccacuuuuuaaaaaaaaaaucaacauucugaaacccaccaacauagcuuacuucuucaaauaagaaaucaaucucacagacagaaagagaacuuaauuuaaacagaaacccacaaauugcaaguaaaugcuuagcacaguaguucccaguuuauggacaaauaagucugucaguucccagggggcccauaaagcauuuucccauggaaaccguguuauugaaaagccuaauuugcuuguguucuguggcucaggagaggaggaaaauauuuaacacauacccuccuuaggucugauucggcaagcauuucucuugaagguacucuuacuucucagcucccccauuacagggauucuaagacccugccgccccaacaccuucgcugauguugguaccacacuguguggagugggggacggagugcacaccaacuucuguucccucagaagaacugcccuggucuuaaguacaguaacucccugccugaagucagcaccccagaaaacugucaccacuuuuuaguuucuuccauuccuucauacgugaacccucaaauuaacuaaaaccucuccauuuugauuuuuaaaugaaagguccccgcaaggccguagagaagcagggaaagcagacuguccagggguauugauggccgacugcucaaaugaaucacauaagaaugaagggauggucaggcacgguggcucacgccuguaaucccagcacuuugggaggcauaggugggcggaucacuugaggucaggaguuaagagaucagccuggccaacacggugaaaaccugucucuauuaaaaauacaaaaauuagcugggcgugguggugggugccuguaaucccagcuacuccggagggugaggcaugauaaucgccugaacccgggagauggauguugcagugagccaagaucacaccacugcacuccagccugggugacagauaaagacuccgccaaaaaaaaaagaaaagaaaagaaugaagggaugccgggaugcagacagacucuccuccugauagaugucuucagugcaaaacugaccuuuuucaggaacuuggggaugucucgugacaggccugaagcacugaggccaaaucaagaaaaaauaaugaacuccauuccuuaagaaauauggaugaaauauaaccauguccucaaagucuuggagggaauccccugauguccacuucagagccuaguuuaauaacucugaacuccaagaaaaccuagauccagguuguucuguucacugcucuauccccagacuaagaucaauauccaacccacagcuaaauaggaaaugaggccaaacugcaguuuauacuccauuugcgaagcccucucaauuagaaauuucuggccaauaaucacuggccagaaggaacaacacugcaccaaacagcuuuugaggcuuuuguacacuuuucuuccagcuuacccagaacucaaaacucauuguucacaucuagauacauacccuuaaauuuuaaucuaagaaaacucaaacagagcaacagcacagaaaaaccaugcugaguguccagcuuagcacuguggcucccaaacacauuucuucagaaaugaccaugcaccuuucaucuaacuuaguuuaaucuuuugagcccucuucauccaacuggucagcaaaccaaagccuacugaacuacagguucuucuguucuuucuuuauucuuaaaauggaaagggaauacuaacagauucugagaaauaaacaaugcgacuuucugggaaaucacaaagauaaaucaaaauuuguuugcaacucaaacuaaacucuagauauuugcuuuucucaauacagacuaucuccaguaugaaaaucugaaauccuucaaaaccuaaaacguuccgagcaacaacaugaccccaaaguagaacauuccacaccaggccgggugcggugucucgcaccucuaauaccagcacuuugggaggcugaggcggguggaucacgaggucaggagaucgagaccauccuggcuaacacggugaaaccccgucucuacuaaaaauacagaaacaaaauuagccaggcaugguggcgggcaccuguagucccagcuacucaggaggcugaggcgggagaauggcgugaacccagaaggcagagcuugcggugagccaagauugcaccacugcauuccagccugugugacagagugagacucugucucaaaaaaaaaaaaaaaaaaaaaaaauuccacacuugacuucaugugaugggucacagucaaaaacagagugaaaucuuuuugcaugcauaaaauuauuaaaaguaugacauauauugcauauucaggcuauguguagaaaguauauaugaagcauaaaugaauuuuguguuuagacaugggucgcauccucaagguaucucauuauguauaugcaggcauucuaaaaaucuaaaaauauccgaaaucugaaacacuucuggucccaagcauuuuggguaagggauacucaacccauuucucuuuauaacuugagaacuuuaccgaaaguguuuaugaauacguuagugccaccagaaauggguuaaccaaaugcccauuaaacuucgaggggaaagauucacuuauuuauuuuugcaucuacaauuucugucauauagcaagcauuuaauaagcuuuauuaaaauacuaauaaugggccggcugcgguggcucaugccuguaaucccagcacuuugggagaccgaggcgggcggaucacuugaggucaggaguuugagaccagccuggccuacguggugaaaacccaucucuauuaaaaauauaaaacuagccagguguggugcugcacgccuguaguccugucccagcugagacaagagggugagauaggagaauugcuugaacccgggaggcggaggucgcagugagccaagauugcaccacugcacuccagccuggaugauagagcgagacugucucaaaaaaauaaaauaaaaaauaaauaggcaaagaggcagcacuggggaauaagggaaggaaguaacccccagagagggaggcaacacuccucacccuccccagaagagucaacucugaugaaaagaguucucuaaacuuugaggcuaaaaaucuagcaguguacuagaucucagcugccaacaguucuuccaucaauagauucaauauuuagcaaaaauuaaauagugaauuaaugagauuuuaugagaccacacaucuccucugauuccaugucauuuaagauggcugacugacaauuccaguugauuugcugcauugcgcaaaaguuucagaaaucaucaggcagcaaaucucaugcucauuuaaagguccucauuucucuucucaaaccugcaaaacgcuuuaaauauuagaaacugaugucaucuuaccagcaccugcuaguuuucuguaacauugagcuuauaaaaucaaaucucugcaucacagcaaaugcaaaagugcuuucuucguuuuucucauuuucacugaauuuuaaguucacagaaugggauuaaucauaguaacaucacacucucauccauucacacacuuauuaccugcuuuuguuuaauuauuauaaugcugcaagcaccugugaauucaccacccaaaacaagacaggaucuagacuaagaaaccacacucaaccauacuacucccccaacccauucauguaauuuccccggaauccucuucucauuauuuccuugcuuuccuccuuuuauguuaauuuuauuuacaguuuuaguuaaucuauuccuuaaaaaguguguauucuuuauuuucgcuauauuaagcauuuaauauacaauaguuuguucauuaauucuccccaccgcaacuacugaaauguaauaaguacauuaauaagacugccaagacccaaacuuacccuaauuaacguugacauuauuacuuagacaacauaacacauuuauuucauuaggucugcugccagguaacaaaaagcuguacuuuguaacaacuggauauaccauaagaagccaggaucaaaaguaaauacaaauugcugguuuuuauaacuuuaaaauauuugcuauuuccuuccuuuuuguggcaacacuucccuuugagcaacccacguuucauauaugcuacauuuuuucuuaggaaacauaacaaacaugguucugccagaaggaagaauggugaguuuucaagauuccacccaagcuggaaaguauuuuuuuaaaacaugugcaacuggcaggaaaaagaacauggaagagucuucucagaagcaccccaccuacuuaucuuucaagugcaucucagaagccuuuagugacuauugcccccacauaaaacuaaccccccccaacugguuuccucaagcauacucagaucacagcaaccuuggcaaguuaugcugccuauuguuucacacagcgguuucuuccugcaguguaagcccccuaaaggcagggguguuucuuauguucagcuuuguaucucuagcucagcaccaugcuugaacauuguuaaguggcucuauuaauauuuuuuaaauguguuagugaauggaugaaaaauguuagugcaccuauuuaaaucacauuauuaugaaacagugagaucugcagaucugcuuuuuaagcacauaacuuaugauaaguaggauaaaauuuaaauugcaaaccauaauuaaggagaaaaaaacuaccaccaccacacaaccaauaacgagucaaggucugaguucugagcaccuaaagaggcaggcuuguuagcaagaaauauuucuaucacuaaacagauauucaugcaucauaaaacaaagcaugccucuuugaagccuaaagaauauggcaagaccgggcccaguggcucacgccuguaaucccagcacuuugggaggccgaggcaggaggaucacuugagaucaggaguucgagaccagccuggccaacauggugaaaccccgucccuacugaaaauacaaaaauuggccgagcaugguugcgagcgccuguaauuccagcuacucaggagguugaggccagagaaccauuugaaccugggaaguggagguugcagugagccgacuuacaccgcugcacuccagccuggacuauagagugagacucugucucaggagaaaaaaauauauguauauaaauauauauauaaaaauauauaaauauauauaaauauauaaauauuuauauauuuauauacauauauauggcaaauauacccagaaaggaacaggagggguggugcacuuugguguccgcaaaaaauacagcuuaaaaagcaucuaccucaaguauaagaucuaccaugacuuucuaaagaauuaaaaaaaaauuuuucccauaccuccaucugacgcccuugucaguuuaaucuuuccauucaaucccacccucuggcuguuaccaaaaugccauaggcuaguauugcaaacacaguccacuacagucaccuguaauuuaggcgaauaacagaacuuccuucacuauugacuauuaugaaagguuugagagaugacuagccugggaucaucuguucccugcugggaggaggucugaaaaauucauaggcaggggagaaugggaagguaaguuaaaacaaaccagguaaaaagaaauccacuuuaaauaaagcugcauuuggaaguguacaacaauucucucaagagccuccagaaaggcugccuuugguuccgcagagcuccacaaccgcacaaccugcucuguuauaaacuggacagcacgcagcaccuugcuuaacuaacucuaaaaauaaagcccucucguuuagcucacuaaacuguuaccccauauucccuaaaagcugucauuacgaucaaaaugucugcagccuuuacaacuaaaaauguggaaacuuguguugcauccuuuuaaaaacuccaucugcugcggggagccagugcacaucuacccaucuauuugaguauaugcgaaucuugcccuuaucuagaauauccuauuucccauccauaugccuggcucuagcaaaauaaggacccucaauggcgcuucuuuacugcuucucaagaaaccuccauguucugaccugacuacuccuggaaacacagcagccccuccucaaaccuuucuuucugccuaaccugcagcuuccagaacgcacuacggggcuucgcuucugcuacuuucgcacuuacuuccuccgccggcagccuuuuucccaccucucacaucuaacaacguaccuucaagacucaacauaagcaugaccuccucucucaagagagguccuuccagaccccacuugcguuucucaaaucaacccgggccuggguuuucacgccugcuuucccagaaaccaaacuccugcaagcaggggcagaaccucauuccaccugcauucuccgaucauuacacauucucggggcaagaggcgaagcucaaagacugccuggggucggacgugagcgcugaaacaccgcucaaacugcacgagccgaggcgacgccgggguuagggcugcauuccugucccgggcagcuccggagucugagaaacgccaacgucugcacucccaguucugagaccccgggaggaaccggcuccgagccccagagaggggcaaccgugcagggccaggggggacacgcuacgggcuacucgguucuggugaccagacaauuucgucaggaugcggugcacgagacggagaagaaacgcucuucagcaccaaacagcccgaggcagacaugaggaggaggaggaggaagggaagagggagaaggucagggccagggucaccagaggcggcggcgggcggaggguaccgggccgcagccgcguggagagaccagcgcccgccgcggggacugagacccucggaggcuccggcugcgcuggcccggccuccgccccucgcgacgggccuaaagccgcgggcuugcgucuagcgccucccgggaaggcgcgcccgccucaggucccgccaggccacccacccggggccgccggggcgccacuuacccggcccgcccggccgacucugcccaugagccgcgccggcggcagagcggagccgggcggcacuccgcggaaacccgccagcggcaggaggccucggcggcgcccacccuucgcugaguccucagggcgcucggcggcgcggggucagggagcgcgggcugccgggagagcgcgcccgcgccugcgccccgccugcgccugcgccugcuucggccucugcgccugcgccgagggcgccuugccgcacugcccccugcccgcgggaggaccgcacugcacgcuccccuccgccggcgucuucuuaccaucaagaggugucgcccuggcgcacauuuucgaaauuccacaaggcuuggggagcgcggcagcgcccccagauggugaggaggagaagugguccgaggccgggcuuucugauaggggaggugggggaagucccuccaggccccucgaucucauucauucaaagccacuccuauauaagcaaaaaguugaaaauaagucugcauaggccagaugcugcaaaaggauggcaaggagcacgagguuaagcguaagauuauggaaacagaugccgcgauuagggguacagaaaagaaugucaaugcuauaaagccucggucuuuaaaaacgacgucgcugacagaagcagggagggaaagggaaagugggacuucggguaaauaugauuuuuacaucuguaauuaauugggugucaaauagaguucaagc

SEQ ID NO: 13047 - RNA, 1956 nt, Homo sapiens
cugagucgaaguggacgcuuugagcguagccgccccacagccgccgaucccugcgucgcuuccuguagaacccugggccugcuuugcagcuuuccucccuuugucucacaaccaugucuaccaacgagaaugcuaauauaccaguugcccgacuuaacagauucaagaacaagugaaaagacaguacagaaaugaggugucgcagaauagaagucaaugugaagcugaggaaagcuaagaggaaugaccagaugcugaagaggagaaaugcaagcucauuuccugauguugcugcuucuccgcuggagaaaaaccgcaaaaaccagggcacuguaaauuggucuguugaugacauugucaaaggcacaaauagcaacaauauggaaagucagcuccaagcuacucaagcugccaugaaacuacuuucuagagaaaaacagccccccauaggcaacauaaucugggcugguuugauuccaaaauuuguguccuucuugggcagaacugauuguagucccauucaguuugaaucugcuugggcacucgcuaacauugcuucugggacaucagaauaaaccaaggcugugguagauggaggugccaucccagcauucauuucucuguuagcaucuccccaugcucacaucagugaacaagcuguaugggcucuaggaaacauugcaggugaugguuuaguuuuccgagacuugguuauuaaguauggugcaguugacccacucuuggcucuucuugcaguucccgauaugucaucuuuaguaugugguuacuuaugucaucuuaccuggacacuuucaauccucugcugcuacaagaauccugcaccccaguuagaugcuguugagcaaauucuuucuaccuuaguuuggcuccugcaucaugaugauccagaaguauuagcagauagcuguugggcuauuuccuaccuuacugaugguccaaauaaacgaacugacauguucuugaaaauaggaguuuugccccaacuugugaagcuucuaggagcuucugaauugccaacugugacuccugcacuaagacccauagggaauauugucacugguacagaugaagagacucagguugugaucgaugcaggagcucuugcugucuuucccaaccugcucaucaacuccaaaacuaacuuucagaaggaagguacauggacaaugucaaacaucacagcugacccucaggaugagauacagcaaguugugaaucauggauuagucccguuccucacaauguucucucuaaggcagauuuuaaagacacaaaaggaagcuguauggggccaugaccaacuauaccagugguggaacaguugaacaggcuguauaccucauucauuguggccuaauaaaaccauugaugaaucucuuaacuucaaaagauaccaagguuauucugguuauccuggaugccauuucgaacaucuuucaggcugcugagaaacuaggugaaacugagaaacuuaguauaaugauugaagaauguggaggcuuagacaaaauugaggcucuacaaaaccaugaaaaugagucuguguauaaggcuuuguuaagcuuaauugagaagaauuucuugguagaggaagaggaagaucaaaaugcugugccagaaacuaacucugaaggcuguaccuuccaaguucagaaugggacuccuggaacguuuaacuuuuagaucauguagcugagguauguauuuguuguguacuauauuugguauuuugucuuacuguuucucuacuaagaacucuuuuuaaaugugguugguuauuguagcacuuuuuacacugaaacuauacuugaacaguuccaacuguacauacuguaggaagcuuguccucugaauggguuucuuauuucuguguggaauuucuuaucuugcagcauccuauaaauaaacaauaaaguccacccuuuacuucaaaaa

SEQ ID NO: 13048 - RNA, 82356 nt, Homo sapiens
cggaaguggcaccagcacuuccgguacggaaaacucgcugcugccccaaccuggcuugacaggcuuggucucugcaaguggcucucagccccuucuucuuuccugccucaccuuccaauucguuugccgccgccgucccgcagcugcuguuuccggaguugccccuuccccauguuccggggcaggaguccgcaaagcgaagauccgcccgccgguuccucaucauguccgaacugacuaaagagcugauggagcugguguggggcaccaagagcagccccggucucucggacaccauuuucugccgcuggacgcaagguacccuggcggggcucucacacuugcagccgcugcuucuuuugcccugcgagaguccgccugugacgccucucgcuccagccccucgcgugccccgcucucugccccagucgccgugcucagcgcugaagcuggacuuucuagacacgcccugccuugccuugguggggagaguuugaguaggagaaugguuacagcugccacuaaauacccgcagcgcucuuuccauccuccgggcugcccuucggcuggggaggaggagaggguggccccuugcuggguugcagggcgugacacggaagaugcgccccgugccccggugucacuuucucaaggggugcuguggccuuccgcaucuuuacccccuaacagagcugucuauugguggugguuggucuauuuuuggugagaaggagggacguccaagggaaaguccaaguggcuaauuccaaaaagcaguuuuuuguuuguauugucauuaugugguuaggcgugguagucuguguauaaacacuguuauuugcuaaaaaguguacucuuggcccaaaguauccccguuuuuuauaugguuuauuaucugucacgguuaaaaaaggaauauggaucauaguacuuccucggccgguaugcuuguaacccagacaggacuuuuacuuacaugaagagucuuaguacaaauaauaaugaaauaaaauaagcauuuauugaauucuugcacuguaacaggcugggcgcuuuauacuaguaacuaucccuaauucuuaaguuuggauaggcaaacaacugacacauuccuaaaggugacuuaggaaagaugaugaugagguuaaaacauaaccuugagucagaaggaucaauaauuuauguauguaaaacacuauuauuauuaaaacaucuauuuagggaacaccuguucccgaaauagauugggcggaauuuuggcauaguaaauauaaaccccuauuucaaaacguguauuuuguaacaaaaauucaggauuuacguaaucucucccucccucccacauguuuguuuuaagagcugguaaaauuacaauuacgauguauuguuaaguugggauauuuagucccucacuguugcuuugcaggcgaaaaaaauuaguuguaaagguaaaugacugggccaaaguugcacaaaucgauagaacugggaguggauuccaggucucucgauuccuaauauaccucuguuuucauuaucuuccuuugaguucccaaacccuacauguaaugacuugggcucuuuuuuuucacauucaauuaugucaguuaccuaaucuugggcuucuuagagggagauuuuauuuuaacacuucccacuuugacuuacuuauucuaauaguaagcagcucuaaaauacugugaaagacuaagaaaaaauuuacuuccauuguaaucaguuaacauuuauuaaacauuuuacaaaguagaauaagauaauauucagcccuguuuauauuuauacuguaaugcaaauacaaggaagauucaggguggcaguucuaguaaugguuaagagcacagucuggaauagauguacuugguucagguucaugugauuuagcuuauuuaagccucaguuuccuucucuguaaaguacagauaauagaccuuacagaguuauugugaggauuagaggccauguaaauaauuuaggugcuuagcacacuaucugacguauagugaacacucaguauaugguagcuguuuuuauauuauuuuaaaaaguguuuaauuguagacuaugccaaauucacucuuuggcuuuuuccugacaauuacaauaaguuguuuauuugauggcuaaucauuauucuaaauagaacuuuauaaugacuuauuagaacgcucugccaccuuuaaucaugcagaaauucuuuaacaggauuaguuccaucaguaccauuucaaaauaaaggauuucuuucuuuuuuucguuuacagggugcaguuaguuauauuuuggauauguagcucuucaaggccuuacacugauuaagauuuuaaggcaaccaaacauauauuuuugaaguuaucgccucugaaucagagggguccuguuacugguuuugauauguuaacuguuguauucauuuguuuguucuuugaggccauugcuaaauauugcuguggcaguccuuugggauugugggaacaggcacaagacacugcuuugcugcauuacuaaugugacaucaacucuggcuuuauuucauagucugugaucgugucuucaguugacaacugcagucucauuaguuuucuggaagcaagauacagauguaagauguuuggcaugaauauuuauacaauuaugucuagagauauuucaucuauaaaauuauauugauugaucaaguuaaauucuuuugauaugguuguuaaaacaauaagcugcaggaguggcacauaguuguuuuuaauuggcuugacauuuuuagauaauucucuucuacaaaucccuguucguuuuaaaaaaugcgggguguuuuuuuucuucuucuuuuuuugggcaguuuuaauuuuaaaggcaauaagccauguaauuuaagggcuuaaaguuggcaggguuuuauuuuaacgugaaaauuuauucuucucucugcuuuccuccugcucaauugccuauaguacuuuuuaaagaauagcauauaauuuucacuuccuuagcucauuaacacuauuuauccuccccccuucccacaaacuacaccaguauuccaagcucuuacaguugagagucaguagggugggagggaagacaaacaguaaauauaacguagcauaaauuacacauguacaauaaauaguuugaagaugaggaaauacagaguucugggugggguguccuggucaggccucauuuuaagaugagauuugagcaaacacuuggagucacucagcuagucaugcagaagucggaagaaagagugcuccaggcagaacaaaugguaguuauaaaaaacuucacagaaaauacacuuggucuguuuaaggaacaagaaggaaguuaguguggcaggagggggaauaaaggaaaaggagaguaauaaaagaugauauaagaaaugaaauggcccaaaucauauaaagcuuucuaggccauuagaaggacuuucacucaucuuauacaugaaauagggguccuucgaagguuugaagcaaaggagagauacuacuugacaaguuuuuaaaggacugaucugccugcuguguuugaggauagacuguaguggauugggacagcaagaucagauaagagacaauggcagcaguccaggggagaaaagaugcuaucuuggaccagaguagugguaguggagaugguaagaagcggacagagugaccacaaccaaacagaaccaaaauaagaaucagcuagaccuaacagaaguaguauuucuuguauaaauaaaaacauuuugacuuauuuggaauuuauuuucuuuucaauauugauugcuuagcucaguguuuggcaaacuucuuuaaagggugaguggccuuuuuauugccucucagcucauuaaugguauugcagcaaaagcagccaugguuaguauggguguggcugcauucuaaaacaugaaagcagaugaggguuguaguuugcugacgccugagggagaguguaaacucuuauagccauuuuuccuucuuccaauuauuuuccuucuuccaguuauuuuauuguuucuccuaaagacuagucagagagagauuuauuuuugcuauuuguagcaguacaguggguggguuuuuuuuuucuuuuuccccaggggaagaggggcguguagguguaguugauugaaauuagagcuuugggcuuucaguguagcacaauuuuuguuacguaauaugaaaaaaagauauuuaacaaauaacuuaggaaaauugagggauccauuaaaauauaaauauaaaauauauuaggaguuaauacaguuggguuaauuuaagguuuaaaggcguguuuggguauuuauuuuaaugugauuuacuauuuuaucaaaguaauaaaaugacacaccaacaucauuaauuuuucuuccaaagugaagcuaauacuguggaucacaucguuuaaaaguuuuuuuguuguuuuuggaaguuuuuaacauucucuuauauauauuuuuccuuucuucaacauaccuaaauuauaauuugccuaacaaccaauauuucuuaauucguaauugguaagcauauaugacaaaauuaauuccuugguacuuugaauauauaauuuguuuuauuauucaaauacuugaaaguaucugugauaauaucuuauauuuguacuauauuuuacagcuuaugaaaaucuuaccuaaucuuugcaacaacccugaaagauaggaaagaacaaauguaguuauccucauuuuuuuagaugugaaguccaauugagauauuugacucagccaggaugucaaacuaagucuuucuauagccuuguuuacauggaaggcuagaauuguagaagguauaguugucaaaauggugugcaaaauguguauauguauaguaaguaauaugaaaacaagagauugaaaaauugcgaugagguucauggcucagguuuacccugguucugagcuauaaaaugugaaaaugagaaagauuuuucugugaucuguaguacuguguaaugugauacaaaauugucuacguaggauuagguguuuuaagauggguaauuucagacguaaucaggaaaaacggccauuuaugguaaguuaaguccuuuuaaaacuaggaaauaauuugaguaugagaacucuugagaagaaaaguaaugcuguguccugagaaauucaaacuuaaguaaaaccuuauuaugaaaagagaagucuacucagcauaguccuguuuuaggauagaauacuuaauuuucauuuagcugacuuuauuucauuuuggcucuacuagccuuuguccguuaucaguuaacacacucaaacauguauacuggaauuaaacagaauuuggcaugaagcauaacugcuuagaauucacuccaugggcuuuuaauauuaaaaguacaaaagcaacucacuguaacgcauuuccaacugaaagccccaccuguggauaauugaguuacaugauuuaaauuuuuaaggaaggcaagauccauuacuaauucacacuuuaauuucauacacgaaaaguuuagcagaucuuaauuuugccucugcacuuggguacaacacuagggucccuuuccuuauucucaguagaagagcuggccaaacagugaagauuucaucucuuguuccuagguuggaccuuaaauuugguuguuuuaacauaaccagaaaccuuaguugucacuuucuuauuaaauuuguuacauguaucuucucuauuccaguucuccauuuguccuauuuuugaucucccaggcugcuguguauugcuggagaaaauuguguccagcaccaauacaaauguaguuaaaucuuagcugagcccucagugcuucucuuaguucuuuccuuauguuuuuuggaauuaacacuuuccucaauucuguacccuucucauuccucucacucucaauauaacaccuguucacuuuuucauuuuuccucauauguuuaacuuaaaagccuucuaaaauuuacuucuucuccuaggccaguggcucucaaguuuuuggaacucagguccccauuacaguguuaaaaaugauugaggacuucaacucaaaaaauuuaaaacuuagugagacucuuggcauuguuuuacauuuuugcuaaucucuuuaauguuuaucauauuagaagacagcuggauuccuacacuggcuucuccagucuguggcaauauauuauuuugguugaaguggaugcagaaaaucuggccucacauaugcaauuggaaaaggcaugagaaguaugguaguagccuuuucagauaauuacacauaaucuucuuuaauaccacaccaaaacuugacacaucagaguauuguagagauuaguugcaauacgaaaucuaaaaccaaaucauguaacuuuucauccucuguuaaauugaaauccauuggucugucuugcaguuuuaauagaucucuuaccucugcauuaauuuauaacaguauacaucagugauuuggagauuaucagucuacugguuuaugacaaucuuccaaguguuaguguaugucauuauaccauaccagaagucacguuuguuucuguuaccagugaugucaucggaacaaucuguaagcauugagaagcugucagagucacaguaguggacacaaguguuccaaguuacugcuugaaugcucgaaauuuuaucacuggcuauuuuccuugaaaugucaagcucacuuauuuuugagaaaaugucagccagauacucaagucugaauaacuguagcuuauugguaguuauacuagguaaaagcagcacuccauuaaaaaaaaaaaaguagcugguucagcuugcaguuaaaaaaauuacacauauacuuuuccuugagauaacuuuugaccaucauacccaguauguagcauaagugcuuuauggguagcuuccauuuuguuccgcagaauauauuuuuaaaaagacauuguauucaagaucaagauacaauaaaauuaguaauuuugacugcagcaguaaguauguucuuaaauuggcucuguaguugugugaggguauggggguguuuuuuaggacagugaccacuaggacagcuugauguuacugucucgauguaugcuaaggaaccagcaauguauuacaccauagcuuuuguaccaucacugugaaugucaacacagcgaaaggggcaaaucauaucuuaguuuuaucauguaaauaauuguaacuuccagugggcccccugaaaggucucuaggauuuccaggguuaucgguggaccaccuuuaaaagucucucucagcucuuuuucaggacuuggagaccuuaaacuuccucuuuuccauauaaucacucuuucccuuuucuaauucacacccuucagucuacaaaauuaauaauucuugauccaacuacccuucaaacuaucauuccuuuuucccuucugccaaacuuaaauauaguugucuguugguguucgagggguaguggguucaaggaucccccugcagauaccaaaauccauagacgcucugcaguauuugcauauaaccuacacacgacuuccccuacacuuuaaauaaucucuagauuacuuacaauaccuaauacacuguaaaugcuaugcaaauaguuguuacauuguauuguuuagggaaugauaugaaaaagaaagucuguacauguuuaguacagacccaaccaucguuuuuuucccacccucaaauauuuuccauuuguguuugguugaaucuguggucgccaaaccuauggauaugaacggccaacuguaguuugcuuuuacuauuucucuuucuaauccgaauuacacuucaaccuuuuaaaauuuggcuacucucccuagugcuguaaauuuauauuuuuaguauucccaaugacaugauuaaucuaguauuuuaauuuauaucuuuauucagcagcauuuguaauaguugacuacucuuugcuucugauuuuuccuuucuaggagcucaguuaaugugcuuuucucuuauccuucuaauguuuaucagucuccuuugcugacucagccucugcucacuuuuuaaaguucccaacuucauuauuuuuguuuuacaaguucucauucacuuuaacugacauguuuaagaugauugaaauugcugccucuaauccuaaguccugcccugaacuacacacuuacaucuccgauuucuaaaaguugccaaaugguuaucucacauuuuugagacugaacuugguauuccuagaaacaaacacugccauuaucuuccaugccaaaacaucaacaagcauuaauugagcaauagccacaguauguuguaaacauacugugggaaaacaaugaccaguaacacagauacaacaccggucaggcaaggcagaugauuaagaaguaaacaaacaauaacuacagauuaugguaaguacugguugugcuaggggaugacaggagagacuacuuagauagguuuguaaggaaauaucccuaugaggaauuaacaccuaaacugagaccugaaaaauaaggauuuaucuauauggagaguagcggaaagagcauuuuuauguagagagaacagugagcauugaggcuacagguaaagucucugggauguucugaggaccuaaggucacaguagauaaugauuguaaguguaaacagagucagcuggauugauagaucauacagugucuucuagaccacagaaaggaguuuggguuuuauuuuaauugcaaugagaagccacugaaauguuuuaagcaggcugugucaaaaucugauuuccauuucuaaaauacuuucuggcaacuguguggugaauaguuggggacuggacaggagggaggaaggaauagggagacgugguuggaaacucaacaguauuuaaggucaaagauuauagcgguuugaacuauaggguggacuggagaugggauggaaauggacacguuaaagauacguuuugaagccuugaagcaggcaggccuuaucuuagggugaaaccuauagguaaguuugaguuuuccagagaaaugguuagcagguguaucaagcagaagaaacauuuacaagggguaagagacauagagaaaaugaaauaucucaggaccugaaagaaaaugugcccagaaucuaaaagggagaauggcaaagggugaagagggagaugcaggcaggagccagauaauacaggaccauguuaagggacuuagacucugucuaugucuggaguccuaaucugggcuauauuugggaauuacaugguuauaacaaggaauggacugucugggaguagaugagauuacucaggaaaaauauauagaaugaaaggagcauagauccuaaaaccaagaccuggggaacauuagcacuuaaaagcagugaucauggagacagaagaacuagaaaagcaaaacuuggaacaaaaagccaagggacaaaaguuucgcagguuuguggucagcauuucagauugauucuuuggaagguuaaauaagauaagauuugggaacuagccuguacugaugacugaugaacuugggugagaaugaguuugguucacuuaucgggggaaccagcacccaauauuucaacguagguucuuuucuauuuucccuaaguguuggcuggucugagaaauaaagggacagaguacaaaagagagaaguuuuaaagcugggugucggggggagacaucacaugucagcagguuccaugaugcccccugagccgcaaaaccagcaaguuuuuauuagcugagaucacaugcuuuaagggcaauaaaauaucacaaggcaaaugggggcagagugagaucacaggaccagggcaaaauuagaauugcugaugaaguuucauguuguacugggccggcauugucauugauaacaucuuaucaggagacaggguuugagagcagacaaccggucugacuaaaauuuacuaggcaggaauuuccuaauccuaauaagccugggggcgcuacaggagaccagggcuuauuucgucccuuaucuacaacuguauaagacacuccccgagcggccauuuuagagaccuccccccugagaaugcauucucuuucucagggcuguuccuugcugagaaaaagaauucagcaauauuucuucuauuugcuuuugcaagaagagaaauaugacucuguucugcccagcucccagacagucagaccuaaugaucaucucccuuguucccugaacacugcagccauccuguugcuuuugggugcccaaauuucauauuguucaaacacacaugcucuacaagcaauuuaugcagauaacacaaucaucacaggauccugaggcgacauacaugcucagcuuacgaagaugacgggauuaagagauuaaagacaggcauaggaaauuauaagaguauugauuggggaagugauaaauguccaugaaaucuucacaguuuauguucagagauugcaguaaagacaggcguaagaaauuauaaaaguauuaauuuggggaacugauaaauguccaugaaaucuucacgauuuauauucuucugucacagcuucagcaggucccuccauucagggucccuaacuucccgcaacauucacucauggguugaaaaccagauuagugaggguuaaguaaauugugugguaagaaaauugaaacagggcauauauagaugacuagcuggacuuugggaggacaagagugauggagugcugauuggaguuuuugguggaaucuuaagguuuuguuuuguuuuauuuuaauauguuagauaaauguuuauaugcuuccuggaagagauugaagauaaagagaggagaugggauggaauggcacccucucuggcacccucuccauugcucucaccuggugucucaaacuagaaacuucagaaacagcucuaauuucuuuuguaccaagccuuugccccacuuaacacauaguaaauaaaucuuauuuuuaccucagaaauauuauuugaauguaguuucucuucuccacgguaauguugcuuucauuacgucagcaucaucucuauagggauguugaaacaacuucuuccugcuucucuuccuuuaaaaaaggaaaaagaaaaaaaaaaaaaaccaguaagaugauauuacuguuuuacugaaagaucucugcugguuaaguccugguucuuuggcccuuugcaauauuaaccacuugucaucuuuccugccgcccauuugcuggcaccuccauccuacccccguacuacccuuuagcuguguuaaauuuucucugauuuauaaacauucuguccucuuggaaaaccuuuuugcuuuaauuaagguauuuucuuuagcugaauuccauucauucaccuuugccucucuggcaaauuccuguucaagaugagccuggaaguuaucuguuaugauaguauagagcaugccuuucuguauccacaauacucugcauucuucucuuauaacauuaguuuauuccuuuauuuuaguaauuaucuguuuguaugucucucuucaccugcacuaguggcuccuccagaccagagacugugucauccaggcauauauccuagaugauuggcauaauaucagauguucauuaaccugaacugguuuggcugaaugucugaauaguaacaauuaauggaauuuauagguucuuagcauuuuggaauugggauugauuauuuuaaugagaacacugaggcccaagcaggugaaaugaucuucacaggguuauccagauggucacuggguucuccuaacuucugacccagggccaucugaagaacuuccgcuagcugcuaucagucaaugcugguuggguaauauuuaaauuaagguaaagccaauauaaacacauguacugucuacaaugccauuuaauuuuucuuucuuuuuuuuuuuuuuuuuuuuuuuuuuuuugagaugaagucuagcucuguggcccaagcuggagugcaguggcacaaucucagcucagugcaagcuccgccugcuagguucacgccauucuucggccucagccucccgaguagcugggacuacaguugcccaccaccacaccuggcuaauuuuuuguauuuuuaguagagacgggguuucaucauguuagccaggauggucucgaucuccugaccucgugauccgcccgccucugccucccaaagugcugggauuacaggcgugagccacugugcccggccaaugccauguaaugauuagcuuauagaaugugacagaaaguuugaaaugauagaaugauaugguauuuaaagaguucuaaaaauuguuugaauuuaguagacuaucuaguccuccuuagaugaaaagucagauucagugucauuuuacuaaaguccauacuuuauccuccuagaggaguuccugggugcaaaauugugugaguauauguacucuuacgugcauuugggaguggggguggauagguucuauagauuuuuuuuucaaaagguuccuugauccacaccucaugauuugaagauauuuugcuguugugauaagugaucauucucaaagcaaaguacaugaaagauucuuuuagcugcuacuugaauuauauuuuuaaucuuuccuacuugcuuucauuuuuaggguuuguguuuagugaaucagagggaucugcauuagaacaguuugaagguggccccugugcuguuauugcaccuguucagguaacauagacuccuuuaccaacuccuuagagggacauuuugaaacguuucauacuugucguuuucuaaugucuguacuccauauaguaauuaugagacauaaucaauuaacucuuaacuuuugcucauguaaauuacaauaaauauccaaaauaaaaaugaauucaccauaucgaugaguugugcaauaguagccuuuugacaaucuuuauuuucaaggaaaaauaauaggcguucccugacuuucagaaaauuaggaaguuucuugacuucuuuaacacagagauccuauuaaguaauaacauguuauacacuagauagguacaaucacuguaauuguacuauuuucauuauuucagucuguaaaaguuacuuuccuaaagcugaaggugauuucauauuuuucuggcuuauaacuuuuucaaauuugaaaaaaguuggcagcuuauacuauuuuaugcuauagcuuuggcuuuucugaauaaaauucguaacaacugauuucaaacaauuucaaaaaccaaaaauguuuuuucuuugcacaaaacauaggauuuaucggaaugucuuuauuugauuuggaaucuugguauguuacauuguuugaauuucaaaggcugauucgcuauaaacuguuaaauuguuaaaaccaagaauugaauucucaguuuacuguaauacugaugaugucugugaaugacaguguuacuuuggaaguguuauaaaagaacuguuauaaaaauuacagcuaauuuauuguuuauguuuuaaccaucguguuuugaaaauauauauauuuaauguggcauuuauuauucauuggguauuaagaaugcauucuggccaggcacgguggcucgcaccuguaauccuaccacuuugggaggccaagguggguggaucacauggucaggagauggaggccauccuggcuaacauggugaaaccccgucucuacuaaaaauacaaaaaacuagccgggcgugguggugggcaccuguagucccagcuacuugggaggcugagacaggagaauggcgugaaccugggagguggauguugcagugagccgagauugcgccacuguacuccagccugggcgacagagcgagacuuugucucaaaaaaaaaaaaaaaaugcauuccuaaacuguuggcuacaaaguaaauuuguuucucagaacuuaugcucuauauagagcauaauaauacuuacauuauuaaaaauauauuucuguagaggaagaaaaauuaugguugauuccaaaauaucuuuuauagaucauuuauuuuuuuaaguugacuuuuuuuugcauuaggagaauuuuuuuaaaaugaggaaaaauuugaaugucugaaucuugccuuggaauuauggaaugugaagaaugagauuuaacuacaaauuaguaauuauagcuguuguacugaguaacugaaacaacuuuugguugcuaguaggaauguuaccucaauuugaagauuccuuguuauguccauauguaaauuagauuauauaaauacugccccucuuggucaguaauagcaagguuuuuguugcaagugcaugaauauaguuaaauggaggguauaccacaggaguuuccuguuuuauaaaguacaguauauuucaguagugguaguuauuuuugcaaguggguguuaugcaaugaugguuauauucaaaauccugaaccuacuuuucuauaccuuugagguaguaauuaaguuuaagaaucacggccaggcgugguggcucaugccuguaaucccagcacuuugggaggccgaggcagguagaucaccugaggucagguguuggagaccagccuggccaauguggugaaaccucgucucuacuaaaaauacaaaaauuagcuggguguaguggcaggcgccuguaaucccagcuacucgggaaacugaugcaggagaaucacuugaaaccagaagguggagguugcagugagccgagaucacgccacugcacucuagcucgggugaaagagugaaacucugucucaaaaaaaaaaaaaaaaaaaaaaaaaaaucacauaggccaggcacgguggcucacaccuguaagcccagcacuuugggaggcugagggaagaggauugccuaaggccaggaguucaaaaccaggcugggcaacagagugagaccccugcucuaaaaaaaaaaaaaaauugaaaaaauuagcuggacaugguagugcacaccuguaguccuagcuacucgggaggcuagaaggggagggucuuugagcucaggaguucagggcugcagugagcuaugaucaugccacugcccuccaaccugggcaauagagggagacccuguuucuaaaaaggaaaaaaaagagucacguaaacuuuguaaagaauuuuguuuguauuaauauuucaguguaagagucaaaacuaaguuauuaaggagaccagaagugagcaaguacauauauuaaaacuuuuuuagaguauaaaaauuagaucaugauacuguguaagaagaauaggcaaaauaauggaaccaaauacauaauacaaucauagaccucauuaccugucacaauuuaccaggaauuugucacaccaggaauaaagaaggaacuaagaucaguggugaaauaaaauaaacuuccauaaaucccaucaauaugacuuguuagcacuuugaagggaagauaaguuuagauaauuuuguaccauauaucaaauguauccuuggaauaauauuuaacaauaagaaacuuaauguaucaucaacacucuaagagaaacagagacuuccaaacuaagaaauauuugcaguaaauauuagcaauaaagggauauugucuuucuuauauaaauaacuuggagaaguuaauuagaaaaacacuaagauucaggggugaaaugggcauagaugugcagucauaacagguggaaugaugcuuuacagccaaauaaucaggaugcucacccucacuaggaagccaggaaaguaaaaauaaaacuguaacuagguucuauuucuuacuuuuugucaucuuuaaaaauaaaauuacaauugccagugcauguaagggugggaagaugcuggcacacucauauacugcuauauaguacaaauuuguggguaggaauuuuaaauuauaauuggaaccaugacagugcagauucugauguaauaguuguguuucugugaaucuuuucuaaagaaauauuuaauauggaaaaaguuguauuuaaaaaggagcuuauauguuaaaguagcaaaaaaauugcaagcaaccuaaugcacaauaauguaauuuaaauaauaaguaaacuuugauaaauagcuugauagacaaguagugauuaagaauuaugcuuacgaauucuguagaaaaacagaaaauacauucauauacccauuaugauuuuucacuuguaauaaaauuaaaacuagauauuaaaaaagaugggaaggaagcaugucaaaaugcuaacaguaguuauauuggcugugaaauaaugaauauccccaucucacuucucaaauguugugauguaguuauacuuuucuacuugaugguuguugcccuuuugcggaaaaaucagaagcgcuugauuagcauauuuguagacuuuaugccuauguaaauggaauaugacuuaguuuuuuguuguaacaccuugaauuguuuauuggugccagguacugugcuaagugcauuacauagauuuucucauauaaucuucgcugcaaacuuuuaaaguuuguacaguuauuuuuaguuaguaauaguggagccaggauucaaaccuaaguuugccugauaaaaagcagucuuccuaaucuguacacuaauacuuucaaacacaggugaggaaaagucgucauuguaaccuguuuuuucuuggaccugcccucuagagauucagagagaauagguggagcccaagaaacugcaauuuaaacaagucaggugacugggauauagcuaccguugaacuacacuuugagaaguagacacuucacugugcagcuuuuuaucaaauaaccaauguaacaucguugacucgcuuaaggggaaguuuagaaauccauuugucuuuucuucugaaucuuguaccuuuuugaguuaaacuugagcuccugauaauaaagugaugacucuaauaguguuaaucuugugucacagaugaagacuaagggaacagaaccacuuuuauauuuagauuucuuuuaccugaaggaaucuaaaugaaauguagacuuguucguguucuacagggcuuucacuuugugaauagagcaguaaguuugugugcuuuucaguuauucuguuaugugaguuaguucuucuacuugucagaaaauauguauuguggaagaagaagaauuuuaugaaucuagaaucaaguuuauagcaguauacucugaauaaauaacugcacaguuccugucaaaugugaggggaacccauuugacaucuuuacagaacuagucaaaagauuagaaagggaguacacauuauuuuuucccacuuuaaaauugaagaaugauaugauguaugguuauaaugcauuucacuaauuauugcuuuaauuguguaaaggcauuucuuuugaagaagcuccuguuuucuucggagaagucuucuuggcgggauuguucagguaugauagcugucuuuuaaaacuuuugcuuccuccucuguuuuaauagagaugaucuaaaauuaucugagaaagucaaguaucagugggaauuuuuuuuccugagguuuccuuuuaaaauguuuuagaaaguuucaugaacagugacuccauauuuccaaauuuggcuuucuaaccagggguuauaagacaugaugguauaacuaagggaaaaacguuuggccucuugguaaaacacggugcauuuccuagaacuguuagguggcagcaugccauaaagaacagucuuuuuuuuuuuuuuuuuuuuguagucuuauuuagcugugggcaagaccucagaauuaucauuauauuccugcauguuuuaguauaaugccuuacacaaugcaaauacugcaaauaauuuuggaugaaauugcaaaugaagcugucauagcuucuguaacaugagcuucuguacccagagagauguguggugccaccuuauaauaacaagaauuugcauuccacgugacaguuuacaaagaucuuuccuucacuuacacaauuuccugugaaccucacaguaaauucuggaagaaguuaggacacauuacaaucccaguuuuguaucuaaggauguaacagcuuacauuccaaaccaugacuauagaaucuacuaaugauuuugaauuuaagaguuaagggaucacuuccauaaguuuuaaauuaauaggugaaauacaaaacaaauuuuaguagagaagaaacuauuugagauacuauuuuugaaaugaacuuuuaauaaaauuuauacuauuucuuauacuauauucacuauauucacuuugauaaaacauuuguaaagcauugucauaagugucauaaauacuguggugauuagaaagugaacagcauaguuccugcaguuaaagaacuguuaauccauuaggagagacagaaaccuccuuguaucauaaaauuuuugaaaguuucagaaaguaauacuacuucuugagaguaauacugcuugaaaagaguguggcuaagguucauaaagagauggucugagcauuugcgccauuuucuauaaaauucuaaugcucaaaucuguauucuaaccacuggcuucugcugauguaauggacuuugguaacauaugugcugacggucucucaucucauuauucuuaucccuuugggacggggugaucauagacguuagauuaauucagaugugagggaaaaaaaauagagguuucaacaggccuuuacauugugcucaguucuucaguagaggaaaccucuuggcuuaaaugcugcaguugcuaaaguuuuaagaaagugaugaucagugucacauuaugaucuuucauaauguuuaguucugcauuuuucaguauucuuuuucuacuuggugguguuauuuggauggcuuuauuuaaaguggugauauuuuaauccacaaacacauuguuuuucuaagacauaauuuaaaaucuauuuagagauuuuucccccauuuuuaaaaugcuugauuuucaucauuaacccauucuuacuauuguuauucaugacagaauuuuuuuuuuuccagaggaaaccauuauaacuuaugcuuugguuauuuuuagaggaagagcagaaggaacuccuuugucauaccuugugugauauuuuagaaagugcuuguugugaccacucuggaucauacugcuugguuucaugguuaagaggaaagacaacugaggaaacugcuaguauuucugggaguccugcagagucuaguugccaaguggaacauucuuguaagauauauuuuuauuuccugaaguuuuuuucuuguuccuuuguuuuaaugaaucuauugaauauuuugaagaaaaaauuacuuaaaauuuucauaacauguauucuuuuccagcuuaagcuuaauuacugagccucacuauuuuuuauuuccauaucauuuauuuuaacuacuuagaagauacuacauuuuugcaaaaaaaaaugcaucucuuaaacuuuuaaaaauguucugguuaacuucugcuugauaauaaucucuuuugagcuuuagaacucuuauuuagaaauaaugauaugcuucaguuucagaugccuuaauguuuugcuuugguauugcaaaaacggauuuuuuuggacaucagaagauuucauaaaguuaucuuuacuugcuucccagagcaaagauggggacauuucuccucauugcaagcuguuucuuuucuuuccgaauuauuuggauauuuuuauacauauagauuauuuuaaggcaauuuuaauuaugccuuaaguuuuucauaccuugaagauaaguuaaauaauagcuguuuacguuaaauaauagcuauucucauuauucauaaaaauuauauauucugugguuuuuaacuuuugaaaauuguuauguaauugacccgaaagcugccagugugaaauggagacagcuagugguacggaagcuaguuaagaguugcuuuucugauuugcuuuucaggaauaaucuugcuaguugaugguuuuuuauaauugguagucccaagugcuuauguuaaauaagugacuuauucuacccacagagcaucacauuaacuaucaucuuuguggaaaguuuucguaaagagauuacguaccugaaaguacacuucaauuguaugggauacacauuuugcuuuccauauaguauuaucuauaaggugcuguugccucccuggacuaaaaugccucuguguugucagugucuuuuuucuccuaccucugcaguuaaaaugccuuaagccuggcaaauucuaauaguaguaacauuugcaaggaauaauuuugaacauuugaacagcuauaugaugcuuccuuuugaagccuuugaaauauggccuuucaaaaagaacuuaacauauuuuagaguuuauaaugacauuugaagacaacaaguggaaaacagucacaaggaugcuaguccaaagugucacuaagauugguuuuaacauauucuccagguuuuacuguguggguguuagcacacuuaauagguucauuuaggauauuaaaauuuugaaagaggaauuguugaucuuuugaaaagguauuuuaaagauuuugugcuuaaagccagucuguauauugaugugagaaaauaguaagaucuuuuuauauaacauuuuccauuaguaucuuaacaguauacugagugcauacuaugaaauaugcuaugcaguucuguggugauacgucacguugcuauagguuaaagggccuuauaaugcauucccuuugguacuucaguaacuaauuuagaugggcauauuauauugaauuacccuccagaaaacauuuuaguaauuuuuccaguuuacuuuguaucucauuuuaaaaguugccaugaaguaaaccauauuuuaaauuuuuuaaauaauguauacauuugaaauacuuuguuaacugaaaauuugagaauuuaccuuagugacaaaugaacuguauuuauauuacaauuuuuauuccguguaacaaucuauuuuaccuguucuuuccuuuauucccagcuuuguucuuuuucuuguguuuuauauuuuuucaccaucccugccugcuaagcuuuuuauuuugcuugccucuuuucucuaaauuauuaucuuuaugucuacucuuguaguauacccaguaaaacuauuuagauaaucuaauguugcagaacaagcaguauaauuuggaaaagauuagguagaauuuucauuuucugaaaguuuuaauguaaaguguuuuccccucuuguuaauauuacuuucucuacaaacauuaauuucauuggcuuaugugguguguauaguuuuggcuuguugguaaugcacaguuguucgcaguagugaauacucagguucaauuucaguuuguuucccacauaaaccaagaaauaacuuaauacauuuggacugcuaaagauuuuaaaacgaaauaugaaacacucacaacuaggcuuuggaaagcuagcauaaugugacauuuuaaauuguaaauaaaaaucuaaaauuuugacuucauaaugaaucaauuuucuuaacucaccagugagaauuuauauuugauaguaguaagauuugcuuuaugaaauauaugugaaguuauucauugugauaaauaacucccuggagccaagacuaucugugcucaagucucaucucugcuguuuaauccuauguacucuugagaggauuuuucugugugccucagguuccucuucuguaaaauggagcuaagaggguuuauaugaggauuaaaugagguaagacauguagggcauuuagaaaagggccuggcacuuaguaaagugcucaauaaacauuaccucugauuaaaaugcuuucuucuauuuccuuugauuaauaaacauaaucuaaauaaguuacugaaaacuuuuuaacaguuauacaaauaaaugaggaaacaaacuuaaagcugucauugaaccuguguaguuugaaaguguuaugccuuuuuauacauguuuguuuaauaauuaagccuuaaaccuaaagauuuuauauuauaaaaaggaagguuagcucugaugauauuacuuggauuuauauaaucugaaagauuauuuaaaagugcaggacacauuaugauaugugaggcacugauuaucaguaauuuuucauacuuuauaacugccguagcauagcugaacugaaauguuauuuaaucacccuucuauauucucaguauuauaucgauuuuaguuauauucauaauaaagauguugaaauauaaauucauguuauaaugaaguugaaaauaaacugagaauuuuaagggaguaaggaaauagggaaaguuuugauugcuugaaaguauuuacagccugcuguguguaucuugugucauuuauuugccauguguagugcugaaaagugucuuuuauguauagcugccuuggcugucgaagagcuuggcuuugagcgauuucaugcauuaauucaguaaguaacauuggaacauuuaaaauacuuacucuguggacacauugccacuuuaagucuguucauacuguggaaagguucuuaguuuuacauagaaaugcgcuacuuaaacauaaauuuuaaauccauugcuucaggauuaauuugccuuuaaauuaaaauaguuuguaaauguauaaacuaugcugaguccuuaauuaacuacccagauacgcuuuucaaaaacauuaaaaagcuuuuucaucauuacaaugaaaaaaaaucauuuuagcuuaauguuucugugaccuaaacaaauaugaagauuucuaguaggauaaauauuagaauuauuuauuugccaguaucuguuuucuauaccuuuuauuaagaauaccgauauuuuuguuagagcauuuaaacuuuuuauuacaaaguaaaagguaaagauggcuguugauagaauuauggguggcauuugguuuaaaauguaacauuaauuucuuuuaaaagaagccgcaaauguguaaguuaucuuuggcauuaagauauuuguuaaguaauuucuaggauuuaaaaagugaaguuuucuuuguguuuacccccucuuacaagaaggccacucuauucuuuaaauaacuguauauuauugaagaauuuacugaugccagacaguucaccuaagagaugaagagguucccugccaaguagguguucuuucuuaaugauaaauaucauauauagugauaguugucagaaauagcuuuugguuuuaguggcuaaauuuguaaugaaaaauuuagaaacgucccaaaacuuuccuguuuguauguauauguuuuaauguauaagaaaauuuaaaaauuuucccuuuuaugaauguaguuaaucucaucaugauaccaauacuuaauucuuuuuuucccccagaaaaagaucguucagaaguuuaccagaauuaaaagaugcugucuuggaccaguauucaauguggggaaauaaauuuggaguauugcuuuuucuguauucuguauuacugacaaagguguguucaagaagaugauuuuucugccuuugauuaauguuguucagugcuguuuuuccugcagugaugaguaauuuuauuccugaugguguuuuuaaauucuuagaauaaaaaucuuuuacguugaaaaugaguuaauuucuguuuccucagcacucacucguugcuuaagcaguuucaccucugcucuuuuggacuacagagauuaucaauaauguucugguugugaaaugcuguccuuucuuccaaauuguguuuccuuugauccuuccguguagcacuugaccccuuaaccccuucuggaagcuguuuuugaccuugauuccauuucuugauuuuuuuuuugaaaaaucacugugugaguuuucuuucuauaaugucucacgauucuuauuuuguuuuguuuucuuugauagcuuuguuuccuucuuuaucuguuaccuccugcucuuuucucuccuccucuaaauuuuuauaguccagaaauuuucuucccuggauccaguaugccuuuuauggauauuucauuugcucagguuaccuuuauauagcuauuuaauaguuccaauauguccccuucuaguccuacucuuuuuccccaaauaccagucucauagcucuaguaacguguuagucucaguugacuaugcuauuagaucuaucaugucugaaaucaaacuucuuuuauuugacaaauguuuuuugagcguugauugacucuaugcuagggacuaugucuguauuaauaauaugggaugcauuuuuaaugguaucuauuuagcauuguaaaaaaauggcacauuaauaauuccauuauggcaguguguuuuggcguuuggucuucugucugaaccuauuagauggaaucaagggcauacuguuucuaguagggaccaucugacagagauaggaccuugaugcaugagggcaaguuuucuauaugggaaagcuggaggacauuuuuuccagcagugggcacugcaaguauaaaaguguaagggauugaggguauaaugcagguuuggggagcucuaaguaguugagccuuacuguagcauaagacaccagagaggcaacuguggaagaugagacugggcacauauguaagaaaagacuuagaauaugaagaccuuucuauguacacuguacaaagaguagguuucaucugcucagaauuggaacacaguaaaaaguuugaacaagggagugacaagaucuuuuuguugauaaaagauaucuuaaauugggauaggaguugugauggauggaguugguguuuguaauauaagacuagagucaggaaaacuagaaaauuggguauugaaauaagagcagccuaaacuaggacaggucauggaauggaaaacaaaaggaguauauuuagaaauguaaauaaauaccuauuuggaauauuaaauguaaauaaauaagagaacccaaagugcuuaguuguguagauguucggaguagcugugauggugguaucuaagaugacugguuucuuauaagcucuucuugacuguucaguauucuccaacuuucuuaugcucaaaacguuugauaccuccucuguuucuucuucuuuacagccaauaaauuaucaugcaaguuguccuuccuugaccuggucuuuaaaaugguauccccuuccucaguagugauugugucacuuguugauaguauucaucuugacauuaucauagccugauuuguauuguuuaggaggauggcauaugcaagagcucaugcuucuuuguuucccccugcgggauuuagucauucuuuaaaaaucuugguuguuaauuaaucaucuauuuaauucuuagaaaugaccucuaauaugauagaaacaauggcuaaaguuaagugaauagaacaaugaauagcaguuuaucuuuguccuucuggaauugaugagguuacaauaaguaggucuucuuguacuuauccaguauguagaacuuuugggaguugagugcccuucugaagguuuaaaaaguaucaggaaauugguuuuuaagaaaagaaggcacuuccugcccuccuaauuugcauuuugucaguauacauuugaaugaccaacauuugugagaaaguacaaucagaaguaaaccuuccauuuuauguaccaguuaaauaauuaaaacgcaaauuauuuaauguuauaucucuaucgauauucauguguguauguauuuacugcaauaaguuuuuacaugaucuaaaaaaaucaguugccuuaacaggcucauauucauuuaacuuuuaaauaauucauuuaacuauuaaauaauuucuccuuucuccuauuaaaaguuaauucucucuccuugcccuuuuaaccaacgguacauauuucacccaugaguguuguuuauauagagcccaugaaagaaaauaaaagauauuugaggaacuauuuuuuaaaguuaucucaaaugcacccccauuucaaaucugaguuacuugugguagaaaaguuacuuaaauaauuguauuaguuuauaguguaaacuagucaguuuuuaaacagucauaauuuucauuuuaguuuuuuaaaauaagucaaugaauucuguuucuuuagggcauugaaaacauaaaaaacgaaauugaagaugcaagugaacccuugauagauccuguauauggacauggcagguaauuaacuaaaaucucuugucuccucaugugaacuccaguuuuuagaaacuugacuucagauaaaacaugacugagucaaguaauuuuguuugucaguaguguugacaguacaacauguauggauuugagcacuucuuuguauuaugcauuguuugcuugauguaugaaauguuaauuucauuuuauguaugcauuuauuggggcaaauauuuuguuuuaagauaacaguggggagguauuuuaacaaauccauuuguaauuuuuuuaaaugagaaaauuuauucauuuugacuuagaaauaaguauaucuuuguaagugcuucucugcuugggagaaaaacauuccccauuuuccucucggaccacccuccucaagcuuuuuauggcuauuuuuaccaaaacucaaugaaacagugauaguuaaccuacucuaauacgugaguccuucuuuuuagaccuuucugccugaaagaugaaaguucauguaucuuucaucaaagacaaaauauuaauaauuauauauucauuuuuaaagauuguaaauauuaaguaacuuauuagucugucauuuuuuauccauuuaaauauaucuuagauaaaguuguuaaauguaugugaauauguagaacaauaaauaccacugugcugauauauuuggugauacauuuagcaaggccgaauauauaaaauugaaaauguaagguuuucccuaacuuuguaaauucuuacauaauuuaaugugaaaagucauuacuuuauacuuugcuguaggaauuauuugauuuggcaacuauauucauauuuaauugcuuuuuaauauuuauuaauagccaaaguuuaauuaaucuccugcugacgggacaugcuguuucuaauguaugggauggugauagagagugcucaggaaugaguaaguauauuccuuguuauguugcucucuuugaugaauaauauuucauuggaauacagcugauuauuauucgucuauuuaauggcucuacauuaccuagagguuaaguguuuucuaauagaagaauccuuuacaguuuucaaggcaccauaauguuaagaccauuaaucuuggagccaggcaaucuuggguucaaaucccaaauguaugacuuuagugaaguuacuucucaggccuuucauuuucugugguauaaaacugggauuuaugacucuuaauauguauaaacacagugcauauuuauucagagauauuacugcacucuuugcuuaaaauggagcauuacaaagccugguggugugaaauacuuacuuuggguuuuugccuauauuacuuuuaaugugcguacuuuaaaacaccgagcaaauuuaauacugagacuuuuaaauuaccaacucuuccacuaccacuuccauuucuggucucaauuauuucuuuccuguggcuucguauguugucaggcacauugaaauggaucccauuuuggccaauccauuccguuaaggagagcugauacauaacugaauaaaauucccuucacuuuauuacugggucagucugaauucauuuauuuauucauuuaacuuacauuaaguaaccacagugugccucucugaaguacguagcauaggacacgaagcuccaggguucccagagcucacagucaaacagagcaaauauaauugagaaaauaauaguuaccacuuuuugcucccauugaagugauucaugaucuuccauuugaauuuuucucaaauucagaaauguguaguuaauuaacagaaacaugaaagggcauaauauuaaggaaaaaaucaguaaaauuaaaacuucagaauuaaaaagcaccacaguacaacccguuuuacuguuuaaaaaauuuaagaacuaaguucacuucuuauuuaauucauaugcaaaauuauuuacuuaguggugagguuagaaugagagccaaguuuuggugauuucuaguaaaggucagaguuuaaacagugaaauucgugaacaaaaaacuacaaauuaucuugcucagcucucuuuaauugagaucauccuauucuucaacccuuaaucugauucauagcugaaagcauuuaauccugucaaugaaaaaaaaaaucucauuucagugucucuuggguaauauacaggguuuuuuggucucucuguuucucugucaccugugauggcuucuguacacucccgucuuucuucuucuuccaguuguuucuggacccccagguaucuuaucucauaugauuagggaagcaauagguucuugcugaacuuggguugaggugccucaucccacuuggcccucuguccuugauacuucuuacugugugcucuggccugacccuucccacacugucuuuagcgcaucacucucucucacacuugguacucaucagugugguucaucuuucuacgcguucuccggauucucgauagcuuacccuaguccccaaaccagaauacucuucugccucccuaggcucuuccucacccaaccucucguagacugagaugagauaacuuucauuggcaggacuaacagucagaaugagguuucaagaauaggaggcuccauguccgggcacgguggcucaugccuguagucccagcacuuugggaggccgagguggauggaucaccugaggugaggaguucgagaccagccuggccaacacagugaaaccccgucucuacuagaaauacaaaaauuaaccagauguggugaugcaugccuguagucccagcuacucaggaagcugaggcaggagaauugcuugaacccgggaggcggagguugcagugagcugagaucaugccacggcacuccagccugagcaauagagcgagacuccaucucaaaaaaaaaaaaaaaaaaaagaaaaggaggcuccuuaggcagcucuugacgugaagucguuacuuccuguacagaauauauuagucaauuaucaguuucgguucuugagauguacacauaugucguuuuuguuccuugaaauagugcuuuucaaggcugucaucuugcuguggaccuuuuuucuguauaguuuaaaagccaaaacuaagcaauaacuuugaaauagcuaacuuggaaaagaaaauuggguauauuucuugcauuuuggaauguuuguuugaagcgaauguucagucaucaaacuuaaaaaugagaaaaauaccccauuuauauuucacugaaccuucuugguuuuuccuggauaacacauaguacacauuuucccucccacugccaggcugauuauugcuagaaaagaaaccucauuacaaguuucauugguugggcguacucuaaauuaauccuacuuaaacucauuuaaacucuuacugcugacugcacauuguaacccuuuuuucuacuccucauaacuccuuuaucuaccacugcuugaggcagugaauucaaaucccuucuccucuuuaucugucucuaacuuuaccucugcccacucacucucagcugacuuuagaaucucaaguugucuuuuuucagcauauucuuuuuuccuguuuuagaagaacuauauaucuuuccagaguuacuguugauuccauuuacggucucugcuauuaaaugugauucucuucccuggucuacacaaaauuuagguggcuucuacugccuaaaacaaaaaucgugauguguaacgaccaggccacaaaccucuuucucuccauccuuucaccagcagaauuuccuugcccgcaucgcuaaaauauuuacucucuaugaucugaaaucugugucauuuguucuucuaaagcaaagaccucacuaccugcgaaaaucguagccuuuuuccuaccccucauucucccugaagguggcacacugcauggcucauuuacuaacucuguaccacggacagaaaucuuuggauuaaaaucucaaucucagcuucuucucuaugaauggggcagauaucugccucucagguguacuguggaauuuaaagaagaugaacucccaugccaucucacauauguauuacagcacucaagacuaacauguaguguaagaggcaguguaucauuaaguauguuagcuguguggaauuagacuacugugguuggaaucucaguugcgccauuuauuaaacuguguggaauuaaacaagaugcuucacucagugccucuuucucauccuccaacgggaaugauuaucacaggauaguuagaaugaggugagaaaauggcaaaaaagagauauucaucaaguccuugagcacuguucaauacauguuugccacugcugcauaaugagcacucuuaucaacaacugguucucaaacuugucugcacaucacaauuaacugggagaaauuuaaaaucaucaguaguuguaacugcccuuuauagaaaauugaaacacuugagggcagacauugguuaugcagcuugccauaauguuuucugauguuacuuuauucaacaagcuuuauuugaaaaccugcuaguuauuuguaccuuacugucauguaucuaaugaguugcugagucuucgagauucuccauucucgaaauuugucucacagaggccaagugguaccgcaggacacugugccaugguggaacaagcagaggccucggguguggcgauggcaccaguuaguuuaugccucugcuguuugacggugggcaaacugcuaaauuaucugagccucgguuuucuuaccugugcauugagguuaaaaauacacauauucauauaugcugccuagcgcaagcacagaaaugcuagcugcucccuuuuuucuuccuuugccaagucuguuguggucucauuacucucaccugucuagacuaucaugcuauagcuuucugucugucauuccacuccaguauauucugcaaacugacaaguuaaugauuuuauuuuacacguccuguuagguuauuucucugcucagugccuucaaugacucucuugcuaaugcuugccaacuaaaguuucagcuucuuagcauucaagagccucuguguucguacucaacccuauguuuauaaucuuuuacuagucuccuucacaaauccagugcuuuaauccacugguucucaaacuuggcugcacaucacgauuaacuaggagaaauuuaaaaucauaugccaaggccacaccaccuagagauuguaauggaauuguugucagcuggaaucugggcauucauauauuuuuaagcaagugauauuguguagucaggguuaagaaccacuguucuauucagacggcucugccucccggucguuaaaaacaaugguacuuuccccaaaaugucauccugcucauuccaucuggccccauuaaaauguuaacucccauuuaaugucucuccacuuaaccccgacagcaggaaaaguuuucuccucccucugaucaucuauggugcuuuaccucagucggcuucauucuauuacaccucgcaucauaguucuuuguguacauguucuugcuucuguaaacgaggugccuaggcuuuugagggaaacugaauuuuuucugugggccaguguaggcauuuuggaaauaggaucuuaaucuuuacaacaacccuucaaggcaaguauuacuccauauguuaugaagaaggaaacugaagccuagagagguaaagcagcuuaccuaaggauuuucaacgaguaacuauuuaauuguaauuuuucuuucuauauugccugccuccuacuauguugucagagcaggaaacaaguccaguaaaugcugaaugaauguaugucucauguuaguaaacguauuuuuuuccuagucuguuuuuugccuugaguuuccuuaugguaaacaguuagauuguuuccauuuuuagcuauaagaaacugcuguaguaaacauguuuuguauauacgucuuuccuuauauaaguauaccuacagguuagauuucuaaaaguagaaaguguauuaaaauuuuaggcaucuguuaauuuuuuuuuuuuuuacuuauagcuuuauugagauacucacguaugcaugucacccauuuaaaauggacaauucaguauuuuaaauauuuucucagaguuguuuagccaucaccacaaucaauuuuaaaaaauuuugucaucuuaaaaagaaagccuguccuccuuauacuuccuuccacgccagcccuagcauccgcucaucuacuuucucucuauagauuuaccuguuugagauguuucauagaaauagacucauacgcuauccggucuuuggugacugauugauuucacuuaguauaauauuuucaaggugaccauguuuuagcauguaccaguacuucacuccucuuuauugaugaauaacauaccauugcacaaauauaccacauucauuuguucgccaacauguggaguguuuccacuuggccauuaugaguaaugcugugagguacauucauguacaaguuuuuaugagauguauauuuuaguguuucuuugccauagaccaaggaguugaaauccugggucauacgguaacucauaagguuuaacuucuugaggaacaucuguuaaauuuugauagauaaugccaaauguccuucuaaaauuugcuuuaucaacugguaaaaguauaaacuuauucuuugaaguguguaggagaguucguauuuuucugcauccugccugacacuuagaauuguccaucuuuaacauuuugucaguuuguugacaagugauaggcuguuuuaauucacauuucucuggugcucauugagccugagcuugaucaucucuucacguguuugugaguuuugaguauucuucuucugugaauuaccucuucccaucuuuuuggcuuuuggggaggaggaguuauuuucuuuuguucaguuucuaggagcucuuuauaaauucucuuaguucuuccucuguuugaccuguguugcaaauauugucacccagccuucucuuucuuguuaacuuuguuaaugauauauuuuuuuauauccaaggcuuuuauuuauuuauuuauuuauuuauuuauuuauugagacggagucucacucugucacccaggcuggagugcaguggcacgauccuggcucacugcaaccucugccuaacccggguucaagcaauucuccugccucagccucccgaguagcugggauuauagguauaugccaccaugcccagcuaauuuuguaucuuuaguagagacgggauuuuaccauguuagccaggcuggucucgaacucccaaccucaggugauccgucaaccucggccuuccaaagugcugagauuacaggcgugagcuaccgcgccuggcuggcuuucauauuuaugagguuaaaucauuuggucuuuuuuuuagauggcuucuauuugggcuuuuuuuuuuuuuuuuuuuuuuacuccuguuauaucaauuuuaugugucucccacccccagauuuuuuauuuucauuuuuuagagacggggucucgcucugucacccaggccauagugcaguagugcagucauagcucacugcagccucuaaaugggcuccagugguccucuugccucagucucucaaguagcugagacuacagacgugcaccaucaugcccggcuccaccccaagauaauauucucuaguauuuuccaaaaaugcuuuugugggcuuuuuguuuuuuaauguuuggcucuuuagucuaucuggauuuuguauuuaugaaugguaugaguuugggaucugccuuuugacuuuuucucaaagaauuaucuaauguccuaauuccagucaguucuccacagauaggaaauacguuuuuuguugaacacauuuuuccauauuuacauguuuuuauucuauuccacugaucuuuuugugacuucuuaugcaaaacuucacaauuacauaguuuuauaauauacuuugauauucauuagcauguuuccugauguuauacuuuuacaaaauugucauagucuuuucuacauuaucuauuccaguugaacuuuccucccagcucuucaaguuccaguuuuaagaaaucuuugaagauuuggauugguuacauuauauuuguagguuauuuugaggaaauuauaucuuuacauauuaucuucccaacuagauuguuuuguacauucuuuagugaaaaauauucaguguuuuauauagauuauaugguccugaauccauauacuugauucuaccccaguuuuugaaaccaucuuuugcuucuccaauagaacagaaauaagcugcaguagaacuaaucaaauuaaaugcauucuugcccacucuuucacaggggcuagugugauauuuuucaaacucagugagaucauguuucucucucccuuaaaaccauucgauggcuggcuucccuacgcacuuaaaauaaaauccaaacuccuucuaagguucucagauccuuuuguggucuuucuccucucuaccugccauccaucuucauuucguacuauuccauguauguugagcuaaaguuuucuuugauuuugauuuucuguagauuaauuuugucauggucucuuuuuuaucuuaaaggaauucuucaguauuuguacauuauuuuuguccauauuguuuauuuauuuuuguaugcuuauuugaugauuauuuuuauuuuauaauuuucuuuaugggauagggauagaagagucaacucuuguaauucagaaacccagaaguuucuugguuuuuuguggguuuuuguuuuguuuuuauaaaaagaaaucaguauuacagccagucaaaugcauagcuaauugaaagaugauggacucauacacagaauaaugcauauguuaauuagcucaguuuagccauucuacaguguauacauauuucaaaacauguuguacacgguaaauauauacaacuuuaauuugucaauuauaaaauaaacagaaacggauauuauaguuaggccaaaaaauagucauguuucucuggugcuugucugguuauauuccacuuaauauguggaacuccuaaaaaugcagucagaaacugaaugaguuuugaugguuuguuucauucucuuuuauauaagauaaucaguuaggcuggguguauuggcuugugccuuuuaaucucagcaguuugggaggccaaagcgggaggaucacuuaaggccaggaguuugaaaccaaccugggcaagaaggcaagacaccgucucugauaauaaaagauaguaaauuaauucuggcaaagaaaacaagaauauaaucacaaaguaauuugaauuuuuuugcaaauguagaguacaugcuugggaccagaagcauuuaagauuucgauuuuuuucagauuuggaaauauuugcauuuuuccucaccaguuuagcaucccuaaucugaaaaucugaaauccaaaaugcuguaaugaacauuuccuuugagagucauguuggcucucagaaugcuucagaucuuggaacauuucggauuucagauuuucagauuaggaauacuugaaaauagacacuuucaaggcuuauugagaaagucuccuacaaauaaauucuauaaaucguaacaugugagaauauuaaauccucacuguauuacaacuuggcauaaaaguaaauuuuccuagugugaugcucuugaaacuaucauaagaagguaaaaauguuaaguauauauucuguuuaagaaaacaggcauaauacauuuuuaaaauaauuaccauccagacuagaugucuaagcauguguuuacugaucaaaucuaaauaguucauuacccaagaauuaugaacaacuaguuugcuguauuuaguaacaugauauuauuauuagacauuuguuuaaaaguccagggaaauagaugauguaguaucuaauuguaacacuagguggugguaacugauuuuagaaauuaaauugugaaacuguuucccaauguauguauucuuuuuuacaugaaaacauuuaguguugcuuacauuuaagaaggaaagggagagaaaaguuugcgaagauaugaaguauccauuuauaccuauuugggcuguucuucuccucucccuuguuuugcuuuaaccugaagauucuaaaaccuuuuaaucucaugcccuuuacacucuuacggaugaucccaaagcaaauaaucaauguuuuucauguuaaagauugagaaauuuuuaaauacguauuaauucacuuuaaaauaacagguauaugaaaaaauguucaacaucacugaucaugagagaacuacaaaucaaaaccacaaugagaugucaucuuaccccagucagaauggcuguuaaaaaacaacaaaaguguggcgaagauagagaaaagagaacuccuauaugcuguuggugggaauauaaacuuguacagccacuauggaaaacaguauggagauuucucaaaaaacuaaaaauaggauuaccagauccagcaaucccacuacucaguaucuacccaaagacaaagaaaucaguauaucaaagggauaccugcacgugcaugcuaauugcagcaccauucacaguagcaaagcuagggaaucaaccuaaguguccaucaacaggucaauggauaaagaaacuggaauucuauaaacaauaacaaagaaugaaauccuguuauuugcaguauacgugaauggaacuggaggucauaaucuuaagugaaauaagccaggaagaaaaagacaaaaucacacgcucuuacuuauaugugggaucuaaacaaauuugaucacauggagguagagaguggaaugauagauaacagagacugggaagggucaguggcaggcggugggagaagcaugaggggaguggguuagaguacaaacauacuguaacauggaguaaauucaauauuugauagcagaguaagaucacuaugcuuaagaaaauugcauuguacuugagcaguggauacucuucauacccuggcuugaucauuauguaguauauguguuuaaagaaauuucacuuuuaccuccuaaauuuguagaaauaaaacauaauuuagaaaaaaacaaaauauacucauuaauauuaacauaaauaacauuuuuaauaaacuuaacaaaaauuaaggagagugacguuguuuuaaauuuuugcaaaucccuuuaaugcuuggcuuauuaguagacagccggaucuucauauaugcuuauaaauuuagucugauacaauauaacagaucaaccucuguaaaacucugugcuuaugagagaguaaguguaaaaagguaauuaacaucauauuaugaaaaucauguugaucucacguagucucuaagagggucuuguggucccugaggaauccuaaaccacaauugaagaaccauugcucuaccugaucugugccuguaagaagcuagugacaaaguauaaacuguauguauaugcaccuucuauuaauuuuggauuuaccaauccagaaaguuaaacugucagcucuugccuuacaccaucuagauguuguaguuaaggcuacacaguaaaauguuggccacaaaaauaacagaguuaauauucuuacuacauucauugauaagaaaauauauccuaauggaaaaauggacaaaacaugaccagaugguaaaaaggaugcaaaauuauauaugcauuauguuuacagugaacauaauuuuuacccagaaagaaaugcuuuuuagauauauuauggacccaaauauauuauuauauuaauguauguuagcugaaggguaucguuuaugaaaagacuuuauuauuaucacauuuuuauucccugcguugugucuguucugacuuacccacuuccauaacuuuaacucucaucucuaugcugaugauucccaaaucuuuaucuccaacccugacguuucucuccuguauuccugagccuuacuuccggcuauuuaucccucucuagcuagagcacguaaagguaccucaaucccagcuuagcuaaaaccaaacucauguuaccucuucacacgaguccagaacuuacuucuuaauucuuuguguuaaucacuauuuaucauguccccccagaccagaaacauuuaaggaaacuuugccaaauucuucauuccuuaaaugcaucgauuuuucauaccuguuuguuguuucuucugcuuugaauuuucuugucauccucuuuuuggccuggagaacuguaauacgcuucaagauucaacucccuguuaucacuuuuauaagccuucccuaacacuguaggcagauacucucauaccacuccguguguguguguguacagagagaccacauauguuuuuuucaucugucgucuuugguaaagucauagccuuucuaaggcagagaucauuuucuauucuucuuuauuuccccagucugaagcacacagccuguguuuauaggaaagagggauggcauuaaauguccauguuuuaaguauuaggcaaguggagucacugcuaccuaaugauaaauuuuaccagugauuagcauauccauuuguuuuucaaaaucaaagucaauucaaguuagcccuuuuacauagguauugagucucuuuuucuucuuguauuuuugucaacaauggcauggauuucagggaguaaauucucucauuuaaaaaguuaacauugaauaucaaguuuuauaaauacauuuaauauacaucuaaagcaucacauuuacccaccacaaaccugaucuaaugguauuuuauaaugagcaguacuguaaugauuacaugcuaaguuuuaaaguauaguuuuggguaaaaguuaaaaguuuugguguaguauaaauauauauacauauaaguacguuucaaauuuauacacacuacuacaaugcuaaguuuucguuuuuuguuguuguuguuguuuuuugcagaacuucuugguauacaugaacaagcagcaguaggauuuuuaacacuaauggaagcuuuaagauacuguaagguaaauugauuuuuaagguacuuugaauguuuuuuguuuagauguccacuauuguggauacuguuuuguuccucugacagcacauuugagcacagcacuaugguucaguaccgcucucuucuuccuuccuaucccccacccuaaaccagcaggguuauuaagugugguuaagccagcugauuaugcugaguuuccuaugcuaggucuguuguuauuuuugucggaggaggggcagaacccaguacaaaauaauucaaaaaagccacagacaucuauuauugaauaugaauuuauuuuuggcaaaaugaggaugaagaaagcacuguuucuuuauuaccuaacgaagaauaugcuucacuaaaacaacugguaauacuuuauuaggcaaagagaaagaauugccagaugccugaaauucugacuuuuaucuauuccaucugaaaaaugauuucacacugaaaaaaauuucaagcauuuuacaacauuaaacucuuugacacaugcacuaggguuaggaacugccauggaacucucauuuauugcuguuuauuucauucuccuccuacacaaucugaaacaaccugaaauggguauuguaaauaguuuuaaauggaauuuaaaccauuauugacuugcacuucguaagaugucaugauuugggagaaagaaguagaucuaguuuucuuuuucauuaaaaaaauuuuuuuaaauagagacagggucuugcuauguugcccaggcuggucucaaacucuugaccucaaguuauucuccuaccuuggcuuccaucccuaagugcugggauuacaggcaugagccuaaggcaccugaccuuccuuuucuauuuuagaacaggguuccauagcagggguucagauggugauaauuauauguaauaacgauaaucaugguugauccucuuuuucgucagacagcguuccuuuuucauguuucacuugaacacugggugauaugcauaugauaaucaaauuggauuuguccugcccuuacuccuuuaguagugaucauaugguuaaacaguauuuucagugacuuuuaucuucggugacuuuaauuguguaaacuaaagcuauucugaaacagccuggcaacuagagaaucaaaguguguccccuucccccuaacacauauacacacacauucguagauccuaaagaaaguuaagcauggaggcgggggguggggcaagugggaugugcacgcaugccugcgucuuguaugaggcuaggggguggagauuuuauauuuggaaauauuuccuguguaucccuuaagacccugguggucuuugcaguugcguugcuuucucuacugcugugcuccagccacacugguccucucacuuucccagacacgccgagcccucuccagugcuugcuguccucucugccuggaguuguccagcucuugagauggauggcucacuguccccuucaggcuggacugcagaucguaccucagagacuuuuuucuugaccacucccucagauauucuuuuccacaauauuuaauaggaauaauuaaugacacuuuuuguuuacuuuucuuuuuaaaucuugaauuugcuuuucuauugucuucccuaauggaauauagacucuggaaacugggacauugcuagguacauauuaagugccaggugcucagaaauauuuguugaaugaaugaauggacguauucaccagaauuguuugguuuucuagauguaggcuuuacuuugcuuuaauuuuuagguagaacagaagaacguuuuuccccucaagaucuuagugggaagucaaucgcugcuguguauucuucuguuuacauauugcuguaguguuuuagcaguuaacuaugguuuuaaaugagauuuaaggcuucugcuaauggcacaacaaaacacacuaacacuuggauaggugaaaggcaaaacucuguuccuuccaacugcaaaugagggagggaagccaggcagggccacaugcaggauugcaucuggggacugggguacagcaagcuggagccauuaggagcagcugauguaccugaaguaggauggggucagcuagauugccugagcuccccuguggauuggcuaauuuggauaacucuggggggcucuuggguuaucccuaguagucugucugguaccugacuccagggugauuagggugaucccuggagugugggagaccuauaaugguaguggcuggaauaagaacuuaauuagcuaucuuuugcaagggaaugacuggccucuagccagggccucaaaagugagucaagacagcauuuuuugaaaaacuauauuacgcuacaguguucaucucucucuaacuucucaaauucuguguauauuuuacauuuacuuucuaugagaugcuuggaggaauggcauuaaggaagucauugagcuuguguuaauuuuguaagucugaacauuuccccgugcuuugauaaguguagcagauuucccuuuaaagaugaaauuaacauuuugcaauaucauuuugauuauacaugcauuaauacaauuaaggugaugaaauaaucucuuucucccuccugcacucucccucucaacacacacguacaaacccaacaaagaauaagguggcuauggcuacuuuugacucuacuuuuuuaaaaaagauagauuuauaacucacauaccaggagauucaccauuuuaaagcauacaauucagggcuuuuuaauauauucacgaugcaaugcaaccauuaccccaaucuaauuccaaaauguuuuccuuacccacaaaaggagcucuaaacccauuagcagucccaugcuccucccacucagccccuggaaaccacuacucuuguuucugccucuguggauuuaccucuuuuguacauuucauaccaauggaaucauguaguauauagccuuucguuucuggcuccuuucacuuagcaugguguuuucauuguucaucucuguuuuuuacauguguuaguauuucauuccuuuuuaugagcaaauaauauucuuuuguauguuaaaccaauuuuaucuguucaucaguuggguuguuucuacuuuagcuguuaugacuagggcugcuguaaacauugauguacaaauuuuuuguguacauguuuuuauuucucuuuguauauacccaggagugaaauuacuggucauacaguaauucuauuuuuaacuuucugaggaagugucaaacuguuguccaaagugaugacacuuauuuaugcauucaauauauuuuuacuauuacaaaacauuucaugaguuuagcauucauuuauucuuugaucuuauccuuuguuuguuuguuuuuuuuuuuuacuucuaccuuaauuuaaauacacacuuuuucugaaagaaagguuaauaucuaaucucuucaccacacgaggcaccaugugaugugauggaaauccaucagaguagauagaagucagaaaacuuaaguccuaauucuagcucuguacuauuuaguugccugagaugagaccaggcacagauccuguguauuucucugguuccuuauguauaaauugaaggacuugcacagcucaccucuaaaauccucguccacucuggaacugugauuuuaucuuucccucuuucuuuguuccuuuucuuuuauucuucucugcuguucccaaaccauccuuccuacuuuacuggcucaacauugccacauuagcacaucuaacucaucccucccaucauaggacaaaaauacuaguuucucuguccauggauacaaaagaguaccuauuuuccacuucccuccuagugauaagaauaaauuccacagggccaggguggugguugaagcaggggcugcuggcugauuaggaaagaauuuuuggccugacugccacaaacagccacuuggaauuccccaauuauaggcagucuguaagaaaaaggaaaaugcagcaaauuguauugcuaagauucgucauuuuuaaguuaaaguuucugucuucauaugagaguggaauugaguggugugaacguguuggguuucauaagucuauucuguuuguuuaguauuaaacuuuuuuuuucucagucacacacacacaaucguguucucaaguuuuugguauaguaauguucacagauuauguaaccuugagagcagaguacaaauacagcuuuuuauacauuuuaaagagacuguucauacugugaaacuuugaaccuaccuucuaucaugaagagucaaauaacaggacacuuacauacuuaaaugguuuaaauuguaauuuuucuugauuauuugggagcaaagauguucuuucccuuugauuauucauaaaucuacucauuugauaaacuauaauuauuuuccuuauaaaguuauuaucgucaaguuuauaguuuuaggguuugagguuucaugcugaaauucuaagaaguggucauuuuaucuaggaacuuuagcaaaaccugagaaugacucuuagggcuaaauaguuaucuccagcuguguuaaaucuauauuguuguuguuuuaaugucaaagcacaauauaagcucaguacugacagucuucuaacacucauuuuuacauucagcauuugaucucuaugggugaagugcucgggcacaauacauuauuucaguuaaauacaaauuggacacuuuaugcuucagauauuuaugggcaaauaagaggcaguauaaauuuuuaauuuguuuauuuguuuuauuuugcuacauuuguucuagguugguucuuacuugaaaucuccaaaauucccuauuuggauuguuggcagugagacucaccucaccguauuuuuugccaagguaugcuuauagcaggauuuuuuuuuaaguuaugacaucaggcaaacaaguauuauaaguucauauuugguuuggaucuuugugcaaacuucagucuauucccacaacaaaugaauuguucaaaaaucucaaaaacuaauacugaagaacauacuguuuucgugcucuaaaucuggaaucuuuuaaucaaaaucuaucaugauuuaguuauaauuucuucuucuuucuuuagagcuuuagcuuuugauuuuuuucagaaaucacuuguguuauagagaaaacaauugaauuuuaaaguuuuagauugcuuuuuuuguaaguaggauaaaagauuuauuuaacuuagaugauacaugauauaaaauguuuuaauuacagcaucuccuuugaaaaaauuuuaaaaucuauuaauaauucaaugguauuaaagucaaaugcucuuuuaagauggaauacuucccacaauuuuaauauauaccugauuacaauauugaaauagcugaaauauaucugaauauuucuuuucuugucuuuuuuauuuuuuuucuuuuucauuuuuuuuuuuuuuuuuuuugagauggagucucacuguguugcccaggcuagaguguaaugucacagucucgccucacugcaaccuacgucuccuggguucaagcgauucucccacuucagccucccgaguagcugggacuacaggugcaugccaccacacccagcuaauuguguuuuuaguagagacaguuucgccauguuggccaggcuggucucaaacuccuaaccucaagugaucugcccaccucugccucccaaaguguugggaucacaggcgugagccacugugccccgccauaucugaauauuucuauuucaaaauucuuauaacaaagcuauuuuuaaaucucaacuauaaucuguauaucauguuuuuccacaauugagugguuaagagcuuuggccucagacgacuuugguuuuaaucccagccuugccacuucuuaacaucucucagcccccuuuccugugucuuuaaaauagggauucauaauaguaccuagcuuuuagaauuguugucaggcuuaaauacaaaguauuuagcagugccuaguacaaauuaaaugcugaguaaauuuuagcuguggucaucgucaucaucaucaucaucaucauuuuuaguauucaagaaacauacguuaaacaucucugggaucauagguaacuugauagguugcugaauguucguaggaagauacagaauuguauuuuagagguuucuucauugugaugugcuuuccugauuacuccuugagcuuuuugagcauguauagucaaugaaaguuuauuauuuguuucuguagaaaguacaagugguauaaauuauacucuagucugaauugacaaugcuaaguuucgugaauguaauuaugucuuacuguauuuacuuuuauuguguuggcaaaaguccagauagggguuauagagcaagauacauaauugccuuuucucaagcacggaaagcuuuaaaauuaaaugcuaaaaguacagaguuacugauacauugcauuuaguuugaaagcuuuugcuauuuauuuccuuccugaaguagagagaggaaguuaaaaagcacaaugugaacuacaaaaacugacaauuacuaauuccugagugaggauuucauuuuauaaauuaccauaaaagaaaauuaauucugacuuacacacaaaaauguauuuucaaaccaauuuuuaaucauguuugucugcaaccuuauucuuuaaggaaaacuaauuauaugaaacuaaaaguguugaauauaaaagaugacaauauuuuaaaucuuaaauuuuauaauugauguuuaagaaaugauuuuguugucagaacaguaggagagauuucacagaagguauaauacaaggaacagugucgaaugagcugugagucugaggacauuaucugaaaaaguuagugauguugagggaguucccaagagugaaauaggcccuucuuuuuaugaguacacucuuccuaccuguccugauacuuuugugguucccauagcacucgcccauugugcugucgcaugugucaaacagcacacaguuucuaauucccauacuguuuucugcgugucccauggcagccagugaacuuugucuagggcaggggcugucucucgcccaccuuuuuauucauagaucccugucaugugcaauaacguguugaauuagagacauggaguuaagagaaaaacacaaaaacuccugccauguggguguagaacucuugaauuuuauacuaauuguuacuguuuugagacuuaccuguguagucucaggaucuaguauauagucuggcacacuagggguggggggaauuauuaguugaaugaauaaaacuuuuguacaaauuucccgcauuuggguuccagugacguuuauauccccuaagaauauuuuacacgacucauugugaugcuucauuguguaguaucuauagauacuuucuuagaguagucaaauuuggauuguuugagauguuaccuuuaagaggaguucccagugaagaguuguuuuuuccccuugaaauaaaaguaaaacaaagcuggaaguucaccuaaaugguaaauaagaacaauaauacuugaucacauuuauugaguccuguuuuagauuuguuaaauauaaacugauguucauauagucuucaccacauaaaaaauacuggaaauuucgcucuucuuaaaauuauaacaagaaucauuauucggccauuccuucuuuaacauuucugcauuugagcaagcaguuuuggcuguggguuuuucuuuuuucuuuuucuuuuuuuuuuuuuuuugaguuuuggugaguuugcuuuauuauacauucaguggccugaaacaacauuguuuuaauuuuuccccagcaguuccuuguaaauauuuaugucuuuuuuuauaaaacugauauguuuguugguguauuucaugugcugacuucuuuguucugguuacaauuaaguaaaaaaguauauuuuauuugcauaauuuuuaaggcagucuguaauuuggcguugugaaaugccugugaagaacaguggaauucuuugugugccuuaugcggugaaggugguaauaguugcagguuucuucauucauucauauacucauuuaugagcuuuuuacuggauuauaguaugugccuggcauuaugccagguguugugaauacaguggugagcaaaaauagauaugggucuguucuuaauggaggcggacauucuccuugaguuacucaaggauauauaaauaaucacauaaauuuacaagugugaugagugcugacaaagcacagguccauaaugcuguaagaauuuauuguaguuuuggaaaauugggauguuuacuuaaaaaauugaugccuaaaaugagaaccugagguaucagauuaaaccagaggaagagaggggaaagagcauucucuacaugacaaauagagcaaauucaugccugaagaaagaaggacagacagacagaugaacuugggugagaacaaacugaaagacaagggcuggagggagcacugagaauuagggggacaagguguaagaugaagcuggaagaauagcaggccauguuacucuuugauacuaagaguuaggacaacuagacuuguuaaaaauugguagugggaguaguuuugggggaggugggaaggaagggaacaggauuaaauucacauuuguaaaagauaacucuagcuaauuguggagaauggauauauugaaggauaacccagggaauagguaaaaaagacuucucuaguucuauuucagguaagcaaagaguacaauuugguccagaguagugagguagagaggaaaaaagugcauggauuucagagauuuacuccugagguagaaugacaggacugggugauggauuggauuggcagcggagggguagaaaugucuaauaagauagguguggcuaaugauuagaucuuagagcuuuagaaaauguguacuuagcagcuuugcuguuguugaauguaacugcuuguuauuaaagcaauuuguucacuguaugcacaucacguaauaagugggauuggggaaauaagagguaccucucagacaggcauguggagagcuaugcuguagcuucucugacaugacuuucuucuuguauuucccuccaaagagcagugaugggagacaaucuguuauguagacugaugcaccacguagaaacugcuuaguuuuuaaauuuaaauuuagcacuagugagagcugucagaauccuuugacccacaucuauucuuuaugccaaaggaaccaguccauagaggaauuaaaaacuuuucuaauauugcauggguaggaaggcagaaaugugauagcuaagauagaguaaaauaucagaagcuguauugaauuuaaccuucuguaugggguaaaaagauaauguguuaagugaauuaauaaaguaaaagauguugugaguaauauuuaacacaugaauaauugagaagggauaauuauacuauuucccagaaauuauagaacauugaaauuuauagaauaaaucaagaauuggccgggcgcaggggcucaugccuguaauccuaacacuuugggaggccgaggcaggugaaucacgugaggucaggaguucgagaccagccuggccaacauggcaaaacccaucucuacuaagaauacaaaaauuacccaggcguggugcugggcaccuguaaucccagcuacucaggaggcugaggcaggagaaucacuugaacccaggggacggagguugcagugagcugagauugugccacuucacuccaaccugggugaaggagcaagacuccaucucaaaaaaaauaaaaauaauaaaaaaauuuaaaaaaugaaaaauuaagcauuauugcaaauguacauggaaaacugaauuaagcaucuaauuagaaaguuuuauucugaaguuuuagguuauaaauacuaguuuuauauguucuguacacauguaauuaaauuuuuguaggaaugaaagcuucauguauuagacccuaguaauaaggagaaagugcacauauguuauuuuuuuuccugaagcaaauuaguggcuuugggcaaaaauuaugaguaauguuaacuauauuauagguaagaugaagcacaaauugacauuuucuuaaauaguagcaguuuugaguucuauucauuuuucaugauuuaaaaguauuguuaaucagugacauucaaauacauauaccacugcuuuaaauacauugcaguuuuggaauaauuuguguuuguguuguguuagaagugaauaucacuuccaaaauuuucagaaauauuaaucuauacauagucucaugacuagcacugaaaauacugugauggcaagugguugauggcuuuggcuccuuuuucuaaauuuuguaaguaaauuuuucaaaaaauauauuuugguauauuuauauacaggaugaacuaaggucucagcgauuaaauaugaugaaaguaguauaguauauuggcuaaguuuuaaaauuauagcauuuuucuuucucagaaaaaaaaucuuugacauuucaacuucgguuuuauugugaauuauguuuauuuaaauuugacuugauuuucuuauugaguuguuuuuucuuuucuucucuacccuuauuccuaaccugcuuuccuuuagaagucgaagcuuguggcccguguucauuugcauuaucaaaauaauuggcagaguuugaaaacugaauuuuuccacaucuuugccaauacuggaucauuaaaauuauuauuauaaucauccuaguggguguuaagugguaauuguaauuuugauuugcauuucccuaaugacuaaugagcaucuuuuuaugugauuguuguccacuucuagacguucuuuggauaaacgucuguucagguccuucgccuguuuuuuaauuggguuguuugucuuuuuguuauugaguuauaagaguuuuuuaauauauucuggguacuagauucguccuguauauuuacuuguuuucuauauuaucugucucucucuguaguaagcucugugauggcaggauuuuuguguuuugucaccuacuguuugccagguccuagagcagugccaggcauaguguaggugcucaaugacuuuuuguugaccaaauacauuauagaacacacuguagauccaucuuaaaaaaauugugagaugaccauguuauuacuugauaaguugggggucgggaggugugcuuaagauggcugaauagucuuggaucaucagaauucaauagaucucuaucuuacauggagggcaaauagaaaaacuagcuuuugcuauccuaccugaccaauucaaaccacccguauuauugaauagaaacagcugucaugaguauuuacaaauaagcuuugugaaacuaccuauaugcuguaacauguucaaaauuuacuuucaugauuugaggaugguuaagaaaauugcuucuguccagugaaauaaccucuuaacuaucuguuuuuguuuuugaaaugaacaauuuacuuuuaggacuuaaaguaauuaaauauaauuuuuuuaaagggcacuaguauagguucaugauuuuaauuuucagugccaaaguauuuacuuaaugaacuuaucacuuuauauuugauauauccagugacccagaauuuaccuuuuuaauuguacuggugcccucuuccugaccuauaaucauccaacacauuuuguaggauuaaaagagauuuuucacaagucaguuuuacuugagaaucaucauuaaaaauaaauuuaauaauuuuaugaagagguuguaaaaauguucagguugaucauuuauaacauuucuuucaugaagaaauauaauuuuaaguuuuuaaauuuaaaccaccauguuuuauaaaucauauuuucugucugauauagaaagagucaucuuuuccuacuaacccucugucucugucaaacaacaaaacuguuauuguacuccuugacauaguauccuaaggagucugguugugagaaaugcaucuaagccacccuauguaaaugagauuuuuguaguuacuacugagggagaauaucacagaaucuaacuucaggaaccuuauaggaacugcagagucaucaagcagcaggguucccacagaacuucuaauaagaggauacgggugaggugaaaugcaguacguaaauggaccucuucaaagagggaaacuuaauuccuauuaaguacgauggagaacuuuccaagcaggucaucugagcuguggcagaacaaaggucuguacauggagacagaaugugcccuguaggcaugggucuucagaaaucguaucauggcacuuucauugagguuacuugaaaacaugcgaaccuacugcacagguaaaaagaaauguauuuugaaaaguagacgcuuaaggaauacagaacuuaaacuuuuugaauuguuuuuccuuaauuucagaagaaaaaacuagcucuuauuagaugaaggcuguguaacauuuguuuuguaauaugucaaauauguuaggagucaggucuuucauaauaauccauaauuauuuaaguguucaaacauuagggcauuuguccucuauuuucucccuaaccaucguuuuccucauugauucuucaucuuuuauuuuuauacuuggguuuuaagaauaauuuauuugggucacuuucuuaauuucccucgaauugggaacuaauuaggaaauuaauuuucaaugcaaauucaaaaugggcacuuuaaaucugaaaaucuacuuuaaauauuacuagaauuuagaauguauaaaauggaagacauaauaaaugccuuuuuuguuuuuacugugcauuugaaucucaauguggagugacagcuguugauccaguauaaaaauaguuggacccugccuauagcaucuaguuucaucuucagaagaucaguggcuaauuugcuugguacuccauuuaaacucuucauugaaguuggggagaugaguuuuacaucacuuuuuuguucucuuuuaugguuauaaaggggcucuaugugugugcggaaccucaccuuugaccuuuccuuugauaaaagcaguuuucuugucaggcaugaacacgugaauauccaugacagaacuguucauauaaagaaacugaauuuaaugcuaaggaggaaaaaauuauuuaacuguugcugugugagcugacauuguucuuccagugggaucuguuacugggaauguagggagaauuauuucuacagcacaagcugcuuuuauuacuccuugguguaacaggaaaaacacugcggugaacuguuagagccuuucucucuuagguguuuaaaaacuggacaguucuacaucgacauuucucugcauguaauaaaacgguguuaaggaaaagcuguaaaguggugcuuuauacguuuacucuuccaagaaaauucacaguuggcauuuuguguuuuauugcaguuuaguuaccucauccuuuuaucuuaaguaaauucuggaguuugugcauauauugagauuucgugccucaucuaauacagaaaggaaauagggaaaaugcuaauuauuuguucuuguaguuuaaucauaacuucugugacuuuuaagaccuuaaaauaacaacuuaaaggauccugaaguuaaucucuuaucugaacuacuuggaaagucuggguagacaucuggacagcuuaauuauucucagugauuugaauuauuacaaguauguaaauuuuuaaucacaaacucuuuccuaccugcuuagcacaauuuggggcugucccccaucagccaucuaggauuaugccaaugacuuguaccacaauaauacuaaagcuuuucauuuuuaauuauuuugaccagaaaucuuucaaaauauaaauguucuugccuccuuaagccaagugaacaucaguuacccuuauguacucuuugccuuaugcagcuguauuuguauauucugguuuuugugauuucccugaauuuucuuuuucuuuuacuuauuacuucucagucaucagugaugucagccuuccuggaagaagucucucuuuuccacugaauuuuucuuuuucucuuacaauaguauccaaauaauugucuaaagauaaaauacugauggaagggccuagaaguauucuguuaggaaugaagccuaugaguuuuaauuaagagucaguaucauuaagcccacaccccuagcuaucuguucagaauugauagaaaaaaaucauagccaguagaguugauagcagaguacaaaaaaaggucuuguaugguuaauagaugaccgccacuaagucuuacuaaguuuaauuugggggauuauuguguguguuugcacaugcuuugcuuauguuauccucugcccagaauacgcuuaucaaagucuugcucagcauuccugguccaaccuuccaccauucguauuguguccgcugauucuccuacucucuuguugcuccuguucuuucuuccaacuuccuuccuucuuguggcacuaacugauuucccacacuaccuacugucacacacauucaguauugugguaaguacuguuggaacguaaggauuaauaauacaugguaauaguuuacugugaguguuuacugaauguugucuguauguuaggcaguaugcuaauuaaucaucucaggagcauuccucauuuaauccucaaaccaacccugugagcugcgugccguuuucaucugcauguuacagucuggggccagugagaaaaaugacaucuccaaaguuagauacuagugaguaccaaggcaggauuuaaacuccagucuucugacuucugagcuaugcauuuaacuacuucccucccuuaagaaaacaacucauucugcuagaguagaguagacccuggaagagggaagaaguagguguagaaaagauuauacuugaaugaaaggacaugguaacuuugagacugauaugaagugaaagcuguauagauguaguguuauaaugggaaaguuaauacuguguuuggggaauaguaauugguagaugauagcuaaaccauacuaguugugcuaggauauuaagaugaaaccaaagguugacgaucagcuguaggaccagcuugaauaaucacauuuauuuacaaauuguccuuacuauaugaaagucugucuugauauggaaagcuaaacaggaauauccguggcaugaauguaaagcaaauucauggaaguagagcagccuucugaaucaacagucaaagcuucucugcacagcugugauaaaauuuuaaauuauaaaugugaguacugugacuaauuuguaaucaugcaaaccuuguuuaaaauuguagaaaacgagguaggauugguugggggcccucacuuuuuguucauacuaauccaagccucccaagauuaaauuauugguauugaguagacacaguuucaguaaucuucuuaagcauuaauuuucauaggaaacaugaagucugcguauguggagauuccuccaugugcagcuuacauuguuaaggucagaguuacuggauagcaugagggaagacacaagaggaaaauauagacugcucucaauaggaagaucaaauagaguacauguggcacaagcaacauacagccccagccagaauauuagguuuuaauccccuuugccagcuugcugcaguaaccaacaacccugacauuucaguccuguacacagugguacucaagaagggggcgaugagaacagcccauccuguggguaggaggagugugugacuacugacauuguucagauuugucugcacguggugauggcaaaaaggaauuugagaauguuuuaacgucucuaaaagcaauguacccucuuuuuggcuguacuggagcacaccacagccaccauaccucucuccccaacacacccagcccaaagcuuaccgcccucauaacuuacauguuggcugcaggugugcuccacgugucucuuuuauuuuaagaucugggcugaaggaguagcuucugccuggaaugugcaguucucauaagagagggaaaagaacaagacuucuggccaaaccagauaguggcacuuaaaguuucugcuaggagcuagcauaaugucacucccaguuguauuucucuggcugaaucugaugucaaugaggcaaggaaguaggcccauuucagagaaaaguacuucaggucacuuagcaacagacagugacaaauaauccucuuagaaggaggaagcagcaacuaauugggaacaauaauauuaucuaccaccaucgauuaccuuguaucacuaggugauugaacaguuuaauuccagugauacaaagaguccuaacuuugaaauaaagaggaacuuuauuuuuucagguaccucuaucuguauuaccaguauaacuauucucuguucaccagaaaccuuuuaaaauguaacauuaacuauccuucuaaacaccuacugaauuauaaggccuguguacagugaguuggcuggggauaaguaauucauuacugaaaaggucuuuaaaguuuauucuuuaagccuuucaucauuaugaagagcaaucugcugucaugaauaaucaaagaaccuccaagaacgucgucuaacuucaagaaaagcuugacggauuuguuaaaguuaguuggucgauuacgauaauuuggagagucagcagcucacucauuaaugauuuuaauaauuauggcacaagaguagaugacaucuguuggaaacuucuucucccacugcguuauuuccacuugugcauuuagagucuguguuucuagaggaagaacgucagagggcugucugcuguguuuccuacccugauuucucugcccauacgacacagauuggugccucacagcagugggcuacuguggaggugaccugggcuuuacacguuauuuggaaaauaauggaagaauaagagaaaagaccaccauccuuccugcuuucagguauugggauuaacugaauucuguuaaucuugcugccacuaaugacguucuguguuuugagaugauguaauugacuuaaaaucuauuucccaaauuauuuguucauaaauacagauaguaagcaaagacuaaaggugaaacauuauaaaguaaaauuuugcuuaaagguaaauuauacagcauuuaccuuuuauuuauuuauuggagggacuuuaaacacuauaauauguugucugcaagcuaaaaugucauuuauauaugugcagucauucuugaaguuagaugacgaugcucuuggagguucuuugaugaaucgugacagcagauugcucuucauaacgaugaaaggcuuaaugagaaaaacuuuaaagaccuuuucaguaaugaauuacuuauccccagccaacccacuguacacaggccuuauauuucaguagguguuuagaaggauggcuaauguuacaacauuuuaaaagguuuauggugaauagugaauaguuacacugauaauacagagcuacgugaaaaggagauaucuguuucaugauuguaggcuauuagauagucccauuaacagcuugguccaccuacuuccaucccccgcccccccgccaacccucugcauuuaagcugagugaggcuagauaauuuuaaaagcuauauuguuuugcaaucccuguugaccaguaaauugguugaauauaaauuccucugauaaaaucaugugauuauaucagacuaauguaaagaacugcuuuuacaauaaaaauaauuuugaugguaaaucagagcuuaaauugcuaacuaaaacaguauguaaucguugagucucauguguaggaucucuuccuacugaggguaccuaaaagaguuccaaaugcaguacauguugaaauuuucuccuaaguauuacaacuagggaugaagaaaagaaaaugcaaguguauuugcugaccuuggaaucccuuuacuuaauuaucauucgugggguuuuuuguguguguggugggggaguguaggauuaguguacauuuguuagaacuucaucuuggaagauaauuuucuuaggauaaauuuaauaagauucuuggaaguaaagauagaguagcauguuuuucucuguucuauuagacugcgaccuuaagugcacagacuggguuuuucucuaccaucuauuaagccugccaaauguuuaagaaauuaugguuuuauguauaguuagauagagaaaauauacuacauauggaaccuaaaagcuguugcuauauuaaauuuuggaaauggaaaaucugaggguagaauccuccucuucacauuuauaaagucauuacauuccuucuaacuaaaccauuuuauguacaauaagaaaaauacggcaguuauaccucugaaguguuuugucuugauuguaaaacucucucaauugaauguaauucuauacuugcucuucaaacuugcuaugcaaauaugcaguauauugauauauuaauauuaaguuugcuacauggauuagucuacagaucuuuauacuaggaacccuguuugcaaguguuuaaguuaaauaaaucggcaaaaauuaguguuuauaauuugaauuaaaauuacagaguuaaaagaacugcaacaugaaacacuuuaaugggaauagaaggugguuucauaacuuucugauuacaucucugaacauuuaaacauuacauaaauuuaaacaagguuuaaauaaaagaucauuuucuacagugauccaaaaagcauuguaaacagucaaaauaagcaagccaguaaucacuuuagaagacuauguacugguuuugauuuguggaagaaaacuucuggaauguuuccauuugaauuuacaauaaucucuuggguuuuuucucuuuuuauucucuuuuuucauccucuaguguaaacacaucuuuuuuaaguggugugauuaagaguuauugccuaaagaguugaccaaauuagcuguuaguaguauaugacugagaccaaaagagcaaaacaugauuuuuuuuuuuuuauuguucaagacacaguuuguuguauuaguaaugacaguuacaguuggugguuuuguuauuuggagccuaaccaguaucacuggguuguauguugggaggaaagaaagaguuucuguuuaaauagcuaacaaauggguuuguuaucauuuccccacauacaggguuuugaguuacuuguuuuacacuuaacuucagccaauaaguugccuuaauuccugauaugauuuggcuuugucccuacccagaucucaucucgcauaguaaggagggaccuggugggaggcgauugagucaugggggcuguuucccccaugcuguucuucugauagugaguucucaggagaucugguuguuugauauaugucuggugcuuccccugcaugcucucuccccugcugccuugugaagaaggugcuugcuucuccuucgcugucuggcaugauuauaaguuuccugaagccuccccagcuauguagaucuaugagucaguuaaaccuuuuauuuauaaauuaccccaccucagguaguaucuuuauagcagugugaaaacagacuaaugcaguucguuuuugaaaacauaauugacccuugaguaacaugggaguuggggugcuaacccccugcauagucaaaaauccacauacaacuuuugacucccucaaaaauuuaacuacuaguagccaguuguuggcuggaagccuuaccguaaccaacaguagauuaacacauauuuuguauuuuauauguauuauauacuguaaucucguaagccggagaaaagaauauguuaaaauuauaaugaaugucaguuuguauucuggcccugcuucuucuacgucaucuuccucauuguccagcacugguucagaagcacucaucucuaucaagccaucuucuguuauuucuucugaugugguaucuguuagcucuugaauuucuccaagaucuuuaucuugaaacccuuuacucugauuggcucuguaaauccuaugaacucaugcacaauaucuggacacaguguucucuagcaggaauauguuuugggccagauggauuagcuuuuucuguaacagugauggccucuucaguacuguaauccuaccagacuuccauguuguucuugcuguugcgguucucuuuaauagcaauaaccauaucaucuuuucugcagacuacuguguguaaugagccucaaggguccuuaugaccuccuaaucuagaggcuguauuagugauguuguguuugagggcaguuaacuacuuuggugccuuugguggugagcucaugggauucuggguggccagggacauuguccaauaucaaaagaacuuuaaaagguggucucuuacuggcaggguacuagguaacuucagguacacagcauugauagaacugauccagagaaagcauucucuuccaggccuucuuucuuauacagccaaaagauuggcagcugguguuaucuuuucccuucaaagcuuggguuuagcaguuuuauaaauaagggcaguccuggucaucacccugacugcaugugcauaaaacaguagccuuuuccuuucugucuuaaauccuagugcuuccuucucuuccuuacuuauaaauguccuuuauggcauuucccccccaugccggaauaggacaccuuuguccacauuaaaaaccuguucaggcagauauucuuucuucucaaagauuuucuuaaugguuucugagaacuuaacugcugccucuuuguuagcagaagcugcuucuccuguuaccuugauauuuuuaaagccaaaccaguuucuaaaauuaucaaaccauccuuugcuggcauuaaguucuccaccuuuagcuccuuuacuuuuguuuugcuuuagcuuguauaaugacugcacuuuuucuuaaaucauauuagaaucuaaaggugugccuuuccuauagcaacccugcacuuacauacaaguugcauuuuuuguacaaggagguauuuugcaaaaagcggaagguuuguauggcugcagcaauggcuucaggaauuuccuuuucuuucuuuacgauauuuaugcuggauucauuuaucuugacauagugagcaaccacagcagcagaccucaauccauggugcauaucaagcaauuccacuuuuucuuacguccugacuuugguuucuugggagaacuuccggcaucacuaguggcacuucauauggguuccaugguuuuuuuucaagaguuacaguauugcacuaaacaugaugaaaaguaugugagaacugcuuaagaucacuuuuuacugugauguggaacucacuggagugaugggcugcacaugcggagaugauuagcgccauacuugugcucugagcagauacaacacaagcucaccacaauagcaucaggagauggugaugaaauuauuccaguaguacaguaugcacuaaaguuaauuuuaugcuguugugaucugauacugcaucuuuacauucguuuacaucucuugacugugaguggugccagguacaguccguaugccccuguuuugauacauuuuaacuuuuuauaauagauuuguggcauuucaugguaguagaaaaaauagacuaguaucuacauauauuuuaugcaugcauggcauacuuaauuuuuucuuaacuuuugaaaauaucucuaggcugcacaguuugcgaguuuuucaaauugucacaaauuuccaagaaaaauuucuuccaagaaaaauuuccaauauauuuauugagaaaaaauucacauauaaguggacccaugcaguucauauccauguuguuugaggaucaacuguacucgcuucuuaguucuuugaaggaaucugcuuccauaaguuuucaauauuuucccuugcaaguuccccagccguaaccucagucuaacacuaauauucuauuucuaauagcucacgagaagcucgcaguuagcuaacagugaguguucguagugugccaaguauuaagauaacuccauguauucuacuuggauguuuaaccauuaccuccaaacucuaaaaguucgaaaaucaaauucauucuucugucaaagcucauuucccuuccuaaguccuccuuuucugucacaguucucaguccuguucaccuuuuucaguuucccugugugcuaugaagucacaucucccugccuuuccugauuccguuccuucuagcuagaauucugugcccucuuuucuauuucugcuaauagccaaaauauauucuuuguaaaaucuguaaaagugauuaagaugucuuuacuccccccauauaucaaaaaguuggcauguuuaauaaauguuaaaggcugguugcaguggcucaagccuguaaucccagcacuuuaggaaccugagguggguggaucaugaggucaggaguucaagaccagccuggccaagauagugaaacccggucucuacuaaaaauacaaaaauuagccgggcauggugguggaugccuguaaucccagcuacuagggaggcuggggcagagauuugcuugaaccugggagguggagguugcagugaggcaagaucacaccacugcacuccagccugggcaacagagcaagauuccaucuaaaaaaaauaaauaaauguuagagcauuugggggaaaaaauauguaauauauuaucuaaaucauaggucagcaaauggcccucaggccaaauaaagucaccaccugcuucaguaaaguuuuauuggaacauagccauggccauguguuuugcugcuaagaccauaugcccugcaaaacauaaaaauuuacuauaaaaauuuacucuguggcccauuacagaaaaaugcuugccaaacccugcucuaaaugaacacauguuaacuagaguccaccgagauuuuugccuaaguuccaaaugcucuuucuauagcaggugagcuuguauagccuguucagaaccacaggcaagaaagagaugugugguauacuuuucauuaagguuuacuuuaauuucuuucuacguuggcauagugguuuuuuguuuguuuguuuguuuuugagacagagucuugcccuguugcccaggcuggagugcaauggcaugaucuugguucacugcaaccuccgccucacagguucaaaugauuuuccugccucagccucccaaguagcuggguuaacaggagccugccaccacacccagcuauuuuuuguauuuguaguagagaugggguuucaccauguuggccagucuggucucuaacuaaguccugaccucguuaucugcccaccuuggccucccaaaguccugggauuacaggcgugacacaccgugcccaaccacuagcagaguauuuaaaaaaaaaaaaaaaacacuuggcacuuagagacaaggcaucagguaguuuacuuuaaauucuuuuuacacuccugaacugucagcuccuuaaugccagagaaucugaucuaaaccuucuauggcuaaaaucuggaauucuacuugcuucccucuacuauguaaacagcgauaauuucccaaacuuuacuuuguagcaauauugaaguaacgcuucaguuacauuucuacuaccuuucccccaaaaagauuuaacccagaaaaaaguaaccugauacucccuuuucuucuguuuagaucauaguuuuaaauaauacuuagaaauuaccagcaguaucuuaaaacucauuucagaacuuuuccucauucauuggugaccgcaaaaaaagguugagaauguaacagauggcgaauagaaagaauaacuguauccugauuuugugccccuguaaguuccccucugcauaaaauuugaaucuguaaccauguaccuucucagccagaauuucaaagguuaugguguucaucuauaaauuucaacagucuaacggagacaauugaaaaagaaaaauguguuagaaauaguuaagggagcuaaagcuuauacuagaauaaauguagaaaucugcaacuaagguuugggagugauaaagggaacugaggaauaauaauaacccacaugucagcaauugcucccuaaaucugagagccaacacugcaguccuagcuuuggcauaagaguuaauuauagagcuaaggcuguauugguaauguaucagaaaaaggaaagaggguuuuaagaaauacuguucagguuaaauaaaccuuucuuugacccagccaucccacucuggugaccugcugugcaaauauaacugcacguuuaugauguuacauguucagguuuauuugauucagcauuuuuuguaauagcagaagacuagauacaauucaaggguccagcaauaaaggacuagaucauaaaaucaaaaaggcauugaaaguuaagccaaaugaaaacaugucacuugggcguauacauuaucagcaaaauaauguuggaaaugcagugaagggugagccuaagaaguuucuagcaagggaugguaaaugagagacaacugugcauuacaaaauuuuacaaauguuaaaaaaugucaagugguuuuuaaguugcuuuaccuuuuacuguaauacaugaaaaacuuguaagggcuugcacagguugccuuguuuuaguucccauuccuguuuuuuauaaauaagguuuucaggaaucgaguccucauggcucaguuagaacuccucugauucuuaguuucuucaccugugaacagaguaaaggugagauauuagaacaacaguuaagaaguacauuucuugcaaaaauuguguucacaggggaacagcaguuuagauguuaacauuuguaccccauaaaaaggauucaagguaguaggaagggauacuuggaaacuuacccucugaugacguuugucugaguaaacaccauuauaggcaaagacaauuauagguaaaagcuaaccagagguaaacaacaggagccuacauuuuagauucaugugugucaaguagaauuucauaauggcuuagauaugugggguaaauguaaagaaucaaagagaacacaauuuuugugcuuagaauccugauaaauguuuucugugauaaauuagucaugguagagaauuuguuuuaugggggaaagaaauuucuguccucuaggguguuuccuuugaguucagaaaaauuaaaauucuggacauguagaaguugauugagcuuugacuagguuacuaaauuaaaauuuuuaaugcauugcuaucucauuguaucauuauuugcuauaauaaaucucuggauuuuauuuucgaauauuugaaaacuggaguauauuuuauuucuucuuaccugaacaaaaaaauguggaaaaaaugguuuggguuuuguuuuuguguuuguuuuguuuuuuguuuuuuuuuuucaugcuacauuuuuauaguaacuaccuguauuagacguuuuuccccaguguuuuaaguauuuauguaaaacuccacauguauuauucacaacacuuuucugugguuaagcuuuuauugccacuuuucagacguaaaauaaauggccuggagaguuuaugaccuaucucguuacacaucuaugauacaaauguaacucaaagucuucugacuccaaugucauuaugucugccuacccuaguaucuguuuucuuuuuaaugucauaauacuguagcugguugacaacaugcuucuuaucuuuucaggauauggcuuuaguugccccugaagcuccuucagaacaagccagaagaguuuuucaaaccuacgacccagaagguaaaagauuuuaacaucaucucuguguuuuaugucuucauauguuugaaauacauugauagcgaccugauuuuauucaaaagauauauuggauuauuuaaugaaauguaaguuguguuucuugaacauuuuaaaaggaaaguagugaaaaugggaacaaaugaaauagcacacaaguccuuguugaguuggguuucuguguuucuuggaguacugaagguguaguugaccccucugauuaaucuugaccccaaacagggaaaaauaccaccuuuugaacaaacuguuugaaaaguaaaucauuuucuucuuuacuuauccaaacgaauauuaaauaaacagaucuuccaggauauuucuguauaauugaccucccaggauaaagaagcagaggaagaucaucugaaucauucacuuuggagccuaugcuuagcuauucuaccuaacaaaguauaguuuuuagaaguucacauauauaucauuaaaaugucuacugagucauugucacugagguuguuuugaucacuuuuguguuuacauauuuagguaacgguuaagacuuuauuauagcuaacucacugaccuuucaaguauaacuucaaaacuaaguugucauacuucagaguucccuuacgaaguaccguguagaaauggaaguugcuguauccgugaaguccuuguagauaucugaauggauucaguuaucuuuacuuucuucugucuugaaacuuuguacacuuagugaucugcucuuuuccucucugaaaauccaugucaugcaaauucuaagaauauaucuucucuuaccacuuacuagcagauaacuuuaggcuaguuacuuuuaggucuacuguuuucuuagguaucagucuuagaacaacuguaacuaguucuuagaggcguuaugaauauuaaaugaauaauguggaaagcaccuugcccagugguacaagcaguuguccaagguaauagucauauucuuaacccaguauaacuaugaacauuccaaaaccaaacacauggcuuucauguaaucguuauguguuguguuguguuuuguuuuacuagugaagauuuuggaaccacaguugaaacggagugaaugacuuucuugagaaaagaaacauaaaaggaaaggaucagaaaaucuuaggagauaauaacuauuaaagaauaaaggcaugaaaaaaugccuucagagcagacauaggagcccuaaacuuuagaaggcugauguuguaaggcugaaaaaauuucaucaaugcugcaaagauacugaaauuaagguuguuaaaguaggagacaguugucauaaguaguagcuuuguuugcuuuuaguaaucacuaaugagguagcaggcuuguacuauuuauuuucuuuuacaguguaccaaggaaaaugagaauuucucauauuaccaauacuaaaacauaauuuauaaucagugcaauuuuucagaauugaguugugagagaugcauaugaaaauuuguuguauuucuuuuagacaaagaaaauuacuaaaugcuuuuaaucuacagaguuacaugugacagcuuaucaugacuauaaacugaauuauuaaagcaagcaaaacuuauucagauagcuuagaaaguaugccucuauauaugacuuaggaagaagauaaaauccacuuuucaucuaaauaucacacuguucgugguuuagcuauguguauagucagcucuaagaaggauuaaaaguagauuaauuuuucaguuuuuuuucuuuucacuuacaaacuaaucugcuaauuuaauuuucuuuccccaaaugauaugcuuuuguuucaggauguaagcaaaucaugcguucucagaacacuuaguaugcagaaaguucuuacaagcauuuacauacaguuuccauuuagcagaggcugguauagggacaguuauccugugucacccuccucagaaugcuuuuagaauaacugaccuagaaggacacugaagguacccaggaguauuuuuauaucuuuaucucacuuuuagcucccaccccugguugauaaacccagcucucugacagguagguggauuugcagucacgcuguuaacacugugcuguggguauauuccuaauuaaauaggcguguacaggccagucaccauuuauagcauugccucuaugagaccacaucuuccauaguguaaacaagugauuuaguacugaucguuuggagcauaaaccugguaugaaauuggggaucuaucuaagaaugauguguggcauuugcguggaauguuacgauuucugaagcacuuuaccuccaugaccucauuaaaaccuugccacaaaccuaggagauaggcagggaucaucauccuuguuuuuguucuuuggagaacaaccuuuugaugguuugagucacuucuccagagccacauaccuaaaugugagaaccaagacuagauuuuaaguguuucagcaaucuuuccccuucucucuacuaccaguaucuuucuugaaaggcuaaagucauaaaaagguacuuuuuaaccuuucuaaauuuaaguuuacuuugaacuguuaauuuaauggaguaaggauuugauauucucgcuucuaguugagcaauuucugcccauuucagaaucuugaggaucuuaggagcccaguacuuauuuugauaucaagcauacuuauaaaacaaggucaaaaauauaguuuuuaacuguuaauuucucauuugaauaguaacaaaauuguacuuucugugggaccuugauguaucaccucuagauaauuggcucaguuuaaucucagauucagaaaggggagacuagcacacuuacucagcuuaaagagaagcaguuaucaggucuauucaaaguguuccacaugagcuuuggagaaaguccacaguguuuauuuuugugugucuuuuuuguggaagaaaauguuuggauaugugcuucguauucagguacauguuuuauaggaauuauuguaaaaugauugauaaagauauauuaauaugaucaaagauacuggacaacaacaauucucuagugccucuggauaccaggaaaauggcuccauccguuacgccucacuagcugugugauguuggacgaguuccuaccucaguuuuucaucuguaaaauggacuuaagaguaacuuuauaugauuagucagcacucaauacauuaaccaugguguuguuuuuuuaaaaaauguguggcacagagcuuauuccauaaccuccaaagacaucaaggucuacauagguagugucugaacugcuaaucacagguuuucacauuauacauaaugaauuuuguuuucuucuuucuccuuuauccccucccccuuguacaauuauaugucaggaagcaacaccauuucuuuuaaaucugaagcuguuuguuuuguuaaguugcuaaaauauguugacagccauauuuugucugauuucaguguacugcauuuuuuuaaucuuuaagaauaauuggacuauuguagguagagcuuaauauacaccacucccuaggcauucucuagaauugccuugucuuuucuguuccuuuuaaauaaaugcuccucccugugcccuugcuguggccucccgucacuguuagcacuguuucugucaggcauccccagcuaacaguuuucuguauagugccaccauauuuuguaccuuuuccaucccauaauaaaagugaauuugcaguacaagcuauaaaugagcuacuuauuuaugagcuuguaucauuaaaaguaacaaauguuaacgagcagcuaugagucaaccacugugcuaggcccuggggaucuggacucccugcccuccagaacucauugcccacuggggagccagaaguaaugccaaagaggucuggaaaagcucagcucuggugugugacuuggccuuggggaaaaggucacuugcuuuuucaauaggaauauagaccuacaauuuaauaaauacuaaggcuuuauuaaauucuauuuuuuuuuuaauucccaagaaacuguagucucccucucccacaguguauggaaaauguuagucucaaguacagugggcuucacaguuuccuuauaagcuguuuguugcacaacucugagaaaccuuuuuccagcuucucuguuaguuuugaguauccaacauuuggcuucucuuccugcaguguccaguuuagcuaguaucucuguuaaaauugagaccugcuaggcucuccuguuuauuucuuaaucuuucaggacagaaauccugauuguuuuauauuuccuuugaaagcccaacucagguuuccucccaguuaugaaauaguuaucuuauccaggaaauuacaugccucacuuucacuguccuucaucagcgcuccuuugcauugaguuauuccuccccacaaucucuaaggacuugacacuuuuagcaaucuggauauucaacugguaaaaaucuuuuaaaauuuuaaaccaacagcuuuuuuccuccuuucagccacaauccaacagcauuacaguauguacaugcuagccguuucccauccuggcugcucugcccucuuuugcuugcccugccucauaguccccauucuuuuguguugauaucuauguaguuaauuuaccaguguaugcaaguucuauuuuuuucuuuuaguucuucauagaucugcuugacuaaucaaaugguauucucugagauuuccuuugcuguugacuuugagguugucuuuucaucuuugugccucuguuuccuuauucucuagggagucaguuggugaaaugucagaugaccuagguuucaucuguuuuuacacuuaaugauucuggccuuuuucuaaggaauuuuuuguagguaugguuaacaugucaaaguaagucuucuacaaaggaaaauaauuuugaaaucucuucuaaucuugaguauauuaaaaguuuugaauuauugagaaaauucuauuacaucuuuaguuuuaaaauacuaaauguacaaaauguagaguuacugaccggguacaguuaugguuacacuucagaauaucugugcuuaugaguuguaaaucucauagcuaccuuaaaaauguuuaagcuugagguuaaucauauauaagcauguuguuaagaaggucacauuguuguuuuuguugucauuugccaauuagcucuugguuggggugggaacugaguugcagguuaugguuucugcggaaaggcugccagccaugacaaaguacaugcugucagugcuccugaaaaacgguguacagacugagcaucccucacccgaaagguugauccuccaaaauuuugagugccaauaugacaccguggagcauuucagauuuuggaccagaucagggauguucagccauuauauauuugcaaauauucauaaaccagaaaaaauuugaaaucuaaaacauuucuagacccaggcauuuuggaugagggagacuccaccuguaauaucaaauggauauagccuauaaacacagaaaccuaauuguuccugucuguugguggccacauaaagccuguuucacauucggagacgcugagccuuuagcuaugacuuaacuuaagcaaaaucagugaucagacucaucaaagcuaagcccacagagccagagcuugaauguuuucacaagugccuucaaccaaggucgucuuuauucucaguaccucaaauuauugguaacuuaacaaacuggaauuacucuaaacccuucacuuaaaaaauugcacauuuuuaauuauucuagaugacucauaaccuuuuagucaaggccaaucugucuucaaauggguaaacagcuccuuaugagguuuaagaauagaaaagagguuuaagaauagaaaagaccuuucuacaaucauaacuucauuccuuucugauagagauaguguacaauuccacacccugaaagagcaacugcacacuuuauucuguaguuugauuauaggagcagggcuuuuggacaucuuguucuccauggcaagauuuuuuuuuuaaucaucuaaucccugaaggacauuggaagcugauuuaaagcugagacaaucuucaggaaugaguaaauggauagggaaaauugggcacuguacauuuaaggaauaaacaacuuuuguuuaaaaccacucucauuucaaacuaccccacaaggacuuugugugugucauggucuguugcaucaucagaguuuggaccauuuuccauaaaguagucaucaucagcauuaguuugacucuucauuucagggcuguuuuuuuuaaaccuacagcuuucauuuaaaucaccaagucuguuuuagaauaccuuugcuguuaaucugucaguugucuaaguaucaguggaucacugacauuccuucaagaaacuaaauaacauugugacaaagggaauuuguugguaaagaauuauuuuaauugaauuguuaaaugcaaauguaaagguuuacuuuguuuauugaaagauaaaccuaagauuuuaaguagaaaaauauuuuacccacuuaacgcuguaacacuguuuaaagaucaaguaauuugacuuuaagcuuucgucggaguucucaaguuaaaaaauauuuuuaaguauuugccgauguuuccaagaaaacaaauagaagagggucucuaauagcaauaggcacuaugccuaaaauaaacuuaaggaauaguauguuaacucuuuguauuuuuuaugcgauuuuuuuuuccuggaaccugaucagcauuaauagcauuucuugaaguaaauucuuauuucaaguuguuucugauuuuuuccccccuagauaauggauucauacccgauucacuucuggaagaugugaugaaagcauuggaccuuguuucagauccugaauaguaagcuaaauaggaaguguuauuuagccaacucaaaaagauucgauuaaguuuaagacauauuguacauuuuuugccuuuuuaaaaaucuauaucugcauauaugaagcauagcaaucuauguaaggcaaagauuaagaaaucgaacuaauccaauauuauagcagacuugacauacuuaaauugaguuuccuuucccacccagcaauuacuguccugcuuuuuaaaaaaugcuaaaagugucuuucuauaaacuuuaaaaaguuucucugcaaacacuuccccacgucuuaaaauuuuaugugacauuaguaucuucaguaaaguaaugacgguucuguguagauggugcuaguugcccugcuuaaauaaccagcaggccucugacuuucccucuuaaauaaagaugaucaaagauaucuaacauuucuaaaugauuaaauuaacugaccugaaacuuuuagggauggcugcaauauauuauggcauaucguuuuucaguauuuucuuaggauccugucauugucuucauucucacuguuauguuuuaugcauuguuacaucuacaacuuccucuguagauuaagaucuuuaguuauuauccaugaaaaaauaacucuucuuaaguggauacauguauugaucaaauaugggaauaaaaguuaagauaggaccuuuacuccuuuuuucagcauaguuuuuccuucugcaaguuuuucuaagaaugcaaaaacuugagcuuaucaaacauaaugaaagaguucagcaaaagcaacaggaaacauugguagacaccguuuuuagaauuuggucuuguuccguuuuuagaugaguucagucauacuuucuuugaaaguaugcaauacacauaaacuagccacaucugaauuaaugugucucaagcuuacuacucagagcugugauuucauccauucucaauaguuagaaauauuaauaaaugaauaauuguuuucaauuuaaagagaaauucagaguguugaacuaguccaacaaaugguaugauaguaauuacuauacuucuucuaacuuuauuuccaaguagagaccauguuguuuacacugcucuaauuuacaaaagagaauuaacucaaguaauuuuuguuacugaccagccuaagacaaggaagagaaagaagaaaguuuuuuuuuuuccaaauucuuccauagcuauauaucaucuaccuaauuuuccuuguuuuaucagauggaaaacguaccuugaaucaugaaguuaguacaauugauucaaucagguuguuuuucuugaaguaguugaaagauuggacugaaguauucacucuacuuuggccuauuuacaacuguaauacagaauggcccaugaaauaacugggccauccuaaggauuaaaugaauuaaacacaaaugacccugccuucauuuguuucaucauaacuucccggccuuacucagacucauuaaaaugccauauccuuuguacaguauacuauacaagaaugauagccacaggcccacaaaaguaucucacagggccaauacuagacgucagguaggaggucugugaggcagccugacccagguguuuccgggagagauggcuaugucagcgcagaugcagcuuucauaaaccuuaaaacauagcuuacccucacaagaauagcuuuaacuccuuuugugaaaggcacaccugguaacugacccagaccgaagaggcaaacugaaaggagagaaguugccccugaggaaggugguugacuagaaccaccugaaauccccaaacacaacacuuugcauguuguguaguaagguagauuuaacuuggccuuuauaguuugagauagcaaggaaaauaaaacuuuucugaagacuauuuucauuuuuaaacccauuaaacugcagucugccuucuucugccuucuucuuccuucuuucuagucacacauaacaccaccugucaccagccuugguacaccugcauuguaagggcugguaugcacuuuaggcugcugcuggaccaauacaguauauaucagucacugucauucaugacgcauuagcucuuugagaauuaauguagcucuuuaaccuucaaauuacauugucuaugaauuuuaagcugcuaucucauuuaguuuuuaaaaguaagcuuuuuaagagauguuuucuauuaucugauguaccacugccuuuugacccuguauuuuaagcccaaggagaaaaagaaaaacauuuuguuaguuaaaugccucauuuguuaaauucaggcauaccuaugaagcaaagagaauuugccuuugggaaguuacaagcuugaguuuauaaaccuugguuuuuaaauuacuuuaccuaauaaggaacaauauuccaaagucaucacaauuuaaauuuuaaauaguaacagauuacucuaguuuaaaaauaaccaaguuuggcaaauuagaugucauuccuguguauuugucauuaagguucuaaaaagaacagcucuuaguguuuuuggcagccgaauguguuguaguaccaguaauuuaaucaugaaagaaaagcagcuuuuuuuuuuccucugguauccacuguuuuucuucuuucuccccguaguauaaaucucaugaagaauaaauuagauccagaaggauuaggaaucauauuauugggcccauuucuucaagaauuuuuuccugaucagguaacauaguugaggaaauauauucauuguuauucuguugggaugauuaccugugauuguuugcagcauuuucucuuucuguacaauguccuaaugcgcagauaugagacugagaaaacaccguuacauggaaaccuucccagacagagggaauguguguucgaauacgguaacgcagugccuugauggggagggcagcagaagaugacgcagacaccagucuauacacauaaugauacggagagaacaguucggaaguuugaggaguaaaaagagaaagauucucuuucuccacucccacccccacuuuucuucucucaggaagcuguuaaauacugugagaagaggucaagguggcuguggguaguagaagccccuagcuagugaagcuaagcuccuggagaauuaaaaccuaagugggucugggccguuucccauugggacaugucuuccacugggcuuugauaggagcucaguuaccuggaauagcagaggcaucugggccaaccugaauguuuuugaguuguaucugcaucauuggcaagccaguucuauauccaauacccaucuuucugucuuuguucucuaagugaagcauuuuaccacuaaaucaaauuacuuaacuagauaacagauaucauggucauuuuaucagauaucaguauaguuugcacugaaguucauuguugcaauagacauuccaauuucuauuuuaccgcuauuauuagagagacauauugacaaauagaaaaaauuuaaaagcaagagggaaaauuucaaaauauaauuacuaaaauucagaauguaauuguuaaaaaagauuguuaaacucaagauaaaauuguuaagaaagagguaagauucaaaaaguaacugaggauaucacaauguagacaauguagacuacuggacuucuuaaaacuuuggucuuaaagccuucaugaaaaauuagauuuuauuguccgacauuagacccuucagugugauauccucuuuguucacauucugacuggauaucuggauuaauaauacauuauaccaucuuaaacuuugagacaguauuaauuuuaauuauauuucaaggcugcuaucggaacuuuugauagaaauguugauucuuaguuauaauaaaaagaauauuccuguuuuuaauuuaauuuggggaagauuuugaaaagugagaaauguaaagugagacaguuacuuguaguaauuuuuuagguaaaaagaggguucuagucccuucucuuucgccuguaacagacauuuccauuugguuguacuguuuguugccucuguguuccucucucacuguuuacuuguugccugcuauucugaagacacucuccaccugggccugguuugucucauugucuguauaguucaugcuguuugccucccacgagcaugugauccugcucuugguuaccuuuagagcagugaguucucaguaugaucuccaagagcuuguuagaaaugcuaauucucagguuucucccugaagcagagacuuuaagggugggugcagcaauguggucuaacaagcccugcaagugaucuggaggcccaaguuagagaacagcugcuuuagaggaagaccugucacagucccaccuauucccaucuguucccauccuauagcagcucagacgcccucggugucauagaucuuuuccgaucaugcccuacauaccacugauguccccuuuccccuguagccacaaaaugcauagugacucaacacuccuuuuggcaauuagucacauacugccuugucccuaacagaugaauauagugaucauuccguaaacuauuuauuuauuuaagauggaguuucgcuccuuuacccaggcuggagugcaguggcacgaucucagcucacuguaaccuccgccucccugguccaagcaauucuccugccucagccuccuguguagcugggacuacauaugguggccuggcuaauuuuuguauccuuaguagagaugggguuucaccuuguuggucaggcuggucucaaacuccuaaccucagguguuccacccguccuggccuuccaaagugcugggauuacagguaugagccaccucacgaggcccaguaaacauuuauuuaaucagccacaaauaaaugaaguugcaaaacuggagugacaaggacagccaggaaaauauuuaacuucgguaaucuuuacaaugcuucaaguagguccuguggaagaacacuuauuugcuaugauguagaggcugaugcaggaagaaaaaagugguaauauuuauaagcuuuucaagaccauucguuuaaauaagaauagcagaagcagcuccccuuucccaagcacauacucuccaucaggcacugugugccuuccaaacaccauacuauuaucuuccccauuuugacaaugaggaaauugaggauuagagaacuuaagacgauuguugaaggucauacacuagguaucuuaguagcugauucaggaauuuuuugacaaugaggaaauugaagauuagagaacuuaagacaauuguuuaaggucauacacuagguauuuuaguagcugauucagaaauccaauauagucugucuaaccacagagucuaugcacuuuaccagugggcuacacuacuuuuuguugguauuucuguauuuuaugccaguuaauuacuggaaauagggaauauaaauuauauucaguuacaggaaaaugguuauuuaaguucaaauaauuuaacucugauagccaagagucaaauuauguaacuaauugcaaugacuccuguaauuaaggaaacgaucaaauugauuuuucuauuuucuguaaggcauuuugagugggauacaaaacaauuuuaggcuuuaguugggaauguaagacaugaaaaauuaaacagucuuucaaaauaauagaagagaugauacaaaguaguacuauaugauuccuucucaaauuauuuagacaauuguuaugauaaagguuaaguuccaguguaguaaaaaacuaacuaguguguccaggaaaaacuuuacagaaaaaguaagauuuaaaccaggucuggaaaaaggaaggagaggagggcauuuuagagaagaguaaaaaaaaaucaugaaugugcaaaaggccaacaaaagaucuuuucaugaugaaaugagucaugcuuguccaaaacagaauucagaaaggugaguaguuggagauaagacuaaaaagguagauuaagcccuguaugauuuuaagacucaugauugcaggucacagaaccucagccuaaauuggcauaagugagggggaaaauacaugaaggggaaggaguagcucaggugaauugaagaagcaagcaccgggaaagugcuccuggaguccuugaacagcacugggaggucuccaccucccauccccugucucuaaaguggcuacauucucacagccuaucuuucuguaggagcugaagcuccaguugccagcagcugucuucccuuaauuccaguuggaaaaaauucuaaggagggccaugugccuguuuguauccaucggauauggccaggaagacaagggggaucuauccaggcagacucagccaggggcccugagggaaaucacugggagccaggccuguaauggccuugaacgccagguuaagaggguugaacgugaucuuuagcuaauugaaaagcaagguuaagauagugggaauaacaugacccauuuuucuacaagcuuacucuguuagugauauauaggauauccuuucuuuauugaauauuacugaaaucgccuuaagcauuauaaguauguuuucauuucucacagugcucuuuucacuaauuaaugguugacaauauucaaauauuggauauuuuuuggaaaagaaaccacuaauuaaacaucgugggccaaauuggaaguauugguacauacuggaaguguauuuagucugaguaaaagugaugcuacugcuuuucucaauucauugagaggaacaaauuauuuacauagaaaaggagauauacuuuagcaaauguuuuagaagcuugucuuuugaaaaaaguuauagugauacaugcacauaauuaaaaaaaaaauaaguuaguucugaagagcuuauaauggaaaucaaccuucccuacuuuccagcaucuucuucagaggcaacacuuucaacuucagggcuuucugguaguuacaacuccauaaaccuaaguuccuucuuuugucaaaugaguccccagucaaaggauaaggauuugagaaacaugcauuuuacuuucaguugauuagaaauugccugauauaaauauaauuuaaaguguuaauaguccuuuauuuauaauagggcuccagugguccagaaucuuuuacugucuaccacuacaauggauugaagcagucaaauuauaaugaaaagguaugauaauucacguagucgucgguguucaacuggguugaugaaauaauuaugugaguauguaacaauguucgauucccguacaauugcuaccuaagauuauuccaggagucucuuuacuaugaggacacauuuuagaaucagccaucuuuggauuugaccaguauauguuagucugcauuggaaacugacauuggacuucagagcaguaguuucaccaugacuaaauacacccccauacagaucguuacccuuggcaguguagcguguuucuaaaucaacaucguaguuaguccagugaaaguuguuacuuauccauuuaaaggaagaaagagguaacagugagacuuuuuacuggaaaaaauauuuuuaaauaaauaaccuucauagucagcauauauugagcauuuacccgaaauuguauuaaguacuuugcuuaaguuucacagcaccuuaugaaggaaguguugucuguauaucuccauuuuacaggucaagcagccaggaaaugacagagcugggagugaaacuuaguccagcucagagaccaugcuccuacccaugaugcuuugcagcuuuccuuugcuaaccguugacaaagcacauaggugauucacugccagguguacucaaccuggcguaaagcuagaguucggcugcauugauuuccccuuuuugugugucuauuaucuuugcauuuauucaaguaugaguuacaguacauacuaguuauaguauauauauauauauauaauauauauguauuaguuauagcuaauauuaaaggaauaaggucuaacauuccuuuuuaauuugaucugcccaugcugacuucauguaucuaaauuguggaagguuacagaaaacaguguaaauuaaguacauaauuuuaauuagaccaaaucuaaaagacuaaaauuuacugcuaucuuuauaacaaaauauaaauuagauguuuuugucagguccaaagauauauauauacagcauccaaauuuucuugacaauguauauucuuugcauguauauauauaugcaaacuuggauguuguuuucuaaugugcgaaugagugcuucaucuagaguuugauguuugcacagcuuuguaauaggagguacuuuauaaucacuaauuauucaccuacacaaucccugcaagauaggucaaauauuauccauauuuuacagaugaggcaucugagacggggagaucaagugacucacccagggucacacagcaagucauuggcagaacagggauuggaacugaguuccugauucccaauccuguccuuggucugcuuggccacucuaccuguauguaguauaaguuuucaaaucauguuugugacaagcuucugacacaccaacaaaaagauuagaaaacaaauaggaugaacuguuaaaaugacaguaauauacagcagcuauaaagcaaaguauggaugucauuaagucacagaaauauguuuugaaguuaaucaggagcuaaaauuauaagcugcauagcaagguccuguuagaaaggaaacagacaaaaggagaaugcuggcaaagugagauggagucugagccgccaggcauccgagccugauugaggccauggaggugggucauggcaccuugcccaagcacuucugcucuaaugacaugaguacaugaaguucuuugugaaaaauagggccgauuguauuuaacuuaauaacuugaauuauauucuuuguguauaacuuuucagagaaggcaguuuugcuuuggggacugaaaagcccgaguuguaguuucaaugucaauuuauuucaucaacacuagaaacuaauauauuaacuaaaauaaagaugccaaaaaauguauuucacguuacaauguaucuuuagcacuuucuuaggaaugaguagauucaugacacaagauuaucugaucuaguaauauauucuauuccuauauuuaauguguuuuagaggcaacuaccauuuaaggauaauaaaguuguuucuuuuggcuccuuaaauagcuuauggcuuuuauuuuggaagaacauaauuacacucauguguaucagccagugaauguguaaaaauaauuuuauacacuuuggaagaagacagucgucuguaucuguuucuuuuaaauuauacagcaucagaauuucucuugguacaaaaaagaaauuaaccaccaaggagugccuuaauguccacagugagcccuugguaaugaguuaggguuuuuguugauauguccaaaauacuuuuuaaguauguuucauuguaaauuaaucagaauaaaauuuuucuugcuauucaccugccaguauauauuucugugaucacugccacugcauauacaguaucugguuaguuugaucuuucaacgucucuuuuacuuuucuuucuguccugacauccuuuuuaauuuuuuucuccaugauuuuucaugcuguacagaaugcacucaugaauugcauuucaggaauauuuaauaccauaauagcaaguuuuguugacaaacauucaaauugguuucagcucuagaaauucaauacuuaaauuagaaggagacacauguuccucagaacauaauagcuauauuccuuuuauagcucuccguuucauuaggcagcaugagcaucugagaaccucaguauuaaagcaguaggaccuguauaaauuauauguaaauaugauaauuaagcauuucuuuccgaugguauagauccguugaagaauguuuuuuuucuuagaaacaaucuauguguuuuaggauucacaugaucuugaauuuuuuaaaaaucaccuggccagcuagcaauuaaauaucguuuacaaauuuacuuucacauuaaucaguaagcagauauuccuucucauuucuagcaaaauaaaauuacaugucaaguuucaucugaaacuauguaauaccuuauuugcuagccucuaaaaauuguuuucauuccacauaagaauuugcuaagacuguugcuugaccuugguggcuuuauuuuguucaacaggucauguacguagaagggacugcaguugugauggguuuugaagaucccaugcuacagacagaugacacuccuauuaaacgcugucugcaaaccaaauggccauacauugaguuacucuggaccacagaucgcucuccuucacuaaauuaauuugucuaaguauuuauaaggaagaucuuaauaacagauguugaaagaaggagucaagacuggcaauuggcuggauuaagcuaaacacugguaucacugauuaacuguaaauaacaauuaaaaacacauuuucaguguuuaugauauguuuaaauuauuuguccuaaagcuuuauguuaaagauuauccuauuuuaccccuucgugugaaauuuacuagcaaaauuaagcuuucaucaaaguucaucacuuuugcauucagauacuuggucauuuacuuaccaaauuacaaacgcaauacuacagcauuuguauauuaaguaucacaguuacuauugauaaacuacuuuuggguuuuauuucauugaggcacuuuuuuuauuguuugaaugauuccggcuuguaauauaucagccucuacaaugaaaugcagaagaguucauuuuucuaagaucuguuuuucauuagaaauauugacaaauaacacauugucaaccuggauccuuugacaauuuacuuaacucuggcauguucacaaaaaguagaaacucuaagagaccauuaccauuuauucacagauguauaggggauguauucuaaaaacugacagaaaagagaaucugauagucaacacuguuaacuuuuacuguguaauugccaaauacacuuuuccaaauuugucccaacagcccuguaagccagcuuucuucuauauuuauaaacacgauaaaugcaugagaagaucuguuauuacauuaguauauuacguuauuuauuaugauccuaguugauggccuaaauaaacaccuuuuucuuuaacuguac

SEQ ID NO: 13049 - RNA, 2607 nt, Homo sapiens
gugcaaaagcuucuugcuugaucuuuugacgccauuuugacaagugguuauuucuuguacauuuagcgacuuuaaguaaacgcaacuucagggccauuggcgguaucccccgaaagacugcuagaacuguaagacuguaagcacaguacguauguaugcacucaccacggugcagcauuuguaaaaaggaccaacccccuccucccccagaggcgguggacauguucauuuaaaaucauucacaaauguucuuuggcuuuucaacauaccucacuguucuuggggcaacaucuuauucauuuacaaggcagaggaggaaaaccaucagguuaaaagaaaaucacaucuaccaucuggaaaauucuaaaaggcccuccuucuguuaacaguggcauuuugaaaacaccugaagcacugauuguagaggagcuagcaaagaaacugucaacucagccacccuccuuucaaccuucaccuccacccuccaacuggggcugcuggcaguggggaaaucggggauuuaggugugacccuugagcucugaaagcugucgcacagcugucucccuuccccagguggguccagcaggaccugccaucgcuugguucagcaagggaguauucagaaucucacuguucauccaugugcagagagagaaaaaaagagaggccgaaaaaaaaaaaaaaaucccacauugucagaguaaugccaaacucucucugagugggaugagcagagcagaugcugcaaugagaugccaaagcggcuccccuuccucugugccuugggugccuauaaauugcuccggcgcgcguuugucagccuccucuucuccuggcaggugguacccaggcagaauucugccuucagucucucucucgcuccgcucccggccgugaggcgcucgccgcugcucgcucgcuccuccgccccagcucugagccucgccgugccgaccgugcccgccgccgccgccgcugggcgcacccgggggacgcccgggcccacgcggggcuuuggggugcgcgucuauucgaguuguggugguggcaaaggaggaagagagaaaggaggcaauaaaaaaaaaaggcagcggacgggcgaacugagcgagcgaaagaagaggaggaggaggcagaaaaaggcaacuucagacggaaaguuggugcgaacaggcgcagucugcaaaaacggaaaagucgaucgcaggcggcggcggcauaaaagugugagcugcccgggcgagcucaggaggcggcggcuggcucugcccucccgguggccgcgccggcgccggcugcagccacaggugcgaaggagcucgcggggggcgagggcgccccgcgcaccccucccccggcccccaccccgggcucgggacuucggcucaagucacugggcgcccgcgcucccuccccagccgcagccuccgcggggggagcaggagucggcagcagcggccggcgcacgcacgcccaggggaguugggguucgcaggggguuguuuucggcucugaagagguccccgcccaaccuucaaaauucuguccaaaagcagacaagaggaucgccccgcgcugagccggcuggugggcagcaggaggcgccugaucgccgccggggcgcuggggguggugauggugcugcugcuggugauccucaucccggugcuggugagcucggccggcacgucggcgcacuacgagaugcugggcaccugccgcauggucugcgaccccuacgggggcaccaaggcgcccagcaccgcugccacgcccgaccgcggccucaugcagucccugcccaccuucauccagggccccaaaggcgaggccggcaggcccgggaaggcggguccgcgcgggccccccggagagcccgggccacccggccccauggggcccccgggcgagaagggcgagccgggccgccaaggccugccgggcccgcccggggcgcccggccugaacgcggccggggccaucagcgccgccaccuacagcacggugcccaagaucgccuucuacgccggccucaagcggcagcaugaaggcuacgaggugcucaaguucgacgacguggucaccaaccucggaaaccacuacgaccccaccaccggcaaguucaccugcuccaucccgggcaucuacuucuucaccuaccacguccugaugcgcggaggggacggcaccagcaugugggcugaucucugcaaaaacaaccaggugagcgcgggcgggcggcggggagggcggggagggagcgcgggaaggugcgggcgagagggaggagaccccggaaaugggggugggagcccgcggaggaagggcgcggcggccgggcucccuggagcgacggcaaggggggacgccgucccacccuggagaggcgggggucgugcgcgcaggagggcgccccgcggccuggagagggcaguuccggagucugggacccucgaucggugcgcgccccugcgagcgcgacccucgaggggcgggaagccgggagcugggucccggggacagcucgugcgcuggggagucccggcgcgggaagcgaccccuggccgugggauccuccgcaacagaggguagcuuacgggcuuuc

SEQ ID NO: 13050 - RNA, 8675 nt, Homo sapiens
cgcaccuccucccacgccccuuuggcguggugccaccggaccccucugguucagucccaggcggaccccccccucaccgcgcgaccccgccuuuuucagcaccccagggugagcccagcucagacuaucauccggaaagcccccaaaagucccagcccagcgcugaaguaacgggaccaugcccagucccaggccccggagcaggaaggcucgagggcgcccccaccccacccgcccacccuccccgcuucucgcuaggucccuauuggcuggcgcgcuccgcggcugggauggcagugggaggggacccucuuuccuaacgggguuauaaaaacagcgcccucggcgggguccaguccucugccacucucgcuccgagguccccgcgccagagacgcagccgcgcucccaccacccacacccaccgcgcccucguucgccucuucuccgggagccaguccgcgccaccgccgccgcccaggccaucgccacccuccgcagccauguccaccagguccguguccucguccuccuaccgcaggauguucggcggcccgggcaccgcgagccggccgagcuccagccggagcuacgugacuacguccacccgcaccuacagccugggcagcgcgcugcgccccagcaccagccgcagccucuacgccucguccccgggcggcguguaugccacgcgcuccucugccgugcgccugcggagcagcgugcccggggugcggcuccugcaggacucgguggacuucucgcuggccgacgccaucaacaccgaguucaagaacacccgcaccaacgagaagguggagcugcaggagcugaaugaccgcuucgccaacuacaucgacaaggugcgcuuccuggagcagcagaauaagauccugcuggccgagcucgagcagcucaagggccaaggcaagucgcgccugggggaccucuacgaggaggagaugcgggagcugcgccggcagguggaccagcuaaccaacgacaaagcccgcgucgagguggagcgcgacaaccuggccgaggacaucaugcgccuccgggagaaguaaggcugcgcccaugcaaguagcugggccucgggagggggcuggagggagaggggaacgcccccccggcccccgcgagagcugccacgcccuuggggauguggccggggggaggccugccagggagacagcggagagcggggcuguggcugugguggcgcagccccgcccagaacccagaccuugcaguucgcauuuccuccucuguccccacacauugcccaaggacgcuccguuucaaguuacagauuucuuaaaacuaccacuuugugugcaguugaaggcccuugggcacaaugagagccaguccuccaaacuuucagaaaguuuccugccccuucuggcaggcugccaaucaccgggcgggagaaggaaggaggggaaggcgguggagggagcgagacaaagggauggucccucgggggcggggauggcggggcuguccuguaggucugugcggccaccgugauugccccucugcgcggugcccgaagucccgcugaaaccugccgagggcagcaggucugaaagcugcaggcgcuaguugcgcggagguggcgcagcugcucuggaggcgcagagcgaauacgugguguuuggguguggccgccccgccccuggcgguuuccucguuccccuuugguuaaugcgcaacuguuucagauugcaggaggagaugcuucagagagaggaagccgaaaacacccugcaaucuuucagacagguuuguagacucucuucccacucgcagccgccugaccccacccaacacaacccacgagcaauucuaaaaguugcuuaacucacgucuaaaaagugcaaaacuucagggcugcgcguaaagcccucuaguggcgggaagaccacagguuggagcuucucaugauuagaaaaauauuaauaaaaccccuugagcgauuuuuuuuuuuuuuuugagacggagucuuacucugucgcccaggcuggagugcaguggcgagaucuuggcucacugcauccuccgccucccggguucaagcgauccuugaaugauuucuaagcaguuccuugggacauaaagaaaaaucuuuuaacuuuuuacuuuguuucccaaauguugcacaguuuugcaacacauugaccuucugguuucgaacgguuacaauuuuagauugugguuugccaaagucaaguugcuuaauuuuuacaaggccacaaaaagcgcaauuaugcccugcaguuuaaaauggaaaacguguuggaagauaagaaaacuuaguuuccaacuggaauggagccagcaaguuucuuuucuucuuugcaaauucuauugugucauuaaaguucgauggaaguaucacuaugcacaacuauuuugugaucuaauaagggugaaaaggagccaucuguccccuuggcuaagggguauuaaugguuucuaugggcuucacuauggaauguagauacagacauucuggcaaaugugguggcucuggacagaaauaauaggagucuuuguauucccagggaagcuuugcaacaggcuacauucuuacugaauauguaaugauguaagcacgguucuaauuggacacaaguauuugcuaacauccguuaucuaauaucuggcccagacuugagaaguagguaauguaaaaaguuuuuaaagcuacaagcauaccucacauuuuaaaaguccuuucuugauuggguucuuguguucuuuagcacucuugccauaaaaaauaauaacaguaauaaacccaaggcugaaaaacugaauuuuaacuaaaggguuuuugugcguguuuuuuuuuuuuuucaccaaaauuagauggacuuacagaauuuuuaacuuaaaauuggaauccaaaagccagaagauccccauuauaguuuauaguuguauucccuggaauauuuacugggauuaacugcaaagcacucucagaugaauaguguaguauaacauuuugaaacugaaauacauuuaccaaauuaauuuaaccacagcaaugugugugguucauuuuaguccuugagcauuuuugauuaucauaccugucauguuuucugcaguguagugaguuaacauaaaacaacaucaauacaaaagauccucuguuucgagauuaagcaaaauuccucauucucuucaaugugauagaauaccacauugaucuuucuuuggagguuaguaaaauaucuuuuauguauuuuucagggcuuaacaaguaaaaaucaauguuuucaucaagucugaucuuuuugucacccacucuucauucauuuuuccacuaaggugauagaaaagucucaacaguuuaagaccguaaggcuaugaacuccaaauauaauugcugacaagauaagcaauccucacgcauccuuuugagaggaaauaaaaucuuaguugcaagauuacauauucugauuuggaaugcugagcuuuuuaaauggaaauauagaaggacggcugaaucagcaaaaauccuuuauguaguuucauucuuugcaagcuugaccagucauucugaaacaggcuaacugaacugauacaguggcaagugaaaaagacaugccuuuacaggaugagucaaaggaguuuuagaagaaaaauccaccagagaaagccaagcaaauacaguucagaguuacauuucuuuuccauuuuuuccugaacugaaucuuuggcaugcauauccugaauuggguuauugaauauaaaucuagccuuguacaauggaugccagaugacuacauauuugcuuuggagccuaaggauaaguuucaaaagauuugaguggagaagaaaagcuaaaacucuugaagcacaaguuucuguucuccauguacucaaguguacaugaaguugugaaaauuuguccaccucuaucaucauguuauuccaugaaauuacaaaacaaaucuuaaaaauguuguggcauagauuuucuagauuuaaaaaguaauuaaauuaaaugaauuacuuuauuuuuugagacagagugucacucuguugcccaggcuggagugcaguggcacuauguuggcucacugcaaccucugccuccuggguugaagaaauucuccugccucaaccucccaaguagcugggacuacaggcaugugccaccacacccagcuaauuuuuguauuuuugguagagacgggguuucgccauguuggcuaggcuggucucgaacuccugaccucaagugauccacccgucucagccucccaaagugcugggauuacaggcauaagccaccaugaccagccuuaaaaaguaauuuuaaaauaucacugguaaaauguggauucagucaugauugagugcaguuuaccauguguguggacauuuauuuauuuuaaaauugucugaucaccaccuugaguaaaacacaagcagucacaauuaaaauauauuagugagcaggagaaagcacagcauauuauagcacugaaugauuuauaaaccuauuccagggucauaaaaugugucaacggcuuuucuauaguaaggagacuagguucagaugguuaaucuaagacaaauaaaugagauaagccauacacuuuuacauccuccauguccugucuuuucucuguucaaaauaggauguugacaaugcgucucuggcacgucuugaccuugaacgcaaaguggaaucuuugcaagaagagauugccuuuuugaagaaacuccacgaagagguuaguggagugacuuucggggaaugaaugaggguaaggcagcccccacgguuggcagagcugaccgucugucuguucuuuuugcaggaaauccaggagcugcaggcucagauucaggaacagcauguccaaaucgauguggauguuuccaagccugaccucacggcugcccugcgugacguacgucagcaauaugaaaguguggcugccaagaaccugcaggaggcagaagaaugguacaaauccaagguaggaaacaaaucagugcggcuucaaccaaagaaaagcauuguguucucaaaaccccauaccugugugugauuccuaaauauccucuagcuccaaugcaaagcuggcuuugacuucuugcucauauuguguuugccaccacagccuccccaccacucacaucaccuccuuuauuuauuuauuuauuuucuuauuuauuuaugagacagagucuugcucuacugcccaggcuggagugcaguggcaacaucuuggcacacugcaaccuccgccucccagguucaagugauucuccugccucagcccccuaagagcuggaaccacaggcaagcaccaccaugcccggcuaauuuuuguauuuuuaguagagaugggguuucaccauguugaccaggcuucucucaaacuccugaccucaggugauccacccuccucagccucccaaaauguugggauuacaggcaugcgccaccacgccuggccacaucaccuccuucagaauagcagacucucuucccccuaaccuugccuccaaguaaaccccaaugccauaccuuugaccuccacuguguugaaaugagcacuguagagugaacucugaaaauacuaaugucaguacuccacugcucuuucccuggcuuucaaaacagaaauuuaaaccuauacuggaagacauucagugagaaauaugauuuuuuuuuucuaagagagucaaaagacuugaaugugagcaaucuacauuucuguuuucuucccaacaguuugcugaccucucugaggcugccaaccggaacaaugacgcccugcgccaggcaaagcaggaguccacugaguaccggagacaggugcagucccucaccugugaaguggaugcccuuaaaggaaccgugaguaccaacccugcaguaaaagagggaaaauaaugacccauucugcugacuaggcucaugaugauaccugaacaaaauguugagugaguaaaaauguauaucauaaugcaaagaaaaugaguuaucaagacagacucaaaagggacuucauggaacucuugaagguuuuagcuugccuauaucauugcuucuaauaugaaggacuugguacucgcauucuccaccuaaaauuagaguggucgccauuugccgcuaauggaaauuauugcagaaggucuguaaaugguucugggaacagcuggguuuuucugagaaauaacaccagacaucuuucucacccccugcagaaugagucccuggaacgccagaugcgugaaauggaagagaacuuugccguugaagcugcuaacuaccaagacacuauuggccgccugcaggaugagauucagaauaugaaggaggaaauggcucgucaccuucgugaauaccaagaccugcucaauguuaagauggcccuugacauugagauugccaccuacaggaagcugcuggaaggcgaggagagcagguagggaacucagacuuggaugcgugaacuaauggugaccauuuguuaggcccugugccacugggcucuaagcagugucacauuuaaucuuuagaaaguuucuuugagguaacugcuuuccacuuuuuguagaggaggaauuugaauugagagagaguaagugacuugcugaaaaaggguuaaucaacagcagagcugggauuugaacccauaacucugucaaagccuccacuccuaacuccuguucaugcuccuguggagaaaaugcuuguaguaacauauuuuaaauguacuaacaagaccagucaugggaaaauguuucugagacaaaucucuaguuuaugauuuaaaacaguacguuuucuuacgugacgaaaacaaaaaguguguuaauuuguucccagugguugaaguuauuugccaacaauuuuacuguuucucuucaucuguuuauaggauuucucugccucuuccaaacuuuuccucccugaaccugagggguaagcauuuuauuucccuuuaggaaaaacgucagcugcuuguaaccacuguguuuaugucaaagcauucauuuuuuuuaggauaucugaaaaaaugccauauaagagaaaacucuauaaaacaucuauaauuuucgaacccaaguacacucuugcauucuaugcuuuaaguuaaaugcaaacuccuuuuuccuucuuccugcugcaaguacuaucucauccugaugcucaagagugucagggccuggguuuccaaacagagacuacccuaaaauuauuuggcgaguaguacuuuacacaauugccucucccccacaaaucauaauuguuucaguaaaaugguuacuugguuuuuccaagaaaaaacucguuuuuacucauuuuuggccuguuuguuuauuuagaaacuaaucuggauucacucccucugguugauacccacucaaaaaggacacuucugauuaagacgguugaaacuagagauggacagguugguaucuuuuaaggaaaaaauaggguaaucucagacaggaguugauauauuuuaaaaucagugaaucugaaucucagauacagcuggcuaauuugagagguucagguuucauucaugccuacuaaaaaaagaauaggcuucuucuuccagcaguacacacagccaacuaauuauuuggcuccuggaugugaaguugagauagcagucuuccugugcuccagaauuagugauuugcuuuggugcuuaauuugaagugggaguaagcuuccuuaaaccacuuccuaaagcagcuacaugaaacagcuucacuagacuaccucaauaugaggaauguuuugauccuggacauauggugucuuccuaccuccauacuuuauagauuccuaaacccaucuauauaauacaagcaugugccauacgaucauuuaguuucuuauuaccucccuaugccaggaaagaaauaguugcaauuuauuguagucaucaugaaaucuucccuugcacauaaauuuaaaauguaccugcugcacauuuuaauaugucuuaauugcuuuuaaacuuggcuguauuguguacaacuauuauaccaucuuuuauaaacacaguuuuuuaagaaauuucuuuuuguaaguuacaacauuccacuggauccuuauauugccuguaguggaagagggucuugugugucugccccuucuaguuuucacucaugcagaagcaacauaaccuucugauuugcacaauaaauuacauauauuuagcaggauuuuuauuugccgugauauauaggauaauuuagucuuuggcauguggcauuauauuuauuuugguuuuuuuuuuuaaacagguuaucaacgaaacuucucagcaucacgaugaccuugaauaaaaauugcacacacucagugcagcaauauauuaccagcaagaauaaaaaagaaauccauaucuuaaagaaacagcuuucaagugccuuucugcaguuuuucaggagcgcaagauagauuuggaauaggaauaagcucuaguucuuaacaaccgacacuccuacaagauuuagaaaaaaguuuacaacauaaucuaguuuacagaaaaaucuugugcuagaauacuuuuuaaaagguauuuugaauaccauuaaaacugcuuuuuuuuuuccagcaaguauccaaccaacuugguucugcuucaauaaaucuuuggaaaaacucu

SEQ ID NO: 13051 - RNA, 8675 nt, Homo sapiens
agaguuuuuccaaagauuuauugaagcagaaccaaguugguuggauacuugcuggaaaaaaaaaagcaguuuuaaugguauucaaaauaccuuuuaaaaaguauucuagcacaagauuuuucuguaaacuagauuauguuguaaacuuuuuucuaaaucuuguaggagugucgguuguuaagaacuagagcuuauuccuauuccaaaucuaucuugcgcuccugaaaaacugcagaaaggcacuugaaagcuguuucuuuaagauauggauuucuuuuuuauucuugcugguaauauauugcugcacugagugugugcaauuuuuauucaaggucaucgugaugcugagaaguuucguugauaaccuguuuaaaaaaaaaaaccaaaauaaauauaaugccacaugccaaagacuaaauuauccuauauaucacggcaaauaaaaauccugcuaaauauauguaauuuauugugcaaaucagaagguuauguugcuucugcaugagugaaaacuagaaggggcagacacacaagacccucuuccacuacaggcaauauaaggauccaguggaauguuguaacuuacaaaaagaaauuucuuaaaaaacuguguuuauaaaagaugguauaauaguuguacacaauacagccaaguuuaaaagcaauuaagacauauuaaaaugugcagcagguacauuuuaaauuuaugugcaagggaagauuucaugaugacuacaauaaauugcaacuauuucuuuccuggcauagggagguaauaagaaacuaaaugaucguauggcacaugcuuguauuauauagauggguuuaggaaucuauaaaguauggagguaggaagacaccauauguccaggaucaaaacauuccucauauugagguagucuagugaagcuguuucauguagcugcuuuaggaagugguuuaaggaagcuuacucccacuucaaauuaagcaccaaagcaaaucacuaauucuggagcacaggaagacugcuaucucaacuucacauccaggagccaaauaauuaguuggcuguguguacugcuggaagaagaagccuauucuuuuuuuaguaggcaugaaugaaaccugaaccucucaaauuagccagcuguaucugagauucagauucacugauuuuaaaauauaucaacuccugucugagauuacccuauuuuuuccuuaaaagauaccaaccuguccaucucuaguuucaaccgucuuaaucagaaguguccuuuuugaguggguaucaaccagagggagugaauccagauuaguuucuaaauaaacaaacaggccaaaaaugaguaaaaacgaguuuuuucuuggaaaaaccaaguaaccauuuuacugaaacaauuaugauuugugggggagaggcaauuguguaaaguacuacucgccaaauaauuuuaggguagucucuguuuggaaacccaggcccugacacucuugagcaucaggaugagauaguacuugcagcaggaagaaggaaaaaggaguuugcauuuaacuuaaagcauagaaugcaagaguguacuuggguucgaaaauuauagauguuuuauagaguuuucucuuauauggcauuuuuucagauauccuaaaaaaaaugaaugcuuugacauaaacacagugguuacaagcagcugacguuuuuccuaaagggaaauaaaaugcuuaccccucagguucagggaggaaaaguuuggaagaggcagagaaauccuauaaacagaugaagagaaacaguaaaauuguuggcaaauaacuucaaccacugggaacaaauuaacacacuuuuuguuuucgucacguaagaaaacguacuguuuuaaaucauaaacuagagauuugucucagaaacauuuucccaugacuggucuuguuaguacauuuaaaauauguuacuacaagcauuuucuccacaggagcaugaacaggaguuaggaguggaggcuuugacagaguuauggguucaaaucccagcucugcuguugauuaacccuuuuucagcaagucacuuacucucucucaauucaaauuccuccucuacaaaaaguggaaagcaguuaccucaaagaaacuuucuaaagauuaaaugugacacugcuuagagcccaguggcacagggccuaacaaauggucaccauuaguucacgcauccaagucugaguucccuaccugcucuccucgccuuccagcagcuuccuguagguggcaaucucaaugucaagggccaucuuaacauugagcaggucuugguauucacgaaggugacgagccauuuccuccuucauauucugaaucucauccugcaggcggccaauagugucuugguaguuagcagcuucaacggcaaaguucucuuccauuucacgcaucuggcguuccagggacucauucugcagggggugagaaagaugucugguguuauuucucagaaaaacccagcuguucccagaaccauuuacagaccuucugcaauaauuuccauuagcggcaaauggcgaccacucuaauuuuagguggagaaugcgaguaccaaguccuucauauuagaagcaaugauauaggcaagcuaaaaccuucaagaguuccaugaagucccuuuugagucugucuugauaacucauuuucuuugcauuaugauauacauuuuuacucacucaacauuuuguucagguaucaucaugagccuagucagcagaaugggucauuauuuucccucuuuuacugcaggguugguacucacgguuccuuuaagggcauccacuucacaggugagggacugcaccugucuccgguacucaguggacuccugcuuugccuggcgcagggcgucauuguuccgguuggcagccucagagaggucagcaaacuguugggaagaaaacagaaauguagauugcucacauucaagucuuuugacucucuuagaaaaaaaaaaucauauuucucacugaaugucuuccaguauagguuuaaauuucuguuuugaaagccagggaaagagcaguggaguacugacauuaguauuuucagaguucacucuacagugcucauuucaacacaguggaggucaaagguauggcauugggguuuacuuggaggcaagguuagggggaagagagucugcuauucugaaggaggugauguggccaggcgugguggcgcaugccuguaaucccaacauuuugggaggcugaggaggguggaucaccugaggucaggaguuugagagaagccuggucaacauggugaaaccccaucucuacuaaaaauacaaaaauuagccgggcaugguggugcuugccugugguuccagcucuuagggggcugaggcaggagaaucacuugaaccugggaggcggagguugcagugugccaagauguugccacugcacuccagccugggcaguagagcaagacucugucucauaaauaaauaagaaaauaaauaaauaaauaaaggaggugaugugagugguggggaggcugugguggcaaacacaauaugagcaagaagucaaagccagcuuugcauuggagcuagaggauauuuaggaaucacacacagguaugggguuuugagaacacaaugcuuuucuuugguugaagccgcacugauuuguuuccuaccuuggauuuguaccauucuucugccuccugcagguucuuggcagccacacuuucauauugcugacguacgucacgcagggcagccgugaggucaggcuuggaaacauccacaucgauuuggacaugcuguuccugaaucugagccugcagcuccuggauuuccugcaaaaagaacagacagacggucagcucugccaaccgugggggcugccuuacccucauucauuccccgaaagucacuccacuaaccucuucguggaguuucuucaaaaaggcaaucucuucuugcaaagauuccacuuugcguucaaggucaagacgugccagagacgcauugucaacauccuauuuugaacagagaaaagacaggacauggaggauguaaaaguguauggcuuaucucauuuauuugucuuagauuaaccaucugaaccuagucuccuuacuauagaaaagccguugacacauuuuaugacccuggaauagguuuauaaaucauucagugcuauaauaugcugugcuuucuccugcucacuaauauauuuuaauugugacugcuuguguuuuacucaagguggugaucagacaauuuuaaaauaaauaaauguccacacacaugguaaacugcacucaaucaugacugaauccacauuuuaccagugauauuuuaaaauuacuuuuuaaggcuggucaugguggcuuaugccuguaaucccagcacuuugggaggcugagacggguggaucacuugaggucaggaguucgagaccagccuagccaacauggcgaaaccccgucucuaccaaaaauacaaaaauuagcugggugugguggcacaugccuguagucccagcuacuugggagguugaggcaggagaauuucuucaacccaggaggcagagguugcagugagccaacauagugccacugcacuccagccugggcaacagagugacacucugucucaaaaaauaaaguaauucauuuaauuuaauuacuuuuuaaaucuagaaaaucuaugccacaacauuuuuaagauuuguuuuguaauuucauggaauaacaugaugauagagguggacaaauuuucacaacuucauguacacuugaguacauggagaacagaaacuugugcuucaagaguuuuagcuuuucuucuccacucaaaucuuuugaaacuuauccuuaggcuccaaagcaaauauguagucaucuggcauccauuguacaaggcuagauuuauauucaauaacccaauucaggauaugcaugccaaagauucaguucaggaaaaaauggaaaagaaauguaacucugaacuguauuugcuuggcuuucucugguggauuuuucuucuaaaacuccuuugacucauccuguaaaggcaugucuuuuucacuugccacuguaucaguucaguuagccuguuucagaaugacuggucaagcuugcaaagaaugaaacuacauaaaggauuuuugcugauucagccguccuucuauauuuccauuuaaaaagcucagcauuccaaaucagaauauguaaucuugcaacuaagauuuuauuuccucucaaaaggaugcgugaggauugcuuaucuugucagcaauuauauuuggaguucauagccuuacggucuuaaacuguugagacuuuucuaucaccuuaguggaaaaaugaaugaagagugggugacaaaaagaucagacuugaugaaaacauugauuuuuacuuguuaagcccugaaaaauacauaaaagauauuuuacuaaccuccaaagaaagaucaaugugguauucuaucacauugaagagaaugaggaauuuugcuuaaucucgaaacagaggaucuuuuguauugauguuguuuuauguuaacucacuacacugcagaaaacaugacagguaugauaaucaaaaaugcucaaggacuaaaaugaaccacacacauugcugugguuaaauuaauuugguaaauguauuucaguuucaaaauguuauacuacacuauucaucugagagugcuuugcaguuaaucccaguaaauauuccagggaauacaacuauaaacuauaauggggaucuucuggcuuuuggauuccaauuuuaaguuaaaaauucuguaaguccaucuaauuuuggugaaaaaaaaaaaaaacacgcacaaaaacccuuuaguuaaaauucaguuuuucagccuuggguuuauuacuguuauuauuuuuuauggcaagagugcuaaagaacacaagaacccaaucaagaaaggacuuuuaaaaugugagguaugcuuguagcuuuaaaaacuuuuuacauuaccuacuucucaagucugggccagauauuagauaacggauguuagcaaauacuuguguccaauuagaaccgugcuuacaucauuacauauucaguaagaauguagccuguugcaaagcuucccugggaauacaaagacuccuauuauuucuguccagagccaccacauuugccagaaugucuguaucuacauuccauagugaagcccauagaaaccauuaauaccccuuagccaaggggacagauggcuccuuuucacccuuauuagaucacaaaauaguugugcauagugauacuuccaucgaacuuuaaugacacaauagaauuugcaaagaagaaaagaaacuugcuggcuccauuccaguuggaaacuaaguuuucuuaucuuccaacacguuuuccauuuuaaacugcagggcauaauugcgcuuuuuguggccuuguaaaaauuaagcaacuugacuuuggcaaaccacaaucuaaaauuguaaccguucgaaaccagaaggucaauguguugcaaaacugugcaacauuugggaaacaaaguaaaaaguuaaaagauuuuucuuuaugucccaaggaacugcuuagaaaucauucaaggaucgcuugaacccgggaggcggaggaugcagugagccaagaucucgccacugcacuccagccugggcgacagaguaagacuccgucucaaaaaaaaaaaaaaaaucgcucaagggguuuuauuaauauuuuucuaaucaugagaagcuccaaccuguggucuucccgccacuagagggcuuuacgcgcagcccugaaguuuugcacuuuuuagacgugaguuaagcaacuuuuagaauugcucguggguuguguuggguggggucaggcggcugcgagugggaagagagucuacaaaccugucugaaagauugcaggguguuuucggcuuccucucucugaagcaucuccuccugcaaucugaaacaguugcgcauuaaccaaaggggaacgaggaaaccgccaggggcggggcggccacacccaaacaccacguauucgcucugcgccuccagagcagcugcgccaccuccgcgcaacuagcgccugcagcuuucagaccugcugcccucggcagguuucagcgggacuucgggcaccgcgcagaggggcaaucacgguggccgcacagaccuacaggacagccccgccauccccgcccccgagggaccaucccuuugucucgcucccuccaccgccuuccccuccuuccuucucccgcccggugauuggcagccugccagaaggggcaggaaacuuucugaaaguuuggaggacuggcucucauugugcccaagggccuucaacugcacacaaagugguaguuuuaagaaaucuguaacuugaaacggagcguccuugggcaauguguggggacagaggaggaaaugcgaacugcaaggucuggguucugggcggggcugcgccaccacagccacagccccgcucuccgcugucucccuggcaggccuccccccggccacauccccaagggcguggcagcucucgcgggggccgggggggcguuccccucucccuccagcccccucccgaggcccagcuacuugcaugggcgcagccuuacuucucccggaggcgcaugauguccucggccagguugucgcgcuccaccucgacgcgggcuuugucguugguuagcugguccaccugccggcgcagcucccgcaucuccuccucguagaggucccccaggcgcgacuugccuuggcccuugagcugcucgagcucggccagcaggaucuuauucugcugcuccaggaagcgcaccuugucgauguaguuggcgaagcggucauucagcuccugcagcuccaccuucucguuggugcggguguucuugaacucgguguugauggcgucggccagcgagaaguccaccgaguccugcaggagccgcaccccgggcacgcugcuccgcaggcgcacggcagaggagcgcguggcauacacgccgcccggggacgaggcguagaggcugcggcuggugcuggggcgcagcgcgcugcccaggcuguaggugcggguggacguagucacguagcuccggcuggagcucggccggcucgcggugcccgggccgccgaacauccugcgguaggaggacgaggacacggaccugguggacauggcugcggaggguggcgauggccugggcggcggcgguggcgcggacuggcucccggagaagaggcgaacgagggcgcgguggguguggguggugggagcgcggcugcgucucuggcgcggggaccucggagcgagaguggcagaggacuggaccccgccgagggcgcuguuuuuauaaccccguuaggaaagaggguccccucccacugccaucccagccgcggagcgcgccagccaauagggaccuagcgagaagcggggagggugggcggguggggugggggcgcccucgagccuuccugcuccggggccugggacugggcauggucccguuacuucagcgcugggcugggacuuuugggggcuuuccggaugauagucugagcugggcucacccuggggugcugaaaaaggcggggucgcgcggugagggggggguccgccugggacugaaccagagggguccgguggcaccacgccaaaggggcgugggaggaggugcg

SEQ ID NO: 13052 - RNA, 687 nt, Homo sapiens
uucugaagacauguccaucagauacugggaucuggggaguuucaccaacacuguguuguaccaaggacaugccuauccugugugggaucuggacaucaguccauauagccuguacuucgccagcgggucccacgaccgcaccgccaggcuguggucauuugaucggacguacccgcugaggauauaugcaggacaccuggcagauguggacugugucaaauuccacccuaauucaaacuacuuggccacgggcucaaccgacaagaccguccggcuguggagcgcucagcaggggaacucggugaggcuuuucacaggccaccguggccccgugcuuucucucgccuuuucucccaacgguaaguacuuggcgucugcuggcgaggaccagcgguugaagcugugggacuuggccucugggacccuuuauaaagaguugagaggccacacagacaauaucaccagccucaccuucaguccagacagcggcuugauugccucugccuccauggacaacucggugcgcgucugggacaucaggaacacuuacugcagugcaccugccgacggcuccuccagcgagcucgugggcguguacaccgggcagaugagcaacguccugagcgugcaguucauggccuguaaccuucuucuggugacuggaauuacacaagaaaaucaggaaca

SEQ ID NO: 13053 - RNA, 29888 nt, Homo sapiens
cuucguauuggaaaaguaauuauuuauuaugacaaaaauaaaacuguugaaugaaaacaaaugaauguuacacuauauugcaccaugauuggaaaugagccaaaaccugucuaaaagaugaacauuccagagcaaacagcaucguuuuacuuggguuaaguaggcaugcaaacaacucauuauaacauaauugcagaaauaaaaauuaugaguacuggcaaccuaaacuuaacauauaaaagaagcacuucauaacuaauaaaguauuaaaaacuuuaaaacaugucauuuaaacaaucccaccaucaggaaaacaugcuuugaaccauuuucaagaagugaucaugugaaugcauuaauuuacuuguuuuaaauuuuuuguuguuguuguuaaugcuuauauauuggaccaauggaacacauuuguuuggcugggguucagacacacaguuuguggugugaaagacauuuuucuuuccucugcacaauaccggaggacccacagagcaauccaauuccuaauucugaccuuauuaauaccaucuuccaguugaccaagcauaguaaugaagauauucuuagagcuuucgcagaaagccugaagcuuaaggaguaacaacaguuuguauuuaaaucuuaagaaaugcacauauauaugaauauagacacuuuaaaguuguuuugcauucugaggcaagaaauaauaaauacugaguacagggccugcugcuuccucuuuaaugcucuaaagcaccaauuuauguuaaaauagcaaagugugauuauaaucauucacucugauuagaauaaacgcaacaccaagguuguaauugcuguuagguuuuuguuguuguuguuuuuaacaugcucuguggaauagaugaacaugguaaaauuuguaacuauucuguaauugaaaaaaaucaugaccguuuuauuuuacacuuucacugaaauagcagcuaaacuuuuuuuaagucauaaauaaaaguuuuuguaacuacacucaacaguuuacuccaagagaauaaaauaggggcuucagagucccuaaauuuccugagggaaaauauaagauuaaaaugauuauggucucuugugaauagggcuuaaauaugcaaauaagucacugaugacugggaucaacugauagucauuugauaucuuaccaacacugauggaaauauauucacaguauaaaagaauccaucaaauuuaggauuucuccuuucccuuaucuaauuaaacuaauuaaauauugacugagcacuuuccuaugugcuuuaaugaaaccauaugugaaucucauauaucuaccauguuggcccagcugguaaacaagaguaaaacaaaacaaagucuccaaggaaugcuaucccuuaguuaugaauuuugcauauuucaaauacaguuugggugaaggggguuuuuaugggaugguacaaacaucccacaaacuugagcaaagcaccuuauggauugaaaaaugagguaauuuuuuaauuaaaauuuuacaaguugugcaagaaaacauauccauucuuuuaaaacuuuguuuucuauuccaaaagcuaugcacagcacauuucauauuucuccauuuccaggagaaaauguagauuacugguuuaagaaaugcaaaagaugccuuuaugugacuacaguuccaaauucuaaaacccuaaucagucuucacuccuuuggccacauuaagaauaauacaggccaucuagcuguaugguaaaaagacaguauuuuuuaguaauuuuaaguacccuaaauacgaggagaggcagaaauucacugcuuucauucacauuuucucuuaccuaauauccuuuugaaguuuuuucgaccucaugauauugucuuuacuuucaagugcuuugaauuuguuuuucguaugcuucuaaaccuccaaauuaauauuucccaaauguuucaccaaacuauauacauuuaaagcugccuuuaggucugaggggcacaauuuuuuuuucugcuuuaaauuuaaaauggaauaguugaacauauuuuuuuauauuggucuuccucuauuuauuuugguccccuaaaauuuuuuaaaaauacuuuuuuggggaaccuggcuuuuggauuucagucuucacaguaaaagugaaugaauaaggaggagacgcuacugaaaaacuaaccuugaauauaaaccacuuucagauuuauguagacauuuauguagacauuuguaaaagacugacaaccuggcuacuaacccuacucuuucaauauggaaagucacacagaacuauagacugggguggcaucaaacggcaauaaacucugaacaaauuaaccacuuccauucaauuaguacaagccaagaaaauaagguaaauuaucuagaagagaauuauuuccaacacaggcugguucuuucuaagcagcuuacuauccuuuucuuagcaauauggcuuguuuucucuuuugcauugucauuagcuauuucuauucagcuauuaauucgcugaauuuaaguugaauagcaguuacugauacguuuuucccuacuugguuguauucguauucuaaauaaaauaacaggugggaaucaaauaauggauaaaaauacauuuaauuucauauuaccuguauugcccuacuauuugagggauuuuuaauuuuuaauaguaguauauaagcauucagaauuuuaaaaccaaaagacauuuuagagcuguaguuuaaguuccucaguaugggaaaaacaaaaggaaagccauggacacuaauugucuaaggucaacuagacaauugagaaacggccaaauuaaggcucaaauccacuuuuuuagauggcuagcacaauauucuacuagauacaagacaccaugcuguaucuugaagucacuuuaccccggcaaaauguaaaauagccuuuaggacugaauuagagugaaguuuuuuugguuccaaagcuguagacaaaaagucugccucauaaaguuggucuccaaagauaaauuccaaagaaauuuauccaucuuuagacacgacaccagcacauuuuucuacugauacgguuuuacauaguuaaggacuaaauaaaaauugauuauucagaaugauuauguuuauaauuuguucuaagaaacuacacuaaaaagauuuuuuaaaaaagcuucuauauucuuuaaaauuuucuuugugacccccacaacuuuucagagaauauuguuuacagcacugccuaucacuguuuccauacuaaaauaauuauuuucucuuuaugcuauaaugaaaguuaaauuaugcuuaaucaaaaugacuauggcuaugggguggcacucauuuaaaauuuuucagcaaugaaacuuaaauuuauuaccuuucuucuaaugaauauagaauaaaaguauugauaccuuuaagcauacuaacacaagaaacuaaaagcaaaaauuacauauuuaaucuucagcuuuuaauagauuauauauauuaauauuccagguuuuaaggaauuaaguuacauuaacaauaaaaaauauuccauauauucccuuauaaaagguucuauuaauucuaagaguucucaaaugggcuucaauaagaaugauggguuuaaagaugaaggacaugacacgcucaaaauuaagaaaaaugcuguauuugaacuugcaaggauaauugaacacuuugguuauaacauacuuaaaagauuucuguuaaaauuuaauuuccuuguuuucaaauuaaaagguagaacagucuccugaagguaauguaggugggucccuugcuuuucacuuacuauaaacugugcuaaccaauacauggaggugaagggggauauaaaacacaaauuauuucaucacugaaauaauuagcugcuaacaugacuucuaaagaacagguauaauauaaaacuaagaacuuauuucaaaauaugaauaaaggcacuaauuacaaauguacauuuuuuagacaguaucuuacaguucacugauuuacaaugaaugucagaaccaaugcucuaguauuagauacuugcuuggguuaaaacauucucuuggaguaaagaauaaucaguuuucacguuacugugacaggaaagauugagugaaaaccuaaaaaauacucuuaaaaagucuuacaugaauuuccuaaucaugaacuuuucccaaucagcaccgucuacacugaugccaauuucaucuucaacacauggcuaacauaaaucauuucuaauccaaaacuaaccaaauauuuuuuaaaggauuuacaaaauaaauuguauuuuaaaaauuaaauagcaaauuugagucuauacuaguaguuggcaaaauacaaucaacuauuaaaaacacuuuuaauauaaugcugaugugguaauauaaaaaauaaccauauaauuugacagaagaaaauugagccagccaaucuuacuagauacaagaaggcagauagucauuucauaagaacaaauacaggaguacuaaguaugcuuuuucucaggacagacuuagggaaacuacccucaguacuuacgguaaacaacacaaccaagcagaaauucaggcaaacugugcuuagguaaauggcauuuucuuaauucccccacaucccacacacaccacaaaccauccauaucgauuuaugucugcuuuucgcucauguucuugauuauggguuauauuaaaaacuaaguuaaacuacacuuauccucuacuugauacagaaucacuaagaaaacggcuuaaaacaaaguuaaacaacuacuuuccaaagcccagaaagcuuuccuuuggccacuguucaguucaagggugugcuccaacuaaagauaaaucagaaaaauguuaccacauucgacuaaauuaacuugacuaaauauaauaaaccaagcacaccugaaaaaagagcaaaauuuaaaucaacuuacaaaaauauuaaaauuaaaauaccaauuuugaacacauauuuugauauuaugaacuuuguaucuuuuuuaucaaaauuaaaaaguacugcaaaaaugaaguauuauucucuaaguauucauuuuaucccuuucauuucagcaaaaucacacauuugaauaaacaggaucgaaauacgacacuugucuuuccucuuaauuuaaggaauauauuguuuagauuauuguucauauuagacaacugccucaaaaauguuuuaaugccauccaauaaauaaacuuuugauagauuaugacuuuuuuuaauuuuaaguuguuaagaauauuaacuuugagucuccuauuaauauucuaaaagcuaggauucaauucagcaguuuccuauaacauuuuagaacccaaggcauaacuacaaagauggcaauuguuucaagucuauuacauaauaccgucaaauaaauucaaggaaagccauguaguuuuuuaaguaacauacugcugguaguaaaaaugcuaugacagacacgacuucaaauuuuaagaaacaaaauggacuguucauacuucggcuucagcuacugcccaaagcagcugugauauaucuugcaaagaaaagagcuaaaauuucuguugauaauaaaguuguuuguaaacugaugcuaaaauauauuccaauugucuuauuuuuagugcugguaugauuuacuaacuucugauaguuuuauaugcauugaauaaugugauauucuuaaaauaacagauuuauucaagaauauuuaacaucaaaguugggcuuucaaauaaauauuuuaccuugguuaguuuuugaacaaauguugcaggcagaagaguggacuugauuccuuuagauaaauaaacagccuacuuaauuuccaugcaaauaacaacuuaaacauuauuccaugacucaacaguaaugugggggaaaguuaaaaggcaaguacucaugauguggaaucuuccuuacauauauccucuaggcagauuucuuucuuuacaguaaguucuguccgaaagaugaaugguuuauagagggaacaaauauauuuagugcuggagaagucugcaggcaguaccugaugguuuccaagacuacucuaucaaaccaguaauucucugguugggagggagugcuggucaagaauugaaagcaauuggucauuaagguuauaagaauauuucagaagacaucacgcauaugacaaacauuucuuacaaggcagucacugauuaauuagaauaaacagaagaauuguugcugaaaacauaguuauacauuacauucauccaacugaagauuaguguguuaaaaaaaaaaaguuaagaaaaaaucuuuuauguuccaguucagcugcacuugauucaaguguugcucucagagguuuguguuguuauaaauuaaacaugcugcugccuuagcagccaaagguacuaggaaaaaauguucaugucacagaauaaauagagcagucucuuucaagcaaaaaaguuaucucacaccaauccgggaggucauccacucuagaccuuggcauaaccuaaacaaaagauagaaguauuuuuaauuaaaaaccuuauacuuaaaaacugaaagcguacuuauuauuuuuaggucuuaaccaaaggcugguagcacaaucauuauuuauauacaucagugucaacauucaagucacacuauaauaagugaaauuuuuaaauggaauguucucuuaaauauucuuaaucaguuugugggaaauugcuucagucucaucuugaagauacaacuuugccaguuuugccaugaagagugcaaauacuccccgccuuuuaaaauuaacugaaacuuaacgacuggagaaagucaauagcaacuucaccuuauccuccucaauucuaaagaauggaauacuuagacucagucuuaaaaguaugagucaaaaaggccuacacacagcuauuacugcaagcuauuucugauaaauacuaagagaaaaacuaagaaggugagguugauuugaggauaaguucucugauauaaacaggauaauacuuaaauaacauucgguucuucuuggccuaauacccacauucaaauuguuagagauggaagaauagaccauguggcauuugucucaacuguuuauugucuggaaauaugccucccaaaagaccuccuaauaauaaagaagacauacucuugcagaaagcugagagcucagguuuaaguccuugcagaaaaugugaaauuucuuucaagcuuccuuuuuaaaagaaaggugacauuacaguuuuuuucucaguauaugauaaaggcaacaaagaaaaaaauuuggauuaugaaaacucaauucaauaguuuauugcuuuuugguaaaacauuauauuuacauuaaaaguuuuuaaguugccagugauuuuacuagaauuauuucuagguuguaagccugagacacauuauaaaagucaccuuuaauuaagaacaaacaaacagaaaaggaacaggacccaugaagaaaacaaguuggccuaaaaaguuggaagaaauuugaaagaagucauaccuccccucagacggaugaacuuacccuucuccugugagagcacagcaggauugaaugugccauggaugauccuuaauugaacuaagggugagguauuucgagauuucagcugcugucauacacccuuucauauccuguuuauuugcaaagauaaggacugcagccuuccguaaauccugcaaucaagacaaaauauuucuaauaugugaaauaccacaauuuaaauuuacccagcugaacaguuauaaugaagugcuucuacuuuaacauaaucgggcacuaguauuuaacauaaaaauaaucucaaauacccguaauuucauuauucauuccaacagauuaauauuaaauaauuauuuuuuauuuuugagucgaacuggucaaacugaaaaaaaaaaauacaccugaauuuuaaauacugacucaaaaauacauaauuaauauucuaauaggcaaauaugguaguauguugccaaauacuagaguuuauccaaaacuuaagaguacugguggugggagcugggcaauacuuauuacuuacuagucuuuguauaacauaaggucauugguuaauauucauuucagcauuguuuauacuaugaaaacauuagaagaauagauugugauauacucauacuguggaaaacuauacaguuguuaaaaggaaugaacgaaagcaguacauauuaagauggauaaucagaauauauuaucauggauaagucacaauguuguacaaaaagagcaagauucagaaagauauauauuauauaguauaaguuugaaaaacauggaauacaggccaggcacaguggcucacaccuguaaucccagcacuuugggaggcugaggcaggcggauaacgacaucaggaauucaaggccaggcuggcgaagauggugaaauccugucucuacuaaaaauacaaaaauuaaccaggcgugguggcggguuccuguaaucccagcuacucgggaggcugaggcagagaacugcuugaacccaggaggcggagguugcagugagccaagaucgcgccacgguacuccagccugggcaacagagcaagacuccgucucaaaaaaaacaaaaacaaaaacaaaaaacaaaaaaaaaaccuuucaguuauugaaacuuuuggggaaaagacccuuaaguuuuccuuuugcuuaucucaauuuaucagacuuuuaaaggcaugcuuaaguaacuuuagcuuugaaaaauuuuuacaauaacaguaguaaucuacaaauuaauguguuaggguuuuuuaaguuugaaaaaguaaugaacauuuuuuuuuaccucaagacuuucaucaguuuaguacauaaaguuguguuaaucauaaaauagccaacaucauaucacauuaaucuuugcaaaaaagcaaaggcaacguacagauacuuuacuacacuguuuuuuaaagauuuacuuuaaaaauuuaccucaugagccaacauucuguauaauucuucuuuuguaauagcuagucguucccugucaaugcuaucaacaacaagaaugaugaacuagaagaaaauuaaaaggaaagacagaaaauugaaugggaugcugaaaaguuuucuguaaaacuacucaaguaaucuaaguacuuucucuacauggcaucaucauuacuauaaaacaucuacugcuuuuucaccauaaacagcuuuuauaauacugaaccacaucaagcaguaaaauccaaauguuaacaguaagaaaauaacucauagcuucaacaaauaaaaacugugccccacuuguuuuauuuuaagugaugcccgaauacauaauacuaugauuuguuuucaaaugcugguaguaaaaagcaauuuuugaaaagaaacuuacacuaauuucaauaauauuuuucacuaaaacuucaaaguacuccauuaucauucaucuaaacagucaauaauugcuuacuuguguauaccacaaucuccuaacucuuagaaagaaaagcuaguuugaaagaaaaagauaaaugcauuuuaaaaauaagacaauuuuauaaaacaguauccaccauaaaugcuccagauugaaacauauauacuuaggcauuauauacuggagauucaggugaaauuaaauaaaggcaagacaccagaaaaaagaggagaaaucuguugguaaagcuauacaugaaaaaagggaguuugcauauuaaaaaauaagaagauauaggccaggcauuguggcucacacacauauaaucccagcacucugggaggugaggugggaugacugcuugagcccaggaguuugagacuagcuugggcaacauagugagaaccugucucucuacaaaaaauaaaaauuagccaugcacauagucccaccuacuugggaggcuaaggugggaggacugcuuugagccuaggaaguugaggcuguacugagaaucaugcaacuacacuccagccugggugagagagaggcccuaacucauuuuuuaaaaaauguggggggugggugagggggaggaggaggaggagauggaggagaugauacagcgaaaaagcacccuuaagcugaacacuguauacagaauaaaaaguuaagaaaugagaugaaaugauguuauuacagcaggagauagaugcaaaauaaacugagacaugaaggguagaauuagauuacagagaugacuuuaaaauuagggaaacaggcuaggugcaguggcucacaccuguaaucccagcacuuugguaggccgaggugggcauaucacuugaggacaguucaagaccaaccuggccaacauggugaaacccugucucuauuaaaaacacaaaaaucagccagguguggugguguguacuguagucccugcuacuucggaggcugagggaggagaauccuuugaaccugggaggcggaggcugcacugcucuccagccugggugacagacugagacuccaucucaaaaaaauaaauaaauaaaaaacaaaaauaaauaaaauuagggaaacagacaacuaaucugaauauaaacugaguugggcuuagaagggaauaaacggaaagaaugucgcguggcaaaggaggaaucaacagaauaugggaaacaacugugaguuaaugagaggaaggugucaauaauuacuuaauaccuguaacuucuuguauuauaauggacauacuaccgcuuuugggggacucuuccacgugaagaauuuucaaaaugcaaagugacaggcgccacuguucuuuguaguaauuuugauauucuuguagagaucacuuauuaaaagaacguuucaugcaaauggcaucaguaauggauaucucuuucuggacccaugcuaaguccuccagaguuucagucacuucaagaacuacccuuucgacacacuuuaaguacauauggauucacuagaaucaacuuugaccuauucaucaaugauaacugcccuuuucacagcuggaguuaacugugagcuuaaaacuacuaacagcucugauguuuaaauuaaucauaugcuacaaugucauuugucccuuacuuucuuuucuuuuuuuuugagagagagcgagacucugccacccaggcuggagugcaguggugcuaucucagcucacugccaccuccgccucccagguucaagcgauucucaugccucagccucuggaguagcugggacuacaggcacaugccaccaugccuggcuaauuuuuguauuuuuaguagagaugggguuuugccauguuggccaugcuggucuugaacuccuggccucaagcaaucugcccaccucggccuaccaaagugcugggauuacagaagugagccacugcgccuggcccuucccuuacuuucuaacuuauucuaguuucagaacauuauuuuacuguauaaauguauaagcuacccuuuaacuauauuauuugcuuacagcuucugcauacccaauaaaauaauucagugcuaccacaaguucugauuaucuaugauacgccaucuuuguuuacuuacacguugcauuggaauauauacacacauacacacaugcuauuauaauauaaaucuagaacaauacauguuuuuuaaagaggcaacuuuguucaccaaaaauuauucauauuauauccuuuucuaccucuucccuuccaacuccaauuuuuuuuuuuuuuuuuuuugagauaagagucucguuuugucacccaggcuggagugcaguggugccaccucggcucacugcaaacucugccuccuggguucaagcgauucuccugccucagccuccugaguagcuggggacuacaagucugccccaccacgcccggcuaguuuuuuguauuuuuaguagagacgggguuucaccuguguuagccaggauggccucaaucuccugaccucaugauccacccgccucggccucccaaagugcugggauuacaggcgugagccaccgugucuggcccaacuccaauuuuuaaaagguuucauuuuagaaaaaaauaauugguuagguguacuucuuugcaaagaacaauuaaauggaugcaauugugaaaucauacuaucaaggauaaaucucucuaaacuacauugaauggcuuuuaaaaaaaucugccucuaauaagaaauaaaagcagaaauagaacaugaauauauccagguuuguuccccaaguuagcucugaacucauaaguggcagagaacuuugagagaugauuugcaaaucuacuuuuuucuaauuaaaaaaaaaucuaccaacauuuugaauguucaugguauaaaaaauuuuuaaauuaauaaaauauuuuauuccuccaccggucagggucucuuagaaaguugugagaucuuggggaaaccuacauaauaucuccacgugucagaucucuccaacccuggagacaugaaaaucuugugaagaugaauggagagaaccuggccaaacaguaagcacucaaguaauaauagcuccaaacaaucuuucuauuugccuuuucuuuuauucgaaaacccaaauucuuaagucucauuuaugaaauuuuuauuuauuuauuuuuuaaaaaaaggaaacccaaauucccuacaaaaaaggaucuuauuaaaaggccggccacgguggcucaagccuguaaucccagcacuuugggaggccaaggaggguggaucacgaggucccgaauucaagaccaaccugaucaauauggugaaaccccggucucuacuaaacauacaaaaauuagccgggugugguggcacucgccuguaauuccugcuauuugggaggcugaggcaggagaauggcuugaacucagcaggcggagcuugcagcgagccaagaucacuccacugcacucuagccuggcgacagagcaagacuccgucuuaaaaaaaaaaaaaaaaaaggcaacugucaauacgcccaggugcagccuaauuacuuucuauguuuacucuagggaccuuuggauuaaaauucaaaauucaucuuagcauaccucuguauuugaguaauauguguuccaggaugaucgcagagacuccugaccaccaauaucccacauaagaaaaugaguguucuucacaacuauuucuucaacauugcuuccuaugguuggagaaguaugaaccacuucauucauuaagcuguugaaaaacagacaccguaaaagcucuuguaaaucuugagaaucugaagcaacuuuuaucucuguauuuuuaagaucaaucaaccuucugcaccaaugauggugaucauuagcaugaaaauuauaaaccuggagaacacuugcgcaaaucaauaucuagauaacaacuccagaagaaagacuuguuucuuguuuguuuuuuuuuuuaacggaaggaauugcaagcuugauggaaaagaaaggaaacaguguggugugaauuugcauuucuguggccaaaaauuccaauaccaccaugcccuguuaucaguuagauaagacccaaugucccaugccauccugaaaagcaaguuucuaggugauugcaaaauagcaaauauuggauagcaggcuaucuauaauuuugaagacugucuaaauugagacuuagucacaaaaauuaauucaggcauauuaaucuaaaguaguccuaaaaagaugaccaugggcaaguaaaaauuuaaauuaacuauagauauauuuagaaggccaggugugguggcucacaccuauaauucuagcacuuuggguggaucaccugaggucaagaacuugagaccauccugaccaacauggugaagccucgucucuacuaaaaauacaaaaauuugcagggcgugguggugggcgcuuguaaucccagcuacucuggaagcugaggcaggagaaccgccugaaccugggagguggagaucacgccauugcacuccacccuuagaaacagagcaaaacucugucucaaauauguguguguguguguuuguguguguguguauauauauauauauauauuuagaauacugaugcucauaccccucguauuaucauaaucauugguaaagcuacauuaaucaauuaauucaacaaauaugcccuugccaguaacaugucacuacuguguuggaggaggcuugcaauucucuuggguuuuauguauauuuuugaagccauguguaaaauuauuucaacaaagaugacagguuucugaaauguuuauaugugauguuuaaaagcuaauucauauuuaaacacauaaucaccaaugaaugaaaauguuuucaagagaaacaaguaguuguucaacucugaaacaacaaacuuuaagucaguagcuuuuuagcaaaguagcugaaaaaugcguuaaucacuggcuaaugaaguacuucuggugagcugauggcugucuucuaaugcaacaugagugggaagagguaagagccacacaauggggcaaagaacuguagaacuauuuuguuaaagugccugguagauccacuucuacugcuuaauacuaucauuucauuggcauugaaaggauaauggaagguacucugacaaguggaaugaugagcugugaaaauuuccuaagguauuaacagauuucucugaaagucucaagacucucccucuugcaagcuacuacagcaauauuuucaggagugaucacauuucuuuugacaagucuggcuauguuaaaaaauuccaaagcuauuagucaggaggguagcaauggcuuccuagagcuaucaauuuauuuacauaaacccaagugggguaagaacuaagugaaauccacuuuaucaccucaccccagcacuucuaauaugcgcuuuauuuauuuaauauuaauuucuuucuuucgagggcagaaaacaauaaguguuugugaaggguuuagcaaauguuuauuucacucacuuuucuauagauuguguucgguaaaauuaaaaaaacaaaaaacaaaaaacauauauuuaaguuuuuccgucauuauuauaaugcaucucuuauuaauuguaaacacauuaguuucaauaacuagugaaaacuguuuaauaaacacccauacuuacaauugguaaagaauggugguuuucccugcauuauccagucccacuauaauuacuuuguguucuacaaaaagaaagcaaaucauaaacauuuaacacuacugcauuacugcaauuacaugcuuucaacaaugauuauuaguuagcucauuaaugagaaucauucacugaauaucuaucacuagacuuaaaaugcagaaagaaauguuaugauguuaaggcuaccuagguuaaguaacaaaaucaauuaucauugauucucugucuaguucucauguaaaagaaugugggagauggguaggcaggaaacaccagcaaaguuggucacuuauauugcaucuaggggagaggagacccaaauauuaaucuaggcaaaaauuauaaccuaaauguaaguuuuuuaaaaagccuguuuuacacaccuuuuuagcucuguaccaaucaaguuagcuuuuuaucaaaauguuuucauaucuguaaguuuccccaccuauguauaccaggaucuguuucuuccucucacuuaaaaaucccauguaagcuuaaaauugaaacguuucaugugucacaaagacaaacauauacucucaaguuuuuacacaauuacucauuguuuaacauuuuuucaaccggcuucuacaguucuuuugagcagauucuguuucugcucuuuguacaaugaaaaucucuucaguucuuuccuccuuugggugccaugcacuaaauauucaccucuuuuaauaaguaguugcuaaagcucaucuaauuauuccguuaagugguauauauucugcaauguccuuugaauacagaaaacaacccagauaccaucuuuccuagauuuucacuuaugccaaguauacuaaagauccccuucuccaaggcagaagaaugcuuaaaaaguuacaaguuaacaucaacaggguaaguagggaaguuuccacagaaucacaacacaguugauuuguaggcaacgauugggcacaucucauaucagaaucccgcucuucuugaugaccucuggugaaugucaacauucuggucauauaaucaacuaucagcucauauuccuacucugaaguucuaaacuucaucagccaaaaaaagagggaccaagaaaauuuaaguucuugagaugugcaggucuuccaaugaccuacacacucuagauacagccuauuacagugcaggauaaacagacacgguccucuggaagggcuauuuucacuaugguagaagcugcuuuguaaaacaaaacaaaacuugccugcuuaguauaacucacuauaauucuccuuauuuauuugagacagggucuugcuuuguugcccaggcuggagugcaggggcaugaucacugcagccucgaccucccaggcucaagugauccuccuaccugaaccuccugaauagcugggaccacaggugcacaccaccaagcuuggcuacauguccucuaaugaagcuaaucuuuaaguauuacccuguuuguuaucccuuaaaguacaagaaccuuuaucagugaggaacaaacagacugccuggcacuaagcauucuaaauuuuggugacagcuagaagcuccaccuaccaagcaucuacagaaaacaacaugccugcaguggugagaaggaagccacuaguuuaaagauaagcaaaacuugaaggcagauaauccuguugggagaaaggaauggaaggacaguaccagauggcuccuucuugaagcaacucaaaugaagacccaggucauuugcaaacaauccugcuccuugcuucacuuuugcacuaugaugcuucacauaauacugaaggccugugaugguaaaacucaccaauaaugcaccauuuugaaagguaggucccuaacaugaggaaauguuagguuaagacacuacuguuaggccaggcguggugccuuacgccuguaaucuuagcacuuugggaggccgaggugggaggaucacgaggucaggagaucaagaccauccuggcuaacacggugaaacccugucucuacaaaaaauacaaaaaaauuagccgggcaugguggcgggugccuguagucccagcuacuugggagguugaagcagaagaauggcaugaacccggaagacggagcuugcggugagccgagaucgggucacugugcuccagccugggcaacagagcgagacuccaucucaaaaaaaaaaaaaaaaaaaaaaaaaagacacuacuguuacuaucaguuacaguaaaucagaauguuuuaggccaggugcaaugacucacaccuguaauuccaacacuuugggaggccaaggagaagugaucaguuaaaucuaggaguuugagaccaaacugggcaauacaguaauaucccaucucuuaagaaaaaaguuagccaggucaggcaugguggcucacaccuguaaucccagcacuucaguaggcugaggugggcagaccacaaggucaggaguucaagaccaaccuggcuaauuuggugaaacuccgucucuacuaaaaauacaaaacuuagccgggcaugguggcaggugccuauaguccuaguuacuugggaggcugaggcaggagaaucacuugaaccugggaggcagagguggcagugagcugagauugcaccacugcacuccagccuggugacagagcaacacuccgucucaaacaaaacaaaacaaaacaaaaacaaagaauggucuggaagacaggaugcagauagaugauaaguuuaaguuuaguguguuugaaaccugcuuacaguccagaguuaagagcagaauaagcuggggccgggcgcaguagcucacaccuguaaucccagcacuuugggaggccgaggugggaggaucacaaggucaggagaucgagaccauccuagcuaacauggugaaaccccgucucuacuaaaaauacagaaaaucagccgggcgugguggcagacaccuguagucccagcuacuugggaggcugaggcaggagaauggcaugaacccgggaggcagagcuugcagugagccgagauaacgccacugcacuccagccugggcgacagagagagacuccaucucaaaaaaaaaaaaaaaaaaaagagcagaauaagcuaaagagagaaaugugagccacaagaucugagaucugagcagucagaaguaaaggacaauaaucauacgcaauuggcaaccaguguucaaaaugauaacaugaaauucauggauuggaaagaaaugauuaaauuaugaaauuaagauguuacuguuacaugguucugaaaaagaacuacaauuaaaacuguauuucauuuguucuuaauucuggguaacacuagaaauaacuggccaggugcaguggcucacgccuguaaucccagcacuuugggaggcgaguagaucaccugaggucaggaguucgaggccagccuagccaacaugguaaaauccaucucuacuacaaauacgaaaauuagccaggcaugguggcaggugcuuguaaucccaucuacuccagaggguggggcaggagaauugcuugaacuugggaggcaaagguggcagugagcugagaucacaggacuacacuccagccugggugacagaaaauauaacaauaauaaauaaaauuuaaagacaucacugggccaggcauagugguucacgucuguaauccuagcacuuugggaggccaaggcgggcggauuaccugaggucaggaguucaaaaccagccugaccaacauggugaaaccccaccucuacuaaaaauacaaaaauuagccggagugguggugugcgccuguaaucccaacuacucaggaggcugaggcaggagaauugcuugaacccaggagauggagguugcaguggaccgagaucgcaccacugcacuccagccugggugacagagugagacuccaucucauuaaaaaaaaaaaacaaacaaacaacaaaaaaagaaauaacugaugacagguuuccacaaucauaacacugagagaaaaagacuaugccuacaaaaguucaaaagaaauuuaaaaaacaaugcaaaacuuuagaggugagcuaucaaacacacauaacacauauguauuucacagaacuacauuaacauauaaaauguuugcagagauaaucagaauuccaaauuauuuccuugaauaauaacugucgaaguaaacaggcuuccaguucaaacaauacaaaauugcaggaauuaacuuuuacauugcuuuacuuagacaacacacgcuuuaguauacuuauucacagaaagguaucuaauuuauaagacgcaugagacucuaaaaugcuacaggaaaaaaaaggaugagaauguggaaauacuggaagaaagacacgggaaaggagcacauaaaguaagaucaguaguucuuaacacuggcugcacauucgauuuaccuuggcagugaugcccaggccucuucaccccaaucuaauuuaguuggugugagguggcgcuuugggccuguuauucuaauauaucuaauuccacuggaauagauaaauauaguuacaaaaauggaaaaugcugagauugguaguuaauuuuguugaugcagaaaacaaaaauauaggcuaagauacaucuguggauuaaacccuucagugagucccauuccuugcucuagagaguuuaaugucuuagucaacacuggaggcccucugugauaagguucuccugguugucuuuccaaucucaucuccucuucacuccucgcaagcaaacuaacacacagccaagcucaacuauuuucagcuucccuaaaaguaccaaacuagcucauuccucucccuuuugcauauuagcucuucugccuagaauaacacgucccuucuauucggucugucuagcaugccacccaaauuccuacucaucauuacauuacguccaaguauaccuugugcugcagccaacguuauauuuuuacacauaucuguuaaauaauuuaccacacugcauuuuuuuucauguuugucucguuuauugauguuugaauacuuugccaagaaguaagguaucuuuauucuuuaauuuuguaucuccuaugcuaaacucugaagacuggccuauggcuguaugaaugaauaagaauaaaauaacagaauaaucacugguucuaaauuuuccaacaggaaaguuagaggaagagaaaaauucuaaguagaaauggagauucaggaggccugaacaauuaugcgaguauaaaaguagccacuggaugucuuucaucaccaucuacauuuuccccuuacaucuuuuauuaccucuagucugaguaaggacaccuccaacgaaaaaagacaagacagcagccauguaacagaaaagggagaaaggaaaacgggaaaggauauaaagggaaaaccaacuacuucgguaacguuucgauucuccagcucaggggaaagagaaaacuggugauuuuuguauuaaucuuuauaccuuuaagcaugucuuaaaaugcuguuuuaccgcugggcgcgguggcucacaccuguaauuccagcacuuugggaggccgagguggguagaucaccugaagucagaaggucgagaccagccugcccaacauggcgaaacccugucucuacuaaagauacaaaaauaggccgggcgugguggcgggugccuguaaauaccaguuacucgggaggcugaggaacaagaaucgcuugaacccaggaugcagagguugcagugagcugagauugcgccacugcacugaagccugggcgacagagaaagacucugccucaaaaaauaaauaaauaaaaauaauauuuuaaauguauggauaauacccacaaagugugaagcucugcucacuuugaaaucauuugauaaguaauauuaucugugguuacuggauacaggcauauacauauauauacacaugugugugccuguaucuauauuuauaaccuugaaaaagacugcuuuaguguucuuaucaaucuacagaacaagucaacuaaagccauuccauuaccuccacaacuucuuaaauccagaaaaagauuagauaccuacauuagcaguaacaaauugguaccaacauaaaaggaaauaaaacuggcuuauuaacgaugcccggcucuuaaauguaaaaugaaacgaguugauuuucaaaacugguuucaauuacuaagaaaccauucuguucaaaggacgccucaaacuuuaacuuaucgucggccccuuuuuuggucuggguguuuucucucuucagaagacaucacaucucauucugauucagaacagguuuugcaacuucucggcccuuuggaccugccacuuccaggugucucauuaccuguuacagacuaauuacggacacguaacgucuuacacaaaaccgaaaagcauuuaguuucugaacuaaaugcuuuaaaaaaaaaaguuuacaaugaagaugcuggaaaacucgugcaucugaauaggacaacucauucccaaguccuagaggaaaggaggcgaaaucagagugaaagugcacuggcuuacggcucaaacugcagggcgggaaaacaaagcaccuacauuacucaaaaaaaaaaaaguucuagguuucugggcggacacuuauccuggggauacacauagacacaagcacgcuucaauaaagacgagaaaggcccuccauacgccuccuggcaucauuagcuguaucccgcuuuacuucgccaauauccaaacauucucaguuuggauucugggacgccaaauaccuucucuucugccucccuauuucucccacacgucaggucucuccuguacguccuccaggucuaaaacacugaguuucugcccgcccccuggccuaagucccuuccuccuccgcgucuccgaacgcucuguccccugucuccgguguccccaucggcggcgggacccucugccucggauucgagccgccgcgcagcuccauucuucucaccuugguuacagaagaggcuccacaguuuggcgaagaucagccccaucacgagcaccggggcgggccgcggggucccucggcagcaggugccgcugcgccgggucccccaccgcggcgcgggcugcgcggagccgaggagaacccgccugagaucgcgcagcgagggcacugcuaggccgagaagccucgacccgaccacucagaaggcgccgcgacgaauccccaccggacagcccuuuguuucgagcccacugagcccaacgccgacccguaguccccucggucuguacccaccuaccuaccacagccucuccacagccccaagccccgccuccaccccgccuccccuccggaucccaggaccacccaucgccggaagcuaggcgcgugacgacggcgcacuuacggcaacccacgccuucgacguggcguuuucuucgguuucacuuccgguaggagagucccaaacggccagcggcugggaauuugcgguaucgcgggggggugggaaauuucccuuggugcgugcuccuucugaugucagccuucaaaacguuugugggacuccccuuugauuugagucucugcugcuagcagcugcuucccugaccucuaaaaccaggaaagaccauagguucucuaagugagcagccgccguuugcugcucuuagaaaacucacagaagugaagaguguuucuuuccugacuuauuccuguuccccuaggcaggcgugcuagggguuaggaguucugccgugauucuucuucauucauuuauuaaucuauucauucacguauucauucauuggcuuaugcauuuauguacucauugauugauugaucgauugcagacgaggucgggcuguguugcccagggggacucaauuuccugggcucaagcgaucuuccugccucgacuucccaaaguggugggauugcaggcucagccaccgcgcccggccccugucgugauucuuaguucugaaaagaauugauugggagacgagccauggaaggccuggagccacagaguucaguuaugugauuaauaauaacacauaauaauaacacauagcaccccucuccauuuugccaagcauuagguauguucguggaucccagaucgaaguccacgcauaagccaauucgcuguguaauuguuuucaauuccacuuuccaugguuagguucuagcauugaaaagaaaagcuucacagccuggcaugaaacgaaacugaauguccuugaaaccaguugacggaggagcaagcuuaaaauuuuuuuagacucugacuucagucagaugguuggauuuuaaccuuggcaacguggccuuuuaacaugccaaacucuugaguuaaccuguacaaggagaauguaugacuuacguccucccagugcuaugguuuaaagacccuuuaagacuuagaugcaggauaauaugcuccaacguuacaacauuaaaggcaaguuucaaccuccuauguagaggaaaaagaauguacugacccuaugcaaacuuaacuuucaugacuaucaguuggaccauaaaugugaauaauuuuguguuuguguaaguaauggcuuaaaaggacauuuuuaguccuagcuucauuaucacaaaacaaacuuuagauuccguaacagcuucuucaauuguuagacauggauguaaaccacauucugcuuuuuuuuuuuuuuucuggcuuucggauuucuaagaaaccauuucugaaaagaacaaagcauuuuuguaugaagaugcagacauuuggcugggcgcuggggcucaugcuuguaaucccagcacuuugggaggcugaggcggguggaucacgaagucaagagauggagaccauccuggccaacauggugaaacccugucucuacuaaaaauacaaaaauuagccgggugugguggcacgcgccuguaauccuagcuacucaggaggcugaggcaggagaauugcuugaaccugggaggcagagguugcagggagcagagaucacaccagggcacuucagccuggcgacagagugagacuccgucuaaaaaaauaaaaauaaaaauaaaauaaagaaaaugcagagauuugaagcaaaaaaaacuauagauuucuuaaacauuuuuaugauauuuuagagacaguaaguuugaauuauacuucuacuuuuaacuaaguggaaugaauguauuuauuugaacauggcucuugauauuuuuauugguuuuguuucuuugaaauuucagaaaacuuuaguguugaaguuuucaguucguuaaaauuuacuuuuaacuuacuuuuaacaccuuucuuaugaacaauuuaccugacaaugagacuguucuaauauuuuaaaaauauuuuuucauauuuaaaaguuuuguuugcugauuuggaaaucuaaaauuuuuacaaacuggagggaaagaaaaauagccacaauuaucaaaaguaauaugauugauuaacagaauauaguuguguauuaucuaaacagauaucaugcugauguaccuaucgaucuguuagaaaaaauacuuucaauuacauuaggagaggcacgguggcucaugccugugaugcuagcaguuugggaggccaaggcagguggauuacuugagcccaggaauuuuagaucaacccagacaacauggagaaauccugucucuccaaaaaaauacaaaaguuagcuggacaugguggugcacauguguagucccgacuaaugagguggcugaggcaagaggcucauuugagccaaggaggucaagacugcagugggcuaagaucgugcaucuggacuccagccugggugacagugagacccugucugaaccaaaaaaaaaaaaaaaaaaaaaaaaaaggauuguaacuaauuuucuuaaguguucauuggaaauaacuuccuuuaauuaaauuggaaucccaguaaaaucucuauccaguucaacaaaauauuuuaaagaguucaaggaagaaaaaugucaaacaacucgggaauucaaaaaauaaaacuauaagauguuuuuaaaaggaacuauuacaaacuaacuucagauaauacuuggaagagcuagcuguagcuguaauugaauucaauuuauuacuuauacaacucugaucaauuuguccauugcuuuuuuuaaacggagucucacucugucaccuaggcuggagugcaguugugugaucucagcucacugcaaccucugccucccggguucaagcaguucuccugccucagucucuugaguagcugggauuacaggcaugcaccaccaugcccaguuaauuuuuguauuuuuaguagagaugggguuucaccauguuggucaggcuggucuugaacuccugaccucgugauccaccugccuuggccucccaaagugcuggaagccaccauuuuuuaacuuuccucaaccuuuaagguaaugcccauugugauuuuaguuuaguugaucagucuccagauuaggugugacugauagauuucccgucagaaaauucuaccugccauauggucugaaaucaauaugaucgccuucuguaaauaucuauugagagaccaacaauuuuugaugcuguaaguaauauaaaagaaacucacgucucgcuccuaucauuacgaaaaguguauugauaaaauguugauaaauuucugacaaaguugcuuuauguuuacaaagagaagccauaauauccugaguuucaaaauaucuacuagaucaaacuagccguaggucuaugacuuuggucauaauucaaucaaugagaauugacaucucuucuguaguuuagggcucaaugucaccagccuuccuacauuugauaaaugcuccuuccaacagguacuucaaagcuuguaucaucaacacauguaguccuuuaggggcucggcugcucaguguggcagucaugguggcuuauaaauuacccauuuauaguagguuuuuggcuuuugaagcugacucaauuucuugaagcuucugguccugucuucucuggaaacagcuuugccccucuuuacuacagucccauuccuucggguggagccucuuacauuuccuaaacaccugaaaucuucacuccucccuuagauagaaaaguugacucucuugacaugucagaauuuaggucacuuuaguucuuuccucacaaaugacguuucacuauccuauagccauuccuucaguacauguauauuaauacuauguaacauuuacagaggacuuuguucuaguaccauuuaaagcacucuaccuaauuuguuugguuuauaguaaaauugugaagcaggagcuauuaucuguauuucacagaugaagaaacugaagugaaaagaacuuuaauacuugacugagguugcaagaacuggaaucugcacccuaguagcuugacaccagaggugucaaagauauagauugcccaggaacccugcuaaacuucagucauauguuaauaccauuuucuuuguaagaaucuauguuguuuguuccuuucuuaggugggaaggauacgagcaagauaaagcagcgagggauuuaagucuggcaacaguuggacugcuggauuuucagagaaguguuccccaaagcaaauuauagugcuaauuuccaauguuccauaagcguggcaagaaaaaugggaaguucucgguaagguauauaguauuauuucuagaaauaaagaugaaccaauccaagauugauuuuuuguuuguuuaauccuggcaguauucuuaacuaaauuguauucauucuucccuuuacuuuccagacuuuuuaauuuuauuuauuuuuuuauuuuuugagacagagucuugcccaggcuggagugcagugccacaaucuuggcucacugcaaccucugccucccugguucaagcguuucuccugccucacccucccaaguagcugggacuacaggcacgugccaucacgccaggcuaauuuuugcauuuuuaguacagaugggguuuuacauauugaucaggcuggucuuggacuccugacuuggugauccacccgccucagccucccaaaguguugggauuacaggcaugagccacugcgccaggccacuuuccagauacuauagucccuaauuuauugugucucaaaugccaaauaaauuugagcuuagacuggagcugcuguacugauacaggauuggauuuaugggugaaugggugacuauaggugucauguuauuuucauagaaccauucagguuugaaauuaagaaggaaagaaguucccuugaauggagauagccagaggcagaauuaagaccuuucuuccaagaucagucugaaauaacauuuuggcaaguaaaagaggcaugucugucauagaagaaauaaaaaggcaaccuggaagaacagaaaaagggaggacuagauagaaauuaguuaacugucuagcugggcaugguggcaggcaccuguaauaccagcuacucaggaggcugaggcaggagaaucgcuugaacccaggaagcggagguugcagugagccgagaucaugccauugcacuccagccugggcgacagagugagacucgagggcagugaucaccuaaaucaguguuuuaucaaccuuuuaaaauuaucaucccccuaaagagccuuucuagacauuuuuuccugcuaauucucccauacccuuaccaugaaauuaaaugcucaggagugauuguuuugguaagguuaagcuuuggaguuccacaaacuaaaaagagugagauuguaucaaaaauuguuucaguccucccugaguuccccacacccuggggagccaugucgcccauaugaagaacuuguagccuaaauaaaucuuauauggguguauucauagaguaguuuuccuuugcuuacauagcacauaucuacuaugccaaccucuuguuuuguaauaugcuuuucuuggauccagccuuagaaucccaagagauaucuucgucaacauuaacugucauuacuauaacaucuagucaagaauagucuaaauggcugggugugguggcucacgccuguaaucccagcacuuugggaggcugaaguggguggaucacuuugagcugaggaguucgagaccagccugagcaacauggugaaaccccaucucuacuaaaaauacaaaaauuagccgggcgugguggugggcaccuaugaucccagcuacuggggaggcugaggcaggagaaucacuugaaccugggaggcagagguugcagugagcugagauagcaccacugcacuccagccugagcgacagaaugagacuccaucucaaacaaacaaaaaagucuaaauguccucaauucuguccguguguggcacuagugaaguaauuucuggcaaaugcuuuaucagcauuuucuuuccauaguuuauagagauguucauccaucuuuucauuuagucauucaguaaguauuugagugcccauuauggauuaggcuuggguacauaguggugugauaaagucucuauccuuguggaguuuaaaauguaguucaacuuguuucuccuccuuuaucgcuaaaauacagauucuagccaucaguggugcuauggucaccaugaaauucaggcuacagaaauuccuuuggaaaugucugauuuagacauuuaucacuuucagauguuuuagccaugaaagaaucucauggauuuauugaagaaauaugcuauggucaaggacaagguauuggcucuagaagccaaauuacuagucuuuauccuggcuuuuuauuugugagaacauggagaguuguuucaacccuaggaaccuugauuuacucuuuaaaacagagaaaaugggcugggcgugguggcucacgccuguaaucccagcacuuugggaggcuagagagucagaucaguugaagucaggaguuugagaccagccuggccagcauggugaaaccccgucucuauuaaaauuacaaagauuagcugggccugguggcacaugccuguaauuuuagcuacucgggaggccaaggcaggagaaucucuugaaccaggagguggagguugcagugagucgagaucccaccauuccacuccagucugggcgacagagacucaaaaaaaaaaaaaaaaaaagagcagagaaaaugauaaacaacuugcagguuguugugugguauaauggucauucauuauuuucuacucuuucugguaaagaguuggugugucauggaaaguaccuguucuaugugugugugucuguguguauaauucggugugaaaauuaaagagaaaaaaacaauaaaaaacccuuuccuauacuuauguguaaauuaccauggugugcugcaaaaaacauaugucaaggugauagaauuauuuugacuuuccuguacaguuauaaaaugacucagugaguuugguuagauauccucguucuuugaaucuauauccuugucugcuuaugaugaaaaaaaagaaaaaaaaauaauggcgagggucuuccaaacucuaaagaauaugucaacuaugauacaaguagcaguuagccuuauaacuaacuguaaacacugucuguggguuuuaaguuuuaccugagcauuggauauuaacagaccauuagcccaacuuucaaaaauaugaacccuaugaacuucacaacugaagucagaucuguaugccugagagagguaaaaucaugucaugaaaucaaacgguggcugaugcgcccaaauucuggccucauccucuaacuggaggacaucuggcaggacagcaacugggcugugccuuuuuucaguccagcaacaucuuccacucaacccacgccauuuggcuguuuccccauugccccuggcaccuagcccuccgguaccgggaacuaaauaucuuugaccaucccgcccgcggggucugccuacuuaaccugaggcaggugaaagagccuca

SEQ ID NO: 13054 - RNA, 4451 nt, Homo sapiens
acugaguguacaauuucaccaacauucuaacccaugaaacuuuuacacucugugccaagaaacuguuggcuuuuguaagguacagugcucaacauuugcagauucaggucucaagaagcagagaugucucauaagcagcauuuucccaacaguuuagcaucuguacacaucugccuuggucaucaguccacucacagaguaccauacuuuaucaucacaagugucugacgugaacgaaugccauuuucuauuccauauauuuugcuuuacaauuuuaaguauuugaugaagaugguaacuuuuuccuaacuuaguuaacuauuaaaaaaaauuuugaaaagcaaggugauugaaggauugugaugacaaucucuuugcagcagcuauguaugguuuaugugaaguauccccacuuauucuuguggagcagguuuggugagacagcaauaaccaaaugacaugccaauauuacuggugcaacugguauucuacaaaugcauaaggaacacauagacgacuuccuuuuaggauaaaaugaugcuucuuucacuaccuuuugugguagcuguggcuuccaauagcaacuguuugacaguuauauaaaucuugcauguguauucuuaguuugugucccuuaaguacuacuuaauucucaaguaguaauguuauucuuauacccuucagcguucuauuuugauucaaaacaauugauucaaaacaauuuugaaucaauuuucuauuuugauucaaaacaauugauaauucuguaaaaaaacauaaacacugaauucuucagugaaccaaagcaacaaauaauagagaaaacuucuugaaacuggagugugggaaaacuucuuaacagaacuaagaguuaaagguagugagaaguguguggugugugaauucuuuagugguaaggggaaaugugggcuaaauccuuuucuuucaugaaacucucauucuauuuuauauuucugguuuguucuuguucccaugugagaaaacauacaguuucugaaaauucaaaauggucaucaaugcuuuggacuuuacauaauuauguauuagagaaggugcaacuguacauuacuuaauauacuaugaacauaauagaauaacaaaaaaagauaacaaagagaugcaaacuucuggauaaaucagauaaauggugcuacagaggaauuuaguuauuucagcuuaauuauuuguaaaaauaauaaucagugacuagguaaagauacugaaacucaagaaaaauaucuugacccauuuaugucuaguguuccauuauuggaacgcuaagcuuaugggaguuauuuagagccuacugcucaaggucaucaccaaggucugguugcaaaaauucaaaaaauugcaaccucaggcauaaauggcuuaagcccaagagauggcacugaccauaaaugguggcuugugugugaaggguuuggacuucaagauauacuaacaccuagaaaacuaaaagugcaauugacccccaauuacuauuuuaguuugagguaucaagggcauuugccaaucucuuauauguagcuucuagaguugugcuguccaauauuauauccacuagccaacguggcuuuugaaauuaaaauuaauuaaaauuaaauuaaaaauguaauucuucagucacaccagccacauuucaaaggcucaauagccacgccuggcuuguggcuaccauauuggauaacaagaaacacuuccgugguugaagaaaauuuuaauggacaaugcuguguuucauuugaauucguuguccuugaagaaaagggaagaagaggaaagaaacaagauuugguagcucuugggcauauccaagcauuuuugauuuuagagaggcccuauggaguaaugaaaaaaauacaagcugacacagcuuuaaauccccacuguguuaucuugggaaaaucacuucaaccuccuugagucucaauuugcaauuuuggaaaagaaaaacaauuuuuguccugucuuucuugcaagauuauuaugcaaccugauuaaauguacagaugugcagacucuuaaaaaccuuauguuaauguaacccauauaaaguacgacuuuuggucgaguaccagcacaaauuugcauucaaaggaagaauaguucaucagugcaaaaagcguucaaagguaaucaguucaucacguaucuugagaaaaagagaaugcauucaaaacacaaagcaaaauugcuucaguuucuuuucugcccaucugaauauuuccuuuaguauuugucccacaugacauccaucccauguauuuauccacucuuucacaacauugccuaugaacauccuucaacuggcucaguucuuuauugcauagagccacuuagcuucucuaguuucuuaugauuuccuauuuuacacuuaacagcaaaaggaggcuuccauuuagaaggcacuaucucaaacauaaauaauuucauauuuauuuuaucacuguaacacuaaggagcuauggcauuaaaauauaaaacuauuuggaacuuaauguaaaccuuugcacaugcagacuauauaaagggaauaaaauuauuuuaaauuaugcuaauauccagauacauauucuaagguuaguaucauuuaucaguuuuucgcaacagauucuuauguuacaucuucaugagggaguauaaauuugaucacgucccuagugucuauugcccacuugagaaagguuuugccaggauccacagaucgcuucaagaugcuuucguuuaugauaggaaauuaauauuuaaauaagacuaauugaaaacuagauuaucugguucuaauuucuuccuccugugaaauguucuuuugguuuguauuucuuuagguauuuuccaaguuacugcugcuuuuacuucacgaccuccaaccccacuuuuguuaucagcgucauaugccagagucauggcagauccagccuggacaacauagugagacccaucucuaucaaauauacauauauauauauauauauacacacacacacacacacacacaaauauacauauauaucaaauauauauguauauuugauagagaugauagcaauuauguguguguguguguguguguguguguguguguuagccaagugugguuucucaugccuguagucccagcuacuuuggaggcugaaguguaagaguugcuugagcccaugaguuagaggcugcugugagcuaugaucaugccacugcacuccagccugggcaacagagcaaaaccccaucucuaaauaaaaaaaaagaaucgugagacaucauguaauccaaccucuuaauguuacagauaaguaaacugaggcccaaagagauauaguaauagucccagugucaguaaacugggucuugaacuuaaauguuuguuucaguucucauugccuucaucucuuaauugucggcacuuaaggccaaccaagcagcuuagacagcgcaguccacucaacgguaacuuuauuugcuauauugacaaucugcucuguucuguaauauagaacauuggaucaaucuuuaucuuuuugcugacuuaaggaggcugcuauuguugcaauauccagagauuucaaguucuagccauugcggggucuuugugguguuuucaauuucuccucucuccaccccugcccccaucuguggccaucuaaguuagcaauacaauuuauuuuggccauuuaaaauuuuucugccuuuguuuuauuucuucccaaauauauuugaaaaugaaugaucuauauagcugauuuucugaccacauauauaauugcaauuuuuauuugcucuucaaacuauuacaacauuuuuguccuuauaagguuuuuugggcagauaaugcgaggucugugguguuaccuuuuauauacuccuauuaccuuauguuugugaagcauuuuacauuuuacagagcacuuugauucaucucccuauuuguucauuuauuuaacuguucaguucacugaaauauuuauugaacaccuacuggaaccaagugacugugcuaguaacuugugauauacaguagugagaguccaggcauguaaccgaucauuauaauacaauaacaucccuaaaccagacuuuacaaguagauaggaucaacaauacucuaucaauuuucaacuccaauuuucuauucuacuuaaaaugggaacuagaaacuguuugccugaagaaugugucugaaacauaauauaucacugcaugucugugcuguagaccuguuaauuuuaucugugagaaaaaaaguuacucaaaauucucccugaccuaagaauacuuucuaguucacugcagucuuacugaccagaugcaacaguugaaguuugauuucucgacccaauauuucuauuggguuuugaauuauuaauaucacuguuuugagguauucagaaacaccaguguaucaaaaaagcauuugcacuuuaggu

SEQ ID NO: 13055 - RNA, 4451 nt, Homo sapiens
accuaaagugcaaaugcuuuuuugauacacugguguuucugaauaccucaaaacagugauauuaauaauucaaaacccaauagaaauauugggucgagaaaucaaacuucaacuguugcaucuggucaguaagacugcagugaacuagaaaguauucuuaggucagggagaauuuugaguaacuuuuuuucucacagauaaaauuaacaggucuacagcacagacaugcagugauauauuauguuucagacacauucuucaggcaaacaguuucuaguucccauuuuaaguagaauagaaaauuggaguugaaaauugauagaguauuguugauccuaucuacuuguaaagucugguuuagggauguuauuguauuauaaugaucgguuacaugccuggacucucacuacuguauaucacaaguuacuagcacagucacuugguuccaguagguguucaauaaauauuucagugaacugaacaguuaaauaaaugaacaaauagggagaugaaucaaagugcucuguaaaauguaaaaugcuucacaaacauaagguaauaggaguauauaaaagguaacaccacagaccucgcauuaucugcccaaaaaaccuuauaaggacaaaaauguuguaauaguuugaagagcaaauaaaaauugcaauuauauauguggucagaaaaucagcuauauagaucauucauuuucaaauauauuugggaagaaauaaaacaaaggcagaaaaauuuuaaauggccaaaauaaauuguauugcuaacuuagauggccacagaugggggcagggguggagagaggagaaauugaaaacaccacaaagaccccgcaauggcuagaacuugaaaucucuggauauugcaacaauagcagccuccuuaagucagcaaaaagauaaagauugauccaauguucuauauuacagaacagagcagauugucaauauagcaaauaaaguuaccguugaguggacugcgcugucuaagcugcuugguuggccuuaagugccgacaauuaagagaugaaggcaaugagaacugaaacaaacauuuaaguucaagacccaguuuacugacacugggacuauuacuauaucucuuugggccucaguuuacuuaucuguaacauuaagagguuggauuacaugaugucucacgauucuuuuuuuuuauuuagagaugggguuuugcucuguugcccaggcuggagugcaguggcaugaucauagcucacagcagccucuaacucaugggcucaagcaacucuuacacuucagccuccaaaguagcugggacuacaggcaugagaaaccacacuuggcuaacacacacacacacacacacacacacacacacauaauugcuaucaucucuaucaaauauacauauauauuugauauauauguauauuuguguguguguguguguguguguauauauauauauauauauguauauuugauagagaugggucucacuauguuguccaggcuggaucugccaugacucuggcauaugacgcugauaacaaaagugggguuggaggucgugaaguaaaagcagcaguaacuuggaaaauaccuaaagaaauacaaaccaaaagaacauuucacaggaggaagaaauuagaaccagauaaucuaguuuucaauuagucuuauuuaaauauuaauuuccuaucauaaacgaaagcaucuugaagcgaucuguggauccuggcaaaaccuuucucaagugggcaauagacacuagggacgugaucaaauuuauacucccucaugaagauguaacauaagaaucuguugcgaaaaacugauaaaugauacuaaccuuagaauauguaucuggauauuagcauaauuuaaaauaauuuuauucccuuuauauagucugcaugugcaaagguuuacauuaaguuccaaauaguuuuauauuuuaaugccauagcuccuuaguguuacagugauaaaauaaauaugaaauuauuuauguuugagauagugccuucuaaauggaagccuccuuuugcuguuaaguguaaaauaggaaaucauaagaaacuagagaagcuaaguggcucuaugcaauaaagaacugagccaguugaaggauguucauaggcaauguugugaaagaguggauaaauacaugggauggaugucaugugggacaaauacuaaaggaaauauucagaugggcagaaaagaaacugaagcaauuuugcuuuguguuuugaaugcauucucuuuuucucaagauacgugaugaacugauuaccuuugaacgcuuuuugcacugaugaacuauucuuccuuugaaugcaaauuugugcugguacucgaccaaaagucguacuuuauauggguuacauuaacauaagguuuuuaagagucugcacaucuguacauuuaaucagguugcauaauaaucuugcaagaaagacaggacaaaaauuguuuuucuuuuccaaaauugcaaauugagacucaaggagguugaagugauuuucccaagauaacacaguggggauuuaaagcugugucagcuuguauuuuuuucauuacuccauagggccucucuaaaaucaaaaaugcuuggauaugcccaagagcuaccaaaucuuguuucuuuccucuucuucccuuuucuucaaggacaacgaauucaaaugaaacacagcauuguccauuaaaauuuucuucaaccacggaaguguuucuuguuauccaauaugguagccacaagccaggcguggcuauugagccuuugaaauguggcuggugugacugaagaauuacauuuuuaauuuaauuuuaauuaauuuuaauuucaaaagccacguuggcuaguggauauaauauuggacagcacaacucuagaagcuacauauaagagauuggcaaaugcccuugauaccucaaacuaaaauaguaauugggggucaauugcacuuuuaguuuucuagguguuaguauaucuugaaguccaaacccuucacacacaagccaccauuuauggucagugccaucucuugggcuuaagccauuuaugccugagguugcaauuuuuugaauuuuugcaaccagaccuuggugaugaccuugagcaguaggcucuaaauaacucccauaagcuuagcguuccaauaauggaacacuagacauaaaugggucaagauauuuuucuugaguuucaguaucuuuaccuagucacugauuauuauuuuuacaaauaauuaagcugaaauaacuaaauuccucuguagcaccauuuaucugauuuauccagaaguuugcaucucuuuguuaucuuuuuuuguuauucuauuauguucauaguauauuaaguaauguacaguugcaccuucucuaauacauaauuauguaaaguccaaagcauugaugaccauuuugaauuuucagaaacuguauguuuucucacaugggaacaagaacaaaccagaaauauaaaauagaaugagaguuucaugaaagaaaaggauuuagcccacauuuccccuuaccacuaaagaauucacacaccacacacuucucacuaccuuuaacucuuaguucuguuaagaaguuuucccacacuccaguuucaagaaguuuucucuauuauuuguugcuuugguucacugaagaauucaguguuuauguuuuuuuacagaauuaucaauuguuuugaaucaaaauagaaaauugauucaaaauuguuuugaaucaauuguuuugaaucaaaauagaacgcugaaggguauaagaauaacauuacuacuugagaauuaaguaguacuuaagggacacaaacuaagaauacacaugcaagauuuauauaacugucaaacaguugcuauuggaagccacagcuaccacaaaagguagugaaagaagcaucauuuuauccuaaaaggaagucgucuauguguuccuuaugcauuuguagaauaccaguugcaccaguaauauuggcaugucauuugguuauugcugucucaccaaaccugcuccacaagaauaaguggggauacuucacauaaaccauacauagcugcugcaaagagauugucaucacaauccuucaaucaccuugcuuuucaaaauuuuuuuuaauaguuaacuaaguuaggaaaaaguuaccaucuucaucaaauacuuaaaauuguaaagcaaaauauauggaauagaaaauggcauucguucacgucagacacuugugaugauaaaguaugguacucugugaguggacugaugaccaaggcagauguguacagaugcuaaacuguugggaaaaugcugcuuaugagacaucucugcuucuugagaccugaaucugcaaauguugagcacuguaccuuacaaaagccaacaguuucuuggcacagaguguaaaaguuucauggguuagaauguuggugaaauuguacacucagu

SEQ ID NO: 13056 - RNA, 641 nt, Homo sapiens
aaagcaaaacuggccaccuucuggcauacccucauuuacacaaaucugguacaucuuucuggguuuucuuuuuaaaaauaaaagagagaaaaagagaaccauguacagcauggaagcuuguugucaauuucucgacuguggcaagauuuuaaucugcugcgcuaaagaaucccugaaagccacccccgugagguaagaagcaguggggcagaguuuuucuguggccucacucacaugcugagugcugcuccgucagggacccuggccugacuccucugccugccccaggcccccaugcaguccugacaccugguggaacugaggcuggagaaggaacaaaacuggaggaagauaacggaauccguggcuucguucuguggaggcagggggaagugaacagagccuuaccccccuucugcugguccauccuugccccacuugcccccgcccuaggguugaaaugggugcaagucuccuggcaguagaaggcaugggcaagaugagggcagggcaagcuuccaaggggacaagggggcugggaguggccagaccaaagcaacagcuagggagaaggaagaaccuggaggucgggcugggccccaccaccuaaugucuccccagccacugggccuccacuccca

SEQ ID NO: 13057 - RNA, 3841 nt, Homo sapiens
cgggacuuacucaaccucauauacucgcccggaauuuucaaucucgccugucgaaaucgcuagcugcgcauccgcggaagaaguccuggaugagagguagggugaagggaucaagcagauagcagcaggcaucagcacacuccggccguuccggacggucaggcccgccgcuacagggagaagugcggcggauggagccagggcugcggguugcgcgcgggcugggaacccgguggugccaccuuaagagucggguccgcgcagcggcugcggaggcgcccggcaccugcagggggcgcugcugccccgugguuucucccgcgccgccgcgugcagcgggccuggcagcuccggggccccgguccccggaggggguggggacgcugggggaggaagggagcgaagugcagccguuagguaacgaacccgaacccucccggauucagaagcggccucagugaggcguuugcuggagggagcuuuccaucauucggccgcgagaggaaacguggggaggcgcccuccccugcccccaccgccugccuuccugccucccuccaccuccgcuccccgaccccgaccgugcuucccagacccuuuguucucgagguugggaacggcuggguggggguuccccggggaagaggucccccgcgccgcucggaggggaagggacugucgccugccccgcaccccagcccuccccagugccgucccccuuucccccggccccuuccaucgcguccacgcgcuuccguucucacucggacucccccaacucccgagcuccggcuccccagccugcacggucugcaagcccgccucccuucccacuuccccgccaccucugagguccccgggaagaggggaggagagggagacgugugggggaggagaaaccacagagccuucucggcgcggagcauucccagggacccuuccaggccccgaccccugggacccgcugcagaggcagggcuuucccggcgccgccgcaggucgcuagggccgcccccgccgcgucgcccuggggcccacgggugcacggcccgggcagcaaggcaaggugcggccucucagcgccaggacccgagacccccagcuggagagaaggggacaccgugguccgcgcccuggggaggcuaauugcacacgaacgccccccucuuccccgccccccaccguacccucugcagcgccacccgcgucgccucuccgccgugcgccacccugagggcucccgcgauugcaucuucuugagcacaguuaccaaugcguucagcuucguuucuuacucggauggagacaucgcggagggaagcgaggggacagggaugcgguaguaggggaaagguggggcgggaaaccgagcagagaggugggagacuuggcugaggcaauggcaccaggcagggccgcccggagucccgaguccagguccgcgaggcaggccccggugcagccgcgccccggccgaacccuacauguccucuguacuguggacacgaguccgcggagcgccagucacacccccgcaccccugcaagcucccgccguagagggggcucggcaccauccuggucacaaaguacgugcccccaccccccacccccaggugaagaggacgcagcccggcgccgucagcuccaggcugccuggagcccccuccggccucucggcgcgacccugguccucaauggcucgucgcgagcugcgcuagcugcucucucggcagcggguuccccaggacacacccaguccccaccccccgagagcuggcggccagcucaggaugccaggcggccaggcgggcgcccugccaaauuccgcguuccucuccaggagacggggaguugcgucccaggcucgggaaagcccgcaguucgggcuugggacucgcuuacaaagccccccaaggcgccagggacgccucugcagguugaauuccugcuccguaucacuucaauuuuaauuaaucuuuuaaaacaccgcugucacgucgcuugcagaaaauuaaucaaacuugaauccuuguugcauagcaagaauuucgauccgagucuuuuaaaaaggacuugacuuugcaaagucacgucuuuuacaguucccucauucccccuuuagcaagggaaauacugcaaaagucaagacauguuuguuugguucuuucuaucuucaaaaugaaacuuugcuuauuucugaucuuuauuuuccugucuuugaacaaaaaaaaauaacgagauaaauugccuaccucgauuaauucaaaguauaauuacuuugaaugaucuuuguuuaagagcccagauaaacuaagauaaucuuaauuuuaaugugacacgaccccuauuuuuccuugugaauaaugagaauaaagcagucauuaauuaauaccaagauaucuccauagaagaugguaucuguucucgcugagacacugaaacaucaguuguauuaguaauugauacuguauaauugaacaugaagauagccgucuauuuuuaaccuccaagcucagaguuuauuuggugauuauugagcuccuaauaauuaauuuuuuuccuucuuacugcauaaauaauucuuacgacucccaguucccaugcaaugcagaggcuucucauuaaaaccuaccccucaaaauauaagauugugaagcuauauugugcagcaacuccuucuauuucauuauuuguaacauauuuccucuauuucauaucuuccuggugcauuuccuuugcugugauuuuccuacuaaaucuaugagaauauaacuauaacaucuuuuaccauagcuuugucuuucugugaucucuugguucaguuuaauacacaauacuuaagacuucaauuuuucaaguuacuaaaauuugaggaugaguuccacugaagaaucaaaaauacuuguauagugaaguugccauggauuauauucccaaccuaacacacaguccacuuuaacucacacuuuucuguuguuaaaaauagacuuugcucaaacacauucccuuuuuccaacuugaguugaagagaguucucacaauuuccuggguuaaauguacaugcuaacacaaccuuugacauuaaaaaacaaauuccccucccgcguuggagagaagucuuccaaacagucauggaaauuuagacuguagcuuuaagguaucuaauuauuucuuagccucaguuauuuuggggcaucagaaugaucuucacuuuuuaaguggaaaugguuaugauauuuuucucauacauacaaaaaacucucuacuuauuuuuccaauaaagugucucccaaguaugacauguuguauaccacacaaauauucuuaguaccuccgcuaccaaauccaugcauuuucccugucagugcucuaucuaaaauucuggaaaguauagaggguuuccacuuuuauuucccccuuaguacaauuaaaacuuuaggucaauauauaacggagugauucucugcacuuggauuuuauauuuucccacuauaauuuggacuggaaugggauuaaaacagcaucuagaguucuaaucuugguugauguuuugguguauucaccguaaugaguccuauucucuggggucaugaagcucccaaaugucaaucaagcaaacagauucagaaaugccauuguucgacucccacgucacucgccuuccucucauuuuauuuaacaauaccggaguucucugaucagucauucggaauaugaggcauuaucuggggaaaauucacaaagugucuugaucuuucuuugggagauacuguuaagggguuuccgcaaagcauaaagugcuuguuuauauuucugucuuuggaccgcacuguggaugg

SEQ ID NO: 13058 - RNA, 266 nt, Homo sapiens
gauagcgucaguuguaccagugaaggacaagaaacuucuggaggucaaacugggggagcugccaagcuggaucuugaugggggacuucagcccuaguggcauuuucggagcguuucaaagagguuacuacugguacuacaaguacaucaaugugaagaaggggagcaucucggggguuaccauggugcuggcaugcuacgugcucuucagcuacuccuuuuccuacaagcaucucaagcacgaguggcuccgcaaauaccacugaa

SEQ ID NO: 13059 - RNA, 3957 nt, Homo sapiens
auaucaucacucuuuguggaaaacaacaccuuauuuauucaggguguaauacugucuacuuccuuucagaagacuugaaaaagaucaaaauaggauaaauggacaguuacuacuaaacgauucaaauacuugggcaguaucuuucccucuuaacccuuucacacguuuuuaaagugucaaaauugaugaaugguauaaauucaaaaggaaaauucuuuucuacugaaaaggacauccagcucgcacaaacggugguucagcugaaggcaaggcguuucugguuuuccucugcacucgggcggaucguuaacuuccccaaguuacaacugaguugcucuuuccaggcuuuucgaagcaucuuuaaguuuccccaccaaguccuaaaagacguguauacaauaccacguuuuuaggauaaaacauggaaagaaguauccaagcucaagaaagaugcaagaaaaaaaaucaggacacaccuuccaaacaaguuuaaaauucaacaagauuuuaacuuuugacaaacuacuaucgggcaaaaaaagcguuuccucggaaauaccucauguucaaaucgguuauuugcccucacacugaaacaugauuucuaaccggauccuuaaccgcccagauacaucugaauuuucucaaguuaucuaacaaagguuaugcuguauacacauuuucugaaaguugaaaguuugauucauaguuacauuaaaacgacucugcagaagaugccuuugaaaaauucaauuucacuuaaauuuccaguaaugagcuucauuuuuuaaaaacuaugaaauaaauucguugucauauccacuaauaaauguaguuuugaauuuucccagucuuaaaugggcaauauaaacaguuuuagaauguuauguauacuucccccuuuauaaagucauuuaaaaaguuucaaaauccaauuuugacaguuuaauucaauuucugaaagcaaagacauuuucaaagccaugcucuuaauuuuguuuaucuuauuggaccaaacucaucaugaauagaagaaauuuacacuaaacacuacagaaguuuauuucaaucagcaagaacagcaaauacagaccaauucucuauuaauaacaucuuaauuucaagugaagccuaucuuaaaauacuacuuuugaugccccuuucccauuaaauccuuaaccaaucuucauuaucugcugacaaaugguuagauuaauuuucuuuugaacuucccaagaguauaacucucaaguaaacauuuauaaaaagacaggaauauuuauagauccuaauacuguaccuguaauuguuccaugcugcaacuaaaacuaaucucuggauaggauggggaaucaguguucuagggcaggaaaaaaaacacgcaacaagaaacgcuguuuauuuaaaucaaugaaauuauaaauuucauuauuggauaagacuuaucuauaaauaccuguacacuuaaggucaccaaauaugcaggucuguacauccuaugaaguugauuggucuaaaauaacacaacaaacacgcaacagcuuuuaacucuagguuuuaagaaguucccuaaaucccccgcuagagaaguuucuuaaacuuuaccuuuaucugauauuccaagcgccaagaaacauccguuauaugagggagagaucugccuauacugaaagaugcaaugauaacuucguacauagucuccucagaagaacuuuucaguuauuuauauuuacuaagaauggcucuacuuuccacccccaacuccauuuuaauccauucugaauuuaaaccauuguuaaacuuuauuuuuaaauuaugaaugguaaaggagcauuucaaaaucaucucaauaaacgaucuuuaaaaacaugagcuuaacuucaauugcuugacaugcccuuuggcuccuuuucuuugggucaagaucccgaagaucuuguuucacaccaacacucuccauucauaccugcaagugaaaagugccucagcuugacaccuuauacaguaccuaccuucccaguaggauuucuagggaauucuuauuauucuggagagaaaaaagaaagcaagaaagaaagaaaaaaaaacaucuuuacaaacaaaguaaaagaaaaauaguacuguuaauuaaaaauuuuaaaguaaguaaccugauauuccgugcaaaacaguucuauucgcucucugucaaauuuacagucuucuagauaagugcuagaagaaagaaaaaaaaagccaaaguucugucuccauuuuuaaaacugaaauugaaaucauuaagguaguauuugaaaauaaauggauauuuaaauaaauccuguaccuuagaguugacuugucagcucggugcuuuccugccucuaguauguaaguugcagcugcugcaugacaauguuuuaaaaccacugggucgauauguuucaagucuggaugaucuaaaauaaauuaacuuccagugaugccuaugauaauaaauucuuuacagucauguuccaaaaaggauauuuuaauuuggguuuaaaaacccuuuaacaagauuaaaaacaucaacuauaaggacagucaauuauaaguaaaugagaugagcaacaagaucaagugaaaaacaauaaaaagaacacaacaagaacucuacuauuacuagcuucaauuaacuuauuuugccuuaauauuuuuacuauuaaaaaauauuauagcccccaaagaaaauauaacaaugcaauggucauucuaacacuggaguaaauucaaaggaaaaacaagauaaauauuuuacauugugucaauuuuagaauaaacuuccauccuaaaaaugaugaguuuaggguaaccggcuccaugaacaaauacaucaaggggguagaagguagggcaugaguucagaauauaagauacaaauuucaaaauuauauuaguacuuucaggguuugacagucauuuuuuuuuugagauuaacccagguggugguuacuauuuucguuuaagaacuuccacuuucauacuuuuuguacaaguguuuaguucaugaaacuacagaaaaaaaacaaaaauuugaauuguugggauauuuauauuuaagaaaaucaucuaaaagcgaucggucuuaaaauaugucuucaauccauacugacacugcaccuccgcagucacugaccggaucgcuuaaaagacacucgcauccugguaacuggggcggaacaaaguauugugcaucauaguuuaagguucuaggcguagaaccuguguaaacaugcugaacuagagcgcuggagugaucauagcaacuugagguaugcucuaaguuggcaaaugucaacacugucugaccuaguaauuacuucggaaacagacccuuaaaccuuugcuagccuagcccuggaagcuugaauugcagggagcuccccagaugaaguccaacugucaaaacagccgcagccucagacaaggcuaaacaccuuagauguuuaggccacaaacaagacuugaacaccggcuuuacaaaagaacaaagagacugggagggaaaccgggccaggaacguggaguuggcucuaugcaggugccaaguggggccaaaacaaugcucagagucugcuccgaguccuggcagagccacguccccaacacuccguccggagcgaagggcaaagcccggagacuuccucuucccggggcuuuccccuucucgcuccgccggcuccucuucuccgagcgccccuccaccccggcggauccagcuccgagccgagccgagcggcuuaccuaacacggccucguccgccugggcguccagcagacucuggaaugccgcccggaggagaagcgugaaggcguuggagucgaaggagcggggauccgccagcaucuggaagccuuucugcacagacuccgagagcuccauugugagcgcgccgugaccuucgacacgcacaccacgugacacgcgccgcgcgcuca

SEQ ID NO: 13060 - RNA, 1384 nt, Homo sapiens
ucccuagagugggcgaggugcagaggugcccaggacgccuuggguuccugggacacaggcagaggugaaacaccccacaugccacaggaagcggggagggggugccucucaccacaacggaacccuaaacuauuuccugaaggcuuggggccuccacacaacccgccuccaccagcaaagcgccggcgccucuccaaagcgaugucagcgcaacagguuguuuggaacaggugccggccagcuagggaugggauuggccuuaaguugcggggaucagucaagggccaagacuccccgagaagcaagggcagacccccagagguccgaaaguggggacuggcuagaaaccugcgccccccgcugcugucgcugcuagcgcuggcgccucggcccagaggcaaaaaccagcucgccacaaccugcgccccgggccacggggcccucuacaggcggccgcccgagggcuucccucccggccgcggggcguaguugccccgggccuccuccgaagaagccuggggucccauccccggaucuccuuuuggccguucgcuccccucccugcucgcugcuuccuggagccccucuuggagacuuccaugcgcaaagauagcagaacugcggagagcaaggcgucgggcagccacuuccagccucaagcgaagacaggcagcacaggagucccgaaugccccugggagcaagggcuaggcgggccuccggggacacucguccgacuccaccccggcucuccggaacccugggaacgcggagcagcgggcggggcgcaugcgcgccuccggccagggucccuccccggccugcggaguuuggggaaaguuuggcgagguuugcccuggcagcggcggaugucccaaaggucaggcugcccuggggaugcagccaggaucccccccagagucccaggagcgggcucggcaggagccggagggcugaaaggcggcagaaggugggaagagggaggccuuuuguguguggcacaggagagucacuugcgcacaaacgcagcagcgcgcuccgccgccgccucagccuccacggcagcaccuccgccuuagaggcgcuucauuacagccgagcccuucccccgccuccccccggcccuggccuuuguucggcuugaaaguaaugcugugaauuaaaagaaaugacaauauuuucuaucugcuuaaaaguccaagagaagagcccuugagcuuggcaaaaaucaggcaaaucauucaucaugccaccccgcaccuguggucuuggcauugaaaacccuccagaccuauuccuauuaaacuuaauuauucccccaaagcacacaaugguugaaauggagcagguuggagucuguuuauuggugguaaauguuuuucuga

SEQ ID NO: 13061 - RNA, 2597 nt, Homo sapiens
ugacuuagaaguagcugacuuuauuuuaaaaugccuuuagaacaacagguuaugcacuggcaaaaacaagaguggccacaauuucuuugccuuucugguuuaggggaguguguucacugcuucccacuggaauaaagucaaaguugagauguguuuggccauaaccagccugcaacaugcagacaaaaauuaguacacacuuugagcagauaugaaagacgacuuaaucucucuggcauuugcaaaugcuaaguuaaaucucauuucuucuucuguugauuucauuccuaagccuuguuugcugaauuuagcucaagaggaugaaauguccagagaccuggucaauaggaaaacuugcuuucgaaugccccaugagaacaagugaaaauuuaacaggcaggcauuguucugaguuuugaaacaacccaguuaaacagcaaacaagaaucuucaacuugaccuugaaaaaggcugugugccugcagauaaucuaucaaacaacucuagaugacaaugauauauuucaaaguauugucagaugaaaagauugauaaauuugcuguugcaaagagagaacuuuggaaacaggcaacaggcacuuuagcucucugacuccgccuccuccucuguccucacugccccguccccaccccaccacccccagccgcccuuggggccaacucgguagaagaaggccaguaaaucagcacuguaauauuucuuaaggggcacggaaaagcugugaacaguacuucucauauuaaacgcaauauuucuuugcuuucguggggaacaaaagucauagcaagacgucuuuauggcuaauucagucaaaggcacaucccugguuccccccgaagaaaggucagugucguuguguuugguccaccgaggggguguuuucacacugaaaacugagccagcugucccugucauacccucgccauuggggagcgcgcacuagccaugguuauuaggcacuucuacaccugcaaaauacaccgauuuccaagacuuuucaagacacccucccguucucaugcccccuccucuugucugcuaaacuuugacaacacaauucaagcccuggaugaaagcgcugcacgcaagaagaacucuugggagggguggcccagcuaccaucucccagugucuauugagcggccaucagagaaaugaggcggcaaguguauuuucaaaaguacggaaaaacuuccagauaaucgcuucgaggugucacauuugcuauugccacauaugccaacuguugaacccuaauauuuuauuauaugcaccggugugaguugugggguugcagccaggcguccuucgcuuagaaguggcuuguuuuaaaauuuguaauuagcaugucacugacaagcgccaggagacacauuuuuuuuugaguugcccaaugccagugcacgucuauauuuuuaaaauccgaaugccaacgcuugcccaaauggauuuuauaaaacuucuagaaacauccccuagcuagacucauacccugaauccaauuccgaaggccugcgcuccagagauaggcgacuaacuagcuguuugggagacguccagcgacuccaacaggaaaagagcuagaagggauccugugcagucaccgaagagaaauuguaaaacuagaaauaauucagaaaacgcaucuuuaagagcgagaaugccccgaggugccgguaccucuaagacagaagggcuaauguaacuagcuuucuccauccgcacuuacauagggccuaggaguggggguagggaaccgaagaguccuaucuggcugcggguugcggggaggggacgaggagaggagaagagcccauuuaauuagccggcggugugucucuaauccucaucuuugucuaauccacccaaacugccgagcucuacaugagaagucccuagagugggcgaggugcagaggugcccaggacgccuuggguuccugggacacaggcagaggugaaacaccccacaugccacaggaagcggggagggggugccucucaccacaacggaacccuaaacuauuuccugaaggcuuggggccuccacacaacccgccuccaccagcaaagcgccggcgccucuccaaagcgaugucagcgcaacagguuguuuggaacaggugccggccagcuagggaugggauuggccuuaaguugcggggaucagucaagggccaagacuccccgagaagcaagggcagacccccagagguccgaaaguggggacuggcuagaaaccugcgccccccgcugcugucgcugcuagcgcuggcgccucggcccagaggcaaaaaccagcucgccacaaccugcgccccgggccacggggcccucuacaggcggccgcccgagggcuucccucccggccgcggggcguaguugccccgggccuccuccgaagaagccuggggucccauccccggaucuccuuuuggccguucgcuccccucccugcucgcugcuuccuggagccccucuuggagacuuccaugcgcaaagauagcagaacugcggagagcaaggcgucgggcagccacuuccagccucaagcgaagacaggcagcacaggagucc

SEQ ID NO: 13062 - RNA, 2725 nt, Homo sapiens
aaaaaggcauuguaaaaguauaauuuugcauuuuauucauucauuccaucagcugggaauugcucuauuguacaaauacaguuuuguacaaaaaaaucacaaaauguuacaaaauaaaaaaaguacaaacugcauuacuuaauaaauaugacuaaaaguaguuaaaguggcaaugagauugauuuuaaguuggaaacauuguuugacccagcaaaccauacaagcucuguuuacagacauuucuacaucaauacagggcaauccuauuuugccuuuugaaagaauguaaagaaauauuaagacaguguucuccugcuauaacugccaagguuggcuccagacauuuaugccauuaguuuauaaaucucuuagcuggauucaagaaguuauauaaagcaggaggcuuaucuugucacagaguuuuauaccauguuaacauucucuuacaacaacgugacaaauguaaauaaaaacaacugagagcaccagacaaucuacucuacacaucaaccaggguacagaauaaucauucugccaucagcaaauaucagacuuucauucaaguaagaccugcuacuaucccuuaaaagaggaaaaacaaaacaaaaaccaaaaaaaaaacacaaaaaaacaccuucccacaaccuuccauuaaguaauuuucuuuaaaagauucgccauuucuagaaaaauaaugacuuccaaaacaacagcucuguuucaucaaaauggaaugggccaaacaucugguaacaagaaugcaucaauauccauuugaaauaauuaucuaagaauugugaaauucaaauuucaacaacauaaaauaacuaccaaaucacaaacucuguucaaaauaauacauuucauauaaagcacuucucuggauuuacgccugaaagcuguuugucaaaauggaacacgucauagaugaagguacaccaguuuuuaaaaauguugugcaaaaauacauuuuuauagaaaauagacuaccaggaaugaacaaauuuacacugugagaaaucagcuugcaaauuaaguaaugcucacuuuauacagcaaauuauaaauagcaguaaaaucacccaaagcuaucaugaaacaucauuuaggugcccagcaaccuccagcucugagaaaacauucaaaaagaugauuaaggcauuacaccuacaguaaaaucuacuagcaaguuugaaagugcuauuacccugauuaaaguucaugugauucuccaaacacaaguuauauaugcaauuauucccaggguguaagguuuugagacauuucaagagcaugcauuuuguucaauauacauuuuagacaaggauauggccauagauuuggcaaguucuucgucgcguuuccuuugcacuugaguuuguuugcaccaguugucguacucuggguuaggauaggagugaucaaauacagcaucauaguguccguuacugagccaacugagccaaauacuaggccucagggaauccucugggcccaaauaaugaaucaugguagacaccgugggacucuccagccucccuccaguaguuaaauggauauucacauucagcaucugccccauggccagcaacuccggguacccggcccaugccccgucuugggcagcagcgaugauaaacucccccacgucgcccucaaucagggggcugaaguggucgagauggucggcgauguagugcaccgucugcucccucaacucccggugcaggcucugguccccauacaccgucuugcugacagcucgguagaggcaguugccgucuggaaugauguggaaucgguacuuauuccucugccgcagauacuuguccugcuucuccaccucggccagguauagggccagcuucucgucucugggauccgaccuggagacgaucaccggcuccgccgcacuacucggggcggccucgaugcucccggcggggggugccucggccucugggucgggccuccgcgccgcguccccaccgggcgcgucgcagcgaucgccgccccucucccagccccuggggccccucuccgccaagugcucuucgccccacggaccggggccgggaucggggcuccccggggucgccgcggggccucggugcuuggcggcggccagggccuggcggugcucgcucagucggaaguuccgaucgggccccucccgugucgcguccaagcccgcgggcucggggcagucgggccgcagcagcuccuccaggagccaggccgaggagccccgccgcggcgggaccggggcugcgggcgccggggcgagcaggaggcagcggccgcgcggggcagcggcggagcccgcggcgccgggaacgggaucgggcccgugcagcaggagccugucggcgcccagggcccgcacggugaucugugcgguggacguguagugcggcggcagcggcggcuugcaggacgcgccgggcgggccggcggcggcggaggcgggcgcggcggccccggacaccaccucgaagcaggaggagaaggcgggcaucuuggcggcggggacagcggcggcuucccggugcucggcggccgcggcgggcuggcacucaccggucucgggcucgggcgcggcgccggcggcucccgggggcugcagcgagaccuugaaggggguagcggcggcggguggcgcgggggcggcggccgugggacccggggccccggcgggguagugggugcagacgcugcuguagag

SEQ ID NO: 13063 - RNA, 5251 nt, Homo sapiens
cuccaguauggagaugaaaccaagcagcucaggaugccgaaugaaaucacaagugcagacacaauccgugcucucuucguaagugccuuuccacagcagcucaccaugaaaaugcuggaaucgcccagugucgccauuuacaucaaagaugaaagcagaaaugucuauuaugaauuaaaugauguaagguaaguugugacaucauuuuuugccugccauuuugccuuagaguuuuuuuuguuuuuuguuuuuuuguuuuugagggguuuuuuuuuacccacuauauugcauuuagaguguuuuuuuguuuuuuguuuuuuguuuuuuguuuuuuguuugguccaucauaucccuuucauagaguuuauaccaaauucuaauuucuuuauauccuagugaagaaagcagauucauuauccugauugguugggcuuauuucacccagucagaugauuucacuaucugguuuucuacaauucauuuacaggguauagcuuauaaaaacgaggacaaauuucuccgccacagauuuuugaaugcuacaucugaaaagaacauuagaaaugauucaguccaccauuuuaucuaaggguuagggaaacuaaggcccaaaaagguagcggagagaccugaucgaggucuuaagaguuguaggcaguacuucauucauauuggaacuuucccaauucccccucaaguguucuuuccuccauagaaagacccuguggacauuuuagguaaugaucccacugggucguuauuuacacauaacaaguuagaauaaaagcagugggcucuguauuauuuuccauaagaaaagagacugagaagcaucuucacuuuccauucauuucuuaaagaguuguccuuuacccaaagaucuuacuuuccagguggccuuuccccagggcccccaguugaauauccuccaaaauuaagcuaaauggacuccugcuauugaugggauugagagucaguuagaaacaaaagcaucucucucucccucucucucucucucucuuuuuuuuuuuuuuuuuuuuuuuuuuuuuaugagacagucuugcucuuucgcccaggcuggaguacaauggugcgaucuccguuuacuguaaccuccgccuccuggguucaagcgauucuccugccucagccucccaaguagcugggauuacaggcgcccaccaccaggcccagcuaauuuuuuucuauuuuuaguagguacgggguuuuaccacgugggucaggcuggucucaaacuccugaccucaggucaucuaccugccucggccucccaaagugcuaggauuacaggugugagccaccaugccuggccucaucucucuuuuuuugaagacagggucuugcucugucacccaggcuggaccucaguggcaugaucaugucucagugcagccucgaccuucugggcucaaaugauccucccaccucugccuuccgaguagcuggcacuaccggcacaugccaccauaucuggcuaauuuuuaaucuuuuguagagacagaaucucccuauguuacccaggcuggucugaaacuccugaggcaagcaauccucuagucucggacucccaaaugguugggauuauaggcgugggccaccacaccuggcucaaaagcaucuuuauugucauuuuggugucauguauacaguagaaagaacucauuugaucuguuccaaccaaacaaccuggaaaacaggacuuagaucaacacaagcaaucaguugcuaguauggucucuaaacauuuuagaacuccacagauuauuuagugacuaauccagccauuucauuuuauggaaccagaaacucagacgcauaaaauuugagggacuuauucaaaagcacacagccagcuaaguaccaagcucugccccaaauauggcuguucacacuucuuggucaagaacuuuuugauuucuucgaauguucccucaccaaaucacuggaggcagaacuugggguuucugaguccacacccuggggggaauagcaaguugcccuguuucuucaucauggaauuaauggguaccacuuuuaaaaaauaugccucuagugcauaauaaauguaaacugaucuguaucuaccaaugaucacaaaugacauauuuaggcaugugcccagguguaugaguaauuuagaacuuucaaaguuugacacaugccucaagguauagauacuacaucuguuucacaaccuuacagcuuuuuaaaaauguguuuaaauauucauggguacccaaaaauucauguuuguuuuuaaacuaaauuauuaaucaagcugucaccaaaagaaauuuuuugcauucacaaagcguaaacuugaaacaugaaauaaucacauuauauuuaaagacaauguuuguaguaauauaaucccacauacuguuuuuacauggagcugccaguuacaacaaucaucuuacauuucugccuuugcaauuagaggaauugaaggacacaguaauagcaaguaaacaugcaacuuagggaagccacacuugauuauggagcucaaggcugaugagguuauuaugaguaauugggccucacugucuugcagccugugcaaggauuuuuauauuacaaugagucaccauuuucuagagcuuuucucaagcuucaaaguauggcuacuuugccuucuuuuuuacauuguuugggaaagucgagaaguagucacaaaauaaaagaaaugagagggaggaaaaagaagaaaaggucaugauucuccuuaauggaaaucuaguugauaacauaaaugaaaccaucagucaauauguugauauuugugaaaaugaugaucuuguugauccguaaguuguaguauggauagccuaacuuuuuuuuuuuuugagacagaauuucacucggucgcccagguuggagugcaguggcaugaucucaguucacugcagccaccaccuccuggguucaaguaauucucaugccucagccucccgaguagcugggacuacaggugugcgccaccacgccaggcuaauuuuuguauuuuuaguagagaugggguuucaccauguuggccagguuugucucgaacuccugaccucaagugaucugcccaccucggccucccaaagugcugggauuauaagcgugacccacugcucccagcuugauagccuaaaguuauuuuuaaaaaacucucauuuaaaauauuuaaguggaaagaucaccgauuuauaaauuugucuguaauuuuacuuuucaguuacuuugauuuaaauaaaaaaaagaaccuaaaaauguucaaauguagacaauguuuuauuuggugaugacaguaauguuuaugcuaugugagcacaugcaugucgcuuccaaagaauuauucuauuucuugauuuuaugcauuaaaugccuugauuauauuuuauuugaaugguagaagaaauuuucaccaccagcauuauauaagacaaaaaaaaaaaaggcugggcgcuguggcucacgccuguaaucccagcacuuugggaggccaaggugggcggaucacgaggucaggagaucgagaccauccugguuaacacagugaaaacccgucucuacggaaaauacaaaaaauuagccgggcgugguggcgggcaccuguagucccagcugcuggggaggcuaaggcaggagaaugcugugaacccgggaagcggaacucacagugagccgagacggugccacugcacuccagccugggcgacagagugagacuccgucucaaaaaaaaaaaaaaaaaaaaaaaaaaagacaaaagaaaaguaucauguagauuucaacuggagacagugacuuuaaucuucuaaguucagagacaaauuucacugcacuuccuucaguguuucugaagcgugagcauauuugcuaaacaguugccuaucucaucauuguguuaggcuccucauauuuuccuuagggaaaugcuauggagaguucaggucagaauauuguguuguaaauguugccacaguaaaugcaaccccggccuuuacuguugguucaucucagaugaauauguuucuaaagucaugauaaaccaaccucaugcauuuuaaauaccuccagaaucacaguuagucuuuuucauggcucccgugagguuuucuaguuuuucacguccucgccugugacuccuuccucuggccaaauggggagcuccuuuagugaaaccccacauccuuaccucugugagucuccccuucauauucacccagcccccuuuaauaacagggcugcugguucccccucaagccgacuucuaacaagcuacuggagcaaccgugcaagcuugggcuagucauugcuucaaagcaauuacuggcggauauuuaaaggagaaagagaagacuaguccaagaauccuccacuucaguuaaaacagaaacacaagccaguaaucccagugauugggucagcccacuaaaugaggcugcaccuggaagagaggaauucuuccuccugcccacauuucucugagcuagcccagccggcauuggaagggaucacaguguagacagagccaaaagggccuuggguggcccuucugcugaugaaagcugaacauggagggagagagacuucauagauauucaugugcucuucgauaauuuuaagguaggcucugauccugucuuuugcuacguuaugacaccuuggcucuaagagccggguucagagaaaaaagaagaauuuaucugcugcuauuucuucacauccagcaauucgauuuguauauagaaaaacuaauuuucuaacccacuauggaaggaaaaaaggcaugguaaagauauuagaucuuuuugguacuguuuuuuuuuuuuuuucuggacuccagauaccuuuucuuucaguugccgaaaguguuugaaggcaaaaaaaaaaaaaaaaaaagaaaaagaaaaaaaucuucuuucauguacauucauuagauaagcagcaaaccagguguuugggaaaaguaaacaauuaaauauuuaaauaucaaccaaaucucuuugaauguauuguaaauauuggaacuuuauuuuuuuuuuuaaagccuuaguuuccauacucggaaucuugaaagaaaguucgugccacccaacauuuauggguggggaacuauacuggaggaauaauacuuucuuggggaacaagaaaaggagagaaaagcugaagucauuuuucuucuucuuuuccguauuuauaauugccuauuuuauggucacauagcuuuuga

SEQ ID NO: 13064 - RNA, 3640 nt, Homo sapiens
cuuaccucgcaggccuugagcuugucaccaucucccucagacagaccaguccgacgcguggccaucauuucauuucaaaugacaaagaagggacaaauccuuuggaguccacauuggacguggcggggaaugccaccacacacccgaaggggaagaauuccacaagcaggcuccgaggaggggcagggcuguugaaacagacaacgugccagggaauaaagguuuucaggaagcgccuucaaaugccucgcugauuucucgugacuucaacugacuucgccuucuucuuccauuucuggagacuuaaaaacaaaggcgacaggucuucuuggcagccagugucgaggccaauugcagaaagcgguccccuucuucccagugccacuccugaguccuggaaaaauccgaaugggucgugaagguucgagugucagcuccuagagagauccuaggaaaacgagaaguuaaaggucaugaacuuucuccaggcgccuaucacugucuugcccacauguccacaccaaguucgcguuuccucccgagcaaaacaaacaaaaaaaaauuuuaacguaaacaaacaaaaagccuauaaauucgaggggguguuuaaaaaagagaaaucucgaaacugcccagcgguugcgucaaacacaccuggcuguuaugcagccuucaagaaaaaauguuccccauucaagugcauuuuaauucaugucuuuccuggguagagcagagggcugugcauguuguuuucugcaucacccagacagggacacuucggugaaguuuucucccccacgaggcugaaaugggaucacacuuuccaagcccccucuucgcuccccuccgccccccaaaaacgcaagcacaaagccagccuggcuggggccggcgugggcucggcggcgucuccgggugacucgggcgccgccccuccgccccuccgccccggccggcguccccgaggaggcggcuguuuuccuuggcccgcggcggggcuggguggggacggccggggaggcgugcgcggccgcgggugggacgccggcgccgcucccgcuccagggcaugauucuggagcuacacccgagcaacucugaagucgcggcuuuucccccaacuaccacucgacacggcuucccuuccccuguggccaccuagggggaaaaaacgagaaaaagcaaaccaccacccaccuccccacgauucccccgccccuuccugaggcgggucggggaccucgagcucccgaggagagcggccccaauauggacuuucucaaaggugcuaggagccccggggcgagacaaaaccgggggccuuacccuucccgcccgcucgggcccggcggccgaagcgcggcggcgagcugaagcggagacgcuggccgggcgccgggcccggccgggacgcgcuaggccgcaggcucgguuaauauucaugagcggccccaggcgccccuccuccaaggcuggccggccggaccccagcgcccaccgccggccuuugugcccuucccuccgccccgccgcccgcccuugcuccgcacacgcgggcgcggccccuccgcccccgccgggcgcccgccgcgggcucccuccggccccgagccagcgcccggccggguggccuguggcgggaagggagagagcccgcggcaagccgggcacuccacggcccgcgagcgcagcgcccucucggcugagacggaaaagaaaccagacacgcaccagaggaagcgggacgaguggauccgcacggggcuggccggcuccgggacagcgcgccccgcccgcccgcccggcgugagccggaccccgcagccggacgaucccgcgcugcccgccgccgccgccgccgccgccgccgcgcuccgaggccgccgcccccggccggccgcucccaggcaccgccgcgaccugccccggccggccccgggcucucggccgccgcaggagggcguggggcggggcggcggccgccggacucuccccucgccucgccgggccgggccggggcccagcuccggcgcccgcgaacgccaagugacagaagcgccucgcuccguggccgcgcggagcuguuucccgggggcggauuucucgcuucuuccucccuggauccaccuccucccacuccaccuccuuccccuccccuccccaggggaggcucuggggcugaauauuuucugucuugaauaacacgggaccggggaaccgacgcuggagaagggggauuagccggaggccggagcggggugcucgccugcccccuccccgugggucgcgggaccuacaagcccucgccccccagcaccccaaaaccaggcacacaacgcuccccgccccugcagucucccaagcgcugaacggcagcguccagggaugggcuugcucccgggaaaggagaccuggugguagacgucugggguggagagggggacaagccuauaacagcgacaucugcagacuccagggaucaaagguccuagauugggggacagggcuuggcaaauugugcccccaccccuuuuuugcagcgggaaggcaaugaagcugcgacgagacgugggacuuccagauaagggaguguccccucacgccucacagcaaaaaucucuuccuguggugggaagggggaaguuagccaagcguugcucauucaguucuuucccuuuuauaaauucugcagagcggcugagcgaauuuggcgcggcuagcggaacuguggagaggcggcugcgcuucucuguccgccacacuccaggucacagcggcuccggagccgcggcacaaccgccacccuccccacccaauucccgggccuugucacagaccccggcagcucgcuccgccccgccgugccucacaacaucucccgcugcaaauuacccaaucgggagacgcgacgagagaacgcgaaccaaucaggggcugguaaaucaggcuucccuccgcccucuuccccgcccccgggugaaggccaccgcccccucggccucuccuucccaccccgccccgcuccggggagguggcuccccggcuccgagccucgcggggcuggagggggaguugcucgcagucagaggcagcguuugucaccuugucacccucauccucgcccccucccauacacacuccccuccccuucucggugcuccugcuggugcuguugagggucauuuuuauccucacugcggccggggacugccagcuauugugucugaucagcugccaccgcuguccagagggaaaaaaagaagaacaaaaccuagaaacuguggaguccucuuaccuuuuccuucuuucuuucuacacucuccccuguagacuuagaaacaucccuucuccuuccccgcccgcccaccaccugagguccuguuucuuuaugggggacaggggagcggggacaaaaaacacucccugcagcuggaguaccugcgccuuaguuuuuacaucuuccuuaaaguggaaggugccaaaccaaaucuacaacuaaauccuccgcuucaauucgagggaagacguugacgagaucauuuuuauauggccaugaaauuugcguguucuugacagccugucaccaaacaagucagcuaauaaucaagaaaagaaaaauagaauaaaauacaaggacugua

SEQ ID NO: 13065 - RNA, 3640 nt, Homo sapiens
uacaguccuuguauuuuauucuauuuuucuuuucuugauuauuagcugacuuguuuggugacaggcugucaagaacacgcaaauuucauggccauauaaaaaugaucucgucaacgucuucccucgaauugaagcggaggauuuaguuguagauuugguuuggcaccuuccacuuuaaggaagauguaaaaacuaaggcgcagguacuccagcugcagggaguguuuuuuguccccgcuccccugucccccauaaagaaacaggaccucagguggugggcgggcggggaaggagaagggauguuucuaagucuacaggggagaguguagaaagaaagaaggaaaagguaagaggacuccacaguuucuagguuuuguucuucuuuuuuucccucuggacagcgguggcagcugaucagacacaauagcuggcaguccccggccgcagugaggauaaaaaugacccucaacagcaccagcaggagcaccgagaaggggaggggaguguguaugggagggggcgaggaugagggugacaaggugacaaacgcugccucugacugcgagcaacucccccuccagccccgcgaggcucggagccggggagccaccuccccggagcggggcggggugggaaggagaggccgagggggcgguggccuucacccgggggcggggaagagggcggagggaagccugauuuaccagccccugauugguucgcguucucucgucgcgucucccgauuggguaauuugcagcgggagauguugugaggcacggcggggcggagcgagcugccggggucugugacaaggcccgggaauuggguggggaggguggcgguugugccgcggcuccggagccgcugugaccuggaguguggcggacagagaagcgcagccgccucuccacaguuccgcuagccgcgccaaauucgcucagccgcucugcagaauuuauaaaagggaaagaacugaaugagcaacgcuuggcuaacuucccccuucccaccacaggaagagauuuuugcugugaggcgugaggggacacucccuuaucuggaagucccacgucucgucgcagcuucauugccuucccgcugcaaaaaaggggugggggcacaauuugccaagcccugucccccaaucuaggaccuuugaucccuggagucugcagaugucgcuguuauaggcuugucccccucuccaccccagacgucuaccaccaggucuccuuucccgggagcaagcccaucccuggacgcugccguucagcgcuugggagacugcaggggcggggagcguugugugccugguuuuggggugcuggggggcgagggcuuguaggucccgcgacccacggggagggggcaggcgagcaccccgcuccggccuccggcuaaucccccuucuccagcgucgguuccccggucccguguuauucaagacagaaaauauucagccccagagccuccccuggggaggggaggggaaggagguggagugggaggagguggauccagggaggaagaagcgagaaauccgcccccgggaaacagcuccgcgcggccacggagcgaggcgcuucugucacuuggcguucgcgggcgccggagcugggccccggcccggcccggcgaggcgaggggagaguccggcggccgccgccccgccccacgcccuccugcggcggccgagagcccggggccggccggggcaggucgcggcggugccugggagcggccggccgggggcggcggccucggagcgcggcggcggcggcggcggcggcggcgggcagcgcgggaucguccggcugcgggguccggcucacgccgggcgggcgggcggggcgcgcugucccggagccggccagccccgugcggauccacucgucccgcuuccucuggugcgugucugguuucuuuuccgucucagccgagagggcgcugcgcucgcgggccguggagugcccggcuugccgcgggcucucucccuucccgccacaggccacccggccgggcgcuggcucggggccggagggagcccgcggcgggcgcccggcgggggcggaggggccgcgcccgcgugugcggagcaagggcgggcggcggggcggagggaagggcacaaaggccggcggugggcgcugggguccggccggccagccuuggaggaggggcgccuggggccgcucaugaauauuaaccgagccugcggccuagcgcgucccggccgggcccggcgcccggccagcgucuccgcuucagcucgccgccgcgcuucggccgccgggcccgagcgggcgggaaggguaaggcccccgguuuugucucgccccggggcuccuagcaccuuugagaaaguccauauuggggccgcucuccucgggagcucgagguccccgacccgccucaggaaggggcgggggaaucguggggagguggguggugguuugcuuuuucucguuuuuucccccuagguggccacaggggaagggaagccgugucgagugguaguugggggaaaagccgcgacuucagaguugcucggguguagcuccagaaucaugcccuggagcgggagcggcgccggcgucccacccgcggccgcgcacgccuccccggccguccccacccagccccgccgcgggccaaggaaaacagccgccuccucggggacgccggccggggcggaggggcggaggggcggcgcccgagucacccggagacgccgccgagcccacgccggccccagccaggcuggcuuugugcuugcguuuuuggggggcggaggggagcgaagagggggcuuggaaagugugaucccauuucagccucgugggggagaaaacuucaccgaagugucccugucugggugaugcagaaaacaacaugcacagcccucugcucuacccaggaaagacaugaauuaaaaugcacuugaauggggaacauuuuuucuugaaggcugcauaacagccagguguguuugacgcaaccgcugggcaguuucgagauuucucuuuuuuaaacacccccucgaauuuauaggcuuuuuguuuguuuacguuaaaauuuuuuuuuguuuguuuugcucgggaggaaacgcgaacuugguguggacaugugggcaagacagugauaggcgccuggagaaaguucaugaccuuuaacuucucguuuuccuaggaucucucuaggagcugacacucgaaccuucacgacccauucggauuuuuccaggacucaggaguggcacugggaagaaggggaccgcuuucugcaauuggccucgacacuggcugccaagaagaccugucgccuuuguuuuuaagucuccagaaauggaagaagaaggcgaagucaguugaagucacgagaaaucagcgaggcauuugaaggcgcuuccugaaaaccuuuauucccuggcacguugucuguuucaacagcccugccccuccucggagccugcuuguggaauucuuccccuucgggugugugguggcauuccccgccacguccaauguggacuccaaaggauuugucccuucuuugucauuugaaaugaaaugauggccacgcgucggacuggucugucugagggagauggugacaagcucaaggccugcgagguaag

SEQ ID NO: 13066 - RNA, 3292 nt, Homo sapiens
uccuuucagaaggaaagguccugcuguuaaauuaagcacugagccccacauuucaaccugacccuucugucugaaugugacacguuucccuccccagcccacuuacuuuaguucaggccauucauauucauaaacagauuaucugugaaugacaagcugaucccuggaaagagauggcaaguuagccccacccaccauccucaccaccauugaguuucacacugaaccugacacaaguuauaaccaccaccuucuaggaaaaccacuucucagggagcagggaggacguggccacaaggucaagaacggguuggauccuagcacacugagagauggguacccucuggcugacaccgucaggauucucaggguuaaugaggcucaguucugggaaaccagcaccccacacccucccauccggacacacugcuagauauuuuacaugcauccucccaauuggcuccagagcccagcuugcuguugcucccuuuuacagacaagccauaggucacucaggagccgccagcguguccuagagcuccugcagaggccuccacugccagagagcccccaaccuggguaccaaaggcuucaaaucucaagcucuguccacuugagcuacuuuauuuccuagcugccuucaaaaccccucagugugcuuuuuaaaaacaaaacuugaagcccgcccuggaggagucaagaggagacccaggaagaaggaggccuccagagcagcacgcgggggucucuggggcccugccgggcucgcagaagcgacuccccguggcucgcggggauggggacggcugggcgccggcgggacgcugcaggagcgagcuaccggccggaggacacggggggacgcugggaacucggggugaagggacgggacucagaguuucgucagauugggggcggggagaggaggcccggguccgaggauggaagcgauccccgccgggagggagaacaaagcgguggcccucucucucccccgacgcacggcaagcauuuaaucuacaagcagggugccagggagggaggggagcgggccgagccccaaaauagggaguuugcauuuaccacgacgccucgcccguagucuggcgccuccucgcugcucccggccauguuucucccggggaacgcgggaagggaagacggcgcgggaaggagcagggagggcgaaggcugcgugggggaugggacguggggauggggacggggacggggacggggacggggacggggacggguccgccccgccccgggcccgccggcgggaagcagcggccugacgcggauccauggccccggcgcugcgcccccuccccuggcuaggccgcgggggcgcggggagcagcugccaagccgcuaccgcucccccugagcgcgggccccggacgcgucccuugcggccgccgcugucgccgccgcccccugccggauggucgcgugcagcccccggccccgccgccaagccccgcggggacucuggagcaggaagcccgcggcaggaagagaacgugucccccaggccccugauucccagauccaccgucccagcccucgggcuaacaaucuccuugacuccucccugccagauuucaugcacgcgauugucccaagcagaagcgugaaagagccugugagccagcgugcucuuggaggaugggaaguguccuggauguguuuucaaaccuuggagccgccacccaccucucuccaccuccgcucaucucccuccaccuccccucaccucccuccaccuccccucaccucccuccaucuuccuccaccuuucuccaccuucccccaccucccucaucccagggccuggagcuggaaagauuacacccgauugcuuuuaggguggcccggaucugcagugaucagaucugggcuuugaggauccagccuuucggccuuucgucaacugcauucaggggaggagggggagagauuuuuacacauucucugcuuuaccaguuuugcaagaacaucuggucagauuguaauuguuccagguugcagcuuuacuaaagcaaucgcucuuuucugauuagaaauccuucuuguaugagucuguuguucauuucaaccccucucacaugccuaugcuccgguucuuuguccacuccuguagguuccugcuuuuucugggugugucuucauuccccaggucccugacaucucaccagcgucuucauucacucagcccaauucgggucgaagcccugaauccaagagaacuuaacacaguuuuccugaugcaggcgucuuuuguucaucuucgaauucuggcacacagaggggagaggaaugcugauuuugccuaguuuaaaggggaaauaguuaucaaucgguuaaugacguucuagguuggaaaaauauuagucauucagacuuggcgcccugguccugcucagcagggcuggcucuucaugucguuucuaagcgccagcgccuuggagggugcagcuccagagaucccugaaaucaggcaucugcuuggcaacugccuuacagaaaugggggguguuguuucucagcacacggguaaacauuuucuccuaguaauugugagagggcguuguuuugagccauuuuuguagucugcaucucacuucuuuuccccaaagucaagcaccaucuuuuauuuucauuuucaaagaccaggcccaggaaccauauucacaagcaacaucauuaaaauuuccaggagcagaaaagugcuaucauuaggaugaugaucaaacuuuagaguucacaagacucuccuggggagcugguuaaugcagcuucacuggguggggaagaucuguggaagcaccuagaauccuguaccugcugagagacaccagaugggugugauguggguggcucaugacccaugcuuuaggggauuccacuagaccaucuuacugcuuggauaucaaaacuuagccaugaggcucagugugggugcagggccagauugggggguaccaggaacuucaaaauaugucacaggaguaguugccauacagaagucaaaaagcaucaacuuugguuccagccuagacacugcggaagauguaagggaaaugguagauaaaucuucuucccuuagaaaggcuauuaguuuaaacguaaaauccaacaaguucacagugaaaaauguaacuugcuugaaagacaacaggaaucuuaugaaugugugcucaagaacauccuacauagacuuauauaggucauccuauaaagggcacagaaugaugaguaaauaguuuuuaaaaaucuaauucauuuu

SEQ ID NO: 13067 - RNA, 10304 nt, Homo sapiens
gaggcacgcuggccgccgcaggcacaggcgcagaguccacugcgcgggggcgggaccggggagcuagcugcagguacggugcuccgucuccuguggaggcuuuagcggcucguggacacugcucccccauuuccuuucauuucccccgucuucucagugagauuuccuuggugaguuauuggaggagaaaggaaggaaaacuagaagccagcccgcucccaucgcaugccuuuccccguaccgucccuuccccuuuccgcuacucgcuggucaucucaacucugcgcgcauuuuuccugcugcuucuggucgaggcuccucggaacgccgcgcagcccugcccgccacgugugugagugcgcgcacggggcccgcggccuccuccgccugcugcgcucgcccucccgccccugcucccgggaccgccccuugggcgguccuccgggucggcucugcgccugcucuuccccgggucgggacucuuccucuaggucguucuccaggaaccaguggaccugcucuuuguaaaugagcagccuaaacuaagaggagaagccuuuuaagugggccuuuacguuuuuguccaguuuuuggugucccuuguuggaaaauugucuucugagaagcgguuuuauuccuuuuuguuccaccuggucacccguaaaucuaugcacaugggccugccguaggaaagucauuuagacgcuuuuacccgaguguuuaaaagacauuuugguaauaggauuuggggaggaagauggaugccucugaaccaccgguacagaggccacucugcccgaaggaaauaaagcuucccggagaggagagaaaacacacuugagucuggguuucucacugccugguuggcuggcggagugauuaaaacaacacaauggccuggugaaccuuuuaguuccuguauaaaaaggcuuuacugaauguguagguccuuacuuugggcucuuacugaauuucacuacauaagaauacguuaaguuuuucuuuuuuuuuuuuuuguauacaguugauuuuaauuuuugucccagacgcuuagggaaaauucuccagauuucuucacaucagauugucuuccaaaacauuuuagauagauggaucuguagaucuauauuuagaucuagauccaaaucuauaucacuuugccccuuucuuuucgcccuugaguauuuuauguuugggauuucuguuuagcaaguauagagaaaaaauuuggcgggaaaccuccuguauguacgaagauucgaaccaaggacucauggaaugauaacgccauuagccaaguggauagucacuggcuaaagcuuaugaauuuucuaauuagaaggaacaccuugagacuauuuguguuaaucaguuccugaaauagcaaguaagggcaaaacaugauuucugcaguuagcaccaacuggccuuugguagccuugauguucugggguuacugaaauaaaauaauuucacugaugucuguauauuuauuaugcuuuaaaaaaugcuaaacaauuugugcaagaccucacugugguauaguuaguuuacagccaugagcagguuguuaaaucauuuggaaaaaaacuuuucuuuuuucuuagacauuugaucugcaauucuccuugccuuuugaaaguguguuuaagcaaaauuauuucuaguuuuuauaaugcucuugaaaugacacuucaaaaaaaugccuguguccaccgcauguccacagggaauuaacugguauauaccuacagggaugaacaaacugucuauaaagggguagacaguaaauauuucaggccuuuuuaggccaagugguuauguugcaacuacucaguuuugccauuguagcucaaaagcagccaaagacgguacugaacaaauaugugagcacaugaaugacugaaguugugcuucaaagaaacuugauuuaugaaaaugauggugggccagauuuagccuguggauuguaguuugcacagauccuagauccccguauauaaugguaugccugugauguacauaaacaaaugagaguuguuuuuuuuuuuuuuuuuuuugcgaaggauuauuuuaaucuauuuaaaugaauaaaauggguguagaugaguauauaagacaauuggaagguaaauaaacccuuuauaaagacagguucuuuauaauucucaaaguuauagaauuguggauacuaaaguuuucaauuaaauauucgagaucguuaagaauaugucuaacagcagaagucuaacggcagaaaaagcuuagucagcuuugauaguaauauaaagacuaagugaugaacuugcaaaauuguuuuaguugugagauccuugugauuacagaacuauacuggauugugugguccuuccacccucaccucuguuucauggcaagugggaggcccucugaaugaaaaguuugagagaauuuuuggucagaagucagaagcaguagagcuuaaccuccuuuuggcuaguuuguguccugauacacaguuaguucuccauaucugugaauuucccauucucagauucaacuaauuacagauugaaaauauuuuaaaauuuuaguugggcacaguggcucauaccugcaauccaagcacuuuuugaaggccaaggcaggaagacugcuugagcccaggaguuggagaccagccugggcaacauggcgaaacccccucucuacuaaaaauacuaaaauuagcugggugugguggugcgugccuuuagucccagcuacuugggaggcugaggugggaggauugcuugagccuaggaagucaaggcuguagugagccaagauugugccacugcacuccugccugggcaacagagugggagccugucugaaaaacaaacaaaaacacgaaaauaauggaacaguaaaaauaccacaaacaaaaaagcaaauuaguacaacagcucuguaccuagcauuugcauuguauuauguauuauaaguuauucagagauuaagguauacaggaggaugugcacagguuauaugcaaauacuacaccauuuuauauaaaggacuugcacaucugcagauuuuucucacucuaaagucaguccuauuaacugcuaauuauccaauaucccucucaaugcuuaauccaaauaauuguuaaacacaugaaagagaagagugucaagaccaaaagccuuggagugcacuaccagaaauuucccucuauucaacagaaccauuuuuaugaucauucaacaauauccucaaaucuuuuuuuuccauuucuccgugaauuaaaaaaauuuuaaaugaaccauguguaaugcuuuggugaaguccauauauaugccuucuauguauauucccgaguggccauugcagcagacguucucaaaaaagaaaugaggaugucuuuuccucauuugguugguuaaaaaauguugagccccuaaaaucaauuugugguuaaauguuacaaaauaaaauuuaguauguagcuuaaaauagaauauaucuuuauuguucuuuagaaauaauauauauuauagcacuuaacugccuucugcuagucuaaggaacauguuugugggaaauaauauugauacagaauuuacaaauugaacugucauaauuuucuuuaaaauauaucuauaucuauaucuauaucuauaucuauaucuauauauaucuaccccaaagucuugaaaaagggaagugaaguaaaauuuaaaaacaagaggguagaggggaacuaacauauaggaaaaguaagauugcaaaacauaaggugaagguaacauaauguuuccuuacaaucuacuuuuaaugaaguugauguuaagcaugguagcaagcaauauaaagcggaagaaaagaugaaagauuuacugggccaguauggugguucaugccucuaaucccagcacuuugggaggccaaagugggaggauugcuugaguucaggaguucgagaucagucugggcaacauggugaaacccugucucuagaaaaccuacaaaaauuagcuggguguggugaugcacaccuggugggaggaucaccugagcccaggagguugaggcugcagugagcugagaucaugccacugcacuccagccugggugacaguggaagacccuuucucaaaaaaaaaaaaaaaauuacugcucaugaaaaccaucuacucagauuauauacaauuauuacuaauacagguaucagaaaguuauguauugcaaacucaaaaagaagaaacuguaauguuacaagcaaaagcuuccugaauaggagguuaaucagacuguuuuauguaagugcccuaaaagcaguuugugcuuuuaaaguccaguaccagaauaugguuuaauaaaauaaauugauguuaugguucaaguauauaauucuuucuggucccugguuuacuucagggaaaggauuagacugugcauggcaaaacaguucuugauucgugggugaacaccacgguauucucugaagguuuauaaaccaaaccauaaaaaaaaugcacccugccuuguaccuacauauuuggguucaauuuauauauuccuagcccacugucagugagugacaaugauuaaucuuacuguaaauauuuugugcuaaccacuaugauaugugcuuugauuuuauuauagacacuuauauagcuaagagguaucuuuuuguggcaagaguuuuauuugggcuuuuuauaguggauauuauuacauaugaauauauagugauuuugauagauaauauagccuaaaaaacaacucagacacuaauuucauagcuuuagucugcugacuuuuuccccucugaucauuauacagccaaaucauuaaaauuccagauauccuucugaaaaguuuuauauuuguuauuauuugguuuuuuauugcuugaugguagaaauuccuucaguacuguuuagugaaauucuuuuuauaaugagacacacauguuuaaaaacaguauuuuaaucuucuaauaacagauuuggggaaacauaugaaaagggucaauuuuucuguauuuuuaaaauuucagaugagcuuuucaaauaauagacuagucuauguguagaauuuuaugauacucuauacaguuaugauuaacuuaaauuuuuuuccauuauagacuccacguuuugcaaagaucgguuuugccucagagucaacaaacucuucagauugguuccgguguguccuauguuuacaagucaguggaaauuaagcacaacacauauaaauugaaaagucaaauaaggaaaugaauuaccucccuugacggcucuaauuuuacuuguaaguuaaauucagaguuagcuuaaaaucauuuaaauguuuaauuacagaacagaguuuaaguagcauagaaagucaguauuacaugauuaaaaguuuucagaacauauuuuaacauaugaucuaguauuuaauaugguuuaguugcauauugcuucuaccagagaacacgugauaagccccacuaugugucugugacauuacuucaggcaauuuacaugaacauugcacagguauuauacugcauuuuacguaacuaaaaacuugacuugucuggcauacauuuuuguuuuaauggugaguauauuuccaaagacaaggacuuggucaauaugggaaauuauagagcuucuuuggaugccagaauaauuguugucucucaucauuggaaacauuccugagguucuuggcuguggcccuggggucuggaaauugaguuaaaucucuccacugaugauuauaggguuagaaacaaaagugaugguucugugcagauaagguuauauguagccuuugaccucauugcugauuauuaauuuuucuuaacuauuuguauaauauaccuuucaccuuggcucuuuuuaaagccuucaauaugaauaauauguaacaaugauucuuaauaugcguguaaaaggcacauaagaaagaaaaugucauaccuuuguccuguaguuuggaaaacuaagcauuuuauaagcaaauauguucuuuuauucugguuuccuguuaugacuucuauaagaaauuuaugaguaauauagucugucacaauguucauauaacugaagagaaauuaaauauaaagaauauuguucaacuuuugugaauugcaaguagauagcacuccaacuccaaaucaucuuuauaugugauauaaacugauaaaccaugaaauaauuuucauuaaaagaucucaauaugaaaagaaauaguaauuugauuuaguguauauauacuuuuaaaagcaucuacaaucuggcacuuugugaauacaaguuucuguuuuuuauaguuacaaauuuugucaaaguuuugauuuuucagugucuugagauuuuaaaagauaucauuaaaaggauaauaugcaauauauaagaauuuggguuggaauacuuuuuuuaauuccauaaguuuggaagauuuuuaaacaguuuauguaccaugggcaugguuauauucaguccuauugggauuuuaacaaucuacuguaauuaguaaccaaauuaucuuuuguuguuuuuuguuuguuuuguguuuugaaaagggcuaaagccaauuuuuagguuggcuugggcagaaaagugaaaagagaaugcuccacuuuaaccgaugucaucaucugaaaaagauaacacagaaauguuuuucuaguauacauguuaaaacggauaaacaugcacagcgauuucuuucaagaaccuuugcacuugcggaauugaggaagucaugguauucaacccacucucuuguuggagacaaaaauauuauccugaugggaccuccuggugcugggaaaacaacaguaggcagaauaauaggucagaaacuagguuguugugucauagauguggaugaugauauccuugaaaaaaccuggaauaugagugugucugaaaaauuacaggauguugguaaugagcaauuuuuagaagaggaaggaaaagcuguguuaaacuucucugcaucuggaagugugauuucccuuacuggguccaauccaaugcaugaugcuagcauguggcaucugaagaaaaauggaauaauuguauaccuggauguaccucuacuagaucuaauuugucgucuaaaauuaaugaagacagauaggauuguaggucagaauucuggaacaucuaugaaagacuuacuuaaauuuagaagacaguauuauaagaagugguaugaugcucguguuuucugugaaaguggggcuuccccagaggagguagcugacaaagugcugaaugcaauuaaaagauaccaagauguggacucggaaacauucauuucaacaagacacguuuggccugaagacugugaacagaagguuucagcaaaauucuuuagugaagcuguaauugagggguuggcuucugaugguggccucuuuguuccugcaaaggaguuuccaaaauuaagcugcggggaguggaaaagccuaguaggagcaaccuacguagaaagagcacagauacuguuggaaagauguauccauccugcagacauaccugcugccagguugggagaaaugauugaaacugcuuauggggaaaacuuugccugcucaaaaauugcuccugucaggcaccuuucaggcaaccaguucauccuggaguuguuucauggaccaacaggaucauuuaaagauuugucuuuacagcuuaugccucauauuuuugcacacuguaucccaccaaguugcaauuauaugauacuuguagcuacuucaggagacacagggagugcagucuuaaaugguuuuagucgucuaaauaagaaugauaagcaaaggauagcugugguugcauuuuuuccugagaauggaguaagugauuuucaaaaagcacaaauaauuggcagucagagagaaaauggaugggcaguggguguugagucagauuuugauuuuugccagacagcuauaaaaagaauuuuuaaugauucugauuuuacuggcuuucuuacuguggaauauggaacaaucuuaaguucggcuaacuccauaaacuggggccgacuacuuccgcagguaguuuaucaugcuuccgcauaucuugaucuuguuagucaaggauuuauuucuuuuggaagcccagucgaugucuguauucccacaggaaacuuugguaacauuuuagcagcaguguaugccaaaaugaugggaaucccgauucgaaaauuuaucugugccucuaaucagaaccauguuuugacugauuuuauaaaaacaggacauuaugaucuaagggaaagaaaacuagcacaaaccuuuucaccgucaauagauauucucaaaucuucaaaccuagaacgacauuuacacuugauggcuaauaaagauggacagcuaaugacagaauuauuuaaucgauuagaaagucagcaucauuuccagauagaaaaggcucuaguugagaaacuucagcaggauuuuguagcugacuggugcucugagggagagugccuagcagcuauuaacuccaccuauaauacuucaggguauauuuuggauccacacacugcuguugcaaaagugguugcagauagggugcaagacaaaacuugcccugugauuaucucaucuacagcccauuacucaaaguuugcaccugcuaucaugcaggcuuuaaagauuaaagaaaucaaugagacuucaucaagucagcucuauuugcuggguucauacaaugcauuaccuccacugcaugaggcuuuauuagagagaacaaaacagcaagagaagauggaguaccaggucugugcagcugauaugaaugucuugaagagucauguggaacaacuuguccaaaaucaauucauaugaaagcuuucagaguaaauuuuuuuuucuagcuauaagcaugcaauaauaaaucucaaacacugauuuggaguacaguagcauuuugucuuuuauguaaauaucucuauaucuguuuggaauuucaaaagucugaucucuagggcugacaugagaacuccaugucaccuccucagaucuuuaaucuggaagugacaaaagguaacacagugcacggaccuuugagcuaucauacuuuugccuucugcucaugagggguguaucaauuuccacucccacacccucacuguuauguggaccaaaaugucugguauacuauuuggcgauuaaaauauuuaagcccaguuuucagguacuacaucuguaacuagugaauacucuguugauuagaaaguuaauuuaccacucaaaauggcuaacuugaauggaggaaguaguaaacucuucuauuaggauuugggccaguguuuuuuguuuguuuuuuggugcaguuucagcucacugcaaccuccgccucccagguucaagugauucuccugccucagccucccagguagcugggauuacaggcaugcaacaccacacauggcuaauuuuuuuauuuuuaauagagaugagguuucgccauguuuuccaggcugaucuugaaccucugaccucaggugauccauccaccucggccucccaaagugcuaggauuacaggcgugagccucugcaccuggcuagggccaguguuuuuaacccuccucaaauuccauuuuggacuacaacuaauguguaucucacacuguccaaauuaaagauguacucuguccuucacucuccuuuggauguguacgguuagggugacgauguuugaaaaucaacacauaacugaaauccaggaugaaacaguaagcagaacuacuuagaagugaauacagaaaugaucuauuucaagaggaagguuuuccaaaauuaagaguacuugaguagucucaauaggaguguauuuguagacagcaguuucccuauauuauuuggagucaauucuuacguaauuuguuguuuauuucuucagugaacauugucuuuuucuggcagcugaaacugcacacaacugauacacauauuuaauuuguauuccuuuguaguaauacauuuuaaccaugauuuauguuugugaauuuacuggauguuuucuuucugaauuaaagauugucaagaccaauuaguguaauggacuacugucaaccacaagauggcauuccuaacauaauuugucuuugauaacauucaguuucauuuucugggagaacaaccuccauaaagaaauauauugaaaguuguaaugaaaacauuuuaauaguuuaauaagcaagagaaauuuguuuuaauuuuuuuaaaauuaaaccaauuauauauuaacaccagaucucuggcuuagcuucuaaaaaggagguucuaaaaccaaaaauugaaaaucagga

SEQ ID NO: 13068 - RNA, 2020 nt, Homo sapiens
uggcccaggccccggggccccugauuggggccgcggcgguguaaguggggccuccacuugcgccggaggccguggaaccacucggucuccagaguggcguuggccagguggggugcggaggaggacaggucuuggagcaggaugcggcucuccucgcgcguggccuggaggaagaccuguggggccggugcggacagcgaaucggugcugaaggugauggccgcccgggagaugcugggcucgcccuccagaaggcuccacaccagcgccugguaccaauccaggucguccugcaaguucugcucccgcgacuuauugcucugcagcaucacguugaggaaguugguggcgugugucaguguguccagcgcccggugcaaggaggggugcgcgcuggccagggcuggccacuuccccggcaggcccgccaacucguagcggccggagcaguuggcucgcuucagcuggugggaguccccgguguagagguaagaggccacguccaugggcaccuccucggcgaguuucugcgccaagauggugccaucgguggagcggcuccagggagccgaggaguccgaggcagaggcucgacccggcugcugggcgugcggcuuccccuucgggguccucucucgaggggaauccggccguccuugggggucgcggcuggcgccaacagcucccaaucccagcugagcaagcaggaggcagaggaguaagggguaagccauggcucccaucugccucccagagagaagaggagggaacgggaggggggggaaucacuuuuuaaauuuggaucgucaguuucucaacagucagacuuuuucgaggagucuucccccuucuccagauggcacccaguccaaaggacuugaaaauaagaauguuucgagauuggccccggguggcuaagcuaccgucgcagaaaucaagucaccuguggcagcgcuggccgugcccgcugcgcgaggggccggcuggggauuacgcaccucgcagccuggagccgagcggguuacauggccucgcgcucccagcggcuggagucagcccgaguccgucucucggcccggcugccgccaccgccgcucucauugaggcgcguucagaagcugcugcugcugcugccgccgcggccgccgaagacgcugcuccauagucucacccgccgcaggucguucccgccucccggcacuggcuccuccucgaccgcuucgcccggaggcgcggggcgcgcgcccagacccgcaccgcgagcgcagccgcgacucccgaggagcgaagacguccuuuaagacguucgucuguccggaguagcgaaggccgggcggcugguuaauugcagccuuuagguuuggccgcaaaccacacuccacccucucucccugcucccuccucgggggaggaaagccaguuuaaagaggcagcuuggccgcaaccaaacccuuguagggcggcugcaagucgucuuguucccuguuuggucggcuccucugucaaucagccgacugccauuuguggggccggggagggagcuguccagugcugaacccgaggcggcccgcgggcggcgggggcgcgggaggcagccugccgaguccucgcacccacucgcguuccggaugacucggaaaccugcguggguggcguagggugggcggcagaggggggagaagcagagauucgguggcucagagcgaaggaaacuuggacguacugagggggaggguguuggcgucuugcaugcuuaguuaaaucagccuuuugccuggaaaagagggagaagggaguaguuuucauuucuaggugaaauuagacagaagggacauaggauggagacguguccuccugagcaucugcucauuuuaggcaaauuaucaaaucaucuuucuuguugucaguuaaagaaaugauuaaaacauacuugucuaggcucaucuuagcugagggaguaauggagaaaucuaccagcugugcuuuaaggagagaaaaaaaagucauauuuaaggaaucu

SEQ ID NO: 13069 - RNA, 12181 nt, Homo sapiens
caguagggcuuugagcuaaaagacauacagugacuuuugugauaaagaaaccaaagaaggucgugaaauggguauccaaaaaaaaaaaaaaaacgggcagccuguggcgcugcggcuggauaaagaacaucagggacaggaaggcuguaauaagauuccaccaccaucucugcccaucacuagggcuggaggcagagaaaaacuuccccuacucaagaaaaagaagcuauuuuugucaaguuaaaugagccugaaccugcagagcugaauuggcagaugaauauugcuaauuggugcaguuucuucggugcaggaaagaguuuccaaucagaccggcaauucauuggccacaugaagguaauuuauuaauaaaaaugaacugaaguuucagaauccuugauaaugaugagcucaugguccuucaccucccuucccuucccuagaaagaacacccuacaacaaugaugccucagugauaucuucuccagcccauuccauauguggcaacauuucaagugguuuuuuuuuuuauuaggaauuucuacauuuaguugucaaaucaagcugcucuaaaugccuaauucugauucucccuucaucaacagacuuuuugaggaguuccugauucaaaguaaccaggaaagucugcuaacugcagcuuaauucugaaaagugaaggggaaaacaaaacaggagaaacagucucccuuuaaaaaaaaauuaacuuuauuuuucaguuuaauaaauuugacaaauguauccuccuauguaaccauaaccacauuaagacauggagaauugaccucaccccaaagaauucugguuuccuuugcaguaaccacucuccccagcccuggucauagacagccauuggucuccuuucugucauuguagauuaguauugccuuuucuagaauuccauauaaaugaaguuaucugauggcuuuuuaaaaagucaguugaacguuuuuugagauucaaucuguguugcuguacaucauuaguccaugcuuuucauggcugaguaguauucuauuauauaaacguacuccaauauguguauccaugggcauuuggguuguuucuguuuuagcccauuaaaaaucagauggcuauggguauuaguguccacguauuuguguggacauauguucucauuucucuuggguaaaugccugggggugggauugcugugucauauaguaaguguauuuuuaacuuuauaagaaaccaucagcuguuuuccaaacugacuguaccacuuuacauuuccaucaguaaugccugagauuucuaguugcuccaaaccagagccacugaaauggguauaaagugguaucucauuguuuuaaucacauuuuccuaaugacuaguaauguuaaguguuuuuucauguguuuauuggccauucgugaauuucuuuuugugaaauguuugcaaaaucuuaugcccauuuuuaaaaauagggccauuuuguaacuguccaauggguucuccuugccugcugcccaaguaaaggugauuuaucaaggaguuuauccuuugcaugcccagguaaaggaauugcaguagagagggcuuaauucacucagagccaccugaaugggagacuggaguuuuacuacucaaaucagucucccugaaaauuuugagaccgggguuuuuaaaggauaauuuggcagacaggaggccagggacuggagagugcugauugguuaggucagagaugaaaucacaggggaucgaaguggguuuuucuuguugucuucuguuccugggugggauugcagaacugguagagccagauuacuggucugggugcuagcugguggaucagaaugcagggucuggaaaauaucucgagcaccagucuuagguuuuacaauagugaucuuaucccuaggagcaauuggggagguucagcaucuuguggccucuggcuguaugacuccagaacauaauuucuaaucuuguggcuaauauauuacuccuauaaaggcagucugguccccaggcaagaugggaguugauuuugggaaagggcuguuaucuuuguuucaaaguuaaacuauaaacuaaguuccuuccaaaguuaguucagccuaugaccaggaaugaacaagggcagcuuggaguuuagaagcuagauggaaucagguuagauuucucucagcgucauaauuuucucacuguuauaauuuuuacaaagguaguuucaauuggucuuauuauugaguugugagaguucuuuauauauuauauauuauauauuauuucuuuuuuuuuuuuuuuugagucagggucuugcucucucacccaggcuagaguacaguggugcaaucauggcucacugcagccucaaacuccggagcucaaggguuccucccaccucagccuccugaaguguuagaguuacaggcaugaaccauggugcuuggacaauauauucuuuggucucuuucauguaacugaauuuaaaauuuugaugaaguucaguuucuccauuuuuuguaguuuguccuuuguguggccugaaaagcuuugccuaccccauaauugugaagaucauugucuauaauuucuuuuagaaguuuuaugguuucagcuuuuaaacuuagaccuauacuccauucugaguaaauuuuugcaugugacaugaggaacucauugagguucuuuuuauuuaaucaaugucuauucaauuauuugggcacuguuuauuggaaagaccauccuaacugaauuaccuugcugccuuuauaaacaaugaguugaccuguggucuacaggucuaucuguaugcaaauacugcauuaucuugauuacuguuugcauuagucaguucuaauuagucaguuggcugccaaaagaaauacuugagacuggcuauuuauaaagaaaagagcuuuaauuggcucaugacucuucaggcuguacaggaagcauagcggcuucugcuacuggagaggccucaagaaacugaaaaucaucauggaaggccaaggggaagcaggcucaucuuacacggccagagcaggagcaagaagggaggaggggaggugccacacacuuuuaaacaaucagaucuugugagaacucacucacuauacaguaccaaguggggauggugcuaaaccauucaugagaccuucuccccaagauccagucaucucccacuaggccccaucuccaacacuggggauuacaauucaacaugagauuugguggggacacauguccaaaccguaucacuguuaccauacaggacaucuugaaaucagaugguuauaucuugaauuuuuauucuuuuuuuaacucaaaauuauuuugacuauucuauguucuauguucuuagcauuucuguauaaauuuuagggucaauuugccaauuucuacaucagaagaccguugggauuuugauuagcauaucguucaaccuauagaccaauuugaguagaauugacaucuuaacauauugaguuucuuguuccaugaacauaguauauaucuacacuuguuuauguuaucuuuaauuucuuucaacauguuuugaaguuuuuaaagcacagaucuugcaaauauuuuauucuuaaauagcucauauuuuuagauaauaugcuaaauaguguaguugaucacauuuuauuuuccaauuauuauuaccaguauauagaagcacaacauaguucuuauauuaaauugaacccuaugacuuugccaaggucauucguucuaguagauuuuugaaguuuucuuaugauuuucuauauaaaugaucaugauguauacaaagauauacauuuuuauuucuuucuacaacuguaugcauuuuauuaauuuuuaaauuuuaaacauuuaauuuuuguggauacauaguagguguacauauuucuggacuauaugggauauguugauacaggcaaacaguguguaauaaucacaucaaggcaaaugggguaaccaucaccucaagcauuuauccuuuguguuacaaacaauccaauuauacucuuuuagauauuuaaaauguacaauuaaacuauuuugacuauagucacucuuuugugcugcaaauacaagaucuuauucauuguuucucacuauuucuuuguauccauuauucauucccacgucccccucccaaucccccaacuacucuucccagccucaggcaaccauccuuuuacucuaucuccaugaguuugauuguuuuaauuuuuaacaccgacaaagaagugagaacaugcaaaguuugucuuucugugccuggcuuauuuuacuuaacauaaugaccuccaguuuuaucuacguuguugcaaaugacuggcucucauucuuuucuauggcugaauaguacuauauuguauguguguaccacauuuucuuuauccauccuucuguugaugaacauuuagguugcuuccaaaucuuggcuauuguggauagugcugcaauaaccaugggagugcagauaucucuuguauauacugauuuucuuucuuuuggauauauaucuagcagugagauugcuggaucauaugcugguagcucuauuuauaguuuugugaggaaccaccaaacaguucuccagagugguuguucuaauuuacauuaccgcaaacacuguacugggguuuccguuucuccacaauuuugucagcauuuguuauuguccaucauuuggauaaaagucauuuuaacuggagugagauaauaucuuauuguaguuuugauuugcauuucucugauucuuaaugauauugagcaccuagucauauacuuguuugcuauuuguauaucuucuuuggagaaaugucuauucaaaucuuucgccaaguuuuuaauuggauuauuagauuuuuuuuccuauagaaucguuugagcuccuuauauguucugcuuauuaaucccuugucagguggguaguuugcaaauauuuucucccauucuguguguuaucucuucauuuugucuauuguuucccugcugugcagaagcuuuuuaaauugaugugaucccauuuguccauuuuugcuuuaguugccugugcuugugggguauuacucuagaaaucuuugcccacuccaauguaacgcagaauuuucccaauguugucuuguagucauuucauaguuuuaggccuuagauuuaagucuuaaauccauuuugauuucauuuuuguauauggugagagauagggaucuaguuucauucuucugcauauggauauucaauuuuuccaguuccauugauugaagagacuguuuuucccccauguauauuuuuggcaccuuuacugucaauaaguucacuguagaagucuggauuuguuucugaguccuccauucuguuccacuggccucuauaucuguuuuuuugugagugccaugcuguuuuggauacuauagcuccacaguaucauaugaaucagguaauguaauuccucaguuuuguucuuuuugcgcaggacagcuuuggcuauucugggucuuuugugguuuuauauagauuugaagauugauuuuuccauuucugugagaaagucauugauauuuugauacggauugcaaugaaucuguagauugcuuuggguaguauggauauuuuaacaauuuugauucuuccaauccaugaacauggaauaucuuuccauuuuguguguguguguccucuucaauuuuuugcaucaauuuuuugcaguuuucauuguagagaucuuucacuucuuuuguuaguuaauuccaggguauuuuauuuguagcuauuguaaaugggacuauuuucuugauuuuuuuucagauuauuugcuguugguauauagaaaugcuacuguuuguuguauguugacuuuauauccuauaauacugaauuuguuuaucaguucuaauacuuuuugguggagucuuuagguuuuuccaaauguaagaucauaucuucugcaaacaaggaaagaaagauccuuugaauuucugugguauugguuuagugucucugguuguaaugucuuuuucauuuuugauuuuauuuauuugggucuucacucuuuuuuucuuaguuuggcuaaagcuuuuucaauuuuguuuaucuuuucaaaaaaacaaacuuuuuguuuuauugauauuuuuauuguauuuuucauaucaauuucauuuguuucuguucuaaucuuuauuauuucugcucuucuaccaauuuugacuuugguuugcuguugcuuuucuaguucuuuaagaugcaucguuagguuguuuauuugaaguuuuucuuauuuuuucgcauaagcacugauagcuacaaacuucccucuuaguacugcuuucacugcauacguagguuuuaguauguuguguuucgguuauccuuuguuucaagaaauuuuucaguuuauuucuuaaucucuucauugacccagugaucauucaggaacauauuguguaauucccaugugcuuguauagauuccaaaauuccucuuauuaauuuauaguuuuauuccauugugaucagagaagaugcuugauauuauuucaauuuuuuuaauguguuaagacuuguuuugugaccuaacauauggucuauccuugaaaaugauccaugugcuggaaaguaugcuucugcaguuguuggauuaaguguucuguaaauaaucuucuagguccguuuuguuuauagugcagauuaagucugauauuucguuuuugauuuucugucuggaugaucugucuaaugugaaaguggggugcugacuuuacuagcuauuauuguacuggggucuaucucuuucuuuaauaauaauugcuuuauauaucugagugcuacaguguugggugaauauauauuuaaaauuguuauauucccuugcugaauugacauuuuuaucauuauauaaugaccuucuuugucucuucuuaucauauuagucuuuaaaccuauuuugucuauuuuaucugauacauguauagcuacuccugcucuuuuuugguuuccaauggcaugaaauauauuuuuccuguaagcaacacaccauugucuuauauuuuaaauccauucagccacuuuaugucuuuugauuggagagauuugucuguuuacauuccguuuuauuauugacaaguaaggauuuacuccugccauuuuauuauuuguuuucuguuguuuuguggccuuuuuuuccuucuuuucuuucuuccuguauuccuuuaaauauagcuguuuuucucugcugauauguauuaauuuccucuuuaaggccaauaauucuuagguuugccccuuuuaggcuauuuucuagaucuuguaggcaugcuucauucuuucauauuuuuugucuccucuguguauuuuuaaauagccugucuucaaguuuacuaauuauuucuucugccugaucaguucugcuguuaagacugaugcauucuucaguaugugaauugcauuuucaacuccagaauuucugcuucauuuuuuaaaauuauuucaaugucuauauuaacuuuaauagaauucugaauuccuucucuguuaucuugaauuuccuugaguuucuucaaaaccgcuauuuugaauucucugucugaaaggucacauaucucugucucucuggcauuggucccuggugccuuauuuaguucauuugguaaggucauguuucccuggauagucuuaauguuuguggauguuccucuaugucugggcauugaaaaguuaaguauuuauuguagucuucacagucugggcuuguuugugccuguccuucuugggaaggcuuuccagguauuugaagggacuugaguguugugauccaaguuuuuggucacugaagcuguaugugcauuagggagcacuccaagcucaguaaugcugugauucuuacagacuccuagagguacggacuugguaauuuuggauaagauccagaaaaauuaucuggauugccaggcaaagucucuuguauucuucucuuacuuucucccaaacaaacucucucucucucucucucucuggugagcugcucucuggugagcugggggcgagguaacacaagcacccuuguggcuaccaccacugagacugugcugggucagaccuaaaacuagcagagcacugggucuuucccaaagccugccgucaccacuacuugguggugaagccaggcagucuuguguccuucccuucaggaaguuccccccaggccucaggcagguccagagaugccauccaggagccacugaaacuucagaaauguacuuggugcucuauuuuacugugacuaggcuggcaccaaaaucacaggauaaaguccuucucacucuucccuccccuuuccccagacagaggcaucucuccccauguccaccaccacaaguucauggggauuucugccaggguaccacuaauguucacuuaagguccgagggcucuucagucagcuuguggugaaugcugccaggccugagacucaccuuucagggaagugggcucucuucuggcccagaguagguccacaaaugccauccaagagucaaggccuggaauugggaacccgaagagucuacuugguguucuuuuucacuguguccaagcugguaccuaagcugcaaggcaaaguccccuuuauucuucccucugcuuuuucucaagcagaaggagucucucuucauaaccaccacaacugugaauaugcuaagucacaccugaaaucagcacaucucagagucucacucaaggcccauggcauguacuaccugguuaccacugcugauuuuucagggcccaagggcucuuuagucagcagaggaugaauccuuccagaaccggauccuucccuucaaggcagcagucuaucuucuggcugagugugugucuagagauauuguccaggagguaggaccugggugggaggcuuuacgacucuguccagugaccuauccuacuguggcugagcuguuaucuaagaugcaagacaaagucuucuuuacucuuccuuguccucucuucaaguggaaggaagggaucucuuuuggagcugucagcugugcugcuugggguuggaggaugggcaguguaaacacucccuggccgcccuggcuggugucuugcuaaaucacgugccccccacguccacuggcuacaagcccagcucagcacuaagacuugccuaggauuugcaguccuuguggccuagccugccuuucaaguuuauuuagaaccccagagcacuuaaacccaggguggcaaggcuugugguauuucaaguuacaacugcuggaaugggcaauuccccucuggcuacagcuggucuaaauuuuccuuccauguuaauuggcugaguucugccugguguuggcagcacuaaguucuaaugccaacucccacagucacuacacucuccuucccaaagcacagaguuuugccucuaugccauguggcugcugccaggagaugagggaggguugguguuggcaauacaagacugucuuuccuacccuguuuagugccucuuucaguaauaugaaguuaaaaucagguacugugauugcuugccugauuuuugguucuuaugagaguguuuuuuuguguagauuguuguuaaauuugguguuucuccagggaggacaaucagugaagguuucuauuuagcaucuugcucuacuuccucucacauuuuauuuaguuugauccuauugcauugacuaugauuuuuguaaaguguugaaauggugacaaugguaucuuuguuuuucuuccucaucuugguuuuucaccauuaaguaugauaaugacuaugagauuuuaucauuauccuuuaucauagugugaaagucaccuucucuucuuaguuuucugaaaguucuuagagaauuaguguuaaauuuugucagauaauuuucugcauauaugaagauaauuguguguaauuuuuucuccuuuguuuuguuaauaugguaauuacauugguuuccaagcucuaaauugaccucucauuccuggaauaaaacccacuugguuauaacauguuauuuuucuauauacuacuggauucaauuugcuaaauauuuuguuaagaaauuuuacauguauguuaaugagggauauuggucuguaauuucguuuucuugcacaauguuugccuauuuuuggaaaugucgaccugugaaucaagcugggauaauucuuuuuuucuauuuuacaaaacgucuuguaaaauauugguauuauuauuuucuuaaauauuugauagaauauaccaaugaucccaaccgggucugacauuuucuuugugggaacauuuucaauucaaauuuaauuucuuuaauauguaagggcuauuaaguuuuucuauuucuuuuuauguaaauuuugauaauuuuuaaaggaauuuuuuauuuaauugaagaugucaaacuuauuggcauaaaaucauuaauaauuaauguaacauaaagaagaucuguagugaugucuucucugucauuuauuauauugcuaauucauauaauuucacuuuuuaauuuucuggcuagaaauguauuuauuaauauuuuauagauuuuucuuuuucuuucauuuauuuuaucuauucauguuuuguuucauugauuuuucuguucuuauuuuuauuuuuucuuuccuuguauauacuugggguuuacuucacucuuuuauucuauauuccugagauaugagguuaaaucaugagacugcucuuuuuuucuaacuuagcauuuaaaaguuacaaauuuccuucuauauacugcuuuaccugcauccuacaaauuuugaugcauuaaguuuucuaucauuuuucaguuuaaaauuuauuuucugauuuucccuuguuauuucuucuuugacccauggacuauuuaaauguguguuguuuaauaucaaaauuuaagagaccugaaagauauguuuccgcuuccaauuuauaguuaauugcauugugaucaaagaauauuuucuauaagacuucaauccuuuuauauacgccaagauuuauuguacagcucaacagagaguuuauccuagccaauauucuauauuaacuuugagaaauauacauucuacuuuuguuaggcuaaguugauugacaauuuugcucuagacuuuuaagcauuuauggauuuucuuuaucugccugcucaaugaauaacauaaagagauuuguugcaauuuacaauuaccuauguguauuuauuucuccuuuuaguucuguuuaguuauuuccauguauuuugaagcucuauuuuuaggcaagaugcauacacauuuagaaauaugauauuuuauucaagcaugaacuccuuuaucaguauaaaaugucccuuuuaugucuggcaguauuuauugacccaaagucuacuuugacugauauuaauauagccacccccacuuucuuaucacugauauuugcaugguaaauauuuuccauccuuuuacuuuuagccugucugugucuuuuuaauuuaaaguauauuuuuuguagauaguuuauaguugggucuugccuuuuuauccagacugacaaucugugcuuuuaacagaaauauuuagaccauguauauuuagugaggaucucaauauggugaauguaucaucuuaccauuuguuuucuauuuguagcaucuguauuuccuuccuucuuuucucaugugcugccuucuuuuggauuaauuauauuucuuuaguauuccauuuuauccauguauuaguuuauuagguuuacucuuuugauauuuuuuaaauggcugccuuaggguuucucauaugcaucuuuaacuuauuagagucuacuuuuaaugauaauucaauucucccuggccauuguguuguuauacauauuauuucuacauauguuauaaaccuaauaauaaauacaguguuaauauuuuugccuuaaauauuugauauuuuugccuuaaauauuugauauuuuuaaaaauauaaaaagaaauaaaaauggacuacauauuuauuauuucuuacacucuucucuuuucaauauuuucaucugguaucauuuuccucugccugaagaaacucuuagagggcggauauucugcuaaugaauuaucugagcaucuuauuuaucugaaaaauccuuuauuuugucuucaguuuugaaggauauuuuugcugcauaugaaauucuugguugaugauuuuuguuuguuuuaaca

SEQ ID NO: 13070 - RNA, 476 nt, Homo sapiens
gaacuggcccggcccucacgugcaccaugucuggcuccuccagcguugccgcuaugaagaaagugguucaacagccccggcuggaggccaggcucaacugcauaaaaguuucccaggcagcugcagacuucaaacaauucugucugcagaauguucaacaugacccucugcugacuagaguaucuucaaguacaaaucccuucagaccccagaaaaucuguucuuuuuuguaguaaaaugaauuucaaaaguuucccaaaccacuucuuaugauccaguggauauucaaaagagagcuaaauuugaagccuguacaaaagcuuaucccuguagcacaugugcuguaauauacgaacuucuaguuucaucagucuuuaacaucuaccucucugaauuucaugaauuucuauuucacaaggguaacuguuuuauccacacuggcagcagcauacaauaaaacucaguaugaaaaaaaa

SEQ ID NO: 13071 - RNA, 2505 nt, Homo sapiens
uguuuucaaauagaccuuauuuuugcuaucucuuuguuagguguuaacugaagcaauucgaauauguccagauucauuuggauucauauuuacauugaaaaaacucaacuaagcauuuguuauccacaacaaccuagaguuuaaaaagaucguauuuucaccugucuucauuacuuucuauguaguuucauucuuugucgugguaacuuaaauuugaaauuggaagaaucucuugggauagaagaaagauucuuaccuggugauggaacuucauacuucauccuguguaagaguauuaugggaaguagaaauucacuuccuuaaauccaucguaagauugagccucaaguuugcaauauacaauuuuaaaaauacacauacauacauacauauguauacauuuccaguuuuaagauuuugcgagggucuuauaagaaaacaaaaauucccucaggcuauagaauuauguugucauauaucagaaaaguacugauguauccauuuauauccaaugcgcaccacaccggcacauugugauuuaauucaccgcuugaaucuauauuucuaaccacagugacuucaguaaaaauaccguauaaugaacauuucagcuucuucuuacuuacucgagaguuuauugcaaaucuuaaggauuuuauuauaaagauuuuuuuuuuaguuugguagcacauuuuguaccaaaaaugucaaacacugugcuguaagaauauccauguuuguagaaauguccacuuuucagauaauauaaugccuaccauuauacuaacagaaucauaugguaguugauuuauuuuuuuauuuauuauguauauuuuugguauuguggguucuugaggcaaugauaaaaacacuuaauguauucugacaugagugcucuaauagccuccuucuccucauuuuuaaacugcauacauuacuuucaaaauagguauagauacucugucccgccuuuugagcuauuagccuguuccuguuucccuuugucaccuaagcaaggcuuuuucugagaagguagugaaugguuucaaauguugcauacuauaagaauaaucauuggguaacuguuguuuagaccaacacuuagaaauacuauauuugugccuuuucauuuuuaauuuuaauguguguugauauuuggagcacaaauaaugaaggugccauaauauggcuugccaauguuaccuccuugaauagucaugugucauugucuugaauugguaauuggagaaccuugcaugaaauaugugaucguguguguguguguguaugcgcgugugugucuguguguuuguguacauaccuguauuugcuuggggcuugugugugguauguuacaaagagugaauuucuggaaauagaaaucaguuaaauguugaaaguucagguuagcagaaauauuucauuuaaauaugcuuuacuuuggaggacaauugauuaacagaggaaaugauaauuuucaaaaaugugaucaauuuacugcaugaugaaaugugaaaacagugccuuuuuaggacaucaauuauaauaaaauuguuuuaaaauauuaacaaagaucucaaaaaguugucaugaacauuauucauuuauuuuuaaacuggaucuaaauaagagcuuagauggccaaaauuagaauuaauaauauacccauuuaaauuuuguucauaaauuuaaaaucuuaaucagaauucuuuauaaaaugugggucauagauaugacccaguguuacuaaaauagaacagggauugugaaaauccagcucaacauacuuaaguauacuuggcuuagagccaaguauacuugaagaggugaauuauucugacuuggacaugcaugcucuuugauggauaaaauaaaaauauucaauuuauucuuacaaaagaaggugggugggugaguggguucguuuuaguguucucagauuauaaagacagcuauaaagacagcacuuuccgcacacaaaguguauuuuacaaaccuuuuuuauacaaauuaaugagcucuacuuuauuuaaguguucauggaaugauguaaauuuuagguccaguugaacaaauauugagugccuaucauaugcaagacuaacuccuuacuaggaaugaaaucacacagugucuucuguuugcaguaugugaacuuuauguuugaaaagaaauuauuauauuuaaauuuuuuuguugucagaguuuaucauuguauacuguaacccaguaaauuuugcauucaguuuuaaaaaaugaagauguaacuuaccugagucucauuuuugaaaaugaaauucugcaaaaauuauuuaaaaauuaguucuuggggaaauugauuuucaagauucaaguguauaaaaacuuauauugaacuuuucagccucguuuuuaauuagcugauguuaaugauaagauacauaauacauguaucuuguugcugaaaauauuuuuugcauuucaacacauugaguuaaaauaaaguuguuacuacuuauucaagau

SEQ ID NO: 13072 - RNA, 31708 nt, Homo sapiens
guucagagacuuacaggugcuugccugcauugcaauaaaggacucauuuauugagcaagacuuauauuuaucucuucauuuuggagagccuaauaaacuguuauuacaguuucucuacugacuuucaaaaguuuugaaguuugaaagaccuuugcaauuaaaacagcaugagcacggccagaacagagaacccuguuauaaugggucuguccagucaaaauggucagcugagaggcccugugaaacccacugguggcccuggaggagggggcacacagacacagcaacagaugaaccagcugaaaaacaccaacacaaucaauaauggcacucagcagcaagcacagaguaugaccaccacuauuaaguaaguguuagaguaaauuauuaauaaacacuuguggggaaccaagauuuguguuacuuugguguugacuauuaauacuuaugccuuaauuuaaccauuuugauuccaaauagaggacagaugacuuuguuuuauggccaguagguauuugcaauagaauaauauauuucugccauaauuuguucagcaaguagucauccugaggucagaugauacacacaaauuuuguauaaaugguuuuuggaaacauuucuggcuuucauaauuaguguaaaaguuauuagcuuaguuuguuguaaaugaauaaaauuauuagucaucucguuuuugucaguauaguuuuuuuacgacugcaccuuacccuaguuaaacagcagauaaagccaacuuuauguauuaaauuuaaagacucagucugagucuuuagagucuuuaaagacuugcccagccuucugaacuccaagcauuauucacucagaaaauuuucucguaacuuuuuuuagcuuauggaacuuagcuuuuuuacuuuaaaaaaaaaaaaaaguuggcugguugaggugacucaugccuguaaucccuguacuuuggggaggccaaugugggaggaucacuugaguccaggaguuugagaccagccuaggcaacauaaugagacucugucucuacccaaaaaaaaaauuuuuaauuuuuuuccuccuuuuacauauaaaaagggaacuaagaauuuugaacucacagaacacaguucugaacagucucagaaaccuuuuguuaaccuuaaaauugaagagccuccucuuacuagaggauauuuuuucuuuuaaagcugaaaguauguaggcuauuuguuacuuuuaagugcauaguuuaaauuacaauauuugaaugguaaccaucacuuuaaagauucaguuauaggaaauuaacauuuaagauucuugacuccaguugauguuuggcuuuuguuaagaacuugccauauagguccgggugcaguggcacacgccuguaguccaagcacauugggaggccaaggugggcggaucaccugaggucgggaguucgagaccagccugacaaacauggagaaaccuugucucuacuaaaaauaaaccccgucucuacuaaaaguacaaaauuagcugggcgugguggcacaugcccauaaugcuacuugggaggcugaggcaggagaaucacuuaaacccgggaggcggaguugcagugagccgagauugcaccauugcacuccagcuugggcaacaagagcgaaacuccaucucaaaaaaaaaaaaggccaggugcgguagcucacgccuuuaaucccagcacuuugggaggcugaggcagguagaucacgaggucaaaaguuugaggccagccugaccaacauggugaaacccugucuuuacuaaaaauacaaaaaucagcugggugugauggcaugcgccuguaaucccagcuacucaggaggcugaggcgggagaaucacuugaacccgagagguggagguugcagagagccaagaucgugucacugcacuccagccugggcaacagagaaauacuccaucucaaaaaaaaaaaaaaacuugccauauaaaauaauuuaacccugggaaucuuuauaagauguugacacuggguuacugaacugagguauauguuuuauuacaaccuagaucuuuucacuuccuacagaaaaauagcuuauacaagcuaccagacugucauauaguuaccguaugugguucacuaggaccucuaagaacuaauuuucagcagaauugguuaggucauugggagaauugguauuaguguauauucuguuauuuuuaaggugaaugcuuuaauugguauagaaaugaauacuacuucaguuguaguuugucuuggcagaauguaaguagguuagcaaaauuuagacuauuuuuaauuuuuuuuauaacuuuuuuuuuuuuuuuugagacagggucucacuuuguugccuaggcuggaguaugguggcacgaucauggcucacugcagccucaacuucccaggcucaagugauccuccugccucagcccuacaaauaguggggacuacuggcaugcaccaguagcgacggcguuuugucauguugcccaggcuggucuggaacuccugagcucaagugaucugcccaccucgaccucucacagugcugggauuacacaugugagccacugcgcccagccuauuuuuaauuuuuuuuuuuuuugagauggacucucacucacucuguugcccaggcuagagugcaauggugugaucucgacucacugcaaccugcaccuccuggguucaguucaagccauucuccugccucugccucccaaguagcugggauuacagguguccaccaucacgucuggcuaauuuuuguauuuuuaguagagaugagauuucaucauguuugcaggcuaggcuugaauuccugaccucaggugaucugccugccucggccucccagagugcugggauuacaggcgugagccacugcaccuggccuaugagaauauuuucuauuuaaaaaauucuggggcuggauaugauggcucaugccguucaucccaucacuuugggaggcugaggugggaagaucacuugaggccaggaguuugagacuaaccugggcaacauagcaagacccugucucuacaaauaauaaaggcugcagugagcuaugaucgcaccacugcacucaagccugggugacaggguaagaccccaucucaaagaaauaaaaaauaaauucugauuuggggacaacaguggauuuugauuuuucuuuucugguuuuccuacgauuaaugguuucuuuucaguucugcgguucuucaaaucucauuuucucugcccucucuuccaugaaguccucuagaucccaucaagugucucagaacacuucuaauacuuaaccuccgucacuuacuuucucauuuuaaauaguuuuuucaucucauaagauuauaaauuucuuguggucagguuuugcauuguaucuuacgcauuauuauucacuauuuuguugaauucaacgguaugucaaacugacaucagaaacuucgaugauacaggcuuagaugaaaggcuuuaguaggccgggugagguggcucacgccuguaaucccagcacuuugggaggccaaggcaggaggaucacgaggucaggaguuugagaccagcugaauccccgucucuacuaaaaauacaaaaacuagccagguguaguggcaagcuccuguaaucccagcugcucuggaggcugaggcaggagaauugcuugaaccccgggagguggagguugcaguaagccgagaucaugccacugcacucuagccugggugacauagcaagacuccaucucagaaaaaaaaaaaaaaggcuuuaguacaguaguagucuuggaauugguagcaaaaaguuaccaauguuagaguaugcauuauguaggaccuaguuuuaaguaaaauaaguggucuuuuugucugugaauggagcauuugagauguuuuggggacucugguuauguaagaacagcugcagugaaaacuuuuucgaagaugucacaguuaaauacuuugucugcagauguucccugaucuuuuuuuuuuuuuuaaagaugcuuugaguauuuauuacuugagguuuuuaccuggccaaaaagagaguuuauuuauauucuccuuguuuuuauucucuuucaugauuucuagcauuuccaauaaaaaagaaagauuaagagaugcucauuggcuaauacugugcuauuauuuugccaggcacugugcugagugcauuauaucaauuguuugauguaacuguuaaccuauuuuguuuuauuuauuuauuuggaacggagccuugcucuggcgcaggaucuuggcucccggguucaagcaauucuccugccucagccucuugaguagcugggauuacaggcacaugccaccauggcuggcuaauuuuuguauuuuugguagagaguggguuucaccguauuggccaggcuacucucgaacuccugaccucaggugauccgcuugccuuggccucccaaaguguugggauuacaggugugcgcccaccuuauuuauuuuugagacagagucucccucugucacucaggcuggagugcagugucgugagcuuggcucacugcaguguccgccucccagguucaagugauuccccugccucagccucccgaguagcugggacuacaguugugucccaccaugccuggcuaauuuuuguauuuucaguagaggugggguuucaccauauuggccaggcuggucucgaacuccugaccucaagugauccgcccaccuuggccucccaaagugcugggauuacugaugggagccaccacgccuggccuguuaaccuauuuuaaaaaugagaauagccggccaugguggcucacaccuauaauccuaucacuuugggaggccgaggcagguggauuucuugagcccaggaguuauauaagauauauaaaaucuuacaguuuuuaaauguugagaacuaauuuaaacucauuuaaauuaaaacacaugcuguguaggucaaacaaaacaccuuuugacaacaguuacacuguauacaauauugcuuaagaggauggaugccuuaaucccuucuguucuugauuuuuuuauccuccugagauucucuauaagaacacuuuuucuaaaguuguuuaauuaucuuguuagauauauuaaauggaauauauuaaacuuacugugcuuuuuuaacacuuaauuauaauugagaugaaucaucuuuguuaggaugcuaugaauuuugauacuucaaguuuacuguauucucucuagaccuggugaugacuggaaaaagacuuuaaaacucccuccaaaggaucuaagaaucaaaacuucgguaaguugguuguaaaauacaaguagaauaaugguggggaacuagaagugagguauagcugucccucgguaucuggagggaauugguuucaggaccauaacaccacugccacccuccuccuccaacccaguaagauagauauucaggcuauauauucccauuuuguggaugagaaaacaaaugcucagcaguuaguucucuuagccuauuguuuucaaccgggagaauuuuugucucccgggggcauuuagcaauuuguagaaacauuuuugcuuaucaucaauaggggggaagcuaaaggacagcccuuuacaacaaagaauuuuguggcccaaagugucaguagugcugagcuugagaaauuugacuuagccaaagauauuuguagcucaugagugguagaggugggauuuaacuucauaucuugugauuugcaauucauggcaugauauuuguguaaaaaaauaacacuauuccaccaguccuuaggagacugugaccaagggccgggcacaguggcucuugccuguauucccagcacuuugggaggccgaggcaggcggaucaccugaggucaggaguucaagaccagccuggccaacauguugaaacccugucucuacuaaaaauacaaaaauuagucgggugugguggcgugcgccuguaauccagcugcucaggaggcugagacaggagaauuacuugaacuugggaggcagagguugcagugagccgagaucacgccacugcacugcagccugggugacagagcgagacuccaucucucgaagaaaaaaagaaggcuaugaccaagugcucuuuccccaaaacauaguuuuuuaaaaagcuugugugucaaagcagggacagugguuuuucuucaggaaaaguugaaauacagauuaaaacaaguaaucugcauauauuuauauuuaagauugggcagguaaaguacuaaagucagagaaguuuucuuuccuuuuuuuuuuuuuuuuuuuuuuuuuuugagauagagucuggcucuguccccccaggcugugcagugagugcgaucucaccucacugcaaccuccgucuccuggguucaagcgauucuccugccucagccucccaaguagcugcgacuacaggcgugcaccaccacccuggcuaauuuuuuguauuuuucguggaguuggaguuucaccauguuggcuaggcuggucuugaacuucugaccucaggugaucugcccgccuuggccucccaaagugcugggauuacaggcaugagccaccaugccuggcccagauaaauuuucuuaaacacagauaaauuuaccaaaggacaccaaauuuaccaacaguguuauuuauucuuuuauuguuccuuuuuguuugacuaggaugugaccuccacaaaaggaaaugaguuugaagauuacuguuugaaacgggaguuacugaugggaauuuuugaaaugggcugggaaaagccaucuccuauucagguauguuaacccuuuuuaucacauauguaagguuaugugucaaccauuaaacaguuuucuuuuugcucugcagaagugauacagugaacuaacauuucucucucacguauacacacuuuuucugaaauuuuuaaggguaaauuagaaaaucauggcuuuuacaacucuaaauauuucgguguguauuucuuuaggauauucucuuacguaaccacaguacaguuaccuucaguuaacauugauaaaauacuucuaucucaucugucauucuaauuauuaauggacccaaacauguccuuuauagcaguuuuuuucuucuauacaggauccagucuagggucagguauuauuuguaauuaugucuuuuuuagucauuagcguuucccuaguguuuguucuucuuuuuaugacaucagcauauuaaaaauacagccuacaaccccuucccccaucccucuuuuuuuuuuuuuuuuuuggcaacugggucuugcccugucacccaggcuggaguucaguggccugaucucggcucacugcagccuugaccucaugggcucaagugauccuccugcgucagccuccuaguagcugggacuacaggcaugugccacaacacccggcuaauuuuucuauuuuuuuguagggauaggauuuugcuauguuauccaggcugauuaaaacuccuggguucgccauagugcuaggauuacagacauuagccaccaugccuggcccccuuuuuuuauuaauaguacauuucccguuuugggauuuugugauauucccaaguaauuagauucaagguaggcuuucucagcccgaauaaugcagaaaucacauuauggccuucucaggguaucauguuugaaggugugccuaguguccauuuauuccucuuuggugauguuaauuuugauuacccugucaagauguugugugguuuuucccuucuauaauuacugcucuuuccccucucccuugagacgaauaagcaaucuggggugcauuuuaagaccauacaaauacaauaauacuauggccacccuccuccuccaacccaguaagauagauguucaggcuagguauuauccccguuuuguggaugagaaaacaaaaguucagagcaguucucuuagcguauuguuuucaaccagggaggauuuuugucccccaggggacauuuagcaauuuguagaaacauuuuuuauuaucaucaauggggggaugcuaaaggacagccccuuacaacaaagaauuuuguggcccaaaaugucaguagugcugagcuugagaaacuugacuuagccaaagauacuuguagcucaugagugguagaggugggauuuaacuucguaucuugugauuugcaauucauggcaugauacuuuuuuaaaaaaauaacaaaauuuccccccuaguuuuagcacccauuggugauucuugcuugaucucaucucugcucugauggguuaugaugacuuuccaauucuagcacucccucuguauuugccccuauaaagaagaaacuucccuuccccucauccauauauaucuguuaucaguauggacuuauacucaccauuuuuuucaauuuuuuucaauuuuuuuuuuauuauuauucuaaaaauagccuagaucuggccaauguaagcucuuucagccugguuccuauguuuuuaugauguguccccuucauuuuucuugaguacuuucuugguuuuuuuuuuuuuuuuucucuuuuuugagauggagucuagcucugucagagaggcuggagugcaguggcaugaucuuggcucaccgcagccuucccauccuggguucaagcaguucuugugucucagccuccccaguagcuggaauuacagaugugugcuaccacaccuaacuaauuuuugcauuuuuaguagagacaggguuucacccuguagaccaggcuggucuugaacuccugaccucaaaugaucgcccacuuuggcuucccaaagugcugggauuauagaugugagccaucguacccggccccuuucuugcuuuuugacauaucaugaugcaggcuuaucuuauaccuauccuggcccagcauuggcauccaaggauccuugauucuuuuuaguguggaguaguauuagggaccaagacccaggcauuagguacccuguuugcuacuugguccuuucaguggaaagagcaaggaaauaaaugcauguauauacauauccacacacacauacacauaaauauacacguacauauaaacaugcauuauacauaggccaguuugauaaaugaugacaacagacauacuuaaauugaugaaaugauugaauucaggcugugcuaaggacaaacccugugacaucacugaguacuuuuucauugagccaacauguguggagugaccuagaaaguguuugaccuugggaauucuauaaugaauaagacagauauaugguugcugucuuacagucuggaaaggacagcuaauuguacagguaauucacuguaauaugaugaguaccuuucuaguuggaauugcguauguauguagucauuagaggaagaugggacaaccuggaagaauugagcuguguuccaagcagagaacgcuggguaaugauugcccagaguugagagugugcuuuuggcuggauaaaguaucaaaacaaggauaugcaucaucagagggguaauuuggguguagguauuagaaauaccuaggaaucuacuaugauguaguucauguuaagccauuuuaucuacacugaagucuuuuuuuuucuuucuuuuuuuuuuuuuugagacagagccuuacucuguugccaggcuggagugcaguggcgcgauguccacucacugcaaucuccgacuccuggguucacgcgauuccccugccucagccucccgaauagcggggacuacaggcgugcaccacagcacccggcuaauuuuuuguguuuuaguagagaugggguuucaccauguuagccaggauggucucgaucuccugaccuugugaucugccugcuucagucucccaaaguguugggauuacagacgugagccaacacaccuggcccacugaggucuuaugagaguuccuuuacaguaggaacugcaucauucaacuuuuaucucuaguacuuagcauagugccugugcuuauuuagcgugcuuugaugaaacuuagguaacucaugucugcaggugaacuugguguagggaacugcccagauuaaaucccagcucuacuccuucauaaauugguuauuugggaucuauaagucuuagacuccugaccuauauaauugagguaauaguauaauaccauaggguuguuguaaagauuaagugagauaauucacaugcuuaguacaaugccuaguacgugauaaaugcucaaaaauguuauggguuauuuuauauaauaguuucaaaaaaggaaauuaguuaauuuaggagacguaauuguuuuaaauuuguuuuaaagagacugagucuugcuaaguugccugggcuggaugcagugucagaaucuuagcucacugcagccucaaacuccugggcucacgugauacuccugccccagccuccugaguaaggaugauaguguaguaccagcacaccugguuguuuuuuguuuuuguuuuuguuuuuguuuuugguagagucaagguuuugccauguugaccaggcuggucuugaccuccugggcucaagcaguccuccugccuuggcuucccaaugugcuagaauuauagaugugaaccacugcacuuagcccaguccucauucuuaguggauauuugcugacuccuauuucuuaccuuguauuaaaauuuaaaauuaacuuuguuacuuguacucugaguguuguuauagcauauaggcaauuaacucuucagccacuuaaccaaucugacauccagcuuuuucuguaaaguagaaauaaguacucucccucacaggauuuuuauuguuaagaucaaauguaguguacaaccaaaguauuuugaaauagcaagguauuguaugaguauauuguuuuagauacucaaggucaccacuuguauugccuuuuucuuuuuuuuuauugccuuuuucuuuccuauuguuuuguccuggggauccauggaaagcacaagauuauguguuucuuagaaucaaucagaguuacaagucacaaauauuaggauuuuagaaccgaaacaaaauuuacagauccccuaguaaaaaaauuuuuuaaauuuuuauuuucauagguuuuuugggggaacaggugguguuugguuacaugaguaaauucuuuuguuuuugagacaggguuuugcucugucgcucaggcuggagugcaauggugugcucucggcuuacugcaaccucugccucccggguucaagcgauucucgugccucggccucccaagugacuugggauuacaggcgggcaccagcauacccggcugauuuuuguauuucugguggagacgggguuucaccauguuguccagguuggucuugaacuccugaccucaggcgauccacucuccucggccucccaaaguacuggaauuacaggcgugagccaccacgccuggccaaguaaauuauuuaguugcuauuucugagauuugggugcacccaucaccccccugguaaaauauaaccucauggcaggcugucuucuaguauucuuuccauucuuaucuaccuucucguuuuauuuuugucaucccucccccauuccuaaaaguaucucuucuaucaugcuugguuuuacaguuuuauccaggcauuuuuuuuccccuaaauauuaaaacugccuugauuagaugggugagucuucugcauuugaauauuuguuugagauggaauuuaguugcaguuuggcugugagauuuggagaauuggcugggugcaguggcucaugccuauaaucccagcacuuugggaagccaagguggguggauugcuugaguccagggguucaaaaccagccuaaacaacaugacaaaacccugacuguacaaaaauuagcugggcaugggggacauguagucuuagauguucaggagguugaggcuguaagugagccaggauugugucacugcacuccauccugggcaacagagcaagacccugucucacaaaaaaaaaaaaaaaaaaaagacuguuagagaauuaggcacuuaaaauuauaugcucucaaaagagcuuuuacauugacaggcuggaaccagauauacuacagauugcucccacaacguauuucuagagccaucugugaccaguucuaggucuggaugcuguggccaguagaauaauugccauucuaaagguauagcuuuauaggaaccuagacuucuuuggaaggcuuaagaauauacuguuuuugucugcuuagcauuauuugaaacuuuauauuaacuuugggguuaugauugagaaagauggccucucucguugcuucuaaacccugggaacaccucuugaagacuuuuucgaaacucuaagaaggugaagaaaugagaaguaguugauuauugagggaaacauggaagcuccguacuguuggcaacaaaauuuugugccaggucagcuaaggucuaaugaggauuaauaguuuacuauuuauaguuaggaauuauagcauucugaauccuguaaauaagucauucuuccugcuaacaaucgguuuaucaugauugaaaaaaauauuuccuaaaaacucaaagguuuuuuuuguuuguuuguuuuguuuuuuuuuuugguguguguuuuguuuuguuuucuuuuuggguggggucggggagacagagucucaguuugucacacuggcuggucuugaacuccuggccucaagcaguucuccugccucagccuugcagaggguugagauuacaggugugagccaccauccccagccuaaauuagagauauaauuagaaauuaccaucucccuuuuuuuuuuuccuguuaagcaggggacauuuguaacaaucauugcuaccucgucuggaguaaccauagguuguuuuuuuguuuuguuuuauuuuguuuugagacagagucucgcucugucgcccaggcuggagugcaguggugcaaucuuggcucacugcaaguucugccuccuggguucacgccauuccccuaccucagccucccaaguggcugggacugcaggcgccugccaccacgcccggcuaauuuuuuuguauuuuuuuaguagagacgggguuucaccauguuagccaggauggucuccaucuccugaccucauggucugcccaccucggccucccaaaguguugggauuacaggcgugagccaccgcgcccggccuuuaaccauagguuuuuuuucccucuuggaaauuaagguuuggaaaauaagaggaagcagucaguguaaaugcagcuaguugggugauguugagcuuuuguugguaccacacuuuuguaaaaugccucucaaugcuaggagauuggaaaauaaaccauucuuuaauuauaggcaucagaaaccaacucgaucuaacuuaagcaaaaggaaauuuauuggaaaaauaacgggaauucacaagauugagaaggcuagagaaacauacuuggaaaugacuaagaauugagauagcucugaaggacuuaggaagcuguaauggaugcacuauaacaauuuagauucuuaggaggcaacauuccgcuggcccagugugggcuaugugucuaccacuuggcuuagaaaauuggugaggcuuggucuguugggacaggggagaccagggcauauguaauuccuuagaaggaaauugggguguuacuuaguaaagggauacuagaguaaccaaaacacaacaaauacucuucagucauuaucuaaacguuacagugaaugugaauuuggagaccuaagguggcagaugucagcccuaagcuugugggguugguuuuuugggguuuuguuuuuuggggguaauagcuuuauugagauauaaaugacaucacacaucaaaaguauacaauuuaaugcuuuuuagugcauuuagaguucugcaaccauuaccacaauaaauuuuagaacauuuugaucagucccacaaaagaaacccuuuuagcagucacaccucauuuucccacaccccuaaacaaccacugguauacuuucugucauucuagcuuugccuagucuggacaugucauauaaauagaauccuauaguauguguuuuuuuugugacuggcuucuuugacuuagcguaauguuuuccgaguucaucuguguuguagcuuguaucaauauuccauuccuuuuuccugaauaauauuuuauuguauggcucuauuacuucugauuuauccagucaucaguugguagacauuugggguuguuuuccaaggacugaggauuuaaugugcuauuuugugaaaaucugagaaguaggaaggggauuuaaugaucucaacugucauccgucugaaaaaccuaacuugugauuuuaaauaaaauagcaggcugccuuccccuguucccuuuuuaaaauaggaacugacccugcuuuaaccuuaugaaguuuuauuuaugaauaaaguuuguacuauuauaaaaaaaaacauagaaggaacuggcuauuaaggauaaugcugcuaugaaaauucaggugcagguuuuuguguggagauguuuuuauuucucuucgcuguauaccuagaauugcuaguucauaugguaacucuuuuuaaccuuuugaggaacugcaaggcugguuuccagcguagcuguacauucccacuagcaguguaugagaguuccauuuucuccaacuucuugccuacauguuaugugcagaucuaaguucaaauacuggcuaaagcauuucuugcuuugugaccuugggcaaacuaauccuguuuaggauccauuuugucaguuguaaaacaaaguaccuaacuugaaaguugugcugagcacauaguaaguuuuaaaaaaaguuuucguuuccuuccuccuuugccuucucccuggcaguuccucauaauuuccucuuguauuucacagcuuuuugaacuugacuugaauucucuugcuuuucauuauuuccugagaaacacugguaagaggcaguguggaugugcugaauucacugacuguuaaucauaauggccaucauauaaggcaaaauaucagggugucuuaacuuacagucuaucacauguacuuuguuaaagcuuuauccuugaacaguuuuuguaggguauaaucccugucaaagagggcaaaggaauagaagucaauggccuuaaucaagucagucaaaagaugaacugaaaagggggauuaggauaccucuagucuaauucuguucugccucacuugauugaaaaaaagguuuacacuuuaaagaaccugacccagcaagucguuaugagaccaucagagaccaccuaucuuacuuuuucaauacuguaaaacugaguagugugcaggcagccuguuaaaaacuacagacuacuggcaccacagaaccacaaaagagaaaaccugaggugacaggguaaugggagccucuggaacaacuggaaauaaugguucacuuaucugugaugagggaagaaauuuaagaccaaaggguuaaagccaagguuuucuucuuuguuugcuuuaccuuaauaagcagagucuuuaaugcuggcuguaagaacaagacaacaguauuuucuuuucuuuucucucucuuuuuuuuuuuuuuugugagacugagucuugcuccauugcccaggcuggagugcaguggcgcaaucuuggcccacugcaaccuccuccuccugggcucaagcaguucuccuaccucaggcucccaaguagcugggacuacaggugcgcaccaugaccauuuuuguauuuuuaacagagaugggguuucaccauguuggccaggcuggucucgaacuccugaccucaggugaucugccuaccucagccucccaaagugcugggauuacagacaugagccaucguucccagccaacaacaauauuuucacaguuguucuggcagcuguguuguucugaccauauggaacccauuuauauccugugauuggagcucuagguagaaagaguguugucgugggagauggaagucauccugcuuauuuagucauuucuaccaauagcagcuuuaaagggcuaaagcuguuuuuuguuuguuuguuuguuuuugucguuagcccaggcauagaagggacaaaugucagugacugugaauuugguuccuaguaucuuaguuuuagaaauuaaaaauucaggccagacacaguggcucaugccuguaaucccaacacuuugggaggccgaggucgguggaucaucugaggucaugaguucaagaccagccuggccaacauggugaaacaccccgucucuacuaaaaauacaagaauuagcugggugugguggcacacgccguuaaucuaagcugcucgggaggcugaggcaggagaaucgccugaaccaggaggcgaaaguugcagugagccaagaucgcaccauuguacuccagccugagugacaagagcgaaacucugucucaaaaaaaaaagaaaaaaaauuaaaauuccacaucauggcccggcgcgcuggcucacgccuguaaucccagcacuuugggaggccaaagcggguggaucacgaggucaggagaucaacaccauccuggcuaacacggugaaaccccgucucuacuaaaaauacaaaaaaaaaauuagccgggugugguggcgggcaccuguagucccagcuacucaggaagcugaggcaggagaauggcgugaacccgggagccagagcuugcagugagccgagauugugccacugcacuccagccugggcgacagagcgagacucugucucaaaaaaaaaaauuccacauaauuuccuuuuaacaauuuuucaacgaucaagcuuuuucaacgaucuauuguauuuuauaguuuguuguuguuguuuguuuuguuuuugcaaagagugggggugcuugccauguugcccaggcuguucuugaacuccugaccucucuuuguauaugucuauuuauuuuuaaguaacuuuugggaauccuuugcuguugucugggaaauuuaaguuaguaugaacuacuguuauuauuugcaaaauagauaacaaaguaagccaaauauuaaaaugagaggucaccuuuagugaugugaccguauuugagguagcugcaauagaauugaaccuucaauagagagcacauuacagaacagagaaguaggcugugggacagacauuggagauuuacuuauuauauaaauaaaugacaaauaggaccugagguuaaacuuucccagccuauucguguuuuguugcagggaugagguguccaagcuacaauuuuucacuguggucaaauuggugugcuagucucaaaauauauauagucuuaccuuggaauuguuuuuguuuuuuccuuuaaaaauuuuuguagagauggggucucaccauuuugccuaagcuguucucaaacuccugggcucaagugaucguuuugcuuuggccucccauaauggugggauuacagaugugagccacuguaucuagccuuuuuuuuuuuuuuuuuuuuuugagaugagacgaggucucuuucaugcuggaguacaguggugcaaucauggcucacuucacccuugaccuccuggcucagccucucaagguuuauggacacccaccaccacacccagcuacuuucuguaauuuuuguagaguugggguuuuuccauguugccuaguugcccgggcugguguugaacuccugggcucaagugaucccccacuucugccucccagugugcugggacuacaggcaugagcugcugugccuggccauuuuuccaauuuuuauuugaaggaggcuuugcuuuuguuuugucuguauuuucaagugcuauuuaugggucagccugaguuccuccauuuucuuuguuguucucuucagauacacacauaucacaguucuuaugacauuggguuacaauuuaaaauucugugagcaguucugguaaauacugguuuauaaugauguugauguugacuggucgugcugauuuacuuggaucucugcuauucaugugagaauucaaauguaggauacuuaggacacuuaaagcaauaccgaaagagguauccuucaguguauuucagagaggaauuugcuuguguacuacauucagaaguaauuuuguauugucuuaucucuuuuaggaggagagcauucccauugcuuuaucugguagggauaucuuagcuagagcaaaaaauggaacaggcaagagcggugccuaccucauucccuuacuugaacggcuagaccugaagaaggacaauauacaagguuaguugaauaaaaguuuguuuuuaaacuaaaaaugggaguuucagccuuggagccauguguagaagauacucuuuuuuuagucagaauuuacauuaucuaaaauuuguauucuuucuuuucagguuuuuucuuuuuuuagccugaugauggucuuuuuauuaaaaaugauucccagcuuuuuagagauuucuaguuuuaagaguauucuuauaugauacacacuugugacagcauuccagugagacaggaaaaauaaguauuagugcccuauagguaggaaagcugaggcugggcacggugccucacagccuguaaucccagcacuuugggaggucaaaguggguggaucaccugaggccagauauuuaagaccagccuggccaacauugcgaaacccugucucuacuaaaaaugcaaaaauuagcugggcaugguggcgcacaacuguaaucccagcuacucagaagucugaggcacgagagucacuggaacccaggagguggagguugcagugagccaagauugugccacugcacuccagccugggugacagagugagacucucaacucaaaaaaaaaaaaaaaaaaaaaaaggcggcugaggucaugagaaguuaaauuaguugacauugcuacuuauaaacuauggaacuauuucuuguggcagaugaguguuaacagaauuccuuguagaaacaugaacuucuguuuaaaggcuguggauuuugggauuuuaagagccuaggcaguggggaauaaaaaauuuucauaguuauauucaauguaaguuaauggaauuaagauuucaucucugaaacuuuacauuuuuagcuuucgugaucuguaauuaucuuuucuucccacuuucauaugauguaaauagagccuagguagcaggaguuuccuaccuagguauuuuacacagugaaucugacucaaauguaguuggggcuuuuagaaauauuguuaauaaacuuugagcuaauaguugcgaacucaacaugcugaaaguuuguaauuaagaacaguauuggcugggugugguggcucacgccuguaaucccagcacuucgggaggccgaggcaaggcagaucaccugaggucaggaguucaagaccagccucgcuaacaugguaaaacccugucucuacuaaaaauacaaaaauuagcuggguguggugacaugugccuguagucccagcuacucaaggaggcugaggcaggagaauugcuugaaccugggagguggagguugcagucagccaagaucaugucacugcacuccagccuggguaacagagcgagaucugucucaaaacgaagaagcagcagcagcagaaggccaggugcagugacucacaccuguaaucccagcacuuugggaggccaaggcaggaggauugcuugaggucagggguuugagaccagcugggccaacaugaugaauccccgucucuacuaaaaauacaaaaaauuagcugggugugguggcgguuacucaguaggcugaggcaggagaauugcuugaaccugggaggcagagguugcagugggccgagauggcagccacugcacuucagccuggacaacagagcaagacuccaucucaaaaaaaagaagaggaagaguuuaauauuuauauaauaguauugcugagggagagucuaaaucugggacacuauaauagguucucuuuucauaaagagauuuguacauuugaguuuucauaauguccuguguaaugauucaacuuuuuauuuuuauuucuuaauuuuuuuggcgggggagacagagucuugcugugucacccauucuggaguguggugucaugaucauagcuuaaugcagucuuaaucucccaggcugaugugauccuccugccucagccuccccagaagcugagacuauaggcacaugccaccauucccagcuaauuuuuuucauuuuuuuuuuuaguagagauggggucuugcuauguugcccaggcuggucuuaaacuccugagcucaaacgauccuccugccucagccuccaaaagugcugggauucuaggcaugaguuacucacugugcugcccagcccaauuuuuuaauacaucucgguaucuagauuauaaggggcaguguuucuuuucuuuuuuuuuauuugagacggaguuucgcucuuguugccuggacuggagugcaguggcacaaucucggcucaccacaaucucugccucucggguucaagcgauucuucugccucagccucccaaguagcugggauuacaggcaugugccacccacgcccagcuaauuuuguauuuuuaguagagauagggucaggcuggucucaaacucccggccucaggugauccacccaccuuggccucccaaagugcugggcuuauagguaggugugagccaccgugccuaggcuauuuuuuuuuucuuucuuucuuuugagacugagucucacucugucgcccaggcuggagugcaguggcgcgaucuugccucacugcagccucugccuccggguucaagugauucuccugccucagccuccugaguaggugggacuacaggugcgugccaccacgccuggauaauuuuuguauuuuuaguacagaugggguuucaccauguuggucaggcugcucucgaacuccugaccucaggugaucugcccaccuuggccucccagagugcugggauuacaggcgugagccacugcaucauaaggugcaguuacaggugugagccacugcaucauaaggcgcaguauuucuauagcuucuuaaauuuuguaaauaaugauguauagcauguucucccaccucaccccauauuuucuuauauauuccuugauacuguuucagcaauggugauuguucccacuagagaacuugcucuacaggucagucaaauuugcauccaggucagcaaacacaugggaggggccaaagugauggcaaccacaggaggaaccaauuuacgagaugacauaaugaggcuugaugauacagguaagaaaugauuacuaaaagguaguguagcucucuguuauuuuagucacaaguauuucaguaaauuauuaaaaauuguuuuuaagaauuaaggaacagaaauacugcaguaagaaaaggaaaugaccacugcauucaagcgaaaaagacaaauuaccauaauugaaaacgauauuugacuuuauuaguaauuguaaaacagcaaguuuauaauaauuuuaccuguuuaauugguaaagcuaaaaguauuaguagacgauaaugugaguuuguggacaaauaggcuacauuguaaauguggggguguaaacuuacaucucuaucaugggcaauuugggaguauauuuuaaaauuauaaauguauauauaauguguguguguguguguauauuuuuuuuuuuuuuggagauggagucuugcucuguugcccaggcuggagugcagaggcgcaaucuugacucacugcaaucuccgccucccagguucaggccauucuccugucucagucuccugaauagcugggauuacaggcucccgcuaccacgccaggcuaaauuuuuguguuuuuaguagagacgggguuucaccguauuagccaggauggucucgaucuccugaccucgugauccaccugccucagccucccaaagugcugggauuacaggcgugagccaccgugcccggccauaaauguauauuuuuaagaaucuuuccugaagaaaaaaguuggguaaaugcagggcuguagguacaaaguuguuugcuauggggugguauugucgugccgaaaaauuggccaacuuagaaggagauuggcuaacuaaauacguuaagguauaaucugaauaggauucuacauagucauuaaagaguaaaguugaccuguauucauuuucaugaagaggauucaugauacauugccgaguggaaaaagguaacaaaacagcaagaugagaucacucauauaaaauuauaucuugauuuuaguuagaauauuauauaugauaauuaugugauacauucuuuguauugcauagguuuuuaaaaaauuaucuuguuugauccuuuuaacaauacucggcucacugcucuagauuagaggcauugcucuuaugucagaagucuggugugccuucugcuauuaauugagaauuauccuaagacaagaaaguaugccuacuguugaaagcagcaggugauuuaggaagcuguaccccacccaauguagaggugaaacaaauauuuuuuaagcauccuguggugaaauggaagucuuuauccuaaaacacaucuuugugccuuuuuguguuauuuccaccucuauaacacaauguguuucuucucuuucuuucuuuuuuuuuuuuuuuuuaauuugagacacagucuuacucuguugcucuggcuagagugcaguggugugaucucggcucacugcaacgucugccuccuggguucaagcgauucuccuaccucagccuccugaguagcugggauuacaggcucccaccaccacacccagcuaauuuuuguauuuuuaguagagacaggguuucaccguguuggccaggcuggucucgaacuccugaccucaugugauccacccaccucggccucccaaaguacugggauuacagggaugagcuacugcacccggccuaguuguuucuaauaaaagauagucaugugcugcauacaauguuguggucagugacggcugcacguaugucgguguucccauaagauuauaauggagcuauacaauggaguaggcuauaccaucacauagcaaugcauuucucagaauuaucauuaagcagcucaggacuguaauauuauaaaccuuuauccucuuugcucaaauuaaaauuaaugagaauguauguuuucuaaaucuugcauagugcacguggugauugcuaccccugggagaauccuggaucuuauuaagaaaggaguagcaaagguugaucauguccagaugauaguauuggaugagguaaugucucuucauuuggcauuauacuguucuguacuuuucugugcuuugcuuauaacugccagugaaugaagcaaaagcugcuuguguuuaugaucuaauaaacacauaaacaaucaguuuaaauuaauuugcuuauaaaauguguuuuacccgucagagggaguagauuauaggcauucauuggaauucagcauuuugucuuuuucuuagagauagcagacauuagguuuuaauuuuuuaguagaggagugaauaaccucaaugccaaauuuauucuaagucucuuucugcucugugauuaauuuuuaaaagcauauaauauauauugucucuucucauuuugugcauacuacuuuguacuguuugguuuuuaaucucuguuacauguauuaucucaccauguuauaaaugccuuuuaaaaacuuauuaaaaucuguaguccugggaucuagccauguuuuguacauguacagauggucccugacuuaagaugguucacuuuacaguuuuucaguggaagugauaagcuuucauuagaaacuguacuuugaauuuuuaagauugauauuuuuccugguuaguaauaugcuauaugauacucccaugaugcugggcaucagcagcaaacugcagcucccagucagccacaugaugauugagggcagacagccgauacucuacaguauacggcguugcaggugauuuugcccaacuguaagcuaagguaaguggagcauguuuaaaggaggcuaggcugagcgaugauguucaguagguuuggguaauauuuucaacuuaggaugaauuuaucagaacauaaucccauuguaagucaaggaggaucuauagugaucagcguuguuaauguuuugacaugagguuauuuucacauuuggguugagguuuauuauuauuauuauuauuuuuuuuuuuuugagacagacucacucugucacccagacuggagugcaguggcgugaucucggcucacuacaaccucugccuccccgcuucaagugauucuuaugccucagccuucugaguagcugagauuacaauuauguaccacccacgcucagcuaauucuuguauuuuuaguagaggcgcgguuuugcaauguuggccaggcuagucucgaacuccugaccucaggugauccuacugccucagccucccaaauugcugggauuacaggcaugagccaccacgcccggccugguuuguguuuuagguaacaugauuuaauucaaaucagacuuuuaucuuuaaguaaugagagagaacauuuauuaaucacuggguaccagcacuaagugcuuuacaugguuuguuuuuuuuuuuuuuuuuccauuuaauuuuuacaagaaaccuauaagguagguauccugucaaguaguuacuauaguauguagacauccaacuucuaauuugcuuauaaaauacguuuuauacuucagaugcaauagauaggcauucauaggaauucagcuuuuugucuuauagaugccagaguuuagguuuaauuuuuaagaagaggaguggcuggauaacuugaaagucaaguuuuuucuuuuuuguuuuguuuuguuuuguuuuugagacagagucucguugccccgcuuggagugcaguggugcgaucucagcucaccgcaaccuccaccucccaaguucaagcgauucuccugccucagcccucccgaguagcugggauuacaggcaugugccaccaugccgggcuaauuuuguacuuuuagcagagacaggguuucuccauguuggucaggcuggucucaaacucccgaccucaagugaucugcccaccuaagccucccagagugcugggauuacaggcgugagccaccacaccuggccuuagccaaguuuuuucuaaaucccgguaaaguaguuacuacauuauguaaacauccaaauuuuaauaguuuuacaauuuuagaguuguggaaacugaaguacagaguaguucuguaacauucccacacagcugagaaaugaaggaggcaagauuucaaccuggcaguuuagcuccagaaccuguacuuuuuuuugagacagagucuugcucuguugcccaggcuggagugcaguggugcgaucucagcucaacugcaaccuccaucucccagguucaagcaguucuucugccucagccuccugaguaguuggaauuacaggcgcuugccacugugcacagcuaauuuuuguauuuuuaguagagacaggguuucaccauaucaaccagucuugucuugaacuccugaccucaggugauccgcccgccugguccucccaaagugcugggauuacaggcgugagccacugcacccggccucagaacccuuacuuuuuuuuuuuuuuuuuuuuugagacggaguagucucgcccugucgccuaggcuggagugcaguggugugaucuuggcucacugcagcguccgccucccaaguucaagcgauucuccugccccagccucccgaguaccugggauuauaggugcguaccaccacguccagcuaauuuuuguauuuuuaguagagaugggguuucaccauguuggucaggcuggucucaaacucuugaccucgugauucucccgccucggccucccaaagugcugggauuacaggcgugagccaccgcgcccggccagaacccguacuuuuaaacacuacaccauacuaccucuuuaaugagaaucaucacauuaaaauucuguuguggagcugggcauggagguaugugccuguaguccuagcuacucaguaggcucaggcaagaggaucacuugagcccaggaaguucaggcugcagugagauacgauuaugccacugcacuccagcugggugacagagugaaaugcugucucuaaaaauaaauaaauuaauuaaauucuguuacagaaagcgggggagguugucuguguaguguagaauuuuuuuuuuccccuagaagauggggauuauagauuuugcccccuucugcauauuugacucucugcaguguuggagagaauuuauuguuuuccaccaggaacauuucauggaugcuuuuguuggaugaugccuuauucuuugaccauguauuaaccaagaccuuagacauuauuuuauuguuuuuaaaauugucuuuucuuucuacugcaggcagauaaguugcugucacaggauuuugugcagauaauggaggauauuauucucacgcuaccuaaaaacaggcagauuuuacuauauuccgcuacuuucccucuuaguguacagaaguucauggugaguauaaaucuguacuuggaaucagugccauccugugaccuuugaguaugcuuuuauuuguaauuacaucuucauaucugugaauauacuuuaugcuaauuauuucaagccuuuggcucuuucuucaguugaucaauuaaagauuuguuuuacguaaauuaacugacuuuuuaagaagguuguaauaguaacuuaauuaaauuccucaucuuucacuuaguuuuuggugucaugaugacauagccauuggugcuagcugaauugauuccgguauuauucuauauacaaaacagagcuugaguauccuaaacugaaauccaaaauacugcagaauuugaaaccuuuugagccacgaacaugaugcuaaaaggaaauguucuuuggauuuugaauuuucaaauuaaggaugcucagucacuaaguguaaugcacauauuccaaaauuagaaaaaauuuaaaaccugaaacacuucuguuccuaagcauuuuggguaaggaauacucaaccuguaguaacuuagcugcauuuuugagaucuuauaucuuaauuuauuucuaucgggucgggcaugguggcucaugccuguaaucccagcacuuuggggggccgaggcgggcagaucacaaggucaggaguucgagaccagccugggcaacauggugaaaccccgucucuacuaaaaauacaaaaauuagucuguuauggcagugcaugccugcauucccagcuacucgggaggccgaggcaggagaaucacuugaacccgggagguggagguugcagggagcagagaucgugccacuacacuccagccugggugacagagcaagauuuugucucaggguggcaggggggaaauucuguaaugacagaucauauauuuuguuuugaagagaguugcgucccuuacagcaagaguuuaucggacagaaacguauaggguauauuuugaauuugagaugaacucugcuuucauuuaagacgacgacucaucuuuuucccgcuccccccccagaauucccauuugcagaaacccuaugagauuaaccugauggaggaacuaacucugaagggaguaacccaguacuacgcauauguaacugagcgccaaaaaguacacugccucaacacacuuuucuccaggguaagaaguaggcuucugcuguugaauauuaucucucgagucccaguaaaacagaugauuucaucaauuuucccaccgucuucacuguauaaaaguucguaguguuucuggcuuggcacgguggcucaugccucccagcacuuuggaggcugaggcaggcagaucacgaggucaggaguuugagaccagccuggccaacauggugaaaccccaucucuacuacaaaauacaaaaaaauugggcaugguggcgugugcccauaaucccagcuacuugggaggccgaggcaggagaauugcuugaacccaggaggcggaggcugcagugagcugagauugcaccauugcacuccagcucugggcgacagagcaagacuccgucuugggaagaaaaaaaaaaagauuaaaaaauaauucauaguguuuccuaaaaggcagguuuaguuguugaccuaaaguugauacuaaaugauuaaccaagucacagauacacuuuugaauaguuucugaaauacuuugaccuuaacuaggguuaauccucauuauucacauauucuguauuugugaauuugcuuagucacuagaauuuauuuguaacuccggaauuaauacucaagguaguucagcagucauuuguggacguguacaguguggcaaagaguuuaagucaccugacaugcacauucccagcugaggucgaagaaagcaaucucuguccucuuguuuagcucucauacugugaacaaggguccuuuucacagucugccauguuuuucaaguuuuuguugcugauuucacaguuuuaauuggccccuacacauggugcugaagugcugcccaaugcugguggcauugguugugaguauauuaaagaagguauucuuggcugggcacaguagcucauaccuguaaucccagcacuuugggaagccgaagugggcagaucaccugaggucaagaguucaagaccagccugaccaacaggcugaaacccugucucuacuaaaaauacaaaaguuagccaggcauuguggugggugccuguaaucccagcuacucaagaggcugaggcuggagaauuguuugaacccaggaggcagcuguugcagugagcugagauugcaccauugcacuccagccuggacaacaagagugaaacuccauuucacaaaaaaaaaauaaaauaaaauauuuuuaaauggaaacacauaaaacauaacuacuuugaaucagauaaucaauuguauuacucuuguugacaguuauguggcccuuaagaaauauacucuaauacgguaaaucuuagauauuauuaucuuccaucuauuauuuacaauuuuuacaauuuaccaucucucucauaucaugagauucuaaguuuuagaccauguuaauguuucuuuuuugcugguucguguuuucaagauuuggcaaaccaaaugaagguuuuuuuuauuuuucucauacuuauuuuuuucugugcucagcuucagauaaaccagucgaucauuuucuguaacuccucucagcgaguugaauugcuagccaagaagauuucucaacuggguuauucuugcuucuauauucaugcuaaaaugaggcaggugaguauaaaacuagaacuugcacaaauuuaauaagaaaucucuuucuuuauuuuguuuuaauguucuuuuaaauguccugaguuuaagaauaaacuguuccuuaguagccaaaggaccuuucauuuugaccucccucagguucaauuuucuagcaauaaaauagggauaauaguacauauucauaacuuacaagguuguuaggaaaauuaagauaaauguuuaaaugaguacuuuggaagcugucaggcaugauacaaauguaaaauuuuauucuucccuuccuuuccauguuuaauucucuguuuaauacaguaaauagccacauguggcaauuuaaaucaguuaaaauuaaaauaaaaagucaguuucucaaucacagccacauuucaagugcucaguuaggcaccuguugcuacuggauaguguauuggaauuggaaguacagacacaaauauuuccuuuauuauagaaguuuuacuggacagcacugcucuggauuuuuaaauauggccccucagcuggcugauuuuucuuuuuuucuuuacuguuugccuuuagaaaaagauacaauaucuaaauuucagaauuugauuuagcaaaaaauaauuuaaaacuguaacaaaaaugacuuuuuuguuaacuacauuaugaaauuucguaaguaaacaguuucuguagacgaagauaucaagaacuuaacucauuugguuuugaaagcagcuuaauaucauggaucacuuauaaacagauuuuggguagaacugaucgucugggagaaauaauuaugggaaauuuggggcuguauaugaguguuaaucaaauggaauacauugcuuucuccuaggaacaucgaaaucguguauuucaugauuuccgaaauggcuuaugccgcaaucuuguuugcacugguaaguauuuuuguauuuccuuuacccaguguuuuucucccaaguuguuuuuugcuuucucuguucauauuacauagugcaaccugugacauaguccgacacacccuaccacuacuucuaggauuucugaaguugaaaaugaacucuugucagcuccugauacuggguuccauaucugaaacuuuagaagacuuacucuggcacucauaccucaucucugucuuuuuuuugggggggggggggagggggauggaaucuuugucacccaggcuggagugcaguggugcgaucuuggcucucugaaaccuccaccuccuggguucaagugauucuccugccucagccucccaaguagcugggauugugggcgccugcuaccgcuuagcccggcuaauuuuuguauuuuugguagagacagggauuucaccauguuggccaggcuggucucgaacuccugaccucaggugaucuuccugcuuuggucucccaaagugcugggauuacaggcuugagugcacccagccucuuuuagacacauuuuuuaaaacuugcuuacaauuacuggaaaaaaguaacuugggagcagaaaguuauuuaugauaaugugauuaugaaagguaaugccaguaaugugcaaaugcauuugaauaacugaauuaaauuaauaaacuuagguuaugcuagaaauauguguuaguauuguacugagagacauuucuaaauugaaaaaaugaaaauuaucuuuuuuuuuuuaagaucuguuuacccgagguauugauauacaagcugugaaugugguaauaaacuuugauuucccaaagcuggcagagaccuaucuccaucguauuggaagaucaggugaggaaaaaagaggugauauucuugguagaaguucuuuuuugaggcguguaaugacuaaauuuuguucuuuugugaaauagaguacaguagcuaugagaacagugaauuaacaguaauucaguuguuugguauuuaagacuaauuucuaauucuucuguagcauuuauuaagaaaaguuaaaauaacugcuuaauuugagaugaaauuaacacaugagaacuucacucauuaggugguauguucugugacuguuguuuaauguguauuuuauggcaguuuugacugccauuuugucauuugagaaaggugaaaugaaguacuauuuugggcugcgaaaccugaaguuguagggaaaccuguguuugaagaccauuaagaaguuguuuugcauacuaagaauggcacugaacaucauuaucaauccugugugguuuugccacugcuugacuugcacaauucacauugauuuucauauuuuauucauuaaaauuuuuaaacgcauguuuuuuaggucgcuuuggucaucuuggcuuagccaucaacuugaucacauaugaugaucgcuucaaccugaaaaguauugaggagcagcugggaacagaaauuaaaccuauuccgagcaacauugauaagagccuguauguggcagaauaccacagcgagccuguagaagaugagaaaccuuaac

SEQ ID NO: 13073 - RNA, 31708 nt, Homo sapiens
guuaagguuucucaucuucuacaggcucgcugugguauucugccacauacaggcucuuaucaauguugcucggaauagguuuaauuucuguucccagcugcuccucaauacuuuucagguugaagcgaucaucauaugugaucaaguugauggcuaagccaagaugaccaaagcgaccuaaaaaacaugcguuuaaaaauuuuaaugaauaaaauaugaaaaucaaugugaauugugcaagucaagcaguggcaaaaccacacaggauugauaaugauguucagugccauucuuaguaugcaaaacaacuucuuaauggucuucaaacacagguuucccuacaacuucagguuucgcagcccaaaauaguacuucauuucaccuuucucaaaugacaaaauggcagucaaaacugccauaaaauacacauuaaacaacagucacagaacauaccaccuaaugagugaaguucucauguguuaauuucaucucaaauuaagcaguuauuuuaacuuuucuuaauaaaugcuacagaagaauuagaaauuagucuuaaauaccaaacaacugaauuacuguuaauucacuguucucauagcuacuguacucuauuucacaaaagaacaaaauuuagucauuacacgccucaaaaaagaacuucuaccaagaauaucaccucuuuuuuccucaccugaucuuccaauacgauggagauaggucucugccagcuuugggaaaucaaaguuuauuaccacauucacagcuuguauaucaauaccucggguaaacagaucuuaaaaaaaaaaagauaauuuucauuuuuucaauuuagaaaugucucucaguacaauacuaacacauauuucuagcauaaccuaaguuuauuaauuuaauucaguuauucaaaugcauuugcacauuacuggcauuaccuuucauaaucacauuaucauaaauaacuuucugcucccaaguuacuuuuuuccaguaauuguaagcaaguuuuaaaaaaugugucuaaaagaggcugggugcacucaagccuguaaucccagcacuuugggagaccaaagcaggaagaucaccugaggucaggaguucgagaccagccuggccaacauggugaaaucccugucucuaccaaaaauacaaaaauuagccgggcuaagcgguagcaggcgcccacaaucccagcuacuugggaggcugaggcaggagaaucacuugaacccaggagguggagguuucagagagccaagaucgcaccacugcacuccagccugggugacaaagauuccaucccccucccccccccccccaaaaaaaagacagagaugagguaugagugccagaguaagucuucuaaaguuucagauauggaacccaguaucaggagcugacaagaguucauuuucaacuucagaaauccuagaaguagugguagggugugucggacuaugucacagguugcacuauguaauaugaacagagaaagcaaaaaacaacuugggagaaaaacacuggguaaaggaaauacaaaaauacuuaccagugcaaacaagauugcggcauaagccauuucggaaaucaugaaauacacgauuucgauguuccuaggagaaagcaauguauuccauuugauuaacacucauauacagccccaaauuucccauaauuauuucucccagacgaucaguucuacccaaaaucuguuuauaagugauccaugauauuaagcugcuuucaaaaccaaaugaguuaaguucuugauaucuucgucuacagaaacuguuuacuuacgaaauuucauaauguaguuaacaaaaaagucauuuuuguuacaguuuuaaauuauuuuuugcuaaaucaaauucugaaauuuagauauuguaucuuuuucuaaaggcaaacaguaaagaaaaaaagaaaaaucagccagcugaggggccauauuuaaaaauccagagcagugcuguccaguaaaacuucuauaauaaaggaaauauuugugucuguacuuccaauuccaauacacuauccaguagcaacaggugccuaacugagcacuugaaauguggcugugauugagaaacugacuuuuuauuuuaauuuuaacugauuuaaauugccacauguggcuauuuacuguauuaaacagagaauuaaacauggaaaggaagggaagaauaaaauuuuacauuuguaucaugccugacagcuuccaaaguacucauuuaaacauuuaucuuaauuuuccuaacaaccuuguaaguuaugaauauguacuauuaucccuauuuuauugcuagaaaauugaaccugagggaggucaaaaugaaagguccuuuggcuacuaaggaacaguuuauucuuaaacucaggacauuuaaaagaacauuaaaacaaaauaaagaaagagauuucuuauuaaauuugugcaaguucuaguuuuauacucaccugccucauuuuagcaugaauauagaagcaagaauaacccaguugagaaaucuucuuggcuagcaauucaacucgcugagaggaguuacagaaaaugaucgacugguuuaucugaagcugagcacagaaaaaaauaaguaugagaaaaauaaaaaaaaccuucauuugguuugccaaaucuugaaaacacgaaccagcaaaaaagaaacauuaacauggucuaaaacuuagaaucucaugauaugagagagaugguaaauuguaaaaauuguaaauaauagauggaagauaauaauaucuaagauuuaccguauuagaguauauuucuuaagggccacauaacugucaacaagaguaauacaauugauuaucugauucaaaguaguuauguuuuauguguuuccauuuaaaaauauuuuauuuuauuuuuuuuuugugaaauggaguuucacucuuguuguccaggcuggagugcaauggugcaaucucagcucacugcaacagcugccuccuggguucaaacaauucuccagccucagccucuugaguagcugggauuacaggcacccaccacaaugccuggcuaacuuuuguauuuuuaguagagacaggguuucagccuguuggucaggcuggucuugaacucuugaccucaggugaucugcccacuucggcuucccaaagugcugggauuacagguaugagcuacugugcccagccaagaauaccuucuuuaauauacucacaaccaaugccaccagcauugggcagcacuucagcaccauguguaggggccaauuaaaacugugaaaucagcaacaaaaacuugaaaaacauggcagacugugaaaaggacccuuguucacaguaugagagcuaaacaagaggacagagauugcuuucuucgaccucagcugggaaugugcaugucaggugacuuaaacucuuugccacacuguacacguccacaaaugacugcugaacuaccuugaguauuaauuccggaguuacaaauaaauucuagugacuaagcaaauucacaaauacagaauaugugaauaaugaggauuaacccuaguuaaggucaaaguauuucagaaacuauucaaaaguguaucugugacuugguuaaucauuuaguaucaacuuuaggucaacaacuaaaccugccuuuuaggaaacacuaugaauuauuuuuuaaucuuuuuuuuuuucuucccaagacggagucuugcucugucgcccagagcuggagugcaauggugcaaucucagcucacugcagccuccgccuccuggguucaagcaauucuccugccucggccucccaaguagcugggauuaugggcacacgccaccaugcccaauuuuuuuguauuuuguaguagagaugggguuucaccauguuggccaggcuggucucaaacuccugaccucgugaucugccugccucagccuccaaagugcugggaggcaugagccaccgugccaagccagaaacacuacgaacuuuuauacagugaagacggugggaaaauugaugaaaucaucuguuuuacugggacucgagagauaauauucaacagcagaagccuacuucuuacccuggagaaaaguguguugaggcaguguacuuuuuggcgcucaguuacauaugcguaguacuggguuacucccuucagaguuaguuccuccaucagguuaaucucauaggguuucugcaaaugggaauucuggggggggagcgggaaaaagaugagucgucgucuuaaaugaaagcagaguucaucucaaauucaaaauauacccuauacguuucuguccgauaaacucuugcuguaagggacgcaacucucuucaaaacaaaauauaugaucugucauuacagaauuuccccccugccacccugagacaaaaucuugcucugucacccaggcuggaguguaguggcacgaucucugcucccugcaaccuccaccucccggguucaagugauucuccugccucggccucccgaguagcugggaaugcaggcaugcacugccauaacagacuaauuuuuguauuuuuaguagagacgggguuucaccauguugcccaggcuggucucgaacuccugaccuugugaucugcccgccucggccccccaaagugcugggauuacaggcaugagccaccaugcccgacccgauagaaauaaauuaagauauaagaucucaaaaaugcagcuaaguuacuacagguugaguauuccuuacccaaaaugcuuaggaacagaaguguuucagguuuuaaauuuuuucuaauuuuggaauaugugcauuacacuuagugacugagcauccuuaauuugaaaauucaaaauccaaagaacauuuccuuuuagcaucauguucguggcucaaaagguuucaaauucugcaguauuuuggauuucaguuuaggauacucaagcucuguuuuguauauagaauaauaccggaaucaauucagcuagcaccaauggcuaugucaucaugacaccaaaaacuaagugaaagaugaggaauuuaauuaaguuacuauuacaaccuucuuaaaaagucaguuaauuuacguaaaacaaaucuuuaauugaucaacugaagaaagagccaaaggcuugaaauaauuagcauaaaguauauucacagauaugaagauguaauuacaaauaaaagcauacucaaaggucacaggauggcacugauuccaaguacagauuuauacucaccaugaacuucuguacacuaagagggaaaguagcggaauauaguaaaaucugccuguuuuuagguagcgugagaauaauauccuccauuaucugcacaaaauccugugacagcaacuuaucugccugcaguagaaagaaaagacaauuuuaaaaacaauaaaauaaugucuaaggucuugguuaauacauggucaaagaauaaggcaucauccaacaaaagcauccaugaaauguuccugguggaaaacaauaaauucucuccaacacugcagagagucaaauaugcagaagggggcaaaaucuauaauccccaucuucuaggggaaaaaaaaaauucuacacuacacagacaaccucccccgcuuucuguaacagaauuuaauuaauuuauuuauuuuuagagacagcauuucacucugucacccagcuggagugcaguggcauaaucguaucucacugcagccugaacuuccugggcucaagugauccucuugccugagccuacugaguagcuaggacuacaggcacauaccuccaugcccagcuccacaacagaauuuuaaugugaugauucucauuaaagagguaguaugguguaguguuuaaaaguacggguucuggccgggcgcgguggcucacgccuguaaucccagcacuuugggaggccgaggcgggagaaucacgaggucaagaguuugagaccagccugaccaacauggugaaaccccaucucuacuaaaaauacaaaaauuagcuggacguggugguacgcaccuauaaucccagguacucgggaggcuggggcaggagaaucgcuugaacuugggaggcggacgcugcagugagccaagaucacaccacugcacuccagccuaggcgacagggcgagacuacuccgucucaaaaaaaaaaaaaaaaaaaaaguaaggguucugaggccgggugcaguggcucacgccuguaaucccagcacuuugggaggaccaggcgggcggaucaccugaggucaggaguucaagacaagacugguugauauggugaaacccugucucuacuaaaaauacaaaaauuagcugugcacaguggcaagcgccuguaauuccaacuacucaggaggcugaggcagaagaacugcuugaaccugggagauggagguugcaguugagcugagaucgcaccacugcacuccagccugggcaacagagcaagacucugucucaaaaaaaaguacagguucuggagcuaaacugccagguugaaaucuugccuccuucauuucucagcugugugggaauguuacagaacuacucuguacuucaguuuccacaacucuaaaauuguaaaacuauuaaaauuuggauguuuacauaauguaguaacuacuuuaccgggauuuagaaaaaacuuggcuaaggccaggugugguggcucacgccuguaaucccagcacucugggaggcuuaggugggcagaucacuugaggucgggaguuugagaccagccugaccaacauggagaaacccugucucugcuaaaaguacaaaauuagcccggcaugguggcacaugccuguaaucccagcuacucgggagggcugaggcaggagaaucgcuugaacuugggagguggagguugcggugagcugagaucgcaccacugcacuccaagcggggcaacgagacucugucucaaaaacaaaacaaaacaaaacaaaaaagaaaaaacuugacuuucaaguuauccagccacuccucuucuuaaaaauuaaaccuaaacucuggcaucuauaagacaaaaagcugaauuccuaugaaugccuaucuauugcaucugaaguauaaaacguauuuuauaagcaaauuagaaguuggaugucuacauacuauaguaacuacuugacaggauaccuaccuuauagguuucuuguaaaaauuaaauggaaaaaaaaaaaaaaaaacaaaccauguaaagcacuuagugcugguacccagugauuaauaaauguucucucucauuacuuaaagauaaaagucugauuugaauuaaaucauguuaccuaaaacacaaaccaggccgggcgugguggcucaugccuguaaucccagcaauuugggaggcugaggcaguaggaucaccugaggucaggaguucgagacuagccuggccaacauugcaaaaccgcgccucuacuaaaaauacaagaauuagcugagcgugggugguacauaauuguaaucucagcuacucagaaggcugaggcauaagaaucacuugaagcggggaggcagagguuguagugagccgagaucacgccacugcacuccagucugggugacagagugagucugucucaaaaaaaaaaaaauaauaauaauaauaauaaaccucaacccaaaugugaaaauaaccucaugucaaaacauuaacaacgcugaucacuauagauccuccuugacuuacaaugggauuauguucugauaaauucauccuaaguugaaaauauuacccaaaccuacugaacaucaucgcucagccuagccuccuuuaaacaugcuccacuuaccuuagcuuacaguugggcaaaaucaccugcaacgccguauacuguagaguaucggcugucugcccucaaucaucauguggcugacugggagcugcaguuugcugcugaugcccagcaucaugggaguaucauauagcauauuacuaaccaggaaaaauaucaaucuuaaaaauucaaaguacaguuucuaaugaaagcuuaucacuuccacugaaaaacuguaaagugaaccaucuuaagucagggaccaucuguacauguacaaaacauggcuagaucccaggacuacagauuuuaauaaguuuuuaaaaggcauuuauaacauggugagauaauacauguaacagagauuaaaaaccaaacaguacaaaguaguaugcacaaaaugagaagagacaauauauauuauaugcuuuuaaaaauuaaucacagagcagaaagagacuuagaauaaauuuggcauugagguuauucacuccucuacuaaaaaauuaaaaccuaaugucugcuaucucuaagaaaaagacaaaaugcugaauuccaaugaaugccuauaaucuacucccucugacggguaaaacacauuuuauaagcaaauuaauuuaaacugauuguuuauguguuuauuagaucauaaacacaagcagcuuuugcuucauucacuggcaguuauaagcaaagcacagaaaaguacagaacaguauaaugccaaaugaagagacauuaccucauccaauacuaucaucuggacaugaucaaccuuugcuacuccuuucuuaauaagauccaggauucucccagggguagcaaucaccacgugcacuaugcaagauuuagaaaacauacauucucauuaauuuuaauuugagcaaagaggauaaagguuuauaauauuacaguccugagcugcuuaaugauaauucugagaaaugcauugcuaugugaugguauagccuacuccauuguauagcuccauuauaaucuuaugggaacaccgacauacgugcagccgucacugaccacaacauuguaugcagcacaugacuaucuuuuauuagaaacaacuaggccgggugcaguagcucaucccuguaaucccaguacuuugggaggccgagguggguggaucacaugaggucaggaguucgagaccagccuggccaacacggugaaacccugucucuacuaaaaauacaaaaauuagcugggugugguggugggagccuguaaucccagcuacucaggaggcugagguaggagaaucgcuugaacccaggaggcagacguugcagugagccgagaucacaccacugcacucuagccagagcaacagaguaagacugugucucaaauuaaaaaaaaaaaaaaaaagaaagaaagagaagaaacacauuguguuauagagguggaaauaacacaaaaaggcacaaagauguguuuuaggauaaagacuuccauuucaccacaggaugcuuaaaaaauauuuguuucaccucuacauugggugggguacagcuuccuaaaucaccugcugcuuucaacaguaggcauacuuucuugucuuaggauaauucucaauuaauagcagaaggcacaccagacuucugacauaagagcaaugccucuaaucuagagcagugagccgaguauuguuaaaaggaucaaacaagauaauuuuuuaaaaaccuaugcaauacaaagaauguaucacauaauuaucauauauaauauucuaacuaaaaucaagauauaauuuuauaugagugaucucaucuugcuguuuuguuaccuuuuuccacucggcaauguaucaugaauccucuucaugaaaaugaauacaggucaacuuuacucuuuaaugacuauguagaauccuauucagauuauaccuuaacguauuuaguuagccaaucuccuucuaaguuggccaauuuuucggcacgacaauaccaccccauagcaaacaacuuuguaccuacagcccugcauuuacccaacuuuuuucuucaggaaagauucuuaaaaauauacauuuauggccgggcacgguggcucacgccuguaaucccagcacuuugggaggcugaggcagguggaucacgaggucaggagaucgagaccauccuggcuaauacggugaaaccccgucucuacuaaaaacacaaaaauuuagccuggcgugguagcgggagccuguaaucccagcuauucaggagacugagacaggagaauggccugaaccugggaggcggagauugcagugagucaagauugcgccucugcacuccagccugggcaacagagcaagacuccaucuccaaaaaaaaaaaaaauauacacacacacacacacauuauauauacauuuauaauuuuaaaauauacucccaaauugcccaugauagagauguaaguuuacacccccacauuuacaauguagccuauuuguccacaaacucacauuaucgucuacuaauacuuuuagcuuuaccaauuaaacagguaaaauuauuauaaacuugcuguuuuacaauuacuaauaaagucaaauaucguuuucaauuaugguaauuugucuuuuucgcuugaaugcaguggucauuuccuuuucuuacugcaguauuucuguuccuuaauucuuaaaaacaauuuuuaauaauuuacugaaauacuugugacuaaaauaacagagagcuacacuaccuuuuaguaaucauuucuuaccuguaucaucaagccucauuaugucaucucguaaauugguuccuccugugguugccaucacuuuggccccucccauguguuugcugaccuggaugcaaauuugacugaccuguagagcaaguucucuagugggaacaaucaccauugcugaaacaguaucaaggaauauauaagaaaauauggggugaggugggagaacaugcuauacaucauuauuuacaaaauuuaagaagcuauagaaauacugcgccuuaugaugcaguggcucacaccuguaacugcaccuuaugaugcaguggcucacgccuguaaucccagcacucugggaggccaaggugggcagaucaccugaggucaggaguucgagagcagccugaccaacauggugaaaccccaucuguacuaaaaauacaaaaauuauccaggcgugguggcacgcaccuguagucccaccuacucaggaggcugaggcaggagaaucacuugaacccggaggcagaggcugcagugaggcaagaucgcgccacugcacuccagccugggcgacagagugagacucagucucaaaagaaagaaagaaaaaaaaaauagccuaggcacgguggcucacaccuaccuauaagcccagcacuuugggaggccaagguggguggaucaccugaggccgggaguuugagaccagccugacccuaucucuacuaaaaauacaaaauuagcugggcguggguggcacaugccuguaaucccagcuacuugggaggcugaggcagaagaaucgcuugaacccgagaggcagagauuguggugagccgagauugugccacugcacuccaguccaggcaacaagagcgaaacuccgucucaaauaaaaaaaaagaaaagaaacacugccccuuauaaucuagauaccgagauguauuaaaaaauugggcugggcagcacagugaguaacucaugccuagaaucccagcacuuuuggaggcugaggcaggaggaucguuugagcucaggaguuuaagaccagccugggcaacauagcaagaccccaucucuacuaaaaaaaaaaaugaaaaaaauuagcugggaaugguggcaugugccuauagucucagcuucuggggaggcugaggcaggaggaucacaucagccugggagauuaagacugcauuaagcuaugaucaugacaccacacuccagaaugggugacacagcaagacucugucucccccgccaaaaaaauuaagaaauaaaaauaaaaaguugaaucauuacacaggacauuaugaaaacucaaauguacaaaucucuuuaugaaaagagaaccuauuauagugucccagauuuagacucucccucagcaauacuauuauauaaauauuaaacucuuccucuucuuuuuuuugagauggagucuugcucuguuguccaggcugaagugcaguggcugccaucucggcccacugcaaccucugccucccagguucaagcaauucuccugccucagccuacugaguaaccgccaccacacccagcuaauuuuuuguauuuuuaguagagacggggauucaucauguuggcccagcuggucucaaaccccugaccucaagcaauccuccugccuuggccucccaaagugcugggauuacaggugugagucacugcaccuggccuucugcugcugcugcuucuucguuuugagacagaucucgcucuguuacccaggcuggagugcagugacaugaucuuggcugacugcaaccuccaccucccagguucaagcaauucuccugccucagccuccuugaguagcugggacuacaggcacaugucaccacacccagcuaauuuuuguauuuuuaguagagacaggguuuuaccauguuagcgaggcuggucuugaacuccugaccucaggugaucugccuugccucggccucccgaagugcugggauuacaggcgugagccaccacacccagccaauacuguucuuaauuacaaacuuucagcauguugaguucgcaacuauuagcucaaaguuuauuaacaauauuucuaaaagccccaacuacauuugagucagauucacuguguaaaauaccuagguaggaaacuccugcuaccuaggcucuauuuacaucauaugaaagugggaagaaaagauaauuacagaucacgaaagcuaaaaauguaaaguuucagagaugaaaucuuaauuccauuaacuuacauugaauauaacuaugaaaauuuuuuauuccccacugccuaggcucuuaaaaucccaaaauccacagccuuuaaacagaaguucauguuucuacaaggaauucuguuaacacucaucugccacaagaaauaguuccauaguuuauaaguagcaaugucaacuaauuuaacuucucaugaccucagccgccuuuuuuuuuuuuuuuuuuuuuuugaguugagagucucacucugucacccaggcuggagugcaguggcacaaucuuggcucacugcaaccuccaccuccuggguuccagugacucucgugccucagacuucugaguagcugggauuacaguugugcgccaccaugcccagcuaauuuuugcauuuuuaguagagacaggguuucgcaauguuggccaggcuggucuuaaauaucuggccucaggugauccacccacuuugaccucccaaagugcugggauuacaggcugugaggcaccgugcccagccucagcuuuccuaccuauagggcacuaauacuuauuuuuccugucucacuggaaugcugucacaaguguguaucauauaagaauacucuuaaaacuagaaaucucuaaaaagcugggaaucauuuuuaauaaaaagaccaucaucaggcuaaaaaaagaaaaaaccugaaaagaaagaauacaaauuuuagauaauguaaauucugacuaaaaaaagaguaucuucuacacauggcuccaaggcugaaacucccauuuuuaguuuaaaaacaaacuuuuauucaacuaaccuuguauauuguccuucuucaggucuagccguucaaguaagggaaugagguaggcaccgcucuugccuguuccauuuuuugcucuagcuaagauaucccuaccagauaaagcaaugggaaugcucuccuccuaaaagagauaagacaauacaaaauuacuucugaauguaguacacaagcaaauuccucucugaaauacacugaaggauaccucuuucgguauugcuuuaaguguccuaaguauccuacauuugaauucucacaugaauagcagagauccaaguaaaucagcacgaccagucaacaucaacaucauuauaaaccaguauuuaccagaacugcucacagaauuuuaaauuguaacccaaugucauaagaacugugauauguguguaucugaagagaacaacaaagaaaauggaggaacucaggcugacccauaaauagcacuugaaaauacagacaaaacaaaagcaaagccuccuucaaauaaaaauuggaaaaauggccaggcacagcagcucaugccuguagucccagcacacugggaggcagaagugggggaucacuugagcccaggaguucaacaccagcccgggcaacuaggcaacauggaaaaaccccaacucuacaaaaauuacagaaaguagcuggguguggugguggguguccauaaaccuugagaggcugagccaggaggucaagggugaagugagccaugauugcaccacuguacuccagcaugaaagagaccucgucucaucucaaaaaaaaaaaaaaaaaaaaaaggcuagauacaguggcucacaucuguaaucccaccauuaugggaggccaaagcaaaacgaucacuugagcccaggaguuugagaacagcuuaggcaaaauggugagaccccaucucuacaaaaauuuuuaaaggaaaaaacaaaaacaauuccaagguaagacuauauauauuuugagacuagcacaccaauuugaccacagugaaaaauuguagcuuggacaccucaucccugcaacaaaacacgaauaggcugggaaaguuuaaccucagguccuauuugucauuuauuuauauaauaaguaaaucuccaaugucugucccacagccuacuucucuguucuguaaugugcucucuauugaagguucaauucuauugcagcuaccucaaauacggucacaucacuaaaggugaccucucauuuuaauauuuggcuuacuuuguuaucuauuuugcaaauaauaacaguaguucauacuaacuuaaauuucccagacaacagcaaaggauucccaaaaguuacuuaaaaauaaauagacauauacaaagagaggucaggaguucaagaacagccugggcaacauggcaagcacccccacucuuugcaaaaacaaaacaaacaacaacaacaaacuauaaaauacaauagaucguugaaaaagcuugaucguugaaaaauuguuaaaaggaaauuauguggaauuuuuuuuuuugagacagagucucgcucugucgcccaggcuggagugcaguggcacaaucucggcucacugcaagcucuggcucccggguucacgccauucuccugccucagcuuccugaguagcugggacuacaggugcccgccaccacacccggcuaauuuuuuuuuuguauuuuuaguagagacgggguuucaccguguuagccaggaugguguugaucuccugaccucgugauccacccgcuuuggccucccaaagugcugggauuacaggcgugagccagcgcgccgggccaugauguggaauuuuaauuuuuuuucuuuuuuuuuugagacagaguuucgcucuugucacucaggcuggaguacaauggugcgaucuuggcucacugcaacuuucgccuccugguucaggcgauucuccugccucagccucccgagcagcuuagauuaacggcgugugccaccacacccagcuaauucuuguauuuuuaguagagacgggguguuucaccauguuggccaggcuggucuugaacucaugaccucagaugauccaccgaccucggccucccaaaguguugggauuacaggcaugagccacugugucuggccugaauuuuuaauuucuaaaacuaagauacuaggaaccaaauucacagucacugacauuugucccuucuaugccugggcuaacgacaaaaacaaacaaacaaacaaaaaacagcuuuagcccuuuaaagcugcuauugguagaaaugacuaaauaagcaggaugacuuccaucucccacgacaacacucuuucuaccuagagcuccaaucacaggauauaaauggguuccauauggucagaacaacacagcugccagaacaacugugaaaauauuguuguuggcugggaacgauggcucaugucuguaaucccagcacuuugggaggcugagguaggcagaucaccugaggucaggaguucgagaccagccuggccaacauggugaaaccccaucucuguuaaaaauacaaaaauggucauggugcgcaccuguagucccagcuacuugggagccugagguaggagaacugcuugagcccaggaggaggagguugcagugggccaagauugcgccacugcacuccagccugggcaauggagcaagacucagucucacaaaaaaaaaaaaaaagagagagaaaagaaaagaaaauacuguugucuuguucuuacagccagcauuaaagacucugcuuauuaagguaaagcaaacaaagaagaaaaccuuggcuuuaacccuuuggucuuaaauuucuucccucaucacagauaagugaaccauuauuuccaguuguuccagaggcucccauuacccugucaccucagguuuucucuuuugugguucuguggugccaguagucuguaguuuuuaacaggcugccugcacacuacucaguuuuacaguauugaaaaaguaagauagguggucucugauggucucauaacgacuugcugggucagguucuuuaaaguguaaaccuuuuuuucaaucaagugaggcagaacagaauuagacuagagguauccuaaucccccuuuucaguucaucuuuugacugacuugauuaaggccauugacuucuauuccuuugcccucuuugacagggauuauacccuacaaaaacuguucaaggauaaagcuuuaacaaaguacaugugauagacuguaaguuaagacacccugauauuuugccuuauaugauggccauuaugauuaacagucagugaauucagcacauccacacugccucuuaccaguguuucucaggaaauaaugaaaagcaagagaauucaagucaaguucaaaaagcugugaaauacaagaggaaauuaugaggaacugccagggagaaggcaaaggaggaaggaaacgaaaacuuuuuuuaaaacuuacuaugugcucagcacaacuuucaaguuagguacuuuguuuuacaacugacaaaauggauccuaaacaggauuaguuugcccaaggucacaaagcaagaaaugcuuuagccaguauuugaacuuagaucugcacauaacauguaggcaagaaguuggagaaaauggaacucucauacacugcuagugggaauguacagcuacgcuggaaaccagccuugcaguuccucaaaagguuaaaaagaguuaccauaugaacuagcaauucuagguauacagcgaagagaaauaaaaacaucuccacacaaaaaccugcaccugaauuuucauagcagcauuauccuuaauagccaguuccuucuauguuuuuuuuuauaauaguacaaacuuuauucauaaauaaaacuucauaagguuaaagcagggucaguuccuauuuuaaaaagggaacaggggaaggcagccugcuauuuuauuuaaaaucacaaguuagguuuuucagacggaugacaguugagaucauuaaauccccuuccuacuucucagauuuucacaaaauagcacauuaaauccucaguccuuggaaaacaaccccaaaugucuaccaacugaugacuggauaaaucagaaguaauagagccauacaauaaaauauuauucaggaaaaaggaauggaauauugauacaagcuacaacacagaugaacucggaaaacauuacgcuaagucaaagaagccagucacaaaaaaaacacauacuauaggauucuauuuauaugacauguccagacuaggcaaagcuagaaugacagaaaguauaccagugguuguuuaggggugugggaaaaugaggugugacugcuaaaaggguuucuuuugugggacugaucaaaauguucuaaaauuuauugugguaaugguugcagaacucuaaaugcacuaaaaagcauuaaauuguauacuuuugaugugugaugucauuuauaucucaauaaagcuauuacccccaaaaaacaaaaccccaaaaaaccaaccccacaagcuuagggcugacaucugccaccuuaggucuccaaauucacauucacuguaacguuuagauaaugacugaagaguauuuguuguguuuugguuacucuaguaucccuuuacuaaguaacaccccaauuuccuucuaaggaauuacauaugcccuggucuccccugucccaacagaccaagccucaccaauuuucuaagccaagugguagacacauagcccacacugggccagcggaauguugccuccuaagaaucuaaauuguuauagugcauccauuacagcuuccuaaguccuucagagcuaucucaauucuuagucauuuccaaguauguuucucuagccuucucaaucuugugaauucccguuauuuuuccaauaaauuuccuuuugcuuaaguuagaucgaguugguuucugaugccuauaauuaaagaaugguuuauuuuccaaucuccuagcauugagaggcauuuuacaaaagugugguaccaacaaaagcucaacaucacccaacuagcugcauuuacacugacugcuuccucuuauuuuccaaaccuuaauuuccaagagggaaaaaaaaccuaugguuaaaggccgggcgcgguggcucacgccuguaaucccaacacuuugggaggccgaggugggcagaccaugaggucaggagauggagaccauccuggcuaacauggugaaaccccgucucuacuaaaaaaauacaaaaaaauuagccgggcgugguggcaggcgccugcagucccagccacuugggaggcugagguaggggaauggcgugaacccaggaggcagaacuugcagugagccaagauugcaccacugcacuccagccugggcgacagagcgagacucugucucaaaacaaaauaaaacaaaacaaaaaaacaaccuaugguuacuccagacgagguagcaaugauuguuacaaauguccccugcuuaacaggaaaaaaaaaaagggagaugguaauuucuaauuauaucucuaauuuaggcuggggaugguggcucacaccuguaaucucaacccucugcaaggcugaggcaggagaacugcuugaggccaggaguucaagaccagccagugugacaaacugagacucugucuccccgaccccacccaaaaagaaaacaaaacaaaacacacaccaaaaaaaaaaacaaaacaaacaaacaaaaaaaaccuuugaguuuuuaggaaauauuuuuuucaaucaugauaaaccgauuguuagcaggaagaaugacuuauuuacaggauucagaaugcuauaauuccuaacuauaaauaguaaacuauuaauccucauuagaccuuagcugaccuggcacaaaauuuuguugccaacaguacggagcuuccauguuucccucaauaaucaacuacuucucauuucuucaccuucuuagaguuucgaaaaagucuucaagagguguucccaggguuuagaagcaacgagagaggccaucuuucucaaucauaaccccaaaguuaauauaaaguuucaaauaaugcuaagcagacaaaaacaguauauucuuaagccuuccaaagaagucuagguuccuauaaagcuauaccuuuagaauggcaauuauucuacuggccacagcauccagaccuagaacuggucacagauggcucuagaaauacguugugggagcaaucuguaguauaucugguuccagccugucaauguaaaagcucuuuugagagcauauaauuuuaagugccuaauucucuaacagucuuuuuuuuuuuuuuuuuuuugugagacagggucuugcucuguugcccaggauggagugcagugacacaauccuggcucacuuacagccucaaccuccugaacaucuaagacuacaugucccccaugcccagcuaauuuuuguacagucaggguuuugucauguuguuuaggcugguuuugaaccccuggacucaagcaauccacccaccuuggcuucccaaagugcugggauuauaggcaugagccacugcacccagccaauucuccaaaucucacagccaaacugcaacuaaauuccaucucaaacaaauauucaaaugcagaagacucacccaucuaaucaaggcaguuuuaauauuuaggggaaaaaaaaugccuggauaaaacuguaaaaccaagcaugauagaagagauacuuuuaggaaugggggagggaugacaaaaauaaaacgagaagguagauaagaauggaaagaauacuagaagacagccugccaugagguuauauuuuaccaggggggugaugggugcacccaaaucucagaaauagcaacuaaauaauuuacuuggccaggcgugguggcucacgccuguaauuccaguacuuugggaggccgaggagaguggaucgccugaggucaggaguucaagaccaaccuggacaacauggugaaaccccgucuccaccagaaauacaaaaaucagccggguaugcuggugcccgccuguaaucccaagucacuugggaggccgaggcacgagaaucgcuugaacccgggaggcagagguugcaguaagccgagagcacaccauugcacuccagccugagcgacagagcaaaacccugucucaaaaacaaaagaauuuacucauguaaccaaacaccaccuguucccccaaaaaaccuaugaaaauaaaaauuuaaaaaauuuuuuuacuaggggaucuguaaauuuuguuucgguucuaaaauccuaauauuugugacuuguaacucugauugauucuaagaaacacauaaucuugugcuuuccauggauccccaggacaaaacaauaggaaagaaaaaggcaauaaaaaaaaagaaaaaggcaauacaaguggugaccuugaguaucuaaaacaauauacucauacaauaccuugcuauuucaaaauacuuugguuguacacuacauuugaucuuaacaauaaaaauccugugagggagaguacuuauuucuacuuuacagaaaaagcuggaugucagauugguuaaguggcugaagaguuaauugccuauaugcuauaacaacacucagaguacaaguaacaaaguuaauuuuaaauuuuaauacaagguaagaaauaggagucagcaaauauccacuaagaaugaggacugggcuaagugcagugguucacaucuauaauucuagcacauugggaagccaaggcaggaggacugcuugagcccaggaggucaagaccagccuggucaacauggcaaaaccuugacucuaccaaaaacaaaaacaaaaacaaaaacaaaaaacaaccaggugugcugguacuacacuaucauccuuacucaggaggcuggggcaggaguaucacgugagcccaggaguuugaggcugcagugagcuaagauucugacacugcauccagcccaggcaacuuagcaagacucagucucuuuaaaacaaauuuaaaacaauuacgucuccuaaauuaacuaauuuccuuuuuugaaacuauuauauaaaauaacccauaacauuuuugagcauuuaucacguacuaggcauuguacuaagcaugugaauuaucucacuuaaucuuuacaacaacccuaugguauuauacuauuaccucaauuauauaggucaggagucuaagacuuauagaucccaaauaaccaauuuaugaaggaguagagcugggauuuaaucugggcaguucccuacaccaaguucaccugcagacaugaguuaccuaaguuucaucaaagcacgcuaaauaagcacaggcacuaugcuaaguacuagagauaaaaguugaaugaugcaguuccuacuguaaaggaacucucauaagaccucagugggccagguguguuggcucacgucuguaaucccaacacuuugggagacugaagcaggcagaucacaaggucaggagaucgagaccauccuggcuaacauggugaaaccccaucucuacuaaaacacaaaaaauuagccgggugcuguggugcacgccuguaguccccgcuauucgggaggcugaggcaggggaaucgcgugaacccaggagucggagauugcagugaguggacaucgcgccacugcacuccagccuggcaacagaguaaggcucugucucaaaaaaaaaaaaaagaaagaaaaaaaaagacuucaguguagauaaaauggcuuaacaugaacuacaucauaguagauuccuagguauuucuaauaccuacacccaaauuaccccucugaugaugcauauccuuguuuugauacuuuauccagccaaaagcacacucucaacucugggcaaucauuacccagcguucucugcuuggaacacagcucaauucuuccagguugucccaucuuccucuaaugacuacauacauacgcaauuccaacuagaaagguacucaucauauuacagugaauuaccuguacaauuagcuguccuuuccagacuguaagacagcaaccauauaucugucuuauucauuauagaauucccaaggucaaacacuuucuaggucacuccacacauguuggcucaaugaaaaaguacucagugaugucacaggguuuguccuuagcacagccugaauucaaucauuucaucaauuuaaguaugucuguugucaucauuuaucaaacuggccuauguauaaugcauguuuauauguacguguauauuuauguguauguguguguggauauguauauacaugcauuuauuuccuugcucuuuccacugaaaggaccaaguagcaaacaggguaccuaaugccugggucuuggucccuaauacuacuccacacuaaaaagaaucaaggauccuuggaugccaaugcugggccaggauagguauaagauaagccugcaucaugauaugucaaaaagcaagaaaggggccggguacgauggcucacaucuauaaucccagcacuuugggaagccaaagugggcgaucauuugaggucaggaguucaagaccagccuggucuacagggugaaacccugucucuacuaaaaaugcaaaaauuaguuaggugugguagcacacaucuguaauuccagcuacuggggaggcugagacacaagaacugcuugaacccaggaugggaaggcugcggugagccaagaucaugccacugcacuccagccucucugacagagcuagacuccaucucaaaaaagagaaaaaaaaaaaaaaaaaccaagaaaguacucaagaaaaaugaaggggacacaucauaaaaacauaggaaccaggcugaaagagcuuacauuggccagaucuaggcuauuuuuagaauaauaauaaaaaaaaaauugaaaaaaauugaaaaaaauggugaguauaaguccauacugauaacagauauauauggaugaggggaagggaaguuucuucuuuauaggggcaaauacagagggagugcuagaauuggaaagucaucauaacccaucagagcagagaugagaucaagcaagaaucaccaaugggugcuaaaacuaggggggaaauuuuguuauuuuuuuaaaaaaguaucaugccaugaauugcaaaucacaagauacgaaguuaaaucccaccucuaccacucaugagcuacaaguaucuuuggcuaagucaaguuucucaagcucagcacuacugacauuuugggccacaaaauucuuuguuguaaggggcuguccuuuagcauccccccauugaugauaauaaaaaauguuucuacaaauugcuaaauguccccugggggacaaaaauccucccugguugaaaacaauacgcuaagagaacugcucugaacuuuuguuuucucauccacaaaacggggauaauaccuagccugaacaucuaucuuacuggguuggaggaggaggguggccauaguauuauuguauuuguauggucuuaaaaugcaccccagauugcuuauucgucucaagggagaggggaaagagcaguaauuauagaagggaaaaaccacacaacaucuugacaggguaaucaaaauuaacaucaccaaagaggaauaaauggacacuaggcacaccuucaaacaugauacccugagaaggccauaaugugauuucugcauuauucgggcugagaaagccuaccuugaaucuaauuacuugggaauaucacaaaaucccaaaacgggaaauguacuauuaauaaaaaaagggggccaggcaugguggcuaaugucuguaauccuagcacuauggcgaacccaggaguuuuaaucagccuggauaacauagcaaaauccuaucccuacaaaaaaauagaaaaauuagccggguguuguggcacaugccuguagucccagcuacuaggaggcugacgcaggaggaucacuugagcccaugaggucaaggcugcagugagccgagaucaggccacugaacuccagccugggugacagggcaagacccaguugccaaaaaaaaaaaaaaaaaagagggaugggggaagggguuguaggcuguauuuuuaauaugcugaugucauaaaaagaagaacaaacacuagggaaacgcuaaugacuaaaaaagacauaauuacaaauaauaccugacccuagacuggauccuguauagaagaaaaaaacugcuauaaaggacauguuuggguccauuaauaauuagaaugacagaugagauagaaguauuuuaucaauguuaacugaagguaacuguacugugguuacguaagagaauauccuaaagaaauacacaccgaaauauuuagaguuguaaaagccaugauuuucuaauuuacccuuaaaaauuucagaaaaaguguguauacgugagagagaaauguuaguucacuguaucacuucugcagagcaaaaagaaaacuguuuaaugguugacacauaaccuuacauaugugauaaaaaggguuaacauaccugaauaggagauggcuuuucccagcccauuucaaaaauucccaucaguaacucccguuucaaacaguaaucuucaaacucauuuccuuuuguggaggucacauccuagucaaacaaaaaggaacaauaaaagaauaaauaacacuguugguaaauuugguguccuuugguaaauuuaucuguguuuaagaaaauuuaucugggccaggcaugguggcucaugccuguaaucccagcacuuugggaggccaaggcgggcagaucaccugaggucagaaguucaagaccagccuagccaacauggugaaacuccaacuccacgaaaaauacaaaaaauuagccagggugguggugcacgccuguagucgcagcuacuugggaggcugaggcaggagaaucgcuugaacccaggagacggagguugcagugaggugagaucgcacucacugcacagccuggggggacagagccagacucuaucucaaaaaaaaaaaaaaaaaaaaaaaaaaaggaaagaaaacuucucugacuuuaguacuuuaccugcccaaucuuaaauauaaauauaugcagauuacuuguuuuaaucuguauuucaacuuuuccugaagaaaaaccacugucccugcuuugacacacaagcuuuuuaaaaaacuauguuuuggggaaagagcacuuggucauagccuucuuuuuuucuucgagagauggagucucgcucugucacccaggcugcagugcaguggcgugaucucggcucacugcaaccucugccucccaaguucaaguaauucuccugucucagccuccugagcagcuggauuacaggcgcacgccaccacacccgacuaauuuuuguauuuuuaguagagacaggguuucaacauguuggccaggcuggucuugaacuccugaccucaggugauccgccugccucggccucccaaagugcugggaauacaggcaagagccacugugcccggcccuuggucacagucuccuaaggacugguggaauaguguuauuuuuuuacacaaauaucaugccaugaauugcaaaucacaagauaugaaguuaaaucccaccucuaccacucaugagcuacaaauaucuuuggcuaagucaaauuucucaagcucagcacuacugacacuuugggccacaaaauucuuuguuguaaagggcuguccuuuagcuuccccccuauugaugauaagcaaaaauguuucuacaaauugcuaaaugcccccgggagacaaaaauucucccgguugaaaacaauaggcuaagagaacuaacugcugagcauuuguuuucucauccacaaaaugggaauauauagccugaauaucuaucuuacuggguuggaggaggaggguggcagugguguuaugguccugaaaccaauucccuccagauaccgagggacagcuauaccucacuucuaguuccccaccauuauucuacuuguauuuuacaaccaacuuaccgaaguuuugauucuuagauccuuuggagggaguuuuaaagucuuuuuccagucaucaccaggucuagagagaauacaguaaacuugaaguaucaaaauucauagcauccuaacaaagaugauucaucucaauuauaauuaaguguuaaaaaagcacaguaaguuuaauauauuccauuuaauauaucuaacaagauaauuaaacaacuuuagaaaaaguguucuuauagagaaucucaggaggauaaaaaaaucaagaacagaagggauuaaggcauccauccucuuaagcaauauuguauacaguguaacuguugucaaaagguguuuuguuugaccuacacagcauguguuuuaauuuaaaugaguuuaaauuaguucucaacauuuaaaaacuguaagauuuuauauaucuuauauaacuccugggcucaagaaauccaccugccucggccucccaaagugauaggauuauaggugugagccaccauggccggcuauucucauuuuuaaaauagguuaacaggccaggcgugguggcucccaucaguaaucccagcacuuugggaggccaaggugggcggaucacuugaggucaggaguucgagaccagccuggccaauauggugaaaccccaccucuacugaaaauacaaaaauuagccaggcauggugggacacaacuguagucccagcuacucgggaggcugaggcaggggaaucacuugaaccugggaggcggacacugcagugagccaagcucacgacacugcacuccagccugagugacagagggagacucugucucaaaaauaaauaaggugggcgcacaccuguaaucccaacacuuugggaggccaaggcaagcggaucaccugaggucaggaguucgagaguagccuggccaauacggugaaacccacucucuaccaaaaauacaaaaauuagccagccaugguggcaugugccuguaaucccagcuacucaagaggcugaggcaggagaauugcuugaacccgggagccaagauccugcgccagagcaaggcuccguuccaaauaaauaaauaaaacaaaauagguuaacaguuacaucaaacaauugauauaaugcacucagcacagugccuggcaaaauaauagcacaguauuagccaaugagcaucucuuaaucuuucuuuuuuauuggaaaugcuagaaaucaugaaagagaauaaaaacaaggagaauauaaauaaacucucuuuuuggccagguaaaaaccucaaguaauaaauacucaaagcaucuuuaaaaaaaaaaaaaagaucagggaacaucugcagacaaaguauuuaacugugacaucuucgaaaaaguuuucacugcagcuguucuuacauaaccagaguccccaaaacaucucaaaugcuccauucacagacaaaaagaccacuuauuuuacuuaaaacuagguccuacauaaugcauacucuaacauugguaacuuuuugcuaccaauuccaagacuacuacuguacuaaagccuuuuuuuuuuuuuucugagauggagucuugcuaugucacccaggcuagagugcaguggcaugaucucggcuuacugcaaccuccaccucccgggguucaagcaauucuccugccucagccuccagagcagcugggauuacaggagcuugccacuacaccuggcuaguuuuuguauuuuuaguagagacggggauucagcuggucucaaacuccugaccucgugauccuccugccuuggccucccaaagugcugggauuacaggcgugagccaccucacccggccuacuaaagccuuucaucuaagccuguaucaucgaaguuucugaugucaguuugacauaccguugaauucaacaaaauagugaauaauaaugcguaagauacaaugcaaaaccugaccacaagaaauuuauaaucuuaugagaugaaaaaacuauuuaaaaugagaaaguaagugacggagguuaaguauuagaaguguucugagacacuugaugggaucuagaggacuucauggaagagagggcagagaaaaugagauuugaagaaccgcagaacugaaaagaaaccauuaaucguaggaaaaccagaaaagaaaaaucaaaauccacuguuguccccaaaucagaauuuauuuuuuauuucuuugagauggggucuuacccugucacccaggcuugagugcaguggugcgaucauagcucacugcagccuuuauuauuuguagagacagggucuugcuauguugcccagguuagucucaaacuccuggccucaagugaucuucccaccucagccucccaaagugaugggaugaacggcaugagccaucauauccagccccagaauuuuuuaaauagaaaauauucucauaggccaggugcaguggcucacgccuguaaucccagcacucugggaggccgaggcaggcagaucaccugaggucaggaauucaagccuagccugcaaacaugaugaaaucucaucucuacuaaaaauacaaaaauuagccagacgugaugguggacaccuguaaucccagcuacuugggaggcagaggcaggagaauggcuugaacugaacccaggaggugcagguugcagugagucgagaucacaccauugcacucuagccugggcaacagagugagugagaguccaucucaaaaaaaaaaaaaauuaaaaauaggcugggcgcaguggcucacauguguaaucccagcacugugagaggucgaggugggcagaucacuugagcucaggaguuccagaccagccugggcaacaugacaaaacgccgucgcuacuggugcaugccaguaguccccacuauuuguagggcugaggcaggaggaucacuugagccugggaaguugaggcugcagugagccaugaucgugccaccauacuccagccuaggcaacaaagugagacccugucucaaaaaaaaaaaaaaaaguuauaaaaaaaauuaaaaauagucuaaauuuugcuaaccuacuuacauucugccaagacaaacuacaacugaaguaguauucauuucuauaccaauuaaagcauucaccuuaaaaauaacagaauauacacuaauaccaauucucccaaugaccuaaccaauucugcugaaaauuaguucuuagagguccuagugaaccacauacgguaacuauaugacagucugguagcuuguauaagcuauuuuucuguaggaagugaaaagaucuagguuguaauaaaacauauaccucaguucaguaacccagugucaacaucuuauaaagauucccaggguuaaauuauuuuauauggcaaguuuuuuuuuuuuuuugagauggaguauuucucuguugcccaggcuggagugcagugacacgaucuuggcucucugcaaccuccaccucucggguucaagugauucucccgccucagccuccugaguagcugggauuacaggcgcaugccaucacacccagcugauuuuuguauuuuuaguaaagacaggguuucaccauguuggucaggcuggccucaaacuuuugaccucgugaucuaccugccucagccucccaaagugcugggauuaaaggcgugagcuaccgcaccuggccuuuuuuuuuuuugagauggaguuucgcucuuguugcccaagcuggagugcaauggugcaaucucggcucacugcaacuccgccucccggguuuaagugauucuccugccucagccucccaaguagcauuaugggcaugugccaccacgcccagcuaauuuuguacuuuuaguagagacgggguuuauuuuuaguagagacaagguuucuccauguuugucaggcuggucucgaacucccgaccucaggugauccgcccaccuuggccucccaaugugcuuggacuacaggcgugugccacugcacccggaccuauauggcaaguucuuaacaaaagccaaacaucaacuggagucaagaaucuuaaauguuaauuuccuauaacugaaucuuuaaagugaugguuaccauucaaauauuguaauuuaaacuaugcacuuaaaaguaacaaauagccuacauacuuucagcuuuaaaagaaaaaauauccucuaguaagaggaggcucuucaauuuuaagguuaacaaaagguuucugagacuguucagaacuguguucugugaguucaaaauucuuaguucccuuuuuauauguaaaaggaggaaaaaaauuaaaaauuuuuuuuuuggguagagacagagucucauuauguugccuaggcuggucucaaacuccuggacucaagugauccucccacauuggccuccccaaaguacagggauuacaggcaugagucaccucaaccagccaacuuuuuuuuuuuuuuaaaguaaaaaagcuaaguuccauaagcuaaaaaaaguuacgagaaaauuuucugagugaauaaugcuuggaguucagaaggcugggcaagucuuuaaagacucuaaagacucagacugagucuuuaaauuuaauacauaaaguuggcuuuaucugcuguuuaacuaggguaaggugcagucguaaaaaaacuauacugacaaaaacgagaugacuaauaauuuuauucauuuacaacaaacuaagcuaauaacuuuuacacuaauuaugaaagccagaaauguuuccaaaaaccauuuauacaaaauuuguguguaucaucugaccucaggaugacuacuugcugaacaaauuauggcagaaauauauuauucuauugcaaauaccuacuggccauaaaacaaagucaucuguccucuauuuggaaucaaaaugguuaaauuaaggcauaaguauuaauagucaacaccaaaguaacacaaaucuugguuccccacaaguguuuauuaauaauuuacucuaacacuuacuuaauagugguggucauacucugugcuugcugcugagugccauuauugauuguguugguguuuuucagcugguucaucuguugcugugucugugugcccccuccuccagggccaccaguggguuucacagggccucucagcugaccauuuugacuggacagacccauuauaacaggguucucuguucuggccgugcucaugcuguuuuaauugcaaaggucuuucaaacuucaaaacuuuugaaagucaguagagaaacuguaauaacaguuuauuaggcucuccaaaaugaagagauaaauauaagucuugcucaauaaaugaguccuuuauugcaaugcaggcaagcaccuguaagucucugaac

SEQ ID NO: 13074 - RNA, 1460 nt, Homo sapiens
caugucuaagucagagucuccuaaagagcccgaacagcugaggaagcucuucauuggaggguugagcuuugaaacaacugaugagagccugaggagccauuuugagcaauggggaacgcucacggacugugugguaaugagagauccaaacaccaagcgcuccaggggcuuuggguuugucacauaugccacuguggaggagguggaugcagcuaugaaugcaaggccacacaagguggauggaagaguuguggaaccaaagagagcugucuccagagaagauucucaaagaccaggugcccacuuaacugugaaaaagauauuuguugguggcauuaaagaagacacugaagaacaucaccuaagagauuauuuugaacaguauggaaaaauugaagugauugaaaucaugacugaccgaggcaguggcaagaaaaggggcuuugccuuuguaaccuuugacgaccaugacuccguggauaagauugucauucagaaauaccauacugugaauggccacaacugugaaguuagaaaagcccugucaaagcaagagauggcuagugcuucauccagccaaagaggucgaagugguucuggaaacuuuggugguggucguggaggugguuucggugggaaugacaacuucggucauggaggaaacuucaguggucgugguggcuuugguggcagccgugcuggugguagauaugguggcaguggggauggcucuaauggauuugguaaugauggaagcaauuuuggaggugguggaagcuacaaugauuuuggcaauuacaacaaucagucuucaaauuuuggacccaugaagggaggaaauuuuggaggcagaaacucuggccccuauggcgguggaggccaguacuuugcaaaaccacgaaaccaagguggcuauggcgguuccagcagcagcaguagcugugucaguggcagaagauuuuaauuaggaaacaaagcuuagcaggagaggagagccagagaagugacagggaagccacagguuacaacagauuugugaacucagccaagcacagugguggcagggccuagcugcuacaaagaagacauguuuuagacaaauacucauguguaugggcaaaaaacucgaggacuguguuugugacuaauuguauaacagguuauuuuaguuucuguucuguggaaaguguaaagcauuccaacaaagcguuuuaauguagauuuuuuuuuuuugcacccaugcuguugauugcuaaauguaauagucugaucgugacgcugaauaaaugucuuuuuuuuuuuaaugugcuguguaaaguuagucuacucugaagccaucuugguaaauuuccccaacagugugaaguuagaauuccuucagggugaugccagguucuauuuggaauuuauauacaaccugcuuggguggagaagccauugucuucggaaaccuuggugua

SEQ ID NO: 13075 - RNA, 1832 nt, Homo sapiens
gcagaaccaaccucagggagcuaugcaacaguuuaaccaaugauaccucuauucagcuucaauguuagccgcagaaaaugacccucauggaccuuugccaccaggccgggaaaaaagaguggauucaacagacaggguuuacuuugugaaucguaauacaaaaacaacccagugggaagauccaagaacucaaggcuuacagaaugaagaaccucugccagaaggcugggaaauaagauauacucgugaagguguaagguacuuuguuaaucacaaugcaagaacaacaacauucaaagauccuugcaaugggaagucauccauaacuaaaggugguccacaaauugauuaugaacacagcuuuaggcggaaacuugcucacuuccguuauuugugccagucuaaugcacuacccagucauguaaagaucaaugugucccggcagacauuguuugaagauuccuuccaacagauuauggcauuaaaaccuuaugacuugaggaggugcuuauauguaauauuuagaggagaagaaggacuugauuaugguggccuagcaagagaauggcuuuucuugcuuucacaugaaguuuugaacccaauguaaugcuuauuugaguauguggggaagaacaacuauucucugcagauaaauccagcaucaaccauuaauccagaccaucuuucauacuacuguuucauuggucguuuuauugccauggcacuauuucauggaaagcuuauagauacugguuucucuuuaccauucuacaagcauauguuaaguaaaaaacuuacuauuaaggauuuggaaucuauugauacugaauuuuauaacucccuuaucuggauaagagauaacaacauugaagaauguggcuuagaacuguacuuuucuguugacauggagaguuggggaaaaguuacuucacaugaccugaaguugggaguuuccaauauucuggugacugaggagaacaaagaugaauauauugguuuaaugacagaauggcauuuuucucgaggaguacaagaacagaccaaagcuuuccuugaugguuuuaauggaguuguuccucaucaguggcuacaguacuucaaugaaaaagaauuagagguuacguuguguggcacacagcagguugacuuggcagauuggcagagaaauacuguuuaucaacauuauacaagaaacagcaagcaaaucauucgguucuggcaguuugugaaagagacagacaaugaaguaagaaugcuacuauugcaguucgucacuggaaccugccguuuaucucuaggaggauuugcugagcucaugggaaguaaugggccucaaaaguuuugcauugaaaaaguuggcaaagauacuugguuaccaagaagccauacauguuuuaaucucuuggaucuaccaccauauaagaguuaugaacaacuaaaggaaaaacuucuuuuugcaauagaagagacagagggauguggacaagaaugaauguggcuucuuauuuuggaggaucucuugcauucaaauaccccagccaagaaaaauugcacauaguguauauaagcuguucauucuguacagugaauuuucugaaccucucaaaguauguuuuccauucuuccacagcaauaugcaaaacauauuucauccuuuucuacuuuauuuguuguccuuugaaaugauugaccaggaaaaagaucauccuuaaauuuugaagcaagugagagacuuuauuaaaaauacauauguaucuauauaagcauaugugauaguggcucuaguuuuauagaguugcaaguguauuaaacaugacagcuguucauucaua

SEQ ID NO: 13076 - RNA, 9815 nt, Homo sapiens
cucuacaaauaaaguguuuuauuuacaggaguugucucuccaggucccagcucccugccacccccaccccagccccagggagaagagggcggaugccagaggagcuggcagaggcugggcagguccugagugggccaggcuaggccaagagagaaggcacgaggcccugggcgccccagucccagggcagaggccaggccugccuggagaaggcagcacggggucagcucucaggggucaggcuggguuccacgccgccgcagcucugcucauaagacgguggggccucugcgggaagaaagcagggucugcguggggcucuuggcguccccucccugccaagcccuggcugucgacucaccauagggguagccccaagaacuguacucuggaggaagaaucaaggugcugguagugggcacuggccccccggagcccucugcaaaguaggggacaguggcaccuguugaaaugcacaagggagggugcagcgggugugaggcagggcugccauccugagggcagggcuccggcgcaccaggcacagaacucaagguggccagcaggggcugccgcugcgaauggcucuugguggagaggaagacgggguccaagaagugggggccgccagccgcagccucagccucagccuccuccugggguggugcggaaggcaccaccagggguggggccccaggaggcagccccaggccuggccgggggcucacuggggcaugguucacagcaauauugccaaugaagaccgggagggucacaguagcuuccggcgccuucagagagaccuggacaggauugagguggggcaugaggggccagggccaaggccacuaggccucagaccacccagcccccagcagcaccaaaccuguaaguaguagucgauguggaugaggcugcagcccggcagggccgacuggggcaaggcaggcaccaggaucugcucgugccacugcgcccgccgccaggccuugacgcccgcacccuccaccuccgcaaugguccguacgucguggauccagcgcuuggccuuauaggacacuuucuggggaaggaccagccugugagccugcgcaggcugccagcccaccccaggaggccgguccaggcaacuggcgggggcucugaccugcagcagacuggccaccacagggcugguguccuugccugacugguucucaacgucggcaugcagcugcagugccugccccaccacauagccgcggagaucagugcuggcugugaggaccacgcugcccgucuucaccagcuuguaggagaacuucuugguggcagaggccacguuggguugcuuggggggagggccagggaggggcuuagcaggugugcgcaggcuggaucccuguggcauugggacaggccccucagcccugccacgcccugccccuggacaucagcagucagcucagggcaaagaggccacugccuccagacccuggccccccucaccucagcuggggacaggacgcugggaugaagcagugccugcccagcucuuccccagccuccaugaggguggggacccaccaaggaggucacugugccauccucaccucaaugucugggaugcuguucagguucaaggggcucaagauauagaacacgaggcugcacuugugauccuuggaaaaccguggcguguggauggcggcccucaccuggugcacgaucuucccgaaaggacccucaaaggacgugggugcaguggcuggggagagagcaggcacugguaccuggcugccuuccacccugcagagcccaccucccaggaccaguuggucaucaccaggccuguccaggcugggcucucaccaggaagcaggaacuggaaggggaagcugugcucuccagcgggcaggcucccugcagagacaggagggagguggggggcagucccccccugagguggccugagguggccacagggccaggauaagagugggcacugcagcugaccagcucacacugggucucccugucucagucaccagcgccacagcagcacagggcuguggcuugggugaaggacugaggauaagagcuuggcuugaacaggagagugguuugggaauggggcaagggugaaacagcugugccaggggucagagcccacccaaauccagcacaagggggagguggccccuucagccacccagcgccuaugagaaagccaucagggcccacaacccugggacaagaugggccagugccagauccaagaggcagaucuaggaaagggggaggacaggacagacaggccccacuccaagggcugcccccaggggucaccacucgggaacuggcucccaaacuuacccuugucugccagcgacagggaacuguugaaguaacccuccuccacuacccacgcugugucauuagccuuguuggagaccccgcaggaaccuaugcaggucacccggauggcugcaaaggggauggcugcaugagccccagccagccgacggcccaggccccugcuugcugccagcacaggaauucgaccuggggccaagcagcaccaccugggcaggguccugggaaggccagugagcaagcagcccaugccacuucagaggacaucugcccaucuccugucuuggggggcuccaagggaaucaggcaggcgaggggccugaccagcacaaaacgacgucugcccugcaauccagagcagaaagaccccaacgcucauccagaugauggcuggguuaccccccagauugguaaccuuggcucccagccagaccugcgaaagcucagcugccuacaggagacacucgggacacaccaaggggcgcaucuucuugcugcccuguggacaagucagucaggcagggaaggacccguccacacuccaggaagcuaacugccaaccaucaugcugcaggaauguggccagacccgccuaggcagacacaguguuccacagucagcacaccguuggguggggcccuacuuccugggcgagcacugcccagcggggcugacuuucugcaucaggagacggcucaguccucuccggccucccugggggagugcccagaccaggaacugcuugaggcagagguggcacuguucuguggccaggaacacaaauuccuuaguccaacagauguguguccagaaaccaugaugaucagaagaucauggcuggacaaucagguccagcagaagcuggucacaagggaggacagacgcagcagaaguacacacagcacaagacccaggugggcagggguugggggagacaguggcaggccaccugcaccuccagccccucuucucccugcagggcugagucagggccaaagauggccaccucccugccugguccuggugggggucacgugaggaaaaggugacucagacucugacaccugcugagggagcagccaggcaggaggaguaccggugugccgagcgcccagggucagccauaccugccucaccuguggucuccccagcaggccccaccuguggcccaggccuucugccugccacccagagcagcaggauuccucucacaauccuuggcucagccgcagccccacguggcucuccacaugcauccugccuaccccucggcagcugccaggcccagucccccaucccugaggguggcccuugcuuccugcugcacgcccucuacccccgggcgcugccagggccuguccucagccuccauuccagcccagccuugccaccccaaccucgguccauuuuuuguuuuuuuguuguuguuguuguuguuguuguuuuugagacacggucucacucccgccgcccaggcuagugugcaguggcacgaucucggcucacugcagccuuaaccuccuguguucaagcgauccacccaucucagccccgcaaguagcuaggacuacaggcacgugccaccacaccuggguuuuguuuuuuguuuuuuguuuuucuuauagagacaggguuuugccaugcuguccaggcuggucucaaacuccuaagcucaagcaauccaccugccucagccucccaaaguguugggauuacaggcaugagccacgguacccagcucugcucugauuuugaauccaugcucuguuagccaggcccuccucgggccagaccccauacuguguucaugcugaaaauccggaacaccaguaauccuccuguggaccagcagacagcccaacagaagcacaugggcaugagcaggcacagaggagggugggcguggcugaagcaaggagaggaggccuggggacuggaaaugcugccgugcuuuuaacacuccugacagacugcacauccccaccuugaaucccgcaaaugcugggacccagcugggugcaguggcucacaccuguaaucccagcacugugggaggccaaggcggguggaucacuugaggucaggaguucaagaccagccuggcugacauggugaaaccccaucucuacuaaaaauacaaaaaaggccgggcacgguggcucaugccuguaaucccagcacuucgggaggccaaggcaggcagaucaccugaggucaggaguuccagaccagccugaccgacauggagaaaccccaucucuacuagaaauacgaaauuagcugggcaugguggcacaugccuguaaucccagcuaccagggaggcugaggcaggagaaucgcuugaaccugggaggcggagguugcagugagccgagaucgcgccacugcacuccagccugagcaacaagagugaaacuccaucucaaaaaaaaaauacaaaaauuagccaggcaugguggcacacgccuguaaucccagcuacuugggaggcugaggcaugaggaucacuuaaacccaggaggcagagguugcagugagcugagaucgcacaaaugcacuuuagccugggugacagagcgagacuucaucucaaaaagaaaaaaaaaagaaaaaugcuggaacccacagaggaugccggaaagggggcagugguccccagacuaacccguaugccagccaagcacccucaagugaucccagcugguggcacagaacugaagauuaacccugcccucacuguccagauuccuaacccacaacgcugugagauauaauaaaaugguuguguuaacuguuuuaagaauggugucugacuugaggugaccgcgacuuuuacguagcaguagguaacuggaacagauguccaaccucacuagaaauuacagaaaacccggccgggcgcaguggcucagccuguaaucccagcacugugggaggccgaggcgggcagaucacgaggucaggagaucgagaucauccuggcugacacggugaaacccccgucucuacuaaaaauacaaaaaauuagccgggugugguggcgggcgccuguagucccagcuacucaggaggcugaggcaggagaauggcgugaacccggaagguggagcuugcagggaaagcccaaaugaccuaccauuucaauccaucagauugacaaauauuaaaugucucgacacagcugggcgcaguggcucacgccuguaaucccaacacuuuggggggccaaggcgagcggauugcuugaggccagaagugugacagcagccuagguaacacggugaaaccccaucucuaccaaaacuaccaaagauuagcugggugugguggcgcgugccccuggucccagucacucaggaggcuguggugggagccccggaggaaggaguugcagugagccaagauuguaccacugcacuccagucugggugacaaagugagaccucaucucaaauaaaaucaaugucuuggggccaggcacaguggcucacgccuguaaucccagcacuuuaagaggcugaggcgggcggaucaccugagguucggaguuccaggcccgccugaccaacacggagaaaccccgucucuacuaaaaauacaaaauuagccaggccugguggcgcgugccuguagucccagcuacucgggagucugaggcagaagaaucacuugaaccagggaggcagagguugcggugagcagcugagauugcaccacugcacuccagccuggguaacaagagcaacguaaauaaauaaauaaauaaauaaaugucucaacacacguuggagggagguggaacacaaacaccccuuauuccagucaaacugcagacaaguacgagguucuggcaaagagugggacaggucuacuguaauuuuaccugugcauaccaggagacccagaauuccgcuuagaaucucaugguauuuaaccgggagccucacacgccacugcuccuacuagcaaagcaucgcgaaaaccgucaugggacauugacuccacaaaaacaaacaguaugcaacugacccuugggucauccuaaggguccagguucugugaucuucccaacgcccaugcagauggccccguuuugcacauacaccaaggcucuuugagaugacucugccagaguaagcagccuccaaccacuguccaaagugaaaccugucccgagcugccccacacacuccucaguaagaacacgggaggcaaggggcucccgcacagcugccagcugcuucccugccaaaacaccuggagcugcuccucugccucucagcaacugcuucaggucaggcugggugaauuucccagggagcccguuuucacuggccaggccaauggcagcggccauguuucugccuuuucaaaucaucgaaucaggcaggaccacaggaugcaguucugcccacggagaagccagagcaauacaugggguccauugugaggggucucccugcugcuggcggcauacgaccccgcucccucuucuuuccagcuugcagacugcuugugauggcagaacacgcugaagggaaccgagccuuucgcaacaggaaagccaccaggcagggcuuggcugcaggacugaguggcucaguggcaguccccuagucagagugugacuucuuccgccuucuggacuugaacguugcaccucuuugcaggggcccugcaagcccugucccuccucccccaugcagguuuaaaaaauguuuccuggccaggcacgguggcucacgccuguaaucccagcacuuugggaggccgaggcgggcggaucacgaggucaggagauccagacccuccuggcuaacacggugaaaccccgucucuacuaaaaauacacaaauuagccgggugugguggcgggcgccuguagucccagcucuuaaggaggcugaggcaggagaauggcgugaaccggggaggcggagcuugcagugagccgagaucgcgccggcacacuccagccugggcgacagagggagacuccgucucgaaaaaauaaauuaaaaaaauaaaaauaaaaaauguuuccuguguucagaugcacaagcaaggacaagcugcuggaggcugcaggccucucugacucuaaggaagaucaugacugggcugcguucucaagugaccacuggaacuuucuucuccagcuggggcucccaccuguucagcagccccucccuugcaccaccugcacuuggaccaugaagacccacccacuccucauccucaucccaaaggacucacgccugccacagaagcugugaccuguaagccacucccccaguccuguuuccaaaucuguaucaugagaguaacaaccgugccacuugccagggcgcugaggguuaacugaggcuggcccguggcacguggagagaauugcaucgggcccaccaugagugcuccgagaaccacugucggcccuggucgcccaucccaguaacagcagaacaagaagugguccugccugaaccccagcccuggacugggccagccugagcuccagaaaacugcucccucccaggccucccuccgcgucagcccuuuagacagccgguguccucacggcugggugcugacugucaccgacacucaucggcagaguaagugagcaagcucuggggcccaggcagggcugcuguccuccugggggcugagggccucccuacuggcuccuagcaggauugacaagcauccucugaaugaggaaaagaaaccaugguccuucuguucccaucccaggcagggcugggggaaacccccgggggccccgguacacccucccaccucacuugcagcagccugaaucaugugcucucuggcccaucagggcccaucuccuacuccuuagcucacgacccuccuuuuucucccucauucagaccagccucugugagguaggaccaucagccagugcucccucggcucuugggccagcugcccaaagugcugggauuacaggcgugagcauucaacccacccaccacguccacccggaggccaggggagccugcacacccaggccagucacgcaccgcggggccgucccuucccugugguaagcaauggccugcucaccccaggccacgccaggggaaggacgacaggguccugcacagcccucaaccaggauccagccggccucaccacacaccacaccuguacccaagagaugugugugcuaucucugcccugccacggccacaccugcccccacccagaccccaaacucaagguugggacagaggaagggaggcuguggggucaucccaggaggcccaguggggccaggagccugacagaagcaccuaccacccggcuucuuccgaggccccacagccucaggcggugcagggucagggccacagcaccaucaccugucccaggaggcugagaggacagaacagagacuguggguucucagcaggcacaaaaucggugcuguuacccacgcgcgggcccagcggucaagguccagcggcaaguccaggggcuguggcacaggccaagcagcccaggugguucccacaggaggccaagguagagaaguccccggcagggacgcggcacucacagccaagggccgggcagaggcagccucaccucgcgggccggcccucaccuccagggcgcccugccagcggccacugcagcaacccgauacccaguccccgaggcccaggcguccaccucggcggggggccggcgaggccugcuggcggguggcagggggcgcagggagccgcagcaggugucugcaccccgccgggaccgcacgcccgcgccaggagcggcucugcagcgggagcgccugcgccgggagccagggugcgggaaggagcccagcaggugcgagcgcggacggggagggucgcaggccugcgugcgcccgcgcucagggcguccuccacaguggacccgcuucaggccccgccgggaccccgccgccccucggcgagagggcaggaagggcagacgcggaagggcggcgccgcccggaccuccccggcgccgccgagcccgcuucccagcagucccgggcggcgaagacagcgacuccgcgggcccaacccggggccaggcgacggcagccgcuuccgggagcccuggccccgcgcaggugcggccaaaggcccuccccgaggacccgcgcccaccucggaacggcagcggugcccccaggcgcacgcgcacggucccagccaacggcuccccggggcuguagacgacgcggccguggcucaggcugaucucgaagagcugcacucgccccaugccgcggccucaccggccagccgcgcagcgacgcccccgcccgccgcccgcgagucccggcuccgaggcccggccccgcccccuccuaugccccgcccccauccgucccaaucccggccuccacccccauccggccccucccaggcccugccccgccccacggccccgccc

SEQ ID NO: 13077 - RNA, 9815 nt, Homo sapiens
gggcggggccguggggcggggcagggccugggaggggccggauggggguggaggccgggauugggacggaugggggcggggcauaggagggggcggggccgggccucggagccgggacucgcgggcggcgggcgggggcgucgcugcgcggcuggccggugaggccgcggcauggggcgagugcagcucuucgagaucagccugagccacggccgcgucgucuacagccccggggagccguuggcugggaccgugcgcgugcgccugggggcaccgcugccguuccgaggugggcgcggguccucggggagggccuuuggccgcaccugcgcggggccagggcucccggaagcggcugccgucgccuggccccggguugggcccgcggagucgcugucuucgccgcccgggacugcugggaagcgggcucggcggcgccggggagguccgggcggcgccgcccuuccgcgucugcccuuccugcccucucgccgaggggcggcggggucccggcggggccugaagcggguccacuguggaggacgcccugagcgcgggcgcacgcaggccugcgacccuccccguccgcgcucgcaccugcugggcuccuucccgcacccuggcucccggcgcaggcgcucccgcugcagagccgcuccuggcgcgggcgugcggucccggcggggugcagacaccugcugcggcucccugcgcccccugccacccgccagcaggccucgccggccccccgccgagguggacgccugggccucggggacuggguaucggguugcugcaguggccgcuggcagggcgcccuggaggugagggccggcccgcgaggugaggcugccucugcccggcccuuggcugugagugccgcgucccugccggggacuucucuaccuuggccuccugugggaaccaccugggcugcuuggccugugccacagccccuggacuugccgcuggaccuugaccgcugggcccgcgcguggguaacagcaccgauuuugugccugcugagaacccacagucucuguucuguccucucagccuccugggacaggugauggugcuguggcccugacccugcaccgccugaggcuguggggccucggaagaagccgggugguaggugcuucugucaggcuccuggccccacugggccuccugggaugaccccacagccucccuuccucugucccaaccuugaguuuggggucugggugggggcagguguggccguggcagggcagagauagcacacacaucucuuggguacaggugugguguguggugaggccggcuggauccugguugagggcugugcaggacccugucguccuuccccuggcguggccuggggugagcaggccauugcuuaccacagggaagggacggccccgcggugcgugacuggccugggugugcaggcuccccuggccuccggguggacgugguggguggguugaaugcucacgccuguaaucccagcacuuugggcagcuggcccaagagccgagggagcacuggcugaugguccuaccucacagaggcuggucugaaugagggagaaaaaggagggucgugagcuaaggaguaggagaugggcccugaugggccagagagcacaugauucaggcugcugcaagugaggugggaggguguaccggggcccccggggguuucccccagcccugccugggaugggaacagaaggaccaugguuucuuuuccucauucagaggaugcuugucaauccugcuaggagccaguagggaggcccucagcccccaggaggacagcagcccugccugggccccagagcuugcucacuuacucugccgaugagugucggugacagucagcacccagccgugaggacaccggcugucuaaagggcugacgcggagggaggccugggagggagcaguuuucuggagcucaggcuggcccaguccagggcugggguucaggcaggaccacuucuuguucugcuguuacugggaugggcgaccagggccgacagugguucucggagcacucauggugggcccgaugcaauucucuccacgugccacgggccagccucaguuaacccucagcgcccuggcaaguggcacgguuguuacucucaugauacagauuuggaaacaggacugggggaguggcuuacaggucacagcuucuguggcaggcgugaguccuuugggaugaggaugaggagugggugggucuucaugguccaagugcagguggugcaagggaggggcugcugaacaggugggagccccagcuggagaagaaaguuccaguggucacuugagaacgcagcccagucaugaucuuccuuagagucagagaggccugcagccuccagcagcuuguccuugcuugugcaucugaacacaggaaacauuuuuuauuuuuauuuuuuuaauuuauuuuuucgagacggagucucccucugucgcccaggcuggagugugccggcgcgaucucggcucacugcaagcuccgccuccccgguucacgccauucuccugccucagccuccuuaagagcugggacuacaggcgcccgccaccacacccggcuaauuuguguauuuuuaguagagacgggguuucaccguguuagccaggagggucuggaucuccugaccucgugauccgcccgccucggccucccaaagugcugggauuacaggcgugagccaccgugccuggccaggaaacauuuuuuaaaccugcaugggggaggagggacagggcuugcagggccccugcaaagaggugcaacguucaaguccagaaggcggaagaagucacacucugacuaggggacugccacugagccacucaguccugcagccaagcccugccugguggcuuuccuguugcgaaaggcucgguucccuucagcguguucugccaucacaagcagucugcaagcuggaaagaagagggagcggggucguaugccgccagcagcagggagaccccucacaauggaccccauguauugcucuggcuucuccgugggcagaacugcauccugugguccugccugauucgaugauuugaaaaggcagaaacauggccgcugccauuggccuggccagugaaaacgggcucccugggaaauucacccagccugaccugaagcaguugcugagaggcagaggagcagcuccagguguuuuggcagggaagcagcuggcagcugugcgggagccccuugccucccguguucuuacugaggaguguguggggcagcucgggacagguuucacuuuggacagugguuggaggcugcuuacucuggcagagucaucucaaagagccuugguguaugugcaaaacggggccaucugcaugggcguugggaagaucacagaaccuggacccuuaggaugacccaagggucaguugcauacuguuuguuuuuguggagucaaugucccaugacgguuuucgcgaugcuuugcuaguaggagcaguggcgugugaggcucccgguuaaauaccaugagauucuaagcggaauucugggucuccugguaugcacagguaaaauuacaguagaccugucccacucuuugccagaaccucguacuugucugcaguuugacuggaauaagggguguuuguguuccaccucccuccaacguguguugagacauuuauuuauuuauuuauuuauuuacguugcucuuguuacccaggcuggagugcaguggugcaaucucagcugcucaccgcaaccucugccucccugguucaagugauucuucugccucagacucccgaguagcugggacuacaggcacgcgccaccaggccuggcuaauuuuguauuuuuaguagagacgggguuucuccguguuggucaggcgggccuggaacuccgaaccucaggugauccgcccgccucagccucuuaaagugcugggauuacaggcgugagccacugugccuggccccaagacauugauuuuauuugagaugaggucucacuuugucacccagacuggagugcagugguacaaucuuggcucacugcaacuccuuccuccggggcucccaccacagccuccugagugacugggaccaggggcacgcgccaccacacccagcuaaucuuugguaguuuugguagagaugggguuucaccguguuaccuaggcugcugucacacuucuggccucaagcaauccgcucgccuuggccccccaaaguguugggauuacaggcgugagccacugcgcccagcugugucgagacauuuaauauuugucaaucugauggauugaaaugguaggucauuugggcuuucccugcaagcuccaccuuccggguucacgccauucuccugccucagccuccugaguagcugggacuacaggcgcccgccaccacacccggcuaauuuuuuguauuuuuaguagagacggggguuucaccgugucagccaggaugaucucgaucuccugaccucgugaucugcccgccucggccucccacagugcugggauuacaggcugagccacugcgcccggccggguuuucuguaauuucuagugagguuggacaucuguuccaguuaccuacugcuacguaaaagucgcggucaccucaagucagacaccauucuuaaaacaguuaacacaaccauuuuauuauaucucacagcguuguggguuaggaaucuggacagugagggcaggguuaaucuucaguucugugccaccagcugggaucacuugagggugcuuggcuggcauacggguuagucuggggaccacugcccccuuuccggcauccucuguggguuccagcauuuuucuuuuuuuuuucuuuuugagaugaagucucgcucugucacccaggcuaaagugcauuugugcgaucucagcucacugcaaccucugccuccuggguuuaagugauccucaugccucagccucccaaguagcugggauuacaggcgugugccaccaugccuggcuaauuuuuguauuuuuuuuuugagauggaguuucacucuuguugcucaggcuggagugcaguggcgcgaucucggcucacugcaaccuccgccucccagguucaagcgauucuccugccucagccucccugguagcugggauuacaggcaugugccaccaugcccagcuaauuucguauuucuaguagagaugggguuucuccaugucggucaggcuggucuggaacuccugaccucaggugaucugccugccuuggccucccgaagugcugggauuacaggcaugagccaccgugcccggccuuuuuuguauuuuuaguagagaugggguuucaccaugucagccaggcuggucuugaacuccugaccucaagugauccacccgccuuggccucccacagugcugggauuacaggugugagccacugcacccagcugggucccagcauuugcgggauucaagguggggaugugcagucugucaggaguguuaaaagcacggcagcauuuccaguccccaggccuccucuccuugcuucagccacgcccacccuccucugugccugcucaugcccaugugcuucuguugggcugucugcugguccacaggaggauuacugguguuccggauuuucagcaugaacacaguauggggucuggcccgaggagggccuggcuaacagagcauggauucaaaaucagagcagagcuggguaccguggcucaugccuguaaucccaacacuuugggaggcugaggcagguggauugcuugagcuuaggaguuugagaccagccuggacagcauggcaaaacccugucucuauaagaaaaacaaaaaacaaaaaacaaaacccaggugugguggcacgugccuguaguccuagcuacuugcggggcugagauggguggaucgcuugaacacaggagguuaaggcugcagugagccgagaucgugccacugcacacuagccugggcggcgggagugagaccgugucucaaaaacaacaacaacaacaacaacaacaaaaaaacaaaaaauggaccgagguugggguggcaaggcugggcuggaauggaggcugaggacaggcccuggcagcgcccggggguagagggcgugcagcaggaagcaagggccacccucagggaugggggacugggccuggcagcugccgagggguaggcaggaugcauguggagagccacguggggcugcggcugagccaaggauugugagaggaauccugcugcucuggguggcaggcagaaggccugggccacagguggggccugcuggggagaccacaggugaggcagguauggcugacccugggcgcucggcacaccgguacuccuccugccuggcugcucccucagcaggugucagagucugagucaccuuuuccucacgugacccccaccaggaccaggcagggagguggccaucuuuggcccugacucagcccugcagggagaagaggggcuggaggugcagguggccugccacugucucccccaaccccugcccaccugggucuugugcuguguguacuucugcugcgucuguccucccuugugaccagcuucugcuggaccugauuguccagccaugaucuucugaucaucaugguuucuggacacacaucuguuggacuaaggaauuuguguuccuggccacagaacagugccaccucugccucaagcaguuccuggucugggcacucccccagggaggccggagaggacugagccgucuccugaugcagaaagucagccccgcugggcagugcucgcccaggaaguagggccccacccaacggugugcugacuguggaacacugugucugccuaggcgggucuggccacauuccugcagcaugaugguuggcaguuagcuuccuggaguguggacggguccuucccugccugacugacuuguccacagggcagcaagaagaugcgccccuuggugugucccgagugucuccuguaggcagcugagcuuucgcaggucuggcugggagccaagguuaccaaucugggggguaacccagccaucaucuggaugagcguuggggucuuucugcucuggauugcagggcagacgucguuuugugcuggucaggccccucgccugccugauucccuuggagccccccaagacaggagaugggcagauguccucugaaguggcaugggcugcuugcucacuggccuucccaggacccugcccagguggugcugcuuggccccaggucgaauuccugugcuggcagcaagcaggggccugggccgucggcuggcuggggcucaugcagccauccccuuugcagccauccgggugaccugcauagguuccugcggggucuccaacaaggcuaaugacacagcguggguaguggaggaggguuacuucaacaguucccugucgcuggcagacaaggguaaguuugggagccaguucccgaguggugaccccugggggcagcccuuggaguggggccugucuguccuguccucccccuuuccuagaucugccucuuggaucuggcacuggcccaucuugucccaggguugugggcccugauggcuuucucauaggcgcuggguggcugaaggggccaccucccccuugugcuggauuugggugggcucugaccccuggcacagcuguuucacccuugccccauucccaaaccacucuccuguucaagccaagcucuuauccucaguccuucacccaagccacagcccugugcugcuguggcgcuggugacugagacagggagacccagugugagcuggucagcugcagugcccacucuuauccuggcccuguggccaccucaggccaccucagggggggacugccccccaccucccuccugucucugcagggagccugcccgcuggagagcacagcuuccccuuccaguuccugcuuccuggugagagcccagccuggacaggccuggugaugaccaacugguccugggaggugggcucugcaggguggaaggcagccagguaccagugccugcucucuccccagccacugcacccacguccuuugaggguccuuucgggaagaucgugcaccaggugagggccgccauccacacgccacgguuuuccaaggaucacaagugcagccucguguucuauaucuugagccccuugaaccugaacagcaucccagacauugaggugaggauggcacagugaccuccuugguggguccccacccucauggaggcuggggaagagcugggcaggcacugcuucaucccagcguccuguccccagcugaggugaggggggccagggucuggaggcaguggccucuuugcccugagcugacugcugauguccaggggcagggcguggcagggcugaggggccugucccaaugccacagggauccagccugcgcacaccugcuaagccccucccuggcccuccccccaagcaacccaacguggccucugccaccaagaaguucuccuacaagcuggugaagacgggcagcgugguccucacagccagcacugaucuccgcggcuaugugguggggcaggcacugcagcugcaugccgacguugagaaccagucaggcaaggacaccagcccugugguggccagucugcugcaggucagagcccccgccaguugccuggaccggccuccuggggugggcuggcagccugcgcaggcucacaggcugguccuuccccagaaaguguccuauaaggccaagcgcuggauccacgacguacggaccauugcggagguggagggugcgggcgucaaggccuggcggcgggcgcaguggcacgagcagauccuggugccugccuugccccagucggcccugccgggcugcagccucauccacaucgacuacuacuuacagguuuggugcugcugggggcuggguggucugaggccuaguggccuuggcccuggccccucaugccccaccucaauccuguccaggucucucugaaggcgccggaagcuacugugacccucccggucuucauuggcaauauugcugugaaccaugccccagugagcccccggccaggccuggggcugccuccuggggccccaccccugguggugccuuccgcaccaccccaggaggaggcugaggcugaggcugcggcuggcggcccccacuucuuggaccccgucuuccucuccaccaagagccauucgcagcggcagccccugcuggccaccuugaguucugugccuggugcgccggagcccugcccucaggauggcagcccugccucacacccgcugcacccucccuugugcauuucaacaggugccacuguccccuacuuugcagagggcuccggggggccagugcccacuaccagcaccuugauucuuccuccagaguacaguucuuggggcuaccccuauggugagucgacagccagggcuuggcagggaggggacgccaagagccccacgcagacccugcuuucuucccgcagaggccccaccgucuuaugagcagagcugcggcggcguggaacccagccugaccccugagagcugaccccgugcugccuucuccaggcaggccuggccucugcccugggacuggggcgcccagggccucgugccuucucucuuggccuagccuggcccacucaggaccugcccagccucugccagcuccucuggcauccgcccucuucucccuggggcugggguggggguggcagggagcugggaccuggagagacaacuccuguaaauaaaacacuuuauuuguagag

SEQ ID NO: 13078 - RNA, 2566 nt, Homo sapiens
gggcaagccggccaggccuccccccuuuggcgccuccguccagcccaagucccgccugggccgcacccccugacucacuuccuuugcauagaagcggaaaccuccccagagcuuccucuacuccggccggccgcucccuggggacccacaggugucgcugccccuccaggccgaagcuggcccaggaggccccuggcccacccccucgcccugggaggcgcauuuccugcuuggagucucaggccccagcgucuggcacaggcaggggccugcggagcugagggcaguggaccagcugcagguaggggguggguuggggcccagggcccaguuccugccagucaguggcucucuugcuccgaccggccucuucuuucuguccaucuuuucguuucaccuccacuagucuccggggggcucccugcacugcucagcucguucacuggagggguguugggaggaccccaguuuuggagucggggcugggaggccuggguugagccuggggacggggcccgggccuauucucaaaaucauaaguuccagccagacccccgccaaguguucuggagcgugugggggcgucucugaacuccugggcgcucaggccucugcuucccgcggccccuccuugggagacggcccaguccagugggagccgcgggcgggggcaggguccgggggugacuguucaccccagugggcgccugggcggccacugacuccuucgacgacuccuccaggaagccggggcggccaccagauaagccucuaccccgccacuuccucaaggcccgcggccguuuaugggaagacccgagagauuugcaucggggcccugcggaggggcggaggggcggaggggcggaggggucgcuugccggucugaggggcgaggccgcgaccaggccccuggcccuggggcagcccgggccgcaccccacgggacucccaggggguaagaucacuccggggaccgguuccggcggcccgcgggaaagggcaguggcgggaguccagagacccuccccgucuucccguugcagggagggcgaccuguaugcggagcgccguuccugcgacauggaccgcggccagcccagccuggagccugcugccgcggccccccgagccucgggccggugcgugaucgcgcccgugcgcgcugugcuccgccugcgccgccggguguguguccuacgcaaacggcgccuccugcagccggguggggggcccgacgucgggaccggggcgcccaggccgggcugcagcccccgggcaccgcgcgcggaccuggaccagccaaaguucuucaccuucgacagccccgcggagcuacccuccaggacgccacgcaagaagcgccggcgcagccgccuggugcuuuacccggagaccucgcgcaaguaucggccgcgcguggagcacaggagccgcgcgcagcgcugccuucugcugcuagucgccaucgugggcuuccaaguucucaacgcuaucgagaaccuggacgauaacgcgcagcgcuaugaccucgacgggcuggagaaagcgcugcagcgcgcgguguucggccagcccgcugccguaucgcgcaucguggcgcugaugcgggacuaccuggccacgcaugugcacagucguccgcuccuccuggcgcugcacgggcccaguggcgugggcaagagccacgugggccgccugcuggcgcgccacuuccgcucggugcuggaggacagcgcgcucgugcugcaauaccaugcgcggcaccacugccccgaggcgcgcgccgcacaggacugccgcgaggagcuggcgcggcgcguggccgacgugguggcgcgggccgaagcggaggagaagaccccacucuuggugcuggacgacguggagcucaugccgcggccgcugcuggacgagcugcacggcuuccugcagccgcagcgcucccaccacuuccacaacgccaucuacgugcuccucaguggcgcggguggcgccgaggucacgcgcuucgugcugcagaacgcgucccgcgcgcugccccugcgccccgacggcuuccgcagugccgaggccgcagcggcgcaggcggaagaagaccugcgcgccagccugcuggcugugcugucccgggagcauccgcuguggcaggccgcggccaucgugccguuucugcugcuggacaagcgggauguggucagcugcuuccgggacgagauggcgggugagggcuucuuuccugaccaggcccgcgcggagaaccuggccgcgcagcucagcuucuaccgcguggcuggccgcgaguuugccgucaccggcugcaagcaggugguggccacggugaaccuccuguaguggaggcgcaggacgggacguuuggguugauggcggcaguaggagggcgaccagggaccuugugggcuggugcaggccccugagguuucuagugaauuuguggcugcccggcuggugggugcggaucagcuuggagcucugcuuccagguccacacccgccucagaguccggagucugucccugggggcggcaggacagcagccaccuccc

SEQ ID NO: 13079 - RNA, 2905 nt, Homo sapiens
ugagcucugggccuggucuggguccugggucuggggaggaccuggggaggugcgggugacggcaccgcagguaaggcuccugcaagguggcagccuuggggcccgacccuggguaggagggcaggccagugaugacaagggaggccccagccaggcgaaguugcaggcaggggcagugcagggucccagcaggugaaggccccgggaguggagucugcagggcccugggccagaguguucagggcacaggugacuaagcccagccaggucuucagcucaaggccuaggggaaguggggcugggcccuggugagcagaucccugggcccuuccugaggucuggccaggccgaccccaccuggagguggcggcucagggcauuugacgccuccuucccaguucccuggcucggcaagcagcugacccucagguggacagcagcuagaccaggccccugagugacacggcugggugggggugucccacagagcccaccucccaucucgcuccaggcuagagcucagggucagucacaggcugccacccuagagaagagagcaccuuucaggggcagcugaauggagaccccucaacagggaaagccggaaaugacccagcggcagccauaucucuaggaccgcccccgggugaaggacagacaacugcacaccacagagcucgggaaaaccaacagcaucucaguguagcggggagaugggcagaugggggauccaggcugggccagccuuguccacagcccauagaaggguuggccagccagaagggugcaucggggugcccagagggucagaaggccaggcuggggccccaagucccaggggaggccugggaaagccccgggggaggccaugguuccacucgguggccgggccaagcagguugugcccagcuggcucuagagcgugcagaaggggccugugucguggcgcuugggucugcguacacccuggaugaccacgccaggcgccgaagggaagcgugaguugcaguccuccacgugguaggcggcugggccagggguucgggcugccgaaagagaaggcugggagccccacccagguagcagccccaacucaaaccuggcucccaguucccacccccggccccugaacccuuguccucacauugcccacccaugccccaucccuagcccucuucucuccaggccuccuuacaggugcugagccaggaggugaacgcaggggagcggcucaucgagaaggccggcgagcgggggcucugcaggcggcucccaggaaggauauuguagguguuggggccagggcaucucuugccaggugccugcaaagaggccugaagcagggacuggggcugcacccugaggcccagcccccuagccccaggcagcccuagguggguguggccuucaggugucuuggaagcggaguggcagccucugaagcugaaggcggggaaggcgggccggcugagcagcugguagugggcuggcgagggccacugcgaggggguaggagacgggcugcagggcagggugcuccccacggacccucagccagccccccuuuggccccacuggaacccccagcccccugccugcguggacuccccgcccccuuccugcccagcccccaaccuuuugcucuuggucgaagucagcuuucugcgugaaggggcuuucgcucuggaaccacaaagucugccaugcccugcggccaccgcccucuguaguuggaggauggagagagagaaggcugggagccccacccaggugacaguccccacucgaaccugucucccgguucccacccucggccccugaacccuugucuucacaauguccacccaugccccagcccuagcccuccucucuccaggccuccuuacaggugcugagccuagaggugaacgcagggaaggguggaggggcccucaggccguggggguuucagcacagaggcaaaggcccccauucccagggugagggacaggcccggugguugggccucagggaggggacacacaccucggcccuggugcuugcagccgaugcuguaguggggguguggggaggacucucguacggacgggcucggcaccugguaccugguggggcuggggacuuccaggucagcugugaucagggggcguugcuccagcacuggccacaggaagcaagcucugggccugggcuccuuucagcgggccccucccacagccccccaaagaccagcuugggggugggguggccaggacccucacucacauaguucccucagggucuggguguaggugggcagggacuccuggggggugcccgucuguaaccugaggccaacugggaucuccuucaucuuugggggcugugucucaucccaggccauccccggcuccgggcccaacaacagcacagaugccuugggccugcaagggagaccagcagccacugucucagcccccggccgcucccagccacaugccccacagccuguccccucuauugucccucagcccccggcugcucccagccacgugccccacagccuguccccacacugucccucagccccuggccgcucccagccgccuguccccucuacugucccucagccccuggccgcucccagccgccugccccacagccuguccccacacugucccucagucccccagccgccugcccagcaaccugccccccacacugucccucagcccccuggccacucccagcuggcccgccccuucucccccucuccgccaguuacugggugggcucugguugugucugccucaggugaccauggguccaguguuugccuccauugauguaaaaauuugccaggaauuucacugccuucuggucagaauucaucaucagagucuccuggcucucuuccccaacggca

SEQ ID NO: 13080 - RNA, 2905 nt, Homo sapiens
ugccguuggggaagagagccaggagacucugaugaugaauucugaccagaaggcagugaaauuccuggcaaauuuuuacaucaauggaggcaaacacuggacccauggucaccugaggcagacacaaccagagcccacccaguaacuggcggagagggggagaaggggcgggccagcugggaguggccagggggcugagggacaguguggggggcagguugcugggcaggcggcugggggacugagggacaguguggggacaggcuguggggcaggcggcugggagcggccaggggcugagggacaguagaggggacaggcggcugggagcggccaggggcugagggacaguguggggacaggcuguggggcacguggcugggagcagccgggggcugagggacaauagaggggacaggcuguggggcauguggcugggagcggccgggggcugagacaguggcugcuggucucccuugcaggcccaaggcaucugugcuguuguugggcccggagccggggauggccugggaugagacacagcccccaaagaugaaggagaucccaguuggccucagguuacagacgggcaccccccaggagucccugcccaccuacacccagacccugagggaacuaugugagugaggguccuggccaccccacccccaagcuggucuuuggggggcugugggaggggcccgcugaaaggagcccaggcccagagcuugcuuccuguggccagugcuggagcaacgcccccugaucacagcugaccuggaaguccccagccccaccagguaccaggugccgagcccguccguacgagaguccuccccacacccccacuacagcaucggcugcaagcaccagggccgagguguguguccccucccugaggcccaaccaccgggccugucccucacccugggaaugggggccuuugccucugugcugaaacccccacggccugagggccccuccacccuucccugcguucaccucuaggcucagcaccuguaaggaggccuggagagaggagggcuagggcuggggcauggguggacauugugaagacaaggguucaggggccgagggugggaaccgggagacagguucgaguggggacugucaccuggguggggcucccagccuucucucucuccauccuccaacuacagagggcgguggccgcagggcauggcagacuuugugguuccagagcgaaagccccuucacgcagaaagcugacuucgaccaagagcaaaagguugggggcugggcaggaagggggcggggaguccacgcaggcagggggcuggggguuccaguggggccaaaggggggcuggcugaggguccguggggagcacccugcccugcagcccgucuccuacccccucgcaguggcccucgccagcccacuaccagcugcucagccggcccgccuuccccgccuucagcuucagaggcugccacuccgcuuccaagacaccugaaggccacacccaccuagggcugccuggggcuagggggcugggccucagggugcagccccagucccugcuucaggccucuuugcaggcaccuggcaagagaugcccuggccccaacaccuacaauauccuuccugggagccgccugcagagcccccgcucgccggccuucucgaugagccgcuccccugcguucaccuccuggcucagcaccuguaaggaggccuggagagaagagggcuagggauggggcaugggugggcaaugugaggacaaggguucaggggccgggggugggaacugggagccagguuugaguuggggcugcuaccuggguggggcucccagccuucucuuucggcagcccgaaccccuggcccagccgccuaccacguggaggacugcaacucacgcuucccuucggcgccuggcguggucauccaggguguacgcagacccaagcgccacgacacaggccccuucugcacgcucuagagccagcugggcacaaccugcuuggcccggccaccgaguggaaccauggccucccccggggcuuucccaggccuccccugggacuuggggccccagccuggccuucugacccucugggcaccccgaugcacccuucuggcuggccaacccuucuaugggcuguggacaaggcuggcccagccuggaucccccaucugcccaucuccccgcuacacugagaugcuguugguuuucccgagcucuguggugugcaguugucuguccuucacccgggggcgguccuagagauauggcugccgcugggucauuuccggcuuucccuguugaggggucuccauucagcugccccugaaaggugcucucuucucuaggguggcagccugugacugacccugagcucuagccuggagcgagaugggaggugggcucugugggacacccccacccagccgugucacucaggggccuggucuagcugcuguccaccugagggucagcugcuugccgagccagggaacugggaaggaggcgucaaaugcccugagccgccaccuccagguggggucggccuggccagaccucaggaagggcccagggaucugcucaccagggcccagccccacuuccccuaggccuugagcugaagaccuggcugggcuuagucaccugugcccugaacacucuggcccagggcccugcagacuccacucccggggccuucaccugcugggacccugcacugccccugccugcaacuucgccuggcuggggccucccuugucaucacuggccugcccuccuacccagggucgggccccaaggcugccaccuugcaggagccuuaccugcggugccgucacccgcaccuccccagguccuccccagacccaggacccagaccaggcccagagcuca

SEQ ID NO: 13081 - RNA, 2547 nt, Homo sapiens
cagccaugcaggacaacuacgcccugacauucggcaacagcacccggagggccuacuggaaggaaugggcaaagcgaaaccacacacuaugaaaaugcuuuaaugguggugucuguacagcauggauguggacagggaaaacagcaagugcacacagugggacaggccacaggacaggcugggagugaauaaagaguucacacugcuucccugcuuuccccagugacugaaggcucuaggccaccuccuccucagccuccuccucgaacucgcccuccuccucggcuguggcauccugguacugcugguacucggacaccaggucauucauguugcucucggccucggugaacuccaucucguccaugcccucgcccguguaccagugcaggaaggccuugcgccggaacauggccgugaacugcucggagaugcgcuugaacagcuccuggauggccgugcuguugccaaugaagguggcggacauuuuuagcccccgaggugggaugucacagacagccguuuucacauuguuggggauccacucaacaaaauagcugcuguuuuuguuuuggacauuaagcauuugcucauccaccuccuucauggacaugcggccccugaacacggcggcaaccgucagguagcggccauggcgggggucgcaggcagccaucauguucuuggcaucaaacaucugcugggugagcucgggcacggucagcgcccgguacugcuggcugccccggcuggucaguggggcaaagccgggcaugaagaagugcagccggggaaacgggaccauguucacagccagcuuccgcaggucagcauugagcuggccugggaagcgcaggcagguggugaccccacucaugguagcagacaccaggugguucaggucaccauaggugggcguggucagcuuuaggguucugaagcaaaugucguagagagcuucguuaucaaugcaguaggucucgucuguguuuucuacgagcugguggacugagaggguggcguuguagggcuccaccacugugucugacacuuugggcgaaggcaccacacuaaacguguucaugauccugucuggguacuccucccggaucuugcugaugaggaggguacccaucccagacccaguccccccacccagggagugggucagcuggaaacccugcaggcagucacagcucucagccuccuuucucacaacauccagcaccgaguccaccagcuccgcgccuucuguguagugccccuuggcccaguuguucccagcaccacucugaccugugagagaacacagcuaaucauuugucagccagguagacagcacuacuggucaccgccaugcgaaaaaagccgagugacauggugugagcugaccacagaauucacccuggagguagagcaaacggacccuucaaagccaaaagacggcagccugcccugcuacgaauuaagucaggggccaaaccugacagcuuaacaaaccccuccccgggggggccacugccaauucccaaggacagaggaacagccacugccccagcucagcucccugcagggagauuacguguguggcggcuccucgccucggcagacagcuggaccuugcucccaaagccgauuuaguagaggggauugaguggcucagagaagaggagggcguccaggggccccggcugcgcaguucccacggcggugcccuuggagcagccccuugaccuuugagccgccgcccaguccccagccacggcucaccgaaaacgaaguuguccggccggaagaucugcccgaagggccccgagcgcacggaguccauggugccgggcuccagauccacgagcacggcgcggggcacguacuugccgccugcggggacgggagggcgucagccaaggcaggggccgcgggguccccggagggcggucggggaaggggccggggccucaccgguggccucauuguaguacacguugaugcguuccagcugcaggucgcuguccccgugguaggugcccguggggucgaugccgugcucaucgcugaucaccucccaaaacuacaagggacgcgggcgggcccgggcgggccggggcugagucaccgcggccggugcgcagggaggcagccccgccccggacgggcgcggcagcccggcccuccccgccccucccccgccccgcgcgcccuggccgccggguuccugggggcuucggucgcccggcucggccaauuccccgcggagggggcccggcggccgcaaugcgggggcgccgcccggccgcugcugccgccaucuuccccggccgcccgcccacaccgcccggcaggcccgccuggccccagcgccccggcaacuuaccuuggcgccgauuugguugccgcacugcccggccugcaagugcacgauuucccucaugauggcggcggcggcggcggggaagcaggaggaaguagacaaacagcagcagaagagcgggcgcgcagagugcuacaaccgacgcuccgccaacgcuuauauacccucccugcccg

SEQ ID NO: 13082 - RNA, 2433 nt, Homo sapiens
cacgcccgccacagcuggccaccugccucucuccugacucccgugcaaggccaguaaugcaacccaggagggagccgcagggcgcccugggucccccacucccuucuccggccaccccguggcugugcauagcugcccagcagagcccaugcagguaagaggccugggcucaggucggccaggagggugggggccuggagcugggccaggguggugcugcgggaacaggaggcugcccggcuggugcccacaugaaccagaagugugcagacccugguucugccugugcccggugccacgcucccucccaggucugcacgcaccacccccacagacccagcgccugaccucuggggugggcuccuggggccagcaccccauccaggcggaagguccucgaggcaggcuguccaccgcuggcuucccucuggcaggaugcugcagccggagggcccccaggccucggaggaggggggcccccggaggagaggacagacugcaucaucugcugcucggccuaugaccucuccgggcaccugccccgccgccucuacuguggacacaccuucugccaggcgugugugcggcggcuggacacaccggcgcccgagcagcgcuggauccccuguccgcagugccgucagagcacgcccacgccucgcggagggguggccaugcuagaccuggaccuggcugcuuuccuggcggucaaggcugagcgggagccggcaagacuagaaccccugccccucaccucccucaaaggcagcgccaucacucggcagccagcugggcugugcccugcccugggaccccagccccacuucccccagcccagauacugcugcuggggcuguggcagccucugcugcccaccccuaggcagccccgaggucugaacucuggccauucccaccccugcaggggaaaugccugccuuggaaccccugaccacacaccaucauggguucagcccacucagaacaaccuggcaguagcauccuauacgcagcuucguguggcccagcaggguggugucaucccagccgugaacaucccaggccacagccuaagguugggggcugggaggcuccgcaggaggcuggugaccucccaccuguccuggccacaauuaccagaccccagacuagcccgaccggaugugccuggugaggacacugcugucugagugggcggcaagccuggcuugggccuagacgcagcgcaaaggauggcucccaagaggaugcgaaggcgucccgggggccugggcugcaggcuggaggggcagggccggucuggcuaugccuggcgggcugcccagagcaggucuccccucucccacagacguccccgggguguaccgggaggguggcaagacuaccuccuuccucccugcccugcauggcagcccugugaauucacccacucaacaaagcucauggaguucccacugugugucgggugcgguucugggagggucucguguaggcacgaagccauacaggcauugaaggggaugccucggcggggccugccugaggccaacagagggcuggggccugcuugaggucucacagcccaguuggucucauccuucgcugaaccuuuccuggcuccgagcagccaccacacagacccuuuugaggggccggggcuggggcuggggccagacuguggacagcaguuaccaccaagucagugcugcaacacccccacccccacuggaacgagcugucacucaggagccccagggaaggacugcugccccccacccccagagcaagggcgcaggagggagacggaagagaauuugcugagcggacacucagaagcuucuaccuucuccagggcaaaguccccaugcacacagcgggggcugggcagcaagcaaagcagggcaccagcagccccugggcagggugagccucugggggagcugccccgcaccccagggcaggaagaggcccaguccuccuaggggacaccccacaggcgguggggccagcugggacuccgcuggggagaacugugcgcugggccaggcagcggguggggaagguggccuggggagcucuguccuccccucugcagauggaggcugccggccgccgucgcuggcuauaccagggccgagcccgcuagcagccugcugggcccaacccugcccugaacccggaucugaacccucugaccucgggcugggugcccuccccggcuacgugaaaaagcccguccucccccaccaccuggugcaaagggcuucccuccccugcucugccgagggcagggaugacccugagaaggucuggggagcccugaggugcauggaagugggggacuggcgucucucgacucccgggcagccccagccauacucuagcauccugccuggcuggguggagugugucucuugggucacacggaugccug

SEQ ID NO: 13083 - RNA, 1896 nt, Homo sapiens
caaacuuuggcaaagaguuuuaauggcaaaguuggcugcagcgacaaugccacucgggguggggccggaagccaugguggggaaggaagggucagcgggcggcagggcagggccgggucccugaagaagcagcgagcgaggcucagcgggcaguggcgggcaggcaggcgcuacuacaugauggagcaggcggacaguggguuccgcacguggcaggugcacgcggccccacaguacugccggaaggucugguagcagcugcccucgggcucagccccccacugacccccggauggggccgucagcgccucaggcggcaggcggcucaggauggacguguugacagccagcgcggccaggccguagucggugaagagcacagucucacggcggcagguggggcaggagaugaacuuguacuuggggcaggacucguagagaaucugcaggcacugcucacacacagagugcaggcaggacagcacgcggggccuccgcugggugacauuguaggagugcccacagguggggcacuccaggggcucgccugccgccgccgaagaagccgccgaggccgaggggccaggccgaaucacguacugauucacaaugaccucauccucuggggccacgcggggaaagcccagcuccgagcuucccuuacggggccgccguggcaguggcgggguauggggugccccuuccaaggcaggcaugucccccccacaggccugguugacaaugaucucugugucugagggccaggcacgcuugggugccagaguuggggugggccggggagcaggcgggaagcagggggcagccgguagcucagggaacuuuucaggguggacaaucuucauggccuccaucuugaggaugacauggggacccuucaggcaggacaugaggaggcccggccagccacugcccgccucgggcccggggucagagggcauccggcugucuccagucagacuggauguucgggugggugggggcguuguguggggcuggggggcaggugacagggcagcauccuggucccgccaggccuggggggggccccggacggcccguggacuccuagggacagccggcgagaguugggggugcagggccccccccaguggccacaguggcuucucugguccaguccugggaggaggaggaaggggugggggagggggaggcaggcgggggcagggaggggugggaggcugcccugggcugggggucuggcccagggucucacccagggucucuggcugcugaggcuggcgagggggcgcggggggggcucccccugcagccgaggucagcaggccgcgggccgggacaucggggcaggcaggggcugggugggccccauggcuccaggacagggcgcccagggaaggcagcuagccgaagcgcuggcugcaggaggaccggggcggcaggcuccgcggcaggagcagaggcgaggccugggccaggccugagcugcaggugagagacggcaugagggcagugccccggccacccccacccuagcccucgcccugcacaaaggaccgggcgcccgaccucugacccugaccucagccgugggaucccgaccuccgcgggccucagaacccaacccccuccccgguccccgccuccaaggccagacgcaccuucccgagggccgacccccgucgcguggggaggggcgcugaguccgcccccggcccccgcccccugcgcucaccugccccagccuggcgucccggccgcgcgccgccgccgcagagguugucucaaaggcaggcccggacgcggcgcccgcgccucggcccggcagcucggggggcuccggcggcuccggcggcggccgcagcgaccucaggcgauggcggggcccgggcggca

SEQ ID NO: 13084 - RNA, 14133 nt, Homo sapiens
gcugagcagagggugaccccagggcuccuucuaaaggccagaggcgcaggaauggagcuggaggucuggcggguagcaagcacuaagcccuaggacguggcugccugagccguggcccgggcgugacguggaccuucacgugccgcucccugagcacccugggucgggggcggcccgggauucucucaggaggcuacauucccagugcagauguguaggccuagguggccccucaccugcugcugaggagcaggcccugccaggcugagagagaggcccaggcuagaggaggauccuggggggccccacaaagccaccaggacagaaaaggaugaucugacuugcuuuaaucugcacacugcgggggugggggugggcaugcuccucagcagugcauucugggacacgggcgggcgggggcuggcacgggaggacgagagcaccugcagggcagcgccuggcgggcgggcgggcgggcgggcgaugugucagcugcaguucuugggcaggcgguagacgccggccgaguagacgagcugcuggucccgcaccuucuucugcagguagcccugcagcuccugcaggucaaucucggccagugcaggcccagucaccacaaacaugcggagcauguuguagauacgauccagugagaggcucuccagguuggucagcauggccuggauguacguccagaagagcugcggacacaggccagcccccgucaggcaccugcaggccucgcccccgcccccuggccccccguggggccugcacgcgcaccagcagcuccuccuccuucuggucggccugggaggccaugccggagucgcucucgucgucacugucaaugagcaccauguugucccgguccugaggccgcuccuccucaaugacagagaaggugccggggggcuccucacgcagcacacccugcugcagccacacggacauccgccgccgcagcagcgccacgggcaucuucaccgccuugcucaguuccuccaggguccagcuggcugcgugcagagucaccgggacgcugggcagccugggcacgggcugcaccuccccugccucccgucagccgagaggucggggggcucccgggccacccugccuugcccgugggaaagggaagggugccgccugcuggcgcagcugccccaaaccacacccucacuggggaacagccccucacccacagcugggccguguggccggggcaggccagcuaggggcuggugggcucaccuugguccugaaaauacagcaagaucaccgccuguacuggggugaccgccacagacagcgugcggucggccagcuccacguccauggucaccaggcccagggugugcuuccaacugaggguccgcauggccuaaggagggccagggucagcacgggcagcucggcugcagggcgcucaggcccgugggcucugccaccugguaccagugagaaaggggcucccagagccaccugccccaccccacccuggcaggcaggugagcagcgagagcacaggacugggugggguccccaccugcucagccaccauggaagggcaauggggccagcaucauaaggugugucccgaaaaggcuacaggggccuccugacccccagugcuuggaaauguggccauauuugcaaacaggguugaugcagauguaacugaggugcauccuaacccaacugacugggguccuucuaagaaaaggaaagauaggaagacacaggcaggcggggagggggccacacgaagacagagaccaccuggagcaacgcggccacaagccaagaaacaccaagggcuguggcaaacaccagaagcuggggggcaacggaggucucuaagaggguucagagggaacggggcugccaguacuuucaucuuggacuuccagccuccaaaacuaagacaaucuauuucuguuuuuuaagccacccaguuugugacacuuuguuacagcagccacaguaaacgaacagauuuugguaccaggaagggccaggaggggugcugccaaaaccuaacaccaagaacuguggcagcagcuuuggaagugggugauggggagaggcuggaagaacuggugaggccugcacgacugcugguagaaaggcaugaagacaagccuggaaauggcuggaagaggagagcugccgccgucuuggagaaugcacacagcaucacagacuggaugucggcagcaaugccgacccaacaggugcuuccagugaggucucagauggaaaugaccgugcuacugggaaccggaggaggcagcagagagcuuggcuggcugcugcucugcuguugggugcgaagugggaccugcagcugaugagccuggacaucaagcugagauuuccaagcaguguggaaggugccaccuggcuucuccuugcuacuuauagcagaaugcaagagggaaacaaucagugaggcagggaccauuaagcaaaaaggcaccagcccuuggggaucugaaaaauacucuauccaggcagcucugagacguggccaaggguguggcuggaccaggguuugcuagacaugaggugugaccuguguauccaacuaaccaucucagcagcagacagggacagguggggccuccgggaaagggcugcggacccgccugucugaaggcuucggcacuggugagcugcauaagccaacaaggugugagaauuuuacacccgcagaagugcugccaggcuggagugaaaggaaggcaggcuccaagagcagagccgccgaggccaaggcugacggagcagggggccaaagaggauucgcaggccuggaagucaaguggaauuucggcugcuggguuuggacucgcuguccuuuuuccucccaguuuucccuuuuggggugggaauguguaugcuugucuuacggcugaacuuuugaaacagaucaucuguuggcugauuucacggcgucccagcuggaggaauggcgcgcacuccagccucaccuguaccuuguuuagaucuauuuacguagaggaauggcgcacacuccagccucaccuggaccucguuaagaugcauuuacaggcugagauguguguggaacuuuguguggaugguaguuagaugagauuuuggacuuggaguugaugcugaaauggugaagacuuuuggggacacuggggcugucacuugcacgugggaggggcccaccauggggcaaauugucaugcacugaauugugccccucgaaaaaugacacaugaaccccuaacucccggugccucugaugagaucuuauuuggaaauacggucauuaaagauauaauuaagaugacgucacccuggaauagagagaguguucuucuaagagggagauaggaacagagacacgggggaacaucacgggcgacgcggcagagaccagagcgaggcacccacaggccccggagcuccuggagcccccagaagcuggaagaggggaggaagcagccuccccuagagccuucggagggcccugcugacccugacuuuagacuucugacuucuguaaaaugauauguuucuuuuaagcccgcugguuugugguacuuuguucugguagcacuggggcacugacacaccugcucugugggccaagggcuccugaguccuuccaggauccggcagcuucuaauggaaacaaaccccucuuuauggacagaaaauggaaguggagucaguggcuugcuagguccuaguucuggcuccaaggccaugaccuccacaaacgccgccacuggucagccugccgcaggacacaugcaagggcucaggggugacgcugugggcugcauggccagccacguguccaacaaggucgcucggccaggagcucugcuggugggaccucucagcacagccccggggccucccugagccacuccugugucccacugaaguuaagacaaagggcacuagaguguggcugucccagcacaucaggccugagcaacaggaaguggcugagucaugccugggacccaaggcaggacccuggagggaggccauuggggccuugccuggaagcaacgcuggagagccugaggcagccagaggggcagggggaaagggaccgagcacggagccgggccacacggaugauuuguaccagaacacagcggggcacggugcccgcaggcuccagagacaccaggcuguaucacaggccagagcucgagguguggggauggccagggugcuccuuuccaccgagagcaggugcaagccacacagacccuccacaagcugcaagggacaccuggacucuuccagagccaagcugaggccuggagggaggcagcaggcauucgccaccauggucagcagcccggcccuaccacagccccuuggccuccugcccugggggccuccgccuggcccuccccuugucugucuccggaaggaagcuucccccuugguuucuaaaguggacacaucgcccugcccuccccuaggaguaaguucccuugguuugucaacacagcaaggcccucuuacuugcaaaagaaaaaggaaaacacaucuagguccagccuccuucacagcagaccuggagaagcuguggacccucccuugaacucagccccgcccgcccgccggccuccuggcggcucuguccugaggcugcuccuccugccugggccgaggcuggaccauccccuuccugggguaccugggguuggggucugcagacuggaugcuggcugugccccagaacccucuccucacaugucccccgcuggggugcccgccuccccccaguccugagcacucgcugggcacacuggaggccucacaggccccacacaucagacagaaagcccuggaacccgccugugacgaccaucccgaccccuuccuccccgagccgacaccucccaccugugacgaccauccuaacccuuccuccccgagcugacaccucccaccugacuaugagcucagggaaagaaccgccaagccuaguuccaucccucaggcucuggacgccuguacugggacugcugggaucucagcagugcugccaggggaagugagccaaacguggccaauaccauccucugggcacacuguccccaucugccagugaccuccaggccagggcucacuccuccacuccccacaucugcuccccuccuacucccaccacagacccauagccccgguccucaaguaccacuggagccugcaaaggcaguucucgaggaaacagaccuggagaagggggcagggcugggguccugggggucaggugcgccugggagugcugcccugggcagagggcagcccuggcucccuagcugccucccugcagugacgcaaggcaccccaagccccgguucugagaggcagaggguggauagcaaaagaggaggaaacgcucagagggcagggccugcuguggccacaggggucccccugaagcaguucaggagaccugggcccagcacagcccacccaagcgccugugggccgcgcggacgcucgcucacaggggacacgggguugcugggaggaaggcggagagagcgugggccaggcccacucccucuccugcagaggcggcugcgagacaggaccaacccagagacacucgggugacaacggggcagccacaggcaccaggcugcugggagccccgcagugcaggguaggggugccaagagcccaugggguggccuggcauggagguaccuugagcugcucauacuucuugcaguaagccuccagggcugcccugauauccucggggaccuccagcuucucguccuugaagggcggccagaacucacuggacaggaugacagcguagaccccgaacgguggcugcuccucugcuggccgcuucucauccuccucccggauguuggcauugaugcggcgggaguccgccauguccugaggaggagccggugucacgggggaccugcggggcggccgggcagcgggcggggcugggacccaccuucagcaugacuucacagaagugcauuggggccucgccaaagcgcagcuucagcagcuccacguugcggaucucccuggaaagacgagugucugggcagggggucgugaugagccccagccccaaggagcaccuguggcagggcacgggggugccccccaggcagagcagggagccugugugggcaccccaauggcuagcacacccccagccaggagugggggcggaagcacagcuccaaccaggccccaggcacggcgucagggcccugucccgagagaggcugggcaaaggccccggcaccccuggagauggccagcgcgucacaggccucaccgcucggggcugaagcugaacuggugcagcaggcggucggccagcagcgagcgguacucauugaugaagagguccuugcugccguagaugcugaccagcaggcugaugauguccgaugaacgccgcuuggagcucgacuucccuggcauggugggggcaggggugucaccugacaggcaccugggcaaggacagggccgcccuccucccaucccgcccagccagacggcacagcccagcauggcucuuccugaaggcccucgaggcugggagcagcccugagccucccgggagaccuggagucagguccuggagcaacagcuucaauccccagccccucucaccccacagggaccuuccgggacucccaugcaggcuuaggggacaagccaaagguccugggguuuuccucugagagagacuaaagauguguugaagacuuaccaucugugccagggcaggggccaggccugggccccauagcccucagagcccucgcagacgagggccaggcacagaugggcucugagcaggagcuggcacccuaacgggacuuugaggcccaaaucaguacagagcucaggggucacccacaucuucacuccucugccaggugcaguggcggggcagggacaccccacagcucacaagcggugggaggcagggcaucccccacggccagagugaccagccacagaggaaaacagcccaucaccggccugcccaggcuggcagguggcggagcacugcccugaccuuugacacccucaagccucugagacacuagcgacaccugacacagccaagcucugugacaagggaugaguccagagcggacggccuggcugaagcgccccccacacuggugaaagggaccauguggggcaagcuaaccuggaucggcauccacaggguccgggacccaguccucuggcucgccugagucauccucacuguccuggccugucuccaggcucgccgggucggucuuggacagcucaacagccagguccccugucccguccgagucccccgucagcccagccacaaucugccgcacuguguccucccgcguccugccgaugugagugcugcuguggcccacaguguggacaccccgcgcgcaccucccaccacucauuccagucccggccccaucuaggccagcaccaccgacccugccucuacacucaguggugaugggcuauguacuaaacacaggcccgucagacuccuuaaaaacaaauaaacccaacguuacuugggagcagcaggagcugcgagcgcaaggccggccugcgcaccugcaaucccagcacauagggacacuaagccagaagaccuaagcccagguguccgaggcugcagggagacaggauucugccacugcacuccaacagagcgagagccugccucaaaaaaaagaaaaagaaaaagaaaaaagggccgggcacgguggcucacgccuguaaucccagcacuucaggaggccgaggcaggcggaucacgaggucaggagaucaagacuauccuggcuaacauggugaaaccccaucucuauuaaaaauacaaaaaguuagccaggcuugguggcggccuguagucucaguuacucgggaggcugaggcaggagaauggcgugaacccgggaggcggagcuugcagugagcagagaucgugccacugcacuccagccugggcgaaagagugagacuccaucucaaaaaaaaaagaaaaaacaaagaacuggcucagaagccaggccaguuacagccacaaagcaccaaaggaguccagguaggggccagacuccaccggcuccugcugcucggcuccugggggccacugugccugccagccccgggccagggccucugcgaccccugaggaauucccaggcagccaugucaagguccucaucccaacacauucuccaccgaacagccccaggagugucuguuccuugccgugggaaaggccaggacagcagagcccacuccccuugccuggucggccuuggggacuggucagcaccaaggcgaggccaaguggaagagcuucucucugugcuggagauggggaggcugaggaagggcuguggugggccucuggcagcugcacacagagggcacggugacaccgugugacaaggacaggugcccggcacgggcaagaggaaaggaaagagccucgggccugaucccgugcacucagcccagccgggggagaccuuguguccugacggccgaacacacccuccggcugccccccaggaccacgaggagcucagcaggaugcccagggucccaguggcuccugggccagcugcagcccucaccucagguagcggcggauaggcucacaggccaccuccaggaugaccauggaaggguccagcacgcgcagcgccuugauggcagagauauagagggugaugaugucacacguguugacgccuacagccagggcagaagccagcagucaugcagugcccgggaccacagccucccaggggcaacacccgaguagacagcuggccaugccgguagguggucuacagguccccacugcagccucguucccuuguccccccauccccaccucuaccuguucacaggucccgcccugcagggaggucuguucugagagaacuaagucucaucaccucagaccuaccggucaguccugacucccuccaaagaagaaacaagcaagcugacgggcaccucagauccccuaaggaccucaccaauugcuucucaacccauuucuuccuuagaccuacaaguccagggcuggcagacuaggccccaggcucccuggacauggguccccuggugagugucuaagcccagagugcuggguggccgggcagcacacagcaccuggaugcaggagccgagucuccagggcagccuugagggacacgagcagcugcugccucugguccguccucuccaggcaguacuugagguccucgauggcuggccgggagucugggaagucuacaagaagaagaacaucccucagggacagacauggaugcgugcgcacgugcaggcuggugcagagugugugcggugugggaaaggacacgugcuugccagccccaggacgaugaugagaccaccugcuaggcaccagacauccccccgacacucuggcgugcugaugcauuugaccacaaugccacaggguggacagagcaacacccaggggccaguccccagcaggagccaaggccaaggcagcacagcaguggacacccagaagcacuguccagcaucugccacaccugcccugauccaggcacgggggacgccgcaguggggacagucccagcacugcccggugcaccccccugcaagagcgacagcgaaggcacagggagccccagacguggacacagggagcccagaugcagacacagagccgacauggcgaaggcccugggagccccagaugcagacacagagcagacacggcgaaggcacagggagcccagacgcagacacaaggagcccagacacagacacagagcagacacgacgaaggcccugggagccccagaugcagacaaagagcagacacggugaaggcacggggagcccagacgcagacacagggagcccagacgcagacacagagcagacacggugaaggcacagggagcccaagacgcagacacagagcagacacggcgaaggcacagggagcccagaugcagacacagagcagacacagcgaaggcccugggagccccagacgcagacacagggagcccagacgcagacagagcagacacggcgaaggcccugggagccccagacgcagacagagcagacacggugaaggcacagggagcccagacgcagacacagggagcccagacgcagacacagagcagacacggcgaaggcacagggagcccaagacgcagacacagggagcccagacgcagacacagagcagacacggcaaaggcccugggagccccagacgcagacacagagcagacacggugaaggcacagggagcccagaugcagacacagaggagacacggggaaggcccugggaagacuccccagacgggagagcggaccccagggccggggcaggaccaccucggacgaugcugaagagcuccucgaugcgcaggcuggcguagaugcgguagaagaaccuuugcacguggcagcgccagcggcgcaggguguugccggccucgggagaugcgggccuggcggggccguccugcaggaacaccuugccgagccagccgaccacccgcucgauccacugucaggagaacgcuagugugagcugcagggaggcauggugagccccgggcugacucagaggcugggaggagccucacggccacccacccugucggccgggaccgaggggagcccgaaggccaccugcgucuggaggcuggagcacaucaaaaccugcagggugggugauggcccaaaaggcgacgucccggccccccugcagucuucgugccucucacacgcgccagugcccacacuuaucacuggcagcagcaacccuagcgugagacaugacagacacacacgaccugugcgcugugccuggugggcacacuugcccccacuuaaauggauaaacacgcccuugagaccagccggggggcccaggcgagcacaaaccucuagguggcaauuccgccgcggggcccaggcgugcucaugccccacagaccugcuacccaguggcaagaccgcacggauguucacccucuccacccuacuacccacucuugcccaccgcuuuggggacacccucccucuuugaaaacccaacaucacagccaaucugcaccucaguagggggacucugaaacacugaggaaaggacaggugacacaugggaacaggauggggggacccacauggcugggcccagcuccccuauggcuccgggagcccagagcagagccccagaccacaccccaacagcacaggugccuggaggccccaugugagggugucucgcuccccgcuguggugcaggcuggcuguaggucaguccauuagggaccggccaagcgaguccacacucaaguagggcagcaaacaggagaaggggauccauucaguggcuccucuggugggcccagcuucgccacaccugccugagguagcccccucgggauccuggcccgauaccgccugcagccaugggauucugcgcagauccgaagagcgcaccucagaugcguccucgcuaucaccagggcccagaaguacuggucucuaccccacaucaagacagcuccagccaccacccggucugggcccacccaggccuccgugcucuggaugcuucugaagccaggugucagguuugccagaaaccuacuccccugucuccagcggggcacagcccaagggagggguccucaccuuguggaacucacgcaggaaggagcgcucguacucgccccggcaacgguccuccauccucucccgggucaccuggugcagggugguggucacagccucggcacugacccgcuccagcagacugagccugugucuagaggagagcccuggccauggggcacccagagcacacaccggccccucuagcccagaacagccccaugccaggacugcccugccuguagagugcaugcagcacacacacacacacacacccagcacacaccuccccacaauccucagcuguggggggcgguuguaccaaaggcuucaagaagccacugggagcacagagcacucccaggcucugcuguccccgcccagcuggccucuauccagguagggacacuggccuuccccaugugaucaguggcagcagguguggcugucgggggcccuagccuuaucuccuaggaucaacucugaaacgacaaccaacugcacugcuacccuggccgcagagguacagaugccacuguuugugccuuucagugcagucucuggucuacagugacaaaaggacucaagaggaggaugagaaaaguugccguguaacuuuugcagggaugagcccaacagaagcccuucacggucucccugaccccugccagcaaaaggagcacuccuuuaguccaccuuuaguccaccuaagaccucucaaguagcugcauggcuacacccccguucaaugugacaaaaccaccacaaauggccaaggguaugacaauugcuagagaacuacaacaggaccugucucucacaacaaaccccucuccucuccaaacuaacaagagacugcuugcccucacagugaccugaucuuccuggagagaagcagcagcaagcuucuguucacaauuacagggcaaggaaugucgacgagggugagaaucauuccuccccaggaucgacaaaaggcacaguggaauucugcagaguccaggaaguuuggaguugcuaagaaauuugcugcugcagacacaagccacauagggccuuaccagggucaaggcaugaaucugugggacugaaggugagugacagaagagagacaccuguguccaggacacgcugcacaggaaucccugggacucucucucugucauguuccugguuaucaggacggcucaccagcuuucugcugaggccagcuggacccaggggagcagcggggaaccagaaggagcaagggcauggccaucgggacagacuacucacaagaccuggcugagcugauggaacugcuccagagccuggcgacaccagcacuguugcuugucacugcugcacccugcacacagcgggcucugcaggagccgguaguaccggcgacgggcauaccggcuguccagcuccccuuccaguuccgggucugugcccccuucccccuuccucuuacucugcauauagacucucaagaagcacccauacagacgcuggaucaucucuuggaagguucugggggugcuaaagaacaagacuccgcgcaacauaguguggacuucuucucgcagccccugagcaccagugcccaucagcaagcccaggcgaguccauuucuccagcagcucuaggcuacgcagguagggauccaggcggcucuccagcaggccaaaagcgucaaggaguagcaaaaggcacuggggcucauccgcagaguucucgcauugggagauggcauuccagaacucaggggagauguuggccugcagaucguucugcagcaccuccacgaaccacuccuccaggaccgaguguagcccguggccccucagaaccuccaccgccgcccggagcuccucuuccuuuggcgggacugcaccgcugguccgggaagacaccuggggugcagaaaaccgugaggcgaggggaacacaacauagagguggggagaggcggggaagggaagaagcugagggggaggcugcaaaaacuccgcugcccccuguccgugcugcccggacguugggccgaagcuauggaagggcugucagcggagcugaacgaaacgaaacggaaaggugguggaaaauggcaggacaggacagaggcggaugauggacagagccguaugaacccgaggguagcggccccaaagcgcguacggucccggaaacuccgcgcggggccgccccucucuucccaggccucaccagccccagcgcagccggcggcaccaggccggugcucacgguguuccaggccacuaacaacuccuguccgggccgggagucgcugucccccuccgccaccacaacugccgccgccaucugcacccaccgacuccgagauucgcucggcgcggcgcgcggcgaugacgcacg

SEQ ID NO: 13085 - RNA, 1132 nt, Homo sapiens
agaggugugcaguggggccagggcuggacauggcccccggucccuggccuguguccugccugcgugguggccccuugggccucacauauuugucccuucugcucaucccugcugcaggugccuccuccugcccccgcacuccacucccagccauggcuccccuuccccaggcaaggugggagcucugguguccuucugguggcuaccagggcaggggcagacuugggggcccucugcaggcaggugaccggcccauggccauguggcccugucucugcagcuggaaccuacugugaaugcagccuuggccucagccgcgaggcccucaucgcccuccuuguggugcuggcgggcaucagugccagcugcuucugugcccucgucaucguggcaauuggugucuugcgggccaaggggugcgugaacccuggggccgggagaggaugggagugaggccaggcuggcugcccugggcccuuggucuugcaagaagggcuuuacccccugggugggcugucaccugggguaggaauggcguuuccuaggcgugugcugggggagcuccgggggcccagcacuguuccaggacucauguuggccuucguccccucagugaaacaugcccgagacaaguggacaacaggugagcaccagggaggcccucgagggaggcacgcugucucaggggaggcccuuggcggggggagcuaucccaggggagucccuggaggaggaggggugcugucccuggaggaggaggggugcugucccuggaagaggaggugugcugucccaagggaggcccuuugugggggugcacugucccagacgccagccuguccugggggaacaaggacucuaccagcucgugaugacccggcccgucaugcagguugguggagaauuuugggguccaggaagaucucauggaccugcacccgguuuacguggagucccagcuaauggacgcugaccuggaggucucccuggugccaccacuagaggaucagagccuuguggccauccccauggaggcuucuucagaggagccgccaccacccccgccccuaccaccugaguagagggcugagggcagcugggggaggggaauuaaagcguauuuaguggcugu

SEQ ID NO: 13086 - RNA, 1315 nt, Homo sapiens
aaugucacgcaguuuucggucugugucgcuuguugacgccggcagacaguguaaagggagggcaaaggcaugggggaagcuucgagcgcuccaggcggccgcggccgcucaggcuugggcggcagcggcggggcuccccggguccgcgggcgaggcacagccgugggggucgggaucgggguucgggucuggcggucucggcgggcggagggcggcggugcggaggcggcggcggcgcgcacggcaggcggugagcccagagcccagcgccaggcaggaagccaggcugacgaggaaggaggccggcccgagcguguaaaccacggccaggucccgcagggcgagcggcugcgcgcaauggcuaaaggcggcgucggaaaaggcagucagggggcugagcgucaggcgucccggccacacgcagagcaccgucucggccucugugggacacagacaaaggcgcggcgucagguggcggcugccgcaccgcccugcagaccccgacccgcguccccagcagcucaccugacgcgggcagcgggugccggcgcagccaggcgcagagcgggcgcagcgcgcacccgcagccccaaggguugccgcgcaggugcagcgcgucuagagcgggcaggcggcccagcagccccggcgcgagugccgccagcucguuguccugcaggcugagugagcgcagcagcgggagcgcgccuagcgccgcgggcuccaggcgcgccagccgguugccggccaaugagagguugcgcagcgcgcgcagcggcgcgaaagucccuggugccagugcuuccagcugguuggcgcucagguccagcagcugcagcgcgcccaggccccagaaggcucgcacaugcaccgagugcagcccguucucgcgcagguccaggcgcuguagcgcgcccgcucccgcgaaggcaccuggcggcagcgcacggacgcgguugugguccagcagcagcgcgcgcaggcgcaggcucaggcccgggggcacggcgggcagcgagagugccgagcagcuggccaggccucccggcacgcacgugcacaccucggggcaguccggggcgcccagggaccccgagggcgaggccguggccgacaccugggcccagacaggccaaggcgacagcagcagcaacagcagcagcagcggccgaggccgcgaccaggaagggccccgcaugggggcagcccccccgcccccggcacccgcggugggaggcccgcugccugugcgucccuggagcccgucguccgcggagcccguuccugcggcgccugcacaaauauuaacucucug

SEQ ID NO: 13087 - RNA, 7988 nt, Homo sapiens
ggagguggggguugggcggugcgcgccugcacccuggggacggaggggcagagcgcggcugcgcacgggccgcacggggaaggcacgcgcucgggcccugggagugcugguucuguacaagguggcgggccggucacgcacccggagcgagggcgggggcgggcggguggcgcucucccgugcccaaggugcagggcaggguugaagacagucccgagccagcguccggggacccccggggaggcccguucugggcugcaggccggacgaggagaggaggggcucagcccucucgagucuggaggaggcggcccgaggcggcgggaggcgcugccagcugggaagucagggacggccgugggggagggcagggccagccccggcguguggggucaaggggcagacggggugugggugggcggugccgcaagaagaggggaggguggagcucaggcugcagaggagcgcaggcgcccgaggaggggcgacccagccagcuggggccaugggccccacuguggcucaggcuggugcugcgggaaggauggggcugccgucucugcuccaagccccuccgccuggggccaguuagcccccgcuccccacugcucagagaccccagggcccugccucugccggagcgcccugcggcccugcccagccgacucagcucugccccguccucagccgcuccgguccgcaccuugguccagcaggggcugcccgccaggcagcggggugggcgggcggacggacgggaggcccagggugggcagucucuggggcgggugggcuucccucaggccuucccgagcagcaggacccaucaguguccuuggccgggcuaacugggcaggugggcgccuccgggggccucacaccacggugcugaccgagggaucugagagguugagcgggcccgugauaucagugggaugguacugcugcaaaauagaaauacacagacaaggcgcccguuagccccacgcugggggcacgcgcggggccgggacgggguggaccggccagccggccaaccggcgggcgggcaggcgcagccugggggaggcugggggugcuccucccccgaccccguggugcuccggggcucugcgugggccgggccgcugucccguccgucugucugucugucugcgggggagggggcagaggagggcgggcggggagucucagcucucccuaugacgggaacacagcugcagcuggcccuccucccucucaauagcgcgucgcggcagcacugugucuuuuugguuuugcaaagcgccgcguccacccccggugcucuauaaauaagaaccaacaaucaauacccgcuggccccgccggccgccagggaccccagcccucagcgcccagugccgcccuggcccggaccggccacaggacaggggcaggggaucuccgcagccggacugaccccacccuacccaaaggagccccccacccacgccucccucugaauaagcucgcagccccagagaccaggugggagcugggcugcccuccccugcccagacccccagcuggcagugccccccacaguucagccuugcagggcggggccagccccagaugccacgugaugccagaacuggccccagaggacggucccuggugcccagagaggcucgggugaggguuccgcugggaacaugucccugggagggcaccaugagggucucugagcugcaccuggccucgcuccaggcagggcccugggacccagugucacccucugaaaguggcccaucaccugcacgacauuugugcuugccccccguggcugccugccccaaaucgcuguuucuccugucugccuggacacccccucuuccccagccugcccagcccacgaucccugcgcuauucccccucccuguucccugcgggacuccuggcucagacuuugcagcaucagcucugcccgcuuuccgcagcagagguggcuccaggaauggugcuuccaccugcuccuugagccuccaguggcccccaggccuacaggcucucacuguccacccauccugcaugccaagucccuuccccaggaagcugagcagccaggccucaugggucccucuuggggcacccugguggcuucaucucgggauuuggcuugcuugaugccaaguccugucugugcccuggaggucugccccgcuuccagugcacugaggggcagguggcugcaaaucgcacuuccucccccgggcguaagcuucucucuggugaugcugcuuaugggcugggggcuuccugugggccagacuggucccuggacugcaggguggccacggggcugaggucuccgcugccucucugggcagccccuccccaccauggugccugggccuggggugccucuagcaaggcuggguucgcucugggggccucugguccgagugugcauauccgcuacagggacaagcugccccgagcaggaggugggggauucugggcuccaaagggcagaaggccuggcucuuuggggugggccuugugggguugcuggggucaggagcugagguggucguuucccuuccagaggccucccugucugggaaccucagugucguccugggcucugcaggccagggcuuguggggccgccccuacccauucucagacccucugggagcugccgccacaccuccugcagggcccccgcucagccuggggugggagccaccccuuuuggucccaccccacucccugccugacaguccccuguggccggggccaguuccaacuccaggccccagccguccacccagacggacccaggcccggcccccagcccccggcccacacagagaccacaugaagaugcaacacgcauggcucuggugagacaggugagacaggugucuggggggcggggccaguggccagacagacggacgggaugggacaucacagccacccccuccagggccgucgcaggggcgaagugagggcggcgggccccucugggagaggcgagagaaacggggacauaacagagaagugguguggccucccggcagcugaggaguccaggauggggccacgcugggcucccagggccccagaccuggccccgagaggugguguggcugacugacugaccaacgagaugacaggcuucaagauggcgugugggucauggcaggggaggugggcgggcagacuaacggagacacacggggaaagccgaggacccaggagggccggggagaaagguccagagagugagagagagcagcaugggcgggcugggcagagcggccgccacagggagacaggggcagagugggccacaggagcccaggguccggggcggggugauggggcgggagacacacgcagggcagggcagguggagucggacgcgggacuggggugcucucccccuuaccgugucuuuggaggaccuacgccucuugaagcuggaagccaggguggaggugauagcccuaaauguggcuuucuuuuuagggucaggcucugcucuaccacucuuucuauccuaaaaugaauauguauaagugauuagauggcuagggugguggccacaccugcccucgccugcuccugcaugggccgcugcccagccuggccggccacuugggcccucgcuccugccugccucccugugcuggacagacgggccgacagcggacguucgaggguggccucuucuccugcccggggucucgggccugaccuugcucgugcuggggcugggcuugggggcucucggcuggcucuuccugggagguccgccuggcucccuggcuccuggguggcccuggcuuacaggcgucccgaggaggaggaguccucugaggacuggaggaguugccccucaggccacaccagcugucugcguggaggccacugacccccaaggggcacacaccaagauucaggaaggggccgagggcuggaggcaggugucgagguggaauuggagugacagaggcagcucccgggacucuggccucaggucugauggccagguggccugugcccgccagugcuggcagcggccagguccccaggggaccugugggggccaagagcaagagcgggcggaugagagguguggagccuccagcaacccccaucccccagcagcccuggccgcacugucggcuucaucucaggacacaggcuccaggacggcacccagagaaagagaagagacggagugaaccggaacucgaccgcgggccacgagcccuuaggccuguacaggcccacugcccacccugucccaggugggccguggcugcccuugcugguggcaaauucucauggauacaaccugggcaccaggcaggaccggaccuggcccaauucggauuagagucacggagcacaaggacauagcaggaaaggggggggucuccgaagggugucaaggggcuugggucggcggagggcaaaaugcaucuuggacucacgugccauacacaggcgggccccugucuuacccugccugauugccuuccuauggaauggguaccggcgggcgacucuggagacagaggggccaggcggaggcuuggagcagggugcguggccucccucggccccggcuuugcagugggcagccaccugcaggcagccccccaccggugcugcccccgugcccugggagcacucaccacugccccuggccauggcuccuagcuccaguccugcccaccagagccagagccagugccacggccuucggggauggaggagggccguggccaggccgggcccugggcaccaggccucggaggguggccugcccuaccugcagguucuuccgccacacguuaacggcggcaaaggccagcugcaucugcuuccggcgagcauccuugugccgcuuguaggcaaucucgaugaaaaucaggaagaucccggccacgaugcccccagcuaccagcaugaagaccccugugugccgggacccagagccucaguugcuggccagggaggccgcagcccacggagaacccacccgagaauggaugaaggagaacgcaccggccauguucucaaaaguaagggucgcaggggcguugcugcgcgagucacauuccugauaccgaacccacgucuuguccaggucuuccaugaagccauucucgugggaccuggcggugggaacaagugagccugcagugaggcggggcccaggacgggaaggagcaagcugggggcggggccggggcggggccugcgggguagggugcggcguggagugggcagcgcccggccugggugggaaaucagugguggccucggaguggucuggcacuggggagggcguccaccucuggcggagaggggcggaggagggacgcgggcgcacggacacucacuugaggauggacagggagacguucugcuuccaggggcugucuuugcgcaugccuaugccgaagcccgagcggaaaaacagcucuccagucgucaccaggucgcacuucugcgaggccucgaacuccagcaccgccgagucccagaugaaggcaugcagcuugcugccggcagaggcggagucacgggggccuugguccugccagccuggaagccccacgcccgcgcccuccggggugcccggcccggacgcucuccugcccgguggaggccacccucccccuccccgcaccugucccgccccgccaggguggccgcccgcgccucacuugucucucacggccuggauggccuccgccgcacucucguaguugugcuucuccauaugccgguacauggugcucagcuccaccuggcgccggaaguagauauccacggagcucugcuucaccguggcguagauaaacuuguccgagggguuccucagcugcagggucggagggcagggaucgcggcggcggcuccccaggccccuaaccgaggccgaccccagcucaccucgcauucccucccccagcccggccaggccucacccgagggucguugaugcccgugaugcgcuccuccggccgguccagcaccaggaaggccgccagguuggcgguguaggaggccacgaugaucauggcaaagccggcccacaccaugcccaggaugcgcgcugagaagcuucugggggcgccugugggcgggcggggggcucugucagacccuagagggccgaggcgggaccaggcgggccgggcggggccuuaccuuccccgaugccggaguugagcaggacgccccaggagaaccacauggccgaggacagggucagugcguccuccuccuccuccucgcuguucaccuugaaccggccgaaggggcugcggggcgcagagggcgggcgggagagagggcgggagaggcggcccugccccgccccuggccggcuccgcgccccgcagauggaggugucugagccccgggucgcgcucaccugaagcgguccagcagguacagcaucacggccaccacgugcaccgacagccccaccagcagccacagugugcucuggaacggcugcaugaacgaguccagcgugcuccggggaaucuccugcggagggacgcgaggucagcgcggcccgggcccuccagggacuccccccgccgccaccccgccacccggccccugcccaccuucuugaccagaauagucaggcccugguacuugaagggcuuggaaaacucgauguacugcgcgcgcucguuguuuaugguuagcggcgccacgaucaugucugccugcccgcugagcagcucgcccaucaucccauuccacuccuucuuguugcuguuguucaccugcgaggcgacagagccggcgggcaugcaggcagcguccucccagcucccgccacagguacccccgacugaagccgcccuagagcacuccgggggucuucuccccaagacccuacccagcucgcaggccccaccccacuccagccccgcccuggcucgcagaccccucccacgccgggcgggccccaccacagccagcaggccccgcccacuccacgucccgcccacuccagacccccgccugcaggcccugcccacuccgugccccacccacuccgacccccacgucaggccccucccaugucaggccccacccagcccucaggccccgcccaccccaugcuuuacccacgccaggacccagcccgcaggcuccgcucacuccaugccccacucaccccaggaccccccaccaucugcaagccccgccuacuccaugccccacccacuccgaccgcgccugcaggccccucucacgcugguccccacccccgccguccagccuacccgcuccugugugccgaacuugccaucugccaccaggugcaccucguaggugaaguucaugguccgugccagcuugaugagcaggucgaugcaaaagccguagcaacacugaggcaccguguggcgggcuggguaggugcgggcgguaacugcugggcuccagaccgccccacgccccgcgcccugccccgcgccccgcgcccugccccgcgcacucacggcugcccggcgacgugucguugggcccggugcagaucaccuucuugacugggucgccguugacugugaacuccuccuugcaugucccaucacucagcgugggcuugacguacacgaagggcuccugguggaucgucacaaucugggggggaaggggagacccagccuggaccaccgaccuaaggcugcccagggcggcagucucuucucagcucccagccuccccuggcgccccucuuaauccccgacgcaccccucacaccccccgcccugcgccgccggccacugccccucucuggagcuucuucacgagcccaaguguucaggacacguccuccccagccaccgucagcaucgucugccugcagccccgggggggugggggcugggggcucagaaaagacuccuggagagcuggacccuucucuuggccacuuuuucuccagucuuggcuuagacaugauuccc

SEQ ID NO: 13088 - RNA, 4053 nt, Homo sapiens
ccucugacuaccacccugucccagucuugccucuguccccacagugggauccucccacuucagucuccagcugccugguuccccucccaaggcagccuuguccucacuguggggccggggagaggccagcagccccuggggcccaaaaguagaacaggacagggacagggguggugggaggcaggcccccucugagggugcuggggcaaaggucuggacaacaguucaugguugccauuccucccaggacacacgaucugagcccccaaaagaccugacaggacagacgcguccucauucccagcaucccagcauuuugggaggccgaggugggaggacugcuugagccaggaguuugaaacuagccuggacaacauaacaagacucugccucuacaaaaaauuuuaaaaaauuaaccaggcaugguagugcacacccauagacccagcuccuugggaggcugaggugggagcauugcuugagcccaggagguugaggcugcagcaaaccgugacugcgccacugcacuccagccugggcaacagagcaagacccugucucaaaaaacaaaaaacaaaaacccacacacaaaaaagcaaacuuggcugggcgcgguggcucaugccuguaaucccaacacuuugggaggcugaaacuuguggaucaccugaagucaggaguuugagaccagccuggccaacaugggaaaaccccaucucuacuaaaaauacaaaaauuagcugggcgugguggcaggcacccauaaucccagcuacuugggaggcugagacaggagaaucacuugaacccggaagguggagguugcagugagccaagaucgcaccacuugauccugacuucaggugauccacaagccuuggccucccaaaaugcugggauuacagccugggcgauagugcaagacucccucucaaaaaacaaacaaacaaacaaacaaacaaaccaagccugaccugcauugagaucuccaggacgucugggucuggccacgccugggaccacacaaggucccgugcagcagaguggcaacgugguugggugaagaggcugauggggccucccacuguggcugagagugggguguugguuggcuggggcucagggugaccccgcagggccaucccagccuggcuggcacccaacgugggcugguguagaagaaggaaccuggccuccaggcuccaggcccuggcuuagagggagcggggagucuggacuucaggcuggaucccuuccucuuccuggagcgggugcuggcccccaacccgcuugcgucagggacaaaaggacuccuucccuuuccagccuggaaagccccucugcugcaggcuggaggaagggacccugggcccagccuauagucagcggugucuaugggcauggaucuggacggggaaaaggacaaagcagccuccauccacaguucauuccgggaccaggcccuugcaggcacgcgcugggcuccugugggaagacacuaagggccccaggacagaccuccucuccgggcaucuggguuccuagauggcagagguggcagaguggggugggauggcccaauugggagcuuuagcuuccggcaaagagcugagcacaguacaucuucaauguguaagauucuccugggagaccagggcccagcugguggugagcugggggaagugggugauacugccgugggaggagccaccuggcccucuggggaagugcacucgcugucugcagcgcccaggccuggguagcugggugggggcuggggggccaucugugcucagggugccugcaccugggccuucucugcccugggccaagccugcccgagccucucuguccucugccugcccagcuggacaucucugggccucucuggagaccaguggggugggcugugggggcgucauauugcccuggcuuggcaucccucuuguggcuguaccccucccagcagccccaggacuagcaaguccccgagauggggguggggacagugguugaugccaaagguugugggggcaggggcggggcaggagcaggaagguccccugaguucccucaccuugggcagagauaaaaggagcacaguuccaggcggggcugagcuagggcguagcugugauuucaggggcaccucuggcggcugccgugauuugagaaucucgggucucuuggcugacugauccugggagacuguggaugaauaaugcuggugagugucuggcccucggggaggcccaagcuggggacagcuaggcaaccugggaggggaggacggggguggcgcugaguggggcaugucggugucccugagcccaugggaggggaggacggggguggcgcugaguggggcaugugggugucccugagcccaugggaggggaggacgggguuggcgcugaguggggcguguggaugucccugagcccaagugacagagccuccccucccucgugcugcugcagggcacggccccacccggaggcugcgaggcuuggggguccuggccgggguggcucugcucgcugcccucuggcuccuguggcugcuggggucagccccucgggguaccccggcaccccagcccacgaucaccauccuugucuggcacuggcccuucacugaccagcccccagagcugcccagcgacaccugcacccgcuacggcaucgcccgcugccaccugagugccaaccgaagccugcuggccagcgccgacgccguggucuuccaccaccgcgagcugcagacccggcggucccaccugccccuggcccagcggccgcgagggcagcccugggugugggccuccauggagucuccuagccacacccacggccucagccaccuccgaggcaucuucaacugggugcugagcuaccggcgcgacucggacaucuuugugcccuauggccgccuggagccccacugggggcccucgccaccgcugccagccaagagcaggguggccgccuggguggucagcaacuuccaggagcggcagcugcgugccaggcuguaccggcagcuggcgccucaucugcggguggaugucuuuggccgugccaauggacggccacugugcgccagcugccuggugcccaccguggcccaguaccgcuucuaccuguccuuugagaacucucagcaccgcgacuacauuacggagaaauucuggcgcaacgcacugguggcuggcacugugccaguggugcuggggcccccacgggccaccuaugaggccuucgugccggcugacgccuucgugcauguggaugacuuuggcucagcccgagagcuggcggcuuuccucacuggcaugaaugagagccgauaccaacgcuucuuugccuggcgugacaggcuccgcgugcgacuguucaccgacuggcgggaacguuucugugccaucugugaccgcuacccacaccuaccccgcagccaagucuaugaggaccuugaggguugguuucaggccugagauccgcuggccgggggagguggguguggguggaagggcugggugucgaaaucaaaccaccaggcauccggcccuuaccggcaagcagcgggcuaacgggaggcugggcacagaggucaggaagcagggguggggggugcaggugggcacuggagcaugcagaggaggugagagugggagggagguaacgggugccugcugcggcagacgggaggggaaaggcugccgaggacccuccccacccugaacaaaucuugggugggugaaggccuggcuggaagagggugaaaggcagggcccuuggggcuggggggcaccccagccugaaguuugugggggccaaaccugggaccccgagcuuccucgguagcagaggcccugugguccccgagacacaggcacgggucccugccacguccauaguucugaggucccuguguguaggcuggggcggggcccaggagaccacggggagcaaaccagcuuguucugggcucagggagggagggcgguggacaauaaacaucugagcagugccucgugggucuggccagugu

SEQ ID NO: 13089 - RNA, 2523 nt, Homo sapiens
ggccucaccuccucacuucugcagcagagacgagacucagccgguggcaguggccccccucaccacgccgccaugcuugccccgcugugcacucaccguccaggacguggaacuggucugcagccucgcagaagccugggggcccaaggcaggggucaggcuggacaucagcccagagaguggggguggcugagcuggggaccugcuggggacacucaccguacuuggggaaguagaagaucugguccucagucaggugggccuccuggacccgcugcucaaacccacucaggaccgagucgcucacagggagcgagcgggcugcagggcagacaggguuccugggguccuggcaccaggcggcguggagggcucuggaaacggggucuguguguccccugcccccucggggcccucucccugcucccacaccaggccugucugucacuacucccugggccccugcuuagcaggaggaucaggaugggagaaaggaaguguguccccaugggcucacccagccccucgggguggcccagugagugugcagagcuugagcgccugccuggucacagaggcuggcccccacauaccguagagcuucacugacagcugccccgcccgcuccagguacaggacagcgaaacucugguagucggucucagcgacaaccacgugcacagccccucgggcgucucgggcuggggcagagccacaguagccaugucagagagccacaguggcugcgucaucccccacccacaugcccugcagccccugccucaccuugaagcaggaagcggccgaggaccccugugucuccauagagcuggcgcaccugccagcagaucccaucccugggggggcggggaggaggcaccacaggcugggagaccccaaccaggaauccuaguccaggccacagccgggguggggucaggggccagagcagggcugaaguccgggggcugagaggaggguugggguuagggugcagggcugcucugggacucacagcuuucggaagguacugacagccauggcugugcccuggggagccacaugcagugugguggccucggcccgguggcccugcuccugcaggaaacggcaagcggagcccacagccacaaggagccaggucccugcaaacugggggcagaccaugggagaacucgagggcacugugggagggccccucaccugcuucccucuacaccccccacaacuucaccugcuucccucucccccgcaacaacuucuaccugucucccucuaccccucccacaacuucuaccugccucccucuaccccccccaacuucuaccugcugagcaucaaaauuggccuugggcuggauggugcugaugggggaugcgggccggcguggccucugaggcuucuggcccagcgagccagcugccaggagcagagucaagagggucgcagucccagggggcagcaugguggcggcagcaggguggcaggacugugggaggccaaggguagcaccaccaagucccaggacagagucuacucugcugucacagagcccagcccaggaaguccauguccauccguugccuccccaccccccaccuccagccuccucgugagccuagcuucgaucugcacuuccuggcagggcccuggcaccauguccuauguacaaaguccgaguugaccucuggcuguuuauccauuucuccugcaccccugauuuccaccgacaguccuuagcccuuuacacguuaucuuccuuaaaccaucacccaguggucuuaucuccauggccaacgucacgggguucaugaagccacuugcucagggcccggcaacagggagcgccggaggcgggucccgaaccagcguucguugagccucgccugcaaccccgcccacgaccgccgcccgcuggccacaaggggcgcuguucccaaugcgcccgagugcgcgcaggcgcacaaagaaaagccggccaggccgccggagcccaaggcgcaggcgcacgaggggcggaugcgggcuacccgcgcgcucugccuuccucggccaucgaugccucggggcucguggcgucgggccuggcgggcuccccguugggcgggggcggcgguccgagcggcugcggcagcggaagcggguccgggucgcgcagggcgggggcggcgcagcgggcggaggcggccguggugagugcgccugcggcccucgggggucccgccuugucguccccgcccgccuugggcgagugcaggagccccgaggccgcccgugcgcucguccccgccguccgccccgagcccgccgggcagagcugcuccagggccgcagggcggaggccacugccuggccgccccgagcuuccucucggcggaagcccguccccggacggcgccugguguccccgugccucgcgugcggcgguccgggcccuggcgggcugaggggcgcccgcugccggccgcaggaggccgggggaugacgcggcggagaggggccggcccggcccgcccggagcug

SEQ ID NO: 13090 - RNA, 4341 nt, Homo sapiens
gcggaugcgggcuacccgcgcgcucugccuuccucggccaucgaugccucggggcucguggcgucgggccuggcgggcuccccguugggcgggggcggcgguccgagcggcugcggcagcggaagcggguccgggucgcgcagggcgggggcggcgcagcgggcggaggcggccguggugagugcgccugcggcccucgggggucccgccuugucguccccgcccgccuugggcgagugcaggagccccgaggccgcccgugcgcucguccccgccguccgccccgagcccgccgggcagagcugcuccagggccgcagggcggaggccacugccuggccgccccgagcuuccucucggcggaagcccguccccggacggcgccugguguccccgugccucgcgugcggcgguccgggcccuggcgggcugaggggcgcccgcugccggccgcaggaggccgggggaugacgcggcggagaggggccggcccggcccgcccggagcugccggguccuugguugggcggcgguacccgggcguccccugcagacacgcagccccguggaacucccggcgggacgguuggggcuggaggaacaggacgcccgcucucggccucccuucccgggccugggcugagggcagccguugguggguuucagggccgccugggcagaaugucacgauggacgagggcggcacgccccugcuccccgacagccuggucuaccagaucuuccugagccugggcccggccgacgugcuggccgccgggcuggugugccgccaauggcaggccgugucgcgggacgaguuccuguggagggagcaguucuaccgcuacuaccagguggcccgcgacgugccccgacacccaggucaguggcguguggggccccuacccacguucugcagccagggccccgggccccugcgcuugggggucagccuggcugggggcccgccccgcggccccgcguguccaugcucacccccccacacccugauagaggccugucaggacacagcgcaggcgccccucagagcuuggaggccagaggguucauugggucacuuggggggugggggguacaggggucucugugagcuacaggguugaaucccccagccgaggccuaugccaugacuaguggguuccaggggcaccacggggccugccaggacugcuggggccacacucggcucauggccgugacugcgaggaaggcccgggcccaggacugacaacugcccacccgcagcggccauguccugguacgaggaguuccagcggcuguaugacacggugcccugcguggaggugcagacgcugcgggaacacacagaccagguccugcaccucagcuucucccauuccggguaccaguucgcguccugcuccaaggacugcacugugaaggugaggacggccagguguccugcacaccccacccagcucugccgcagcacggaggucccaggacccaggcguuccaaccaggugguggugggggggggggugggucaggccagaggugacagcagccucccugcauccagcggagggaccacagaggaucaggagcggugcaggguggcccugagugcugaggagagggucccacacacagccgccugcuucaggggcaggcuccuccgcucuauaccaaugccccccgaguggaugacaguggcuggaaggggucccugcucccugguggccucugaguagggcuggcagagcuggggccucauggcuguguaguagcaggcccccgccccgcgaccuggccaggcgaucacuacagccgccccugccgaacagaucuggagcaacgaccugaccaucucgcugcugcacagcgcggacaugcggcccuacaacuggagcuacacccaguucucccaguucaacaaggacgacucgcuacugcuggccucggggguguuccuggggccgcacaacuccucauccggcgagauugcugucaucagccuaggugagcacgggcggcggguugacccugcccccgccccacgccgacagccuguccagccccggccuccccacagacuccuucgcgcugcugucccgcgugcggaacaagcccuaugacguguuuggcuguuggcucaccgagaccagccucaucucggggaaccugcaccgcaucggagauaucaccuccugcucggugcuguggcucaacaaugccuuccaggugcgugcggggcuaggggcggggcugcccuccuggggccuggcgcccggcgcccaccuggcacgugcccccgcccccaggauguggagucagagaacgucaacguggugaagcggcuguucaagauccagaaccucaaugccagcaccguccgcacggugaugguggccgacugcagccgcuucgacagcccugaccugcugcuggaagccggugacccggccacgucccccugccgcaucuuugaccugggcagcgacaacgaggaggugguggcuggcccggcccccgcccacgccaaggagggcuugcggcacuuucuggaccgcgugcuggaggggcgggcgcagccacagcugucggagcgcaugcuagagaccaagguggccgagcugcuggcccagggccacaccaagccacccgagcgcagugccacaggcgccaagagcaaguaccucaucuucaccacuggcugccucaccuacuccccacaccagaucgguacaccccugccgccaugcugcccgccucgguccuaggagcuugggggaggccgggcagggguccugaggggcagacagcaagcaaguccacaggcaaagcugggaucguucacucgccccuggggucacaagcccagaccuggggccugugggaugagcagugaaaacaaacgcaggcagggccgcuggccagcaagcaaccgacgggccugauucaggucuggggcccccggagcaggcagugcccacggaccucuguggugcucacagccccagagacaccacugagguaggaagcugcccuggagugauguccuuggggcauuggacagggacccucaccguagcccucccugcaggcaucaagcagauccugccacaccagaugaccacggcagggcccgugcugggugagggccggggcuccgaugccuucuucgacgcgcuggaccacgucauagacauacacggacacaucaucggcaugggccugucgcccgacaacaggugggccucuugccagugucccaggcggggugcccgcaggcggcccacaccuagcacagugccccucgcccagguaccuguacgugaacagccgcgccuggcccaacggugcggugguggccgaccccaugcagccgccaccaaucgcggaggagauugaccugcugguguucgaccucaagaccaugcgggaggugaggcgggcucugcgugcgcaccgcgccuacacgcccaacgacgagugcuucuucaucuuccuggacgucagcagggacuucguggccaggugcagggcgcggcguggugcagggcgggugugggcagcagcgggcgggcggccggcucacccaggcgcuguucugcagcggggcggaggaccggcacggcuacaucugggaccgccacuacaacaucugucuggccaggcugcggcacgaggauguggucaacucaguggucuucaguccccaggagcaggagcugcugcucacggccagcgacgacgccaccaucaaagccuggcgcuccccacgcaccaugcgcguccuccaggcaccucgcccacggccucgcaccuucuucuccuggcuugccagccagaggcgcugaggugugcugggugcacuggagccaccgggaccccuugaggacaucgccaggcucuguggcuuuuucccgagcgggagagguggagaugcuuauagcaguuacgccuuaggaaggggacaaccaggccccgccacacgcucacacacaaaccugcucacgcagcugugaugcuuggcacgggguggccagugcagauggagcccaaggcccccucggccuccugggcaacuugggguacacaggauacugggggugccgcuccucacucaaccccaggcuagggguacaccugacccagcuggccucggcccggggcaccuucggcugguccuguggggcccuggacgguggcccagugguggcaggggcugcuccuggcugugguugugcgcccggggcuugggagcggccggucacgcugcugugggcccgaguguguugcauguccacgcaccacccguucagggcccugaauaaacaguuggcaacagcacauug

SEQ ID NO: 13091 - RNA, 11831 nt, Homo sapiens
cagcccccacccucacuggcugguaaaguguggacacacugacuucacccugggagcuugggcugcccucaugggccaggguguuuauucacagagcaacagagucagcacagggcagggaacgcccaggccucagcauauccugagaccugcagccugucccagccugggcggggcagguguccggucccuggcuagggucugaccaagugcuggaugucacgugaggaagcggggccuugucugggguggucuacggaucacuggugacagaugccgggagggugacaccauccuaggaggaggaagaggagcuuuuuuuuucuuucuuuccugagacggaguuucgcucuugucaaccaggauggagugcaauggcacgaucuucgcucacugcaaccccugccucccugguucaagcgauucuccugccucagccucccgaguaguugggauuacagguuccugccaccauacccagcuaauuuuuucuaguuuuaguugagacgggguuucaccauguugggcaggcuggucucaaacuccugaccucaggugauccgcccaccucaaucucccaaagugcugggauuacaggugugagccaccgcgcccggccaaggaggaggagcuuugacagugguggcugggagaggcagggcagggagggcaaggaugggccuugcacaggugggggcuccuccccgggggguugugucccgccacugcccgcccuccagcgucacagcugagcacagaggcuccugcccacccauccccaggggcuccuaccgcauugaaaaggauguugucaaagccaggggcuguggccucuguguugcucuggaaggggcagcuccccuucuucugcagccagcgccgucccccaagucccagcagcaccaggagcaugagcaauaggagggcacugccaaccacagcuggcacagacccgggugcggcuguguucccugugggccauagggacaugugagcccuccaaagcagcccccacaucuggggcuaaggaggaagccuggggcugcauggucccucagccucugcuggcuccugggguucaccccuauuucaaaggcagaggguauugguucugcuaccacaaggauggggccuggcagacaggcagcugcugucugcagacuugguggggcucauggccccaggcgagauucuuucccucaccaagugagagcagucaguggcugcccugacccggcuggcgguuccuccaggauggaccuugcccugggugugggcacagggagcacagaggccacagccaggcagggcaggccccagaggcugcaccccagggacagcccagcccaggcagcggccccaggggugagcagggcagagugaggagggcacagggccugggccuggcagcucucuuguccugucugggugcagcaugcucgcagcuccugggaccacacacugguaagccuggcaaaccccgagccaggcuggccccuugggcccuccuccgugccuccacugcagcccagggcucacccgggcugggggcaggcugcuggcaaugcugcccagccagauacuccacgucauccagggcaaugggccccagggcuggcuggccgcccagaguggcuucaaacacgaucugauggagaaggaaaggaguuugugugggcccuggguggaggaggaggaggcuccuugcccacagccagccucaccuggaacuccuuggcacuggcuaccuccaccugggccuccagccacuggugccgccgaugcccgccugcgccccacacagccagcuggcccugagcacugugcagcaguaccuucagcucccccuugucugagagcagggccagggcgugucaggccugggguccuggggcuccugcacgccuaaccaggggcgggcuggggaggccaccuccccaccucugcuccuggaccccugcugcccccguugcccaggcacccauuggcccagccggacucacagaagugcucaggaaaacccaugugguaccagaagcggaggcaggaggcugggguggccggcagaggcucgcugcgcagccaggcggcccggcccccggggcccagcacgccaguuucaaagaaggcaaaguggccugggaacaagaggaggcugaugcccagcugaugggcagagccagcccucagggcccgagcagaggcucggugagcagggccuccucuggauggggcauguacucugugggugggcagcaggaggccagguggcugugugugccuccccaccuggcuccagugggcacguaccugccucugugcccagggugugguccacagggggcuggggguaacgagaggggguggcucccccgccccagucccagcuguauccgcccaggccgggccaggccagguggcuccagccacacaggccagacucaaaaucacaggaaccugcaggacaugggugggugaguggugcugccccacggcccaagcccugggcaccacgacuacgaagggaaagggcuaggcaggcaccccagagcagggccgaggccacggcagggcucccaccuggcugagggcagggcccguccuggaggagcagaucauccagagccacguaggagugugccacgccugcggccacugccucaaacaccaccuggcgggugcagggcagggcagccucagcggguccaggcagcccucgggggagggggagggggaggggcaccccacccugcacucacccuccaggcucgcucggccugcacguccaugcugcccaggcgccaggcaagcccgccgugggcacugaggcugagcaccuggugccucccgcgcuccuccagguagacccgcagggugccugccagcaggggcggcccaggucagcaguguggggagagcaccugcaggcccuggucugagcucccaggcucccagccuggcgggcgcaagaggcuccccaguggccucagcacaaggcugguggggacaccaggccaagcuucccugagcccacuggggcccccucccaaagccccucaccugggcugcggaggcucccgugguaccagaaggucagacaagcaggcugggccaggggccugugcuccuuggaggucagggaggccgucuggccccgggguagugcgucugggcuuguguccaccaccauguagugcccuggaggugccagcaucagccugccagccccuggccagccccucaaucccugccccugccaggcccccauaccuugggcugucucagugguauggucuguuggggggccccaggcagcauggcccgaggcauuggccugccgccuccagagaccuuggccuccaggggagaagccgcagucugaguccucaaaggagcaguaauuaggggcccagcaggggcccggccgcacggccacaucguccagcgccauggugccgugguauccgucccggaggcccucgaacagcagcuggggguggagggugucagcuggccaggggcccugcccuguccucccacccgggugccaggccucaccugguacugggcaugggagccaggcuggugggaaaggguggcccaggccucgugccagcgguugcccugggugccugaccgcgaccacaggugugucuccuccccuucccgucucauggcuaggcgcagagucccugcagggaggggaccaguccauaacugaccucucuccugugccuugaugggugucagagcgggggacucugaacccccgggggccuccccacaggcucugcccuguuuccagguccacucaccaaucuggggcccauggaggugguaccagaagcugagacacuccgugggugcugcuggcaccuggggccuggagagcaggugggcacuguggccccaggccagggggucugugggguccaggagcacaaaguggccugcagggggcauggggcugugcugcagagaugccccacucucgucugaaagccacccccggucugagcgcccauccuaccuuggccugugguguggucguggucagggccgcggcucuccacccagcgccagugugugucugagagguggccuggguaccagcugcaugugucccgcucaaaguuacaggagaccucuggggguggggccagguggcgucacacaccuucuccccucccccuccagagcccugagaagguggaagcuccggggucccuggaggaguguaaggggagcacccaggugggagugaggaugggcagcaggaaccucugucucucucgguggucacuguggggcuacagucccucagggucacguuguccaccccagcucccugcuggucagggccauccaaguccaccaaaccgacaaacuccagcuucaugggguagggggaugaggaggaugguuaagucagggcccgcuccagcggagcucccacucugggcugcccuccucacccggaagggccggcggcgggccccuagaaggaccuuguccaccuuccagaugccugcacugcugcucagggccugccaugccagcucccgggagccguuguccaccacaacuagugccaggaagccuggccagcggggcggggggcacugugggucacccggccccagaccccucccacugugcagggagcacccaggggcuggccagggaacuugcggaguguggcgguaccucggggcuggcucuguaaauaauaagccagguggaguucacagcuggggccagaagggccaaggaggggugugaggacccgggccucagcgccuagcugcccccaggcccgcugcagagacaggaagugcccuaggggaagagcauggugcucagagccucaucccuuccagggccccacucugucccucagggauccccaguccagagacccucuguagugcagaggcagagcagagaccccucugaggacgcugcucacacccgggcgggggcuugagccuugggccuugggccucaccagcagcagcugcacuggaccccuggcucuccugggcugagacacgccgccacugcagccgccccacgcuggcguccucccagcccccagccucgggggacucaaagucuguggugccuggaacagcagccggcacugaauggcagaguccucagaguccucagccugccccggcgccuacccccuuggcuccgcagcaggaggucugcaggagguugagccccuuuaccacaggccugcucguccucgcccccugcgcacugcuccucgaagucacacaguuguuccgggggcacacacagguccccgcaggcaagaugccccugcuugcaggaauccuggagccgcgagcugggcggcaggggcuggggggcuggggcccggggcccaggaggcagcggcugcaggguggacaccucugugggggcagaacuggugucaggaggcagggauggggagugcugugccucuccagggcaaggcaggguagggcagagucagcaggcucacccgagacuggucugcaguggucagacaggaugaggucguccagacccacgacgccccccgggccugucugcccggccaggaggaucugagggcagaggggcucagggggugcccagccuauuucccccuggggucuggucccuguccacccgcaguggguaccuuguggguuccccuccccugcccacagugcggcuccccagaccccacccucuugcuguucccuaccuggaagggguaggcgcucuggaugucaacacggucucggacccaggcgguccccagcuccccucggcgccuccgcagcaggacgggggcccggggggcgccgggccccagagucugcaggaacagcuggaggcagccagccucagacccacucagguacugauagaagaccagcuguggaaccaagagcuggcugggggccugcaccggggcagccagcacggagagcagggaggcccugugagccccacccaucucaccgagcaguuggaggugccugaggcuuggaauucggggcuggagaguauagcaggggugccaggcucggccacggagaccaggaaggagccugcgggaaaggacgggagugggccagggccacugggcuguggcugcgugggcagggccugggccggguccucugugggccucacccugugcacuguuccggcuguggucacggcguggccaggaggggcgcucaggaccaccagcgcggugguuccgggaccagccuuccgagcgguuccaugggcccaggccugucucaaagucgguggcuauguggcggccuagggcaggaggugggcgugucagggccaccaggcagugcuuccugaagccguauggccccagcuccaggggggcccuggcaaccacaccccaagaaggaccauccaaggauccaaggcacccccuccuggaugagugccagggcccccaccgaggcguccagucucccagccucacucugggcccccacuccggccucaccacaggugaguggguucucaucagacagguccccgcaguugucuuccccgucgcacagcugcuggggcuccacgcagaccuuguucuggcagugguggugucccgggggacaguuggccuggggggcuggguggggcaggguuaacccuucaccgaggccccaggagugggagagcacucgggggcagacagggucugagcaggggagugggcaggugggggcccucccggggguggaacaggaagaggcggugccuuacugggcagaccacagucccagaacucuaggucaucuagagccacagcgccccuguggguggcauuucggguggcagagaaggucaccugaagagaacaggcucuuaggaccuaagucagggcccagaccccuccucaaggcccccacucguccagacccucccagcucacucggaagucaccccggaugcggccuguggucacugccaacuccugccagccagggccccagggcccugugcucugccacagggucagggucucugcgccaugggucagcuccacccgcaguucagccacaucugcaaugucaggggucccagggcagcugcggcccugcuuguccccagcugcccacccgcccuccccuugggcaccccccacgagccuuggggguccagggugcaccuccagaggccgcgugguaccagagccucagcuugcaagaggaggcugccucucgcaggguuggcgagcgcagggcugcgguggaugccucuuucccucgguggguuccaacggccauguaccagccuggcgcaggugagaggucaggagacggggcagggagcaaggaggguauugggacaggggcgcacagagacuugcccuggccucacccaagucggugcccaguguguggucugagugaggcccaggacccuccagugcggccccugcccugucucggagccagcuguagccugagguacuaaugucccgccagccgcagggguccugcucgaagucacaggcgaagggggcgcccagggugggcgaggccccgugguaaccugggagaguggguggucaggugugugccagaccugcucgcacuggcccugcccgcccaucuggucuuggcucaccacacugggccucaucugagcagucccugcagucacacacgaaguugcacacggccuggccagggcuccugcagugguuggggacccaggcccagccugaggacccugcugcugggagguugacagccagguggccugggggcagggugaccagccaucccagccugccuaggacuauucaguuuuagcacuggacaucuuuuguccggggaugccccucagaccaggagauggagcagggaggggcugggacccacagagaacucccacccggcucaggaccaagcacagcacguuccuguuuccagcccugaagaggcuggggagggggacccggccauggggcaccccaagaaagguagcaggaacccagagugcccagcagggaacugggcacugggagggcgacccccaaugggaggcaucgacgggcggcccagggccuccacaagcuccacccaguccaaggguggcagaugaaggcuggcagagcugggggcaccuccugagcccucuugucccagacugggaggggagucgugccucuuccuuugcuuggcaggcccgaggaccccaugggcugauuccaggucaccccccuugcaggccggccaagguaguaccuugcaacccuccuucccuuuggggcucaggcaucagcccugguguccgucacugccacacagaugguaggcucagaagccagggccccugguccugccucaggagugggaccagacuacuuacccaggaacaggaccaaggcgggcagcagguggcuggacagaggcaugguugggccagagggagcagugcggccacacagggugccugggaaguuccgugcgguuaucagccugcgcuggccccgcacgcugacucugcuguuaaguggagggccccucggcccggccccacccagugcugacggugccaagcaugggccgugaaaguggccccaggagggggccucugacccagggucagcucccaccugcccggcucccucagacacaaggucaggcucuuccacccugcccugcccugccuggugaaggggaggcucccacuggaauggggagggacccaggcaccccaccaggacucugcucggcaguguggggcgggcagaggccgccguggccucucacugugccucuggcaauagcguggugcuggccaaggucaggacucaaccaguccagcagcugcaggaguccagcacgugcaccagagcuggucccugcguucucagccguggggaaccugccuuuaagucaggcuguggaggaucacgccgucauucauucguccugagcagccaggugcuguccggugccagauacagggucccuaggagcccagaaacuucgguuucucauggagcagacucaugcuuggggcagggucuuuggggcuggggaaggaguguggcauuuggggccaggcccuguuugugauuucccauggugugaccucggagcuugugucacugagccucagugucccggucuguaaaaugugguuaugacagugcccgucuggagaggcuggccggaggaccagugagcugacaaaggugggggugcccuguguacaaccagcccuggcccccagggugccccugcaccaccccauggagucccacuguguauggggcuucccagggcaaggccugaacccguguccugcccacagcccugccgggugcaagagggaccugggaggggccuccagagucaacgugagccugugggguagaugcagcugugcgaccugacccuggauacugguaggccccauggggcuggucauggaaggagccugcaggucacggaaggagccucagggcagacaggacacuggggagcccugggaugggcucauaggagggagcacuggugggcgccccaggucuuggccagcccgagggaccaggcccugacuccucucgcaagggcuugccagaccuccuccaagaugcccuggaggacgauggccgugggaagagcagucaggccaucagcgggccccuuuaucagaccccaaagggcugagugugcaccgccacucccuggggccacuccuguguucccccacccaccugcuuuaguuagggucugggggcccccggagguggugacgcagggugcaggaagccaaggacagaguucagaagccggcagguguggcaacacguuuaauucuguggccaggcuagccugucuccaaggccugguggacagcacgucaccagaggcugccgcaggagcaggcagggccagcccugcaagaggagugcaggcaaaggcgggggcucugaaguggcugcuggaggcagcaggccccgggcugggagugcucaguagccgucguuagcccaggugaccucguagucgggguacuuggcuuugauuuucucaguugaaauggcgugcugggcaggaccauaggccuggagaagagaagacgccugcuggcacuaccuggacccuucaacccgauacccggcucugggcauccagccaccagccacaccagaagcgagugugggaaagggauaggcagugccuggggaugccaaacccaccaucccgaccgcccuugggggcuccccuggggagaggcgaccuccacaggcaagcaaaccuugaugguggauccuggggccugaggcgcccagagggacgcacgugggucucaucugcuggugguuuuugugaagagcacagguggggacucugagcuccacccagguacugacugccucugggggcccagggcccaaagugcuggaggacagcuagagcccagcaaggccucccaaggcagggagaggagacagccggccaugucuggggguguccgucccaccccucaggucuggcgugugcuccaugggggaaugcaggaacacaaugggcccuggagggagggcucugccgccgacccugggagaaccccaggaagccugcgugcucagcuggggccacgggucagggcagcaggcucaggugggccucgaagcugguacuggggccuccggcagggcgggacggggcugcggcucaccauggaauagccguacacgugaaucuucuuguccugacucuggugggagaugcgcccgccgcccagacacucacagucgcagccuugcuucugcaugucgcccgacacuuugucguagauguccgcugggaugggagggcggccucaggacgugcccuggccgcccuuggaggccgcgggaggaacucccagccgaaggggucugaaaucccagcucugaacagccccuuccccaggagagacgaagccccuugaggcugggacagggaugaaugagcgaaggaggguggaaccggggagggcgcgggaacugggagacugcuggggagggugucaggccgugucacgcccuucccgcccaggaccucagccugggucaaaccuagcaggggcaggacucggagcagagcgcaguccgcuacggcccgcagccccgcccccgccccgccagccccgccccugccucgucagccccgucuccgucccgccagccccgcccccgccucgccaggcgugccccuggcaugcccgcaggucccgcccucaccaugguacucagcccacuuguagccgcgcacgaucuccuugcucucugcagccggagccccggagcggggagccgaguggacucggaucagcacauacuugaagacgccgucggagucgauguccacaucaggaaugagagcgagguccgccaccgccauguuccuccucccggaguccccuccucccacccgacccgggggccgcuuguacugcgggaggcgggcucugcgagagcgacgaccaaucccgucggggaaugcuucccaaggcccagcgccucagccaauuguaccgccgaccgaggcacgugcugaccaaucgcaauccaguuccuugccgccuugcggcuccgccagccccgcuuaaaggaaacguggaaucgggaauggguggugaugaaauccagccaacggagaaguuccucuccagcgggguccgguggcacccuuggaacggggcaguuaggcggcccgcgaggcuggggcaacgagggaggccugagggacuugccagcccugaccuccugucccgcacguaguccgaagaccacccuccccguggcc

SEQ ID NO: 13092 - RNA, 11831 nt, Homo sapiens
ggccacggggaggguggucuucggacuacgugcgggacaggaggucagggcuggcaagucccucaggccucccucguugccccagccucgcgggccgccuaacugccccguuccaagggugccaccggaccccgcuggagaggaacuucuccguuggcuggauuucaucaccacccauucccgauuccacguuuccuuuaagcggggcuggcggagccgcaaggcggcaaggaacuggauugcgauuggucagcacgugccucggucggcgguacaauuggcugaggcgcugggccuugggaagcauuccccgacgggauuggucgucgcucucgcagagcccgccucccgcaguacaagcggcccccgggucgggugggaggaggggacuccgggaggaggaacauggcgguggcggaccucgcucucauuccugauguggacaucgacuccgacggcgucuucaaguaugugcugauccgaguccacucggcuccccgcuccggggcuccggcugcagagagcaaggagaucgugcgcggcuacaagugggcugaguaccauggugagggcgggaccugcgggcaugccaggggcacgccuggcgaggcgggggcggggcuggcgggacggagacggggcugacgaggcaggggcggggcuggcggggcgggggcggggcugcgggccguagcggacugcgcucugcuccgaguccugccccugcuagguuugacccaggcugagguccugggcgggaagggcgugacacggccugacacccuccccagcagucucccaguucccgcgcccuccccgguuccacccuccuucgcucauucaucccugucccagccucaaggggcuucgucucuccuggggaaggggcuguucagagcugggauuucagaccccuucggcugggaguuccucccgcggccuccaagggcggccagggcacguccugaggccgcccucccaucccagcggacaucuacgacaaagugucgggcgacaugcagaagcaaggcugcgacugugagugucugggcggcgggcgcaucucccaccagagucaggacaagaagauucacguguacggcuauuccauggugagccgcagccccgucccgcccugccggaggccccaguaccagcuucgaggcccaccugagccugcugcccugacccguggccccagcugagcacgcaggcuuccugggguucucccagggucggcggcagagcccucccuccagggcccauuguguuccugcauucccccauggagcacacgccagaccugaggggugggacggacacccccagacauggccggcugucuccucucccugccuugggaggccuugcugggcucuagcuguccuccagcacuuugggcccugggcccccagaggcagucaguaccuggguggagcucagaguccccaccugugcucuucacaaaaaccaccagcagaugagacccacgugcgucccucugggcgccucaggccccaggauccaccaucaagguuugcuugccuguggaggucgccucuccccaggggagcccccaagggcggucgggaugguggguuuggcauccccaggcacugccuaucccuuucccacacucgcuucugguguggcugguggcuggaugcccagagccggguaucggguugaaggguccagguagugccagcaggcgucuucucuucuccaggccuaugguccugcccagcacgccauuucaacugagaaaaucaaagccaaguaccccgacuacgaggucaccugggcuaacgacggcuacugagcacucccagcccggggccugcugccuccagcagccacuucagagcccccgccuuugccugcacuccucuugcagggcuggcccugccugcuccugcggcagccucuggugacgugcuguccaccaggccuuggagacaggcuagccuggccacagaauuaaacguguugccacaccugccggcuucugaacucuguccuuggcuuccugcacccugcgucaccaccuccgggggcccccagacccuaacuaaagcaggugggugggggaacacaggaguggccccagggaguggcggugcacacucagcccuuuggggucugauaaaggggcccgcugauggccugacugcucuucccacggccaucguccuccagggcaucuuggaggaggucuggcaagcccuugcgagaggagucagggccuggucccucgggcuggccaagaccuggggcgcccaccagugcucccuccuaugagcccaucccagggcuccccaguguccugucugcccugaggcuccuuccgugaccugcaggcuccuuccaugaccagccccauggggccuaccaguauccagggucaggucgcacagcugcaucuaccccacaggcucacguugacucuggaggccccucccaggucccucuugcacccggcagggcugugggcaggacacggguucaggccuugcccugggaagccccauacacagugggacuccaugggguggugcaggggcacccugggggccagggcugguuguacacagggcacccccaccuuugucagcucacugguccuccggccagccucuccagacgggcacugucauaaccacauuuuacagaccgggacacugaggcucagugacacaagcuccgaggucacaccaugggaaaucacaaacagggccuggccccaaaugccacacuccuuccccagccccaaagacccugccccaagcaugagucugcuccaugagaaaccgaaguuucugggcuccuagggacccuguaucuggcaccggacagcaccuggcugcucaggacgaaugaaugacggcgugauccuccacagccugacuuaaaggcagguuccccacggcugagaacgcagggaccagcucuggugcacgugcuggacuccugcagcugcuggacugguugaguccugaccuuggccagcaccacgcuauugccagaggcacagugagaggccacggcggccucugcccgccccacacugccgagcagaguccugguggggugccugggucccuccccauuccagugggagccuccccuucaccaggcagggcagggcaggguggaagagccugaccuugugucugagggagccgggcaggugggagcugacccugggucagaggcccccuccuggggccacuuucacggcccaugcuuggcaccgucagcacuggguggggccgggccgaggggcccuccacuuaacagcagagucagcgugcggggccagcgcaggcugauaaccgcacggaacuucccaggcacccuguguggccgcacugcucccucuggcccaaccaugccucuguccagccaccugcugcccgccuugguccuguuccuggguaaguagucuggucccacuccugaggcaggaccaggggcccuggcuucugagccuaccaucuguguggcagugacggacaccagggcugaugccugagccccaaagggaaggaggguugcaagguacuaccuuggccggccugcaaggggggugaccuggaaucagcccaugggguccucgggccugccaagcaaaggaagaggcacgacuccccucccagucugggacaagagggcucaggaggugcccccagcucugccagccuucaucugccacccuuggacuggguggagcuuguggaggcccugggccgcccgucgaugccucccauugggggucgcccucccagugcccaguucccugcugggcacucuggguuccugcuaccuuucuuggggugccccauggccgggucccccuccccagccucuucagggcuggaaacaggaacgugcugugcuugguccugagccgggugggaguucucugugggucccagccccucccugcuccaucuccuggucugaggggcauccccggacaaaagauguccagugcuaaaacugaauaguccuaggcaggcugggauggcuggucacccugcccccaggccaccuggcugucaaccucccagcagcaggguccucaggcugggccuggguccccaaccacugcaggagcccuggccaggccgugugcaacuucgugugugacugcagggacugcucagaugaggcccaguguggugagccaagaccagaugggcgggcagggccagugcgagcaggucuggcacacaccugaccacccacucucccagguuaccacggggccucgcccacccugggcgcccccuucgccugugacuucgagcaggaccccugcggcuggcgggacauuaguaccucaggcuacagcuggcuccgagacagggcaggggccgcacuggaggguccugggccucacucagaccacacacugggcaccgacuugggugaggccagggcaagucucugugcgccccugucccaauacccuccuugcucccugccccgucuccugaccucucaccugcgccaggcugguacauggccguuggaacccaccgagggaaagaggcauccaccgcagcccugcgcucgccaacccugcgagaggcagccuccucuugcaagcugaggcucugguaccacgcggccucuggaggugcacccuggacccccaaggcucguggggggugcccaaggggagggcgggugggcagcuggggacaagcagggccgcagcugcccugggaccccugacauugcagauguggcugaacugcggguggagcugacccauggcgcagagacccugacccuguggcagagcacagggcccuggggcccuggcuggcaggaguuggcagugaccacaggccgcauccggggugacuuccgagugagcugggagggucuggacgagugggggccuugaggaggggucugggcccugacuuagguccuaagagccuguucucuucaggugaccuucucugccacccgaaaugccacccacaggggcgcuguggcucuagaugaccuagaguucugggacuguggucugcccaguaaggcaccgccucuuccuguuccacccccgggagggcccccaccugcccacuccccugcucagacccugucugcccccgagugcucucccacuccuggggccucggugaaggguuaacccugccccacccagccccccaggccaacugucccccgggacaccaccacugccagaacaaggucugcguggagccccagcagcugugcgacggggaagacaacugcggggaccugucugaugagaacccacucaccuguggugaggccggagugggggcccagagugaggcugggagacuggacgccucggugggggcccuggcacucauccaggagggggugccuuggauccuuggaugguccuucuuggggugugguugccagggccccccuggagcuggggccauacggcuucaggaagcacugccugguggcccugacacgcccaccuccugcccuaggccgccacauagccaccgacuuugagacaggccugggcccauggaaccgcucggaaggcuggucccggaaccaccgcgcuggugguccugagcgccccuccuggccacgccgugaccacagccggaacagugcacagggugaggcccacagaggacccggcccaggcccugcccacgcagccacagcccaguggcccuggcccacucccguccuuucccgcaggcuccuuccuggucuccguggccgagccuggcaccccugcuauacucuccagccccgaauuccaagccucaggcaccuccaacugcucggugagauggguggggcucacagggccucccugcucuccgugcuggcugccccggugcaggcccccagccagcucuugguuccacagcuggucuucuaucaguaccugagugggucugaggcuggcugccuccagcuguuccugcagacucuggggcccggcgccccccgggcccccguccugcugcggaggcgccgaggggagcuggggaccgccuggguccgagaccguguugacauccagagcgccuaccccuuccagguagggaacagcaagaggguggggucuggggagccgcacugugggcaggggaggggaacccacaagguacccacugcggguggacagggaccagaccccagggggaaauaggcugggcacccccugagccccucugcccucagauccuccuggccgggcagacaggcccggggggcgucgugggucuggacgaccucauccugucugaccacugcagaccagucucgggugagccugcugacucugcccuacccugccuugcccuggagaggcacagcacuccccaucccugccuccugacaccaguucugcccccacagagguguccacccugcagccgcugccuccugggccccgggccccagccccccagccccugccgcccagcucgcggcuccaggauuccugcaagcaggggcaucuugccugcggggaccugugugugcccccggaacaacugugugacuucgaggagcagugcgcagggggcgaggacgagcaggccugugguaaaggggcucaaccuccugcagaccuccugcugcggagccaaggggguaggcgccggggcaggcugaggacucugaggacucugccauucagugccggcugcuguuccaggcaccacagacuuugagucccccgaggcugggggcugggaggacgccagcguggggcggcugcaguggcggcgugucucagcccaggagagccagggguccagugcagcugcugcuggugaggcccaaggcccaaggcucaagcccccgcccgggugugagcagcguccucagaggggucucugcucugccucugcacuacagagggucucuggacuggggaucccugagggacagaguggggcccuggaagggaugaggcucugagcaccaugcucuuccccuagggcacuuccugucucugcagcgggccugggggcagcuaggcgcugaggcccggguccucacaccccuccuuggcccuucuggccccagcugugaacuccaccuggcuuauuauuuacagagccagccccgagguaccgccacacuccgcaaguucccuggccagccccugggugcucccugcacagugggaggggucuggggccgggugacccacagugccccccgccccgcuggccaggcuuccuggcacuaguugugguggacaacggcucccgggagcuggcauggcaggcccugagcagcagugcaggcaucuggaagguggacaagguccuucuaggggcccgccgccggcccuuccgggugaggagggcagcccagagugggagcuccgcuggagcgggcccugacuuaaccauccuccucaucccccuaccccaugaagcuggaguuugucgguuugguggacuuggauggcccugaccagcagggagcugggguggacaacgugacccugagggacuguagccccacagugaccaccgagagagacagagguuccugcugcccauccucacucccaccugggugcuccccuuacacuccuccagggaccccggagcuuccaccuucucagggcucuggagggggaggggagaaggugugugacgccaccuggccccacccccagaggucuccuguaacuuugagcgggacacaugcagcugguacccaggccaccucucagacacacacuggcgcuggguggagagccgcggcccugaccacgaccacaccacaggccaagguaggaugggcgcucagaccggggguggcuuucagacgagaguggggcaucucugcagcacagccccaugcccccugcaggccacuuugugcuccuggaccccacagacccccuggccuggggccacagugcccaccugcucuccaggccccaggugccagcagcacccacggagugucucagcuucugguaccaccuccaugggccccagauuggugaguggaccuggaaacagggcagagccuguggggaggcccccggggguucagagucccccgcucugacacccaucaaggcacaggagagaggucaguuauggacugguccccucccugcagggacucugcgccuagccaugagacgggaaggggaggagacacaccuguggucgcggucaggcacccagggcaaccgcuggcacgaggccugggccacccuuucccaccagccuggcucccaugcccaguaccaggugaggccuggcacccgggugggaggacagggcagggccccuggccagcugacacccuccacccccagcugcuguucgagggccuccgggacggauaccacggcaccauggcgcuggacgauguggccgugcggccgggccccugcugggccccuaauuacugcuccuuugaggacucagacugcggcuucuccccuggaggccaaggucucuggaggcggcaggccaaugccucgggccaugcugccuggggccccccaacagaccauaccacugagacagcccaagguaugggggccuggcaggggcagggauugaggggcuggccaggggcuggcaggcugaugcuggcaccuccagggcacuacauggugguggacacaagcccagacgcacuaccccggggccagacggccucccugaccuccaaggagcacaggccccuggcccagccugcuugucugaccuucugguaccacgggagccuccgcagcccaggugaggggcuuugggagggggccccagugggcucagggaagcuuggccugguguccccaccagccuugugcugaggccacuggggagccucuugcgcccgccaggcugggagccugggagcucagaccagggccugcaggugcucuccccacacugcugaccugggccgccccugcuggcaggcacccugcgggucuaccuggaggagcgcgggaggcaccaggugcucagccucagugcccacggcgggcuugccuggcgccugggcagcauggacgugcaggccgagcgagccuggagggugagugcaggguggggugccccucccccucccccucccccgagggcugccuggacccgcugaggcugcccugcccugcacccgccaggugguguuugaggcaguggccgcaggcguggcacacuccuacguggcucuggaugaucugcuccuccaggacgggcccugcccucagccaggugggagcccugccguggccucggcccugcucuggggugccugccuagcccuuucccuucguagucguggugcccagggcuugggccguggggcagcaccacucacccacccauguccugcagguuccugugauuuugagucuggccuguguggcuggagccaccuggccuggcccggccugggcggauacagcugggacuggggcgggggagccacccccucucguuacccccagcccccuguggaccacacccugggcacagaggcagguacgugcccacuggagccagguggggaggcacacacagccaccuggccuccugcugcccacccacagaguacaugccccauccagaggaggcccugcucaccgagccucugcucgggcccugagggcuggcucugcccaucagcugggcaucagccuccucuuguucccaggccacuuugccuucuuugaaacuggcgugcugggccccgggggccgggccgccuggcugcgcagcgagccucugccggccaccccagccuccugccuccgcuucugguaccacauggguuuuccugagcacuucugugaguccggcugggccaaugggugccugggcaacgggggcagcagggguccaggagcagagguggggagguggccuccccagcccgccccugguuaggcgugcaggagccccaggaccccaggccugacacgcccuggcccugcucucagacaagggggagcugaagguacugcugcacagugcucagggccagcuggcuguguggggcgcaggcgggcaucggcggcaccaguggcuggaggcccagguggagguagccagugccaaggaguuccaggugaggcuggcugugggcaaggagccuccuccuccuccacccagggcccacacaaacuccuuuccuucuccaucagaucguguuugaagccacucugggcggccagccagcccuggggcccauugcccuggaugacguggaguaucuggcugggcagcauugccagcagccugcccccagcccgggugagcccugggcugcaguggaggcacggaggagggcccaaggggccagccuggcucgggguuugccaggcuuaccaguguguggucccaggagcugcgagcaugcugcacccagacaggacaagagagcugccaggcccaggcccugugcccuccucacucugcccugcucaccccuggggccgcugccugggcugggcugucccuggggugcagccucuggggccugcccugccuggcuguggccucugugcucccugugcccacacccagggcaagguccauccuggaggaaccgccagccgggucagggcagccacugacugcucucacuuggugagggaaagaaucucgccuggggccaugagccccaccaagucugcagacagcagcugccugucugccaggccccauccuugugguagcagaaccaauacccucugccuuugaaauaggggugaaccccaggagccagcagaggcugagggaccaugcagccccaggcuuccuccuuagccccagaugugggggcugcuuuggagggcucacaugucccuauggcccacagggaacacagccgcacccgggucugugccagcugugguuggcagugcccuccuauugcucaugcuccuggugcugcugggacuugggggacggcgcuggcugcagaagaaggggagcugccccuuccagagcaacacagaggccacagccccuggcuuugacaacauccuuuucaaugcgguaggagccccuggggaugggugggcaggagccucugugcucagcugugacgcuggagggcgggcaguggcgggacacaaccccccggggaggagcccccaccugugcaaggcccauccuugcccucccugcccugccucucccagccaccacugucaaagcuccuccuccuuggccgggcgcgguggcucacaccuguaaucccagcacuuugggagauugaggugggcggaucaccugaggucaggaguuugagaccagccugcccaacauggugaaaccccgucucaacuaaaacuagaaaaaauuagcuggguaugguggcaggaaccuguaaucccaacuacucgggaggcugaggcaggagaaucgcuugaaccagggaggcagggguugcagugagcgaagaucgugccauugcacuccauccugguugacaagagcgaaacuccgucucaggaaagaaagaaaaaaaaagcuccucuuccuccuccuaggauggugucacccucccggcaucugucaccagugauccguagaccaccccagacaaggccccgcuuccucacgugacauccagcacuuggucagacccuagccagggaccggacaccugccccgcccaggcugggacaggcugcaggucucaggauaugcugaggccugggcguucccugcccugugcugacucuguugcucugugaauaaacacccuggcccaugagggcagcccaagcucccagggugaagucaguguguccacacuuuaccagccagugagggugggggcug

SEQ ID NO: 13093 - RNA, 6348 nt, Homo sapiens
ggcaacggcagccgcuacauucaaguucuauuuuacuugguucgaaagcucuugcccccuggaaauuauuccgguccaggggcguucccggccggcccucagggguggggccgaaugcagaggcccugggguagggggcgcggggcgcggcggcgggugggcaagcgggacgccuggccggugcagacgcgcggggacgagaugggcgugccgggugcgaaagcaggagcggaggcgggggugcccaauuucucucacuuggugcccccuccccuggcuccgaaguagggcuggggacuccaggagggcccuugcguuuggccuccaccccucucccgcauaccccacccuccagagagcucugggcgcggaccagggugcacuugggggacagguggaggccgggccgccgggcuugcgccuccacgcccgcaguacggcgugcggccagagcgggugugcggggaccucucgggacaggucaagcccccucgggugggcuuccacgcuuaccaacuagcucucucccucaccugcucgcaccacgcuuugcccuccaggcucccaccugggaacgccccgucccuugguccuuccucuccuagccaggugucagcucuggccaggcccaggugcucugcuuccccuguucagguccccugccccuucggcugggagacuugcauaucggccugaagaccucccugcgguuuuucccagcuccugcagggcccagacugcagcggcuggaggcgaagggacggcagggcgcguggcgugguuagugugcuggcuccgaccagcgggaacgcacugcgcaccguccgcccugcccaccgccucggcgggacgcgcucgcgcacacggacgcacagaggucgaccaggguguucuccagcgaggaggcaacacagccgcgggaggcggggcggggcguguuuaaagugacagacugggcuuugguuacgucgggcuucuggacgaggggaaaccggagucggggaggcuccagcgagagccccgcggaccgacggggaccggaucucuacggguggggucugugcaguagugaccccuccgagugaaggcagagcucggcgguccucaggcccaccccgccucccagcggggagcaccgagggcgaggaccgacuucuucuggggauccucgagggcgagcugggagagggaggaggcccggaggagggagagggguugcugggggugggaaggcgaagggccugugaggaacacuacggggacgaagggccggggggugggggccugggcggagcuggaggccgaacugagcggagcuuggaaggcuggggaauuagaggcggggccuagaagaagucgggguggggcccuggcggggcucgggggcggcccugggugggccgggcggggccugagugggcagggcaggguucgggccagcgccugggcuaggccuggugggcccggcgccucacaugaugucguccagcagguuggcgcuggccacccagucgagcgcgcgcggcucggaggcggccaugaucaugcacaugaaggggcggccggugcgccgguccgugggguagaugguggugggcgugaagcgccuguuggccucgacgaacucgcaaagcugcucguagacgcgcgggaacucguggcgcaggaagacgccgcgcagccgcagcucgcgcuggauguggaugaaggccaccucgcgcgcgcgccggcccgccucgccguccugauccaggcccgccgugcccggcgguggcgucaggaucagcgucuccaugucgggcucgcggcuccgcgccgggggcggccgcgcggggcugccggccgccagcgcuaccuuggcgaacuugcgcacuguuggcccguggcugcguggcgcgggcgcgggcagggccgguguccccgguggcgcggugccgggucccacggccacggacacgcugagcaggaagcacucugccgguucguagaggcgcccagcggccgccagcucgcgcgcguagcugcccaggggcgccgcguguguggccagcucacgcagcgauagguaggugggggauagcagcagccccuccaggccaaagcgcaggaaguugucggccgagccuggacuugggaagcccaggaagagcacgccgcggccgcgcgacaggaagccgacacgcgcgaugcgcgagaaagcgcggugcaccgggccgcugucgcggcaaaacugcaguacguggcggcacacgcugcccacgcggccguacacgcagcgcgccuugugggcgucccaguccucgcggcggcacaggcgcgagcaguaguagguguagcagcuguggcaggacuugaaguagaggcaggcguugaacauggucucggugcgccggcagcgcgcauuggagcaggucaucaggucguccucgucggcgcuggguucgggggacgcgucggccgccucucccggggccgcgggcuccucggcgcugccggccgaggcggggggcgagcguggcggcgccagcgcgggggccccggagcccgcgggccgcgaguccagcagucggcgcaguugggggcccaggcagucggccgcgggcucugaggccuggccggcggugggucgcgagucgaugaccagguccgugaugagcucguccagcugcucuaggcuccgcuggcggccagagguggggccgucgggggccgcguggggagguggccgcgugcggcccccgggcaacucccaggcccuggcgcucgggcgcucgguggcgcgcaggucauugucagugauggugaucucgggcgucacguaccaguugcggcccaggcccucgcccgcgcggcccuucuccgucagcgacgucucggacagggacagugcggcguagcgucugggagagguggacagguucacgacgacgggcgggcgccggccuucgggggacacgccucgcggcucccgcaccucgcgccccagcagguucucguagcugcggccgcggcccaacgggucuucucggcgcggccccggggccagaauguugucccaggagcgcgaguaguggcggcugucgguggccagccggggcggacuggugccggugccgccgugccaggaggcgagcaacgggucggggucagagggcggcaccacuugcagggugcgguacggucgcgggccccaguccgcccaggccgggcugcugcgcgggugcggguacguccgagccaggacgucacgcucgcgguaccuuccgaaguccuccguguaaaaggggcgggcgguggagugggcccggggcuccucggggacauagcggggcccguagggcaggccguaggcucguggagccuccccauaguaggagcgggagggcgguuccuggauugggaaggugcgcaccucuccugcguaguagccgcccaugcgccuuggacugggccccgagagcuccucggacggauagggccugggguaguaggcgucgaagguugggccgggacuggcugcaaagcugccccggaagccuuggggcuccucuguauagaagaacuggguggggcccggcgggguggugaagggcagacugcggcgcucggcguagucccggggcccaggcaggggcccgucgcaguagaacgcccggggauccgcacaguaugagucgcugggcgucggggugcgcgacagcgccauguggcggggcccgggcaccgugaggccguggaacugcggggcggggcgggcccagugcgcggccucggugggcccgcaggaccgcgagccccggguggcgugcuggagcacugcgucgucuggcuugauguccaggcggcagcgcacguggggggcgggacccgcggguggcucgggcggugcgcagcggcccgcggcggcgcacaggggcgcgacgcggccggggccgccccgcugcggcugcaacuugaugggaugcagcucguuggcaagggcgcggagcgccggguacgcgggcucccggcgcggcgaugccucggcccgcgccgcacgcugggccucccgcccucggcggggcaacaccggcggcgaggcgggcgcgggcgucaggcccgggggcgcgcggggcgcacucuuggagcgggcgcggcggcguggcucggcuucgcggguccgggcgcgcggcacagcggacuccggcggcgguggcuccggcagggucuccauggccggcccguccagcgccuccaggaagucgaagcugcggcaguggcgcuuguugaaaggcgcgggcucagcaggccgggccacggaucgcucacauggcgagcacuuggacgcgggucccggggucgccaccuugauguccugguacacggucgacaccagcagguccggaggguccguacgggucaucuuaaaagagguccccaggcuggcggcuccagcucacacugccuugcggggcuuuugcccuggggggagacgcgggucagggcggcccccuccgcagcccaggccccgcuacucccccacgcuggcccggcuuaccuggggcgcagcgggcggagcagcccuggcugcgggccugggccgagaacgcgggcgcuuccuccaugccggggucagaagcaccugcgggaggaacccagcuguccaggcgcccguccugcccguccccccguccucucccugcgauggggcgggcgggccagaaaggcuuagccgugguugugguucccgcggcgggagcucccgcgugaagcuccagggccuccccucccccgacuagugacggcggggucggcucggguggaccccuuuccgggugggguaggggagugggggcgugguccuggggcugcgcccucugguguccgcaguuggaaggacgggccgcauuugggccuuauuuauagguguugccccaggagacgucagugacugcgcccccgucacagcgcccacugcagagcgaccccuccgaucgcgcacaguggaaggcgagucccugggccucagccuuagccggcucugcaccaagugggugacaccaaccaccccaccugcuggccgggccgagcacagagccccgcccccagcacugcaaggacccacgccuaggugcccucaacuucccgcgagccccaggccagaaaaaugcccccagagagcauacccgggcccuaaaucucccuuuccucugccgacaccuuuucugaccccaaguaucuuugggugguugaaacaaggccccagcuuuguguaaacgcacaggacaccccccuaggguuugcaaggcagucccaagccaucgagccgcgagcucguggcagccccuccucugagcugcgcaccaggccuggaagcugcccgcugggggugggcagggcggagggugggggaagccccacugcuuugcaggagagggcccuccccauuucgcucagaagguuccauggaaaccugcauuucuuaggcccccacgcggcaggcuggccuggguucagaugugggcugccaaccccucugugaucccagagccagcuggggggugcgucagagaguggccacaggccuggccucugcacacccaacaccuggucuggggggucuaccccagagugagcuggggaaagcggguaccuggccaggccccuugcagggcagaaccucagguggaugggccucucggggucuggccggguccccccucugugucccaggugugcaggggcuuccugcuggcagggcuguuuuucugggucagggccacgagucccaggccuugugcccaucccagccucccccgcccacccccccaucuccccccuccaccccacccguggcaggacugucuacccuccugcucccucuuucaugcuaagcucaaggccaggccggaauccggccggaugacagggugugaggcuccaccccagggaggugacagucggccuugcuggcugcagcugucggugacacccccucccguggggauggggguggggucggcccucucccgggcccaaggccuucuggagcccacggagauggcuggcggccuuccccaccucccagcccugccuugccuugccuugcccuggcugggagcggcccuucaagggauacagccgguguugccugggggcggggacuccccauccuuucggcugcccuaaggcagcuucccccgcccaugacggugacacacucagcaacucggccccuagccccuuaccugggugcugcucuggcugugccccggugggcugugccacccccaggucggcuccucuguguccccggcacugcugcguccccggcacgggcagaagcuuccaggcagcagcgcggauccu

SEQ ID NO: 13094 - RNA, 3294 nt, Homo sapiens
aaggggagagguucgggacuguggcgcgcacugcgcgcugcgccagguuuccgcaccaagaccccuuuaacucaagacugccucccgcuuugugugccccgcuccagcagccucccgcgacgaugccccucaacguuagcuucaccaacaggaacuaugaccucgacuacgacucggugcagccguauuucuacugcgacgaggaggagaacuucuaccagcagcagcagcagagcgagcugcagcccccggcgcccagcgaggauaucuggaagaaauucgagcugcugcccaccccgccccuguccccuagccgccgcuccgggcucugcucgcccuccuacguugcggucacacccuucucccuucggggagacaacgacggcgguggcgggagcuucuccacggccgaccagcuggagauggugaccgagcugcugggaggagacauggugaaccagaguuucaucugcgacccggacgacgagaccuucaucaaaaacaucaucauccaggacuguauguggagcggcuucucggccgccgccaagcucgucucagagaagcuggccuccuaccaggcugcgcgcaaagacagcggcagcccgaaccccgcccgcggccacagcgucugcuccaccuccagcuuguaccugcaggaucugagcgccgccgccucagagugcaucgaccccucgguggucuuccccuacccucucaacgacagcagcucgcccaaguccugcgccucgcaagacuccagcgccuucucuccguccucggauucucugcucuccucgacggaguccuccccgcagggcagccccgagccccuggugcuccaugaggagacaccgcccaccaccagcagcgacucugguaagcgaagcccgcccaggccugucaaaagugggcggcuggauaccuuucccauuuucauuggcagcuuauuuaacgggccacucuuauuaggaaggagagauagcagaucuggagagauuugggagcucaucaccucugaaaccuugggcuuuagcguuuccucccaucccuuccccuuagacugcccauguuugcagccccccuccccguuugucucccaccccucaggaauuucauuuagguuuuuaaaccuucuggcuuaucuuacaacucaauccacuucuucuuaccucccguuaacauuuuaauugcccuggggcgggguggcagggaguguaugaaugaggauaagagaggauugaucucugagagugaaugaauugcuucccucuuaacuuccgagaaguggugggauuuaaugaacuaucuacaaaaaugaggggcuguguuuagaggcuaggcagggccugccugagugcgggagccagugaacugccucaagagugggugggcugaggagcugggaucuucucagccuauuuugaacacugaaaagcaaauccuugccaaaguuggacuuuuuuuuuucuuuuauuccuucccccgcccucuuggacuuuuggcaaaacugcaauuuuuuuuuuuuuauuuuucauuuccaguaaaauagggaguugcuaaagucauaccaagcaauuugcagcuaucauuugcaacaccugaaguguucuugguaaagucccucaaaaauaggaggugcuugggaaugugcuuugcuuuggguguguccaaagccucauuaagucuuagguaagaauuggcaucaauguccuauccugggaaguugcacuuuucuuguccaugccauaacccagcugucuuucccuuuaugagacucuuaccuucauggugagaggaguaaggguggcuggcuagauugguucuuuuuuuuuuuuuuuccuuuuuuaagacggagucucacucugucacuaggcuggagugcaguggcgcaaucaaccuccaacccccugguucaagagauucuccugccucagccucccaaguagcugggacuacaggugcacaccaccaugccaggcuaauuuuuguaauuuuaguagagaugggguuucaucguguuggccaggauggucucuccugaccucacgauccgcccaccucggccucccaaagugcugggauuacaggugugagccagggcaccaggcuuagauguggcucuuuggggagauaauuuuguccagagaccuuucuaacguauucaugccuuguauuuguacagcauuaaucugguaauugauuauuuuaauguaaccuugcuaaaggagugauuucuauuuccuuucuuaaagaggaggaacaagaagaugaggaagaaaucgauguuguuucuguggaaaagaggcaggcuccuggcaaaaggucagagucuggaucaccuucugcuggaggccacagcaaaccuccucacagcccacugguccucaagaggugccacgucuccacacaucagcacaacuacgcagcgccucccuccacucggaaggacuauccugcugccaagagggucaaguuggacagugucagaguccugagacagaucagcaacaaccgaaaaugcaccagccccagguccucggacaccgaggagaaugucaagaggcgaacacacaacgucuuggagcgccagaggaggaacgagcuaaaacggagcuuuuuugcccugcgugaccagaucccggaguuggaaaacaaugaaaaggcccccaagguaguuauccuuaaaaaagccacagcauacauccuguccguccaagcagaggagcaaaagcucauuucugaagaggacuuguugcggaaacgacgagaacaguugaaacacaaacuugaacagcuacggaacucuugugcguaaggaaaaguaaggaaaacgauuccuucuaacagaaauguccugagcaaucaccuaugaacuuguuucaaaugcaugaucaaaugcaaccucacaaccuuggcugagucuugagacugaaagauuuagccauaauguaaacugccucaaauuggacuuugggcauaaaagaacuuuuuuaugcuuaccaucuuuuuuuuuucuuuaacagauuuguauuuaagaauuguuuuuaaaaaauuuuaagauuuacacaauguuucucuguaaauauugccauuaaauguaaauaacuuuaauaaaacguuuauagcaguuacacagaauuucaauccuaguauauaguaccuaguauuauagguacuauaaacccuaauuuuuuuuauuuaaguacauuuugcuuuuuaaaguugauuuuuuucuauuguuuuuagaaaaaauaaaauaacuggcaaauauaucauugagccaaaucuuaa

SEQ ID NO: 13095 - RNA, 3294 nt, Homo sapiens
uuaagauuuggcucaaugauauauuugccaguuauuuuauuuuuucuaaaaacaauagaaaaaaaucaacuuuaaaaagcaaaauguacuuaaauaaaaaaaauuaggguuuauaguaccuauaauacuagguacuauauacuaggauugaaauucuguguaacugcuauaaacguuuuauuaaaguuauuuacauuuaauggcaauauuuacagagaaacauuguguaaaucuuaaaauuuuuuaaaaacaauucuuaaauacaaaucuguuaaagaaaaaaaaaagaugguaagcauaaaaaaguucuuuuaugcccaaaguccaauuugaggcaguuuacauuauggcuaaaucuuucagucucaagacucagccaagguugugagguugcauuugaucaugcauuugaaacaaguucauaggugauugcucaggacauuucuguuagaaggaaucguuuuccuuacuuuuccuuacgcacaagaguuccguagcuguucaaguuuguguuucaacuguucucgucguuuccgcaacaaguccucuucagaaaugagcuuuugcuccucugcuuggacggacaggauguaugcuguggcuuuuuuaaggauaacuaccuugggggccuuuucauuguuuuccaacuccgggaucuggucacgcagggcaaaaaagcuccguuuuagcucguuccuccucuggcgcuccaagacguuguguguucgccucuugacauucuccucgguguccgaggaccuggggcuggugcauuuucgguuguugcugaucugucucaggacucugacacuguccaacuugacccucuuggcagcaggauaguccuuccgaguggagggaggcgcugcguaguugugcugauguguggagacguggcaccucuugaggaccagugggcugugaggagguuugcuguggccuccagcagaaggugauccagacucugaccuuuugccaggagccugccucuuuuccacagaaacaacaucgauuucuuccucaucuucuuguuccuccucuuuaagaaaggaaauagaaaucacuccuuuagcaagguuacauuaaaauaaucaauuaccagauuaaugcuguacaaauacaaggcaugaauacguuagaaaggucucuggacaaaauuaucuccccaaagagccacaucuaagccuggugcccuggcucacaccuguaaucccagcacuuugggaggccgaggugggcggaucgugaggucaggagagaccauccuggccaacacgaugaaaccccaucucuacuaaaauuacaaaaauuagccuggcaugguggugugcaccuguagucccagcuacuugggaggcugaggcaggagaaucucuugaaccaggggguuggagguugauugcgccacugcacuccagccuagugacagagugagacuccgucuuaaaaaaggaaaaaaaaaaaaaaagaaccaaucuagccagccacccuuacuccucucaccaugaagguaagagucucauaaagggaaagacagcuggguuauggcauggacaagaaaagugcaacuucccaggauaggacauugaugccaauucuuaccuaagacuuaaugaggcuuuggacacacccaaagcaaagcacauucccaagcaccuccuauuuuugagggacuuuaccaagaacacuucagguguugcaaaugauagcugcaaauugcuugguaugacuuuagcaacucccuauuuuacuggaaaugaaaaauaaaaaaaaaaaaauugcaguuuugccaaaaguccaagagggcgggggaaggaauaaaagaaaaaaaaaaguccaacuuuggcaaggauuugcuuuucaguguucaaaauaggcugagaagaucccagcuccucagcccacccacucuugaggcaguucacuggcucccgcacucaggcaggcccugccuagccucuaaacacagccccucauuuuuguagauaguucauuaaaucccaccacuucucggaaguuaagagggaagcaauucauucacucucagagaucaauccucucuuauccucauucauacacucccugccaccccgccccagggcaauuaaaauguuaacgggagguaagaagaaguggauugaguuguaagauaagccagaagguuuaaaaaccuaaaugaaauuccugaggggugggagacaaacggggaggggggcugcaaacaugggcagucuaaggggaagggaugggaggaaacgcuaaagcccaagguuucagaggugaugagcucccaaaucucuccagaucugcuaucucuccuuccuaauaagaguggcccguuaaauaagcugccaaugaaaaugggaaagguauccagccgcccacuuuugacaggccugggcgggcuucgcuuaccagagucgcugcugguggugggcggugucuccucauggagcaccaggggcucggggcugcccugcggggaggacuccgucgaggagagcagagaauccgaggacggagagaaggcgcuggagucuugcgaggcgcaggacuugggcgagcugcugucguugagaggguaggggaagaccaccgaggggucgaugcacucugaggcggcggcgcucagauccugcagguacaagcuggagguggagcagacgcuguggccgcgggcgggguucgggcugccgcugucuuugcgcgcagccugguaggaggccagcuucucugagacgagcuuggcggcggccgagaagccgcuccacauacaguccuggaugaugauguuuuugaugaaggucucgucguccgggucgcagaugaaacucugguucaccaugucuccucccagcagcucggucaccaucuccagcuggucggccguggagaagcucccgccaccgccgucguugucuccccgaagggagaagggugugaccgcaacguaggagggcgagcagagcccggagcggcggcuaggggacaggggcggggugggcagcagcucgaauuucuuccagauauccucgcugggcgccgggggcugcagcucgcucugcugcugcugcugguagaaguucuccuccucgucgcaguagaaauacggcugcaccgagucguagucgaggucauaguuccuguuggugaagcuaacguugaggggcaucgucgcgggaggcugcuggagcggggcacacaaagcgggaggcagucuugaguuaaaggggucuuggugcggaaaccuggcgcagcgcgcagugcgcgccacagucccgaaccucuccccuu

SEQ ID NO: 13096 - RNA, 3175 nt, Homo sapiens
ccuggagccugugaagggcaucugaugggaaagggucuuugcaggugugaaguugaggucuugacgggagaucauucugcaugaagaugggcccgaaauccaaugacaaguguccuuagaagagacagaagaggagacacagacagaggcagaggcuggagugacagccacaagccagggaugccuggagcccccagcagccggaagaggcaggaaggacccuucccgggagcugguggagggagcacagcccugcggaccucggguuucagaccucgggcuccaggcugugagaaaguaaauccugguuguccuagucacccgcauauggugacaucagccccuggagacucacacagggccccaucucacuuccugcucagaccuuaccacccuggaaggccccaucacugccccgacuccaggaugcuuuucacagcaucuuucaccaaagcaccuuguguucgguucccagaccagggggagggaugggcaccuccuggggugggaccccgcagccucugacguuggccccaagcucuccccauccagcccccugcccgucccgagucgcagcucacgcaugggaggccugggcgggcuccuguaaugcuuggaguagcagggaucuggaaggacagagggggcucucagcgcagggacagggaccccgcaggcacaccucccauccccacccugucccggcucccgcuugguccgggagcaguggggcugaccuuuguuggucaagucgaugauauuuugugagccaaguccguacuuuucgcagguuucuucaaaucugcucaggaaggaggguuccagcuaugggacccgugcugggaacagaguugguucugugugaagcugggccuugcugggggugcucaggaagugcugaggcugggcagggggucacgcccugaccagagaggggcuuugugccaagugagaugggaggugacagauugaagcacccagcacccuaacggugugucugugggaaggaauagccaacgggaaccaccucuccaaaccccagggccacugcgagacccuccuccgcccaggguugggccggacuucagaggaggugggguccccgagggggucagagggggacagcggagguaccauagagcgccagcgugugggucucggucccguuccugaaguucuggagguggaaggugaugaacagccuguagucagucuccgagacggccacuguguucuggcccucaucugcguggagacauggcucagcguggccuggccccgccacccucaggguccugugacacgugcuguguggccgcaagugaggauggggggucaaguggccuuuugaggcgggaggggaggagcccacggugcucacccagcggagaccccugcacagggggcgggcagcagcggcacagcccccucccuccuugucauuggcuugcagacccugguggccccucagugggcucaccccccagagcucagcaugacacaccugccucccugcuuccccugggccaggagccccccuggguaggugccaggaugggucccuccaguucagggucaagcugucaggggcuuaacuaaaauccccagagucagugcucaccagaauauggcccaggcccuggagaaaggagacccccgacugugagaccaggaggagccuggcuuccacuuacaguugauggaguauuccccauucuucucugucuucucgcagaccacgaccacagccacacacucccccugcacccuggaagccagccaggaagaugccgggaguggagcuccagcccccuggacgugcgauggcagagagcaccccuccuccagggcacaggcucacccucccaaugcccaggccucauuccacagccccaaguucuugggcugggcccugcugcagcccaccggacacccucaucuccucgaaccucaccccagccuuggaagggggcgauuucaucucuauguuucagggaagagcacagugccaggcagaccaagucccugcucccaccucacccugcccccaagggucacacgcacaggcucaggcucucaccagagugcaagucagugagugugcgagcgugugugugcaagagugagaguaugcguugggguggcaggggcaugggucuuccugaugccagcugagaugggcaacacgcacauguauucgaaaucaaauauuaggcugccguucuucaaguguucaauauuccggacgaagacccucaggucuccauuuucuuuaauccgauucaggucaucugaggccaugaaaauagaauaccagaccccugaaaccugaagacaaagagcuccaguggguggggggccgcgggacagcccuggggaugcuuagcgcccacagucuucccucccagggcccggccccuuagcaucuggcucccaaccagaaccccuccgcccuuccagugcccccaggucuccccucgucaccagauccccccuuuacccccaaggucgccccucugcucacagaaugcccuccgcccuuccagggcccccgcugccccccaggucuccccuauguccccagauccccccuuugaucccaagguccccccucugcucacagaaugcccucugcccuuccagggcccccucugccccacaggucucuccucugccccuccaggucccccucuguccucucaaggucccccgcuccacccuuucccacugagucccccucuuuucccuaggucuccccuauacuucuaggaaccccucuguccucuuagggcccccaucucccugcuggccgccacuccacucuccagcuuuccccucugcccucccagggcccccucuaaccucucagggccccagucacucucccaggccucucccacccgacccucccggaguaaccccugcucucccaggcugcugucacagcuuggggaggagaggugggcuccccuuggaccaguugcccuggucacaggucagagaccccaggcugggggaagacaggugccuugaagccuggccccuuccccacagaccccaacgcagacacacccuggccacguuguaguuccucugcauaacgguguggggaucgaacuccugggcugcgaugaggcucagccccaggcucagcagaagcagagccaucuuugcc

SEQ ID NO: 13097 - RNA, 4314 nt, Homo sapiens
uccaucaacacauuaaaaaaauagguuuaaugcaggugggucauggcaugacgaauuucacaggcaccggggacagcaggcggccaggugcucagagggcaccaaggugccacaacucccugcagcguugacaccgcacgagcggcaccaccagcccccucccgccucccgucccaccuucacccucagccaagaggcuugggugacucugaguaauacguuaacaaaaaacaaagcuucuuugaggaaacagcaugacuuagugcaaaagauucucugcagcaagaaaugaggcccacgcagggaagcucccgccuaccugcccagggcguggacgcagcccgggcucaucagaggucauccacagaagcugccgauaaauuagagagcacgguuuacggccagagauuuuuugcuuucucuaccugauuuaggguuuuucaaaaaguuucucuuccaguggcacacaacuguccucauggcuccugggccacugguccgccugacaggguagggucacaagucccacccaugcccagaguguggggacauggauuugaggugacacuaggguugucaguaccacacccuguguccugcucuaggguagccucugccuguuguccuugcaaucauuauucagggcgcccucccacuugcccccaaagucacacggccaugggcaguccaccauagugcugccgugacugcaaggcugaggagcagagcaagggguccugggugagaccucggcccaugguggccacccucccugaacacaggcaucugcgccccuccagcccaccugccccugugccaucauuugggccccccagacacuggaggacagcgugagauaagaucucagcauauaccuggggcucuaagaugcugcuggugccacacaggcucuggggcuguguuugccgcacugaggccucugccgccugcuccggacacuugggacacgcguuuccauccuggcucacugaagccucgaucucccaggcuuucuuugacgguguucccucaaagaaagaggcccaaagcccucccccgcaaaaaaagccagaaaggaauggaggugccuccgcagaaauccagagcaucugcaagacauccucacagcccucccagaacaggcagacaggccaguguugcuggagucagccccuggcucccaggguuccccccaggccagccccugagcugggagccugcugaggccccucccaccugagcccuucuccggccccccgcuagacugcaucuacacaauccaaggggacccugaaggcuggcuggggacucaggacccacacagccccucaggaugacacacacagggugguccgcgggcagugccaggccucaggcggcccagggcagaguaagcagcuuuguggcaguguggugugucagcgaggggagccuuccgugucccguuggcuggggcuggggccagggcacgcagaaggggcugugcagccaggagggccccccuccggaauugcuccugggcacacagcccucuguguccaggggccucccagggugaugucuaaagucccuggcagcugugguccuggagagaggcccacagagaggcggaacggagggcccaccccgcaguacgacccgaagacaugugagcaggagccaccggcaggugggcgcugccccugagagugcauacggggaggguggguccaggaagccagccuaggggugguguccgcgcccccaucacagaagucucagcccuuucuuuucucuccgugggcgccgggcagcagcgacugccugggggaugggcgaagggaaggcgcuggccgaccccacccauggagagaacacagccacaggccgggacgauacaucaagcucgcacccacggcccucacauguccacgaagaccaugaagcaccagcccaggcccccgaccagcagcauggugacguggaugccauagacgagcagcucguucaccaggcggaaguccacgcgccggcggcccagcagcagcagcagcaccgacagcuugcgcuggaagcgcagcaggacgcgaacgcccagguacuguaggcagaagagggcggccagcgcaccccagagcgccgcagugaacaggcugcagcuaaaguagaguaggaagcggaugaagccguacagccagcgcgucuugauguacacgucgaaguuguuguacuuggugcgggccaggugggaggcgcgcacgggcccgcaggccgcaugcaggcagguggugugcgggccguggaaggagcgcacccgccgcggaaugggcaugaccggcauugggccccggcggcggcggcgcuaggucgcaguggcggcggcgguguccaggcggcuguuggcguaggggucaugggcgccuaggccugggagcccgcagcugacccuggggggaggcgucggccugcggggagagccgcaaaacccacgucaguaugaggacaccaugcggaucccuccccaggcaaucagcuggcgaaaguggacacaaacuccagcaccaggacuacgggaaaauggaguccagggcgggaucugcaggcacuccugggcucuuuuccacaaacccucccaaggauacuuccaaggggcccaccaccuggggaagccaaagugcuuguucuagggcagcacuggggaaagggggccuuggggacaguggccaggggaggcccccggaaguggucaaugccaaaacggaugggaaggggcaagaguggcucuuuccugcaggauccucgcagcuccccacuagcuggaccacacucugcucuuaggcaguuugcccguuacugcccuggucuucugcggcugccugacccagggcugaugcaagcccuuaaauggcaucugcaagaagccaccacagggccgggaaaagggacuccagggcucgcaggugaaccgaaaacgagcccggcgggagcaggugacuccagcaaccugcugggugccagauggacggcucgggggccguggggucaccuugcugggccugaacccuggcacuguccuucccuagcagugacuuugggcaggucaccugaccccaagacggcuccugcucuguccaaugggggugccaauagcacugccuuuguggguagcugugggagggaaggggcugggccuggcgugcacaguggggucggcccggggccuggcagcggcccuuacagacugggcugcaaagagcagaggcggcauuuggcucuccagcuucaccuaguaaaggccguuuauaccuugccgaaauaaucuguagacggaaugaacucaaaggucaggaaauaaaaucugagcaggaaaguugguaacauuacaggggacuguugccaagagcuucgccugccuucagauucagccuggggcccugccguggggaccuggccagggcggaggagggaggggccggggccgccugacccucccgugcccgcaggggcccgaccucgcccucucccuccgcccggcuccuccacggggugcaggggccagagcggcccuauuuaaggccggccuuggccuggagcucgccccggccgggaccccggccauggcggugccacucaaacgcgacucggcggagcuguguccccgcagggucucgcggcccgcggcuccauccgggucccugcguuucugcagacgcccgcucggcccggcccauggacccaggacuguuuccucggggccgcagagacgcaacgggccccggccaacuccgcgugagcaccgggccugcgccgcgccgcgccgggcccccuggcugcagagccccugccggagccacuuccgggucccgcgccgcgcguugcccuggagacggcccccgccuaggccggguccccgaccgcagcucacccggugcccucuccgcggcggcgccggcgucccggaccucggggccggccggcggugcuaggggccgggccugcgggugccccugucccucggggcuccgugcgcagggcggccgcauggugcuggggcgcgcggcugggggcgcuggcaaggcggcugagggcgugguucacgcgucgccggcuggggucgcccugcaggugaaggggcucucgggcgcggccgccggaggcguuuggccuagcgugggagccguagcgccgucccucgacggccaccguagggcggccucacgcccccuccacccgcgccgaccgagccgcacuucccuucccccugcuccgggcccgcgcugggcgucccggacucgucgcuucccgagggcgugcgugcgugcgugcgugcgcacg

SEQ ID NO: 13098 - RNA, 1209 nt, Homo sapiens
gacgcgaacgcccagguacuguaggcagaagagggcggccagcgcaccccagagcgccgcagugaacaggcugcagcuaaaguagaguaggaagcggaugaagccguacagccagcgcgucuugauguacacgucgaaguuguuguacuuggugcgggccaggugggaggcgcgcacgggcccgcaggccgcaugcaggcagguggugugcgggccguggaaggagcgcacccgccgcggaaugggcaugaccggcauugggccccggcggcggcggcgcuaggucgcaguggcggcggcgguguccaggcggcuguuggcguaggggucaugggcgccuaggccugggagcccgcagcugacccuggggggaggcgucggccugcggggagagccgcaaaacccacgucaguaugaggacaccaugcggaucccuccccaggcaaucagcuggcgaaaguggacacaaacuccagcaccaggacuacgggaaaauggaguccagggcgggaucugcaggcacuccugggcucuuuuccacaaacccucccaaggauacuuccaaggggcccaccaccuggggaagccaaagugcuuguucuagggcagcacuggggaaagggggccuuggggacaguggccaggggaggcccccggaaguggucaaugccaaaacggaugggaaggggcaagaguggcucuuuccugcaggauccucgcagcuccccacuagcuggaccacacucugcucuuaggcaguuugcccguuacugcccuggucuucugcggcugccugacccagggcugaugcaagcccuuaaauggcaucugcaagaagccaccacagggccgggaaaagggacuccagggcucgcaggugaaccgaaaacgagcccggcgggagcaggugacuccagcaaccugcugggugccagauggacggcucgggggccguggggucaccuugcugggccugaacccuggcacuguccuucccuagcagugacuuugggcaggucaccugaccccaagacggcuccugcucuguccaaugggggugccaauagcacugccuuuguggguagcugugggagggaaggggcugggccuggcgugcacaguggggucggcccggggccuggcagcggcccuuacagacugggcugcaaagagcagaggcggcauuuggcucuccagcuucaccuagua

SEQ ID NO: 13099 - RNA, 4322 nt, Homo sapiens
ccaagaacgccgcuuccgcccggcgcccacuuccaagauggcggcggggcggggccggggcagggcggacggagccggcgagcgggaugcugcggacugcgcugcgcggcgcgccgagguugcugagucgcgugcagccccgggcgcccugccugaggcggcuguggggccgcggggcccguccagaggucgcggggaggcggcgggccugggccuggggcuggcggcgcucaagcuccgagcaggggccggggcccgcggcggcucuggggcgcguggaggcggcgcacuaccagcucgucuacaccugcaagguaggcgcgcggcgggacggaaccggggacagacccguaucugacgcuacacggccugcggggagaagcggcccgccggggauccgggaggcggcguggucaagucacaggaaggaguggagccaccccuuggggcuucugggagggagcggaggcggaccaugaggagggguggagccgucccuggggcggggccuucccgggagagggcgagguuggggguggguggagcuaucccucgggggcggggccuucucuggagagggugagguggcuggagcuaccccuagaggggcgggucuucccgggaggggcguggcggcccucacagccucaccagcuacccugucccagccaggucugcgggacuagguccuccaagcgcaucuccaagcuggccuaucaccaaggcguggucauugugaccugccccggcugccagaaccaccauaucaucgcugacaaccugggcugguucucggaccugaaugggaagaggugaggccuguaccccagggcugggccagaaggccacccagaaguacccuggccucccugggggaaccuugcccuaguguugagguuuauagaucucaccugggaaauccagccaccuuaucaauacaagacacacaguuaaaugagaauuuccuauaaagcccagauagcuuuugaguuuaaguaugccccaaguagggggugcguuuuuauuuguuaaauuuugccagcccuguggcccugccucccugccucugccugcccucugccaucacuggcagccuugucccucucuagcguggaacuuuuuugcccucugccaucuugggguggcuggcccacagcaaggcuugggguguggaccaggagguguggccugggcccuggcugcugggagagcaguggagguggugccgggagccugguccgggccuugccuggccgggagguccugggcaggacaguaacagcgacagcaggucugagaccagcaugccaggugcuuggugguaccuggcccuuggagcugggacuguccucccaucagacccggggcugcagauucuucccucuggcacauagggggcaggagcaggagacuggguuccugaggcggcgcauaccggcagagacacagggcuggugagggcacacaggccagcgucugaagugcccguguggccugaugccacaggagugcugggccuggugcuugcagcucuggccuggccauggggcgcccugaggggacugaagugcagggcggcuggggggcccugaagagccauguugccucccugccccccagaaauaucgaagagauccugacggccagaggcgagcaggugcaccguguggcgggcgagggggcccuggaacugguucuggaggcugcaggggcccccacauccacugcagcuccggaagcgggugaggaugaggguccccccagcccuggcaagacggagccgagcugacuccugcgcuccccggcacugugggacuucggccuuccagaaggagguuuuggcccugggccucucuggacguggccuguuuucuaucaauaaacagacauuacuuccagaugcuggggccuguggcccucguggccuuucuuuuucuggaguuagaacgauugcucugaaucccuggugcugcugggugggacauaggagccgcaggaccucucgccucaccacaguuccuucuacacagagucacccagcucuugcccacagaggccacagucgcguggaaagggggcuggauguggcgucagagcccuuccuggcugucgcugcgugacuuugagcaggucaccaccccugugagccucagccuuccucugcaaggcccuugccgccccccuggccagcucuggcggccucccuuccgugagccagugcagaccugagcccugguccucggccgccggccgucggcgaaacagugagcaaaccaggcugccugcuggcccaggcaggacgagcagcuauggcguggccguguguuaggagcuccagaccccucccgggggagccaccugggccuccuucccucgguggacagcgcucuggacguccccagggcccuccgaggugugugggguuugucucccagccuugucugugcgcaggauguucccguguuuaugaaagcgagcaaacacagcagccuguuuauuugcagaagcguucugggcagcguaaccuucagcauucaucacccgccacacuccggcagggaagagaauggggcgaggugggagguggaggcaggacugagcacgacagggacccagugcggccccucccagcgggacacggccaggacugccagcucacauccggcccgugggaggccggggcgcggcggcaucguucccagugugcuuguggcgugggcuuugccucgauuacccccuguccuucuuucagccaacaacccucuauuauucccacccagagccuucugugccauuuguggaaacuguccucuucucggcugagccaccggcacccaggccugcuccuccauggaggcacuggcugggggucucuugggggcuuggaagugcaguggggcugggcuuggcuuggcugccucacugccuccagagggccuggaccagcauguggggagguccagggagccgucuggaccuggaagugcagaauuagagcaaggagagccgcuugggccaaccccuccucuuacggauggggagauggcggcugguaguugggauguggacguuaccaugucuuuucugucugaugccagcaccucugggcccaggcuggcccuggagggaaauccuucccaaggcuggcacguuccuagagaagaccuauggcuaccccccgcgugccagaagcaucccgccagcuccugccugaggcccccuggacccugucucccuccgcccuucccuccccgcagccccaaucccacagccagguuucugcaaggggcuuugccauccuaaucuccugccacucuacacccccccgccccaggacaucccugccucccgggcacgguugcuggccugggcaucccucgucacagcgucucuccaagcagguuccucggccgcaccuucagaggcugucccagccaguagcgugggcggcacugcugcgcuucccuggcugugcgcgguccugggcccugcacgguuacuuggacccugugugcguguaccaccacacgcaagcuggcugggacccuggaccuggaguacacguugauucugguucccaaggccccuucugggguggaggaggcaacggagucaaccagcacagaggcuguggcugccaacauggccaggugggcuguggcgaggggcagcaggacugcccggcgcaccuguguguccccugacgggggccccgugggggugccacccaccacaagcagcgcccagacaagccccaagacugcagaucugccgucggcuccuccacuguggcucaguguccagacccugagcccagccggaucagacuccaggaaaggaccucccucccccgggugcugggugggcggcagcaggcuggguccucagggggucguggggcugaccugggggcugcugcuucugggggcuggucccggccacgugagugucagcucagagcaugcucuguuucccuaggggcugggagcgugaggagguaggggugcaggaaucaguggugacagcaggcagccacuucaccccucugugccccagcucccccgugguuaaaugcagugggaacuccaucucucugaggucucagagggcccagacaguggguaucuguggacacuuugcacagugcagccucuuaccggguuaggcccccacccgggacuaagcccauacggaccacacucacuuggccgacuuuauuuuucaggaaaaacagaaaaacaaauguaccucuuggguuggaaaggacccauugacaacauggcacagacgugagcaauaaauacgcacauacauucaaguau

SEQ ID NO: 13100 - RNA, 24650 nt, Homo sapiens
cuuccggcgcgcggcgcucuuguucugcagccgccggaagcgucgagucugcagucgcccgggcgacggcgggguccgcgcggccagguaaggugugcgcccagcaggugaggcgcggguggcgucggcagcuucagggcucuccccguggagggggcgcugucccgaggagcggauagccgaggcccgggacgggggcggggcagcgcccaaagucggggaaacugaggcccggcguggcccccguccggccgagccugggcgcgcggggauucuggcccugggagccccucggcugggagcgggcugcgggcuccgaggaggcuccggcggggcggccccggcugcagggcgcccgcgugcgucucggggacugcgccggcgauuccgcgguggccgagccucggaggggguuuccccaguucacgcagcgagcaggaggcggaacugggccugggccgggucugucucccaagccagugccuaaacgcccaucguccuggcgcauccugggguucccugggcccagccgagucuggguggcguccccgcagcuggggcuggagggaccgccugcugcgcuccgucuuggugggcagcccucaugaccagcccuugggagaggggugcggggagagggacagccccugaugucaguggcucagcacgugugacuuugaccuccuuccugcugaucauugcucaccugagcgacacggggagggggaggcagcagccucgugugaggcuuccagaggaaagcgucuccgccggcccggaggcgcugaaccagccugcggucgcugccagcucugccucuggccggcuguuaacugaguuuacagguucacaagcauuucgggcauaaacaaggggcuuugugaaggagugaggggaccugggcugcugaugcggcuaacggugcucgcggguggaugcuuugguuuuguuccaguugggcagggccccagucagccuccagcagggagagccacgccaaggacgggggagggcguuucucuuuguuguuggguguuuugggcucccgggucugugcuagugauuccuuuagauuuucucugcuaauguuucauucucccacucucucucuagcguccuucucccuucagacuuccuggaccacaguuccuaagaaaaaagcuugacaaacauuuguuagugucaggcacugccacguuccaggcguuguucuggauguacagagaacagccagccuucccuuugggagcuuccuucccaaccaugcuguuagugccugccaccugggcagucucagugugugucucugugaacguuucucaaaugcccucugugguccggcucugugucaugggagagcaggauggccaaagugggucacgggcuguguccuugcccuguagugacuuugccacugcaccccacaccuucuacgcuggguggccaguuuccauguggcuuggugugggagcagagacgggacaguggggccuguccuuguucauccacucccugccugugcugguugcagccucagagcaggcgggagauguucuuggggcuuaggcuccuggcagagcacauagcaggaguuuguggggucugagguuccugucccaggguuccccgauucugugccuggccuauuaaucuuucucuggggagcccagugcccacugccgagcaggcuccugccaucccccaugggcgggugugucugaaggagaaugggaucccggcacggucuugguuucuaacaucucgggguguguuuuggaggcaggcgggagucauggauguagaugcugaaagagagaagauaacacaggagaucaaggagcuggaaaggauuuuggaucccggcuccucgggcucccacguggagaucucagaaucaagucucgagucagauucugaagcagguaagccccuuguaccuagccuccugggguccugguaagaacagcuggucugccuccuggguuccucucaggcacauuagggagugaugguagccgggugugguuucucaggccuguaaacccagggacuccugaggcugaggugagagcauuguuugaucccaggaguucauguccagccuggacaacgcagcaagacccugucucuaaaaauaauaauaauaauaauaaacgauggcuggugcugcuuggaccagacccaauuuuuugccaacacuggugucuuucuguacuccagccagagagcuucugacaauuccuccuuugcuagccccugaaccagcuggcuguguguguacacugggcucuaggcaucccagggucugggccuggccuccuugggccugugcagggcuucuggaguggaccauccugggaggagggggcaggccugaaccucaccagauggcagucuggacaguccaugccuggauggucaacacagcucacaccccuaggaucucuucuucucacaugugccccuccccacgugcuccccaccccaagugcucuccuccccacgugcuccccaccccacgugcuccccaccccacgugcuccccuccccacgugcuccccuccccacgugcuccccuccccacgugcuccccaccccacgugcuccccuccccaugugcuccccaccccauaggcuccccaccccacagccucuccucccaacaugcuccccuccccacaugcucuccuccaugcucccuuuagcuucugagccuaccccaaccccaccagcugcugcccugacaggagacccccccagccuugcuucccaccucucccagacccagggccugccucugaggcaaccugcuaucuuucuccuguggugagggccucuacauccgugccucccaucugaccggcuaagcuccugaaggagagguccguuuucugcuaaacuuucccugucucuccaguaaagauagcuugugccauccagugaacccuguguagcuuuguccugugugccuggagguccccaguguguggucagaguuuucucuaucuggcuaacccggccuugguccagugcccaccccgcugucagggagggaagguccgcucaccgccagccucagccugaggcgcugucacuaccucacaaccccaggucugcccaagaagcaguggugagcugcgcccccacccugcccaagacgcugguuaccaacacgguguugcuuguguuucugacagauucacugccuucugaggacuuggauccugccgaucccccgaucucgguaacuguuggccugaucuggcugugccacugggucaggccugccaccaccuuccaaaguagccugggagggggcgugguuugaacccauauugguuuuucugcauuauaaaaaugauucacguuuguuauaaaaaaauuaaaaagcauuugucauugaaauuguccccagaaauaaccacuguuaacagcuuggugaucacaccccuuggguuuuuucugagcucauugcuguaugccucugucuccuguguggcaucugucacuugcggaaagcugugaguugugcaccugcguccugccccucacagcucgccucucugugccucagauuccuguggggcagcggggacguuuacagcacaagucaguuaacacgagcagcuauacagaaauuagcuggugcaguggcacguggcuguggacgcagcuacuuggguggcugaggcaggaggaucacuugagcccaggaggccgaggcuccagugagcugugauugcaccacugcacuccagccugggugauggagugagacccugucucaaaaaaaagaaaaauacacaagcacccaaacagcaccuggcaacugcucugugaggccagugauuauuuuauuagcugccuuuuguuuacuuuggaaaacguuggcgauuugcugcuuccuuuuucugcaaaguuaguggguacugaguuuccucauguuugcguggcugugugguucaccuucugugagugagcacccugcuguagccugugggcaccucaccucccagugggcauuuucacugcguccacuuccuggcucugcagagacuuuccucccacacaggcuugcuccccgugcuuugcuggugaugcacacgacaggggcucaggacagaguucaggguucacaggacgccugugguccuggaaagcugccugcugccuugcagcagccgcagcccuggcguguuccagguuggaggcucugccugccguggauuaggaaaggcgcacacaggccgccuugagagugacaggcuccacucccaaacucagacgcccucccgcugcccaccagggucacuuccugcuuccacauuggguguugcuaugccagagcugccucggugucccagaggcccagcgaugggcgacuggcugccgaggacaggggagcauccacgucucaucucgucacaugccauuucuggcucguuaccaggaagaagaaagguggggcgaagccagcaaugacgaggacgaucccaaggauaaaacccucccugaagacccagaaaccugccugcagcugaacauggucuaccaggaggucauccaggagaagcuggcugaggccaaccugcugcuggcccagaaccgggagcagcaggugggaugggccucggccccccggugcccacaccuccccacccccagagccccccacagcugggccucccagguccagggcuccccagcucccugccucuccucugccccgggucuccuccgcagggagagucauugcugcugguccauagaggggucccugccuugugucugucacaggaggaacucaugagggaucuggcuggguccaaaggcaccaaggugaaagauggcaaaagccugcccccaagcacauacauggggcacuucaugaagccguauuucaaggacaaggucacgggcguggugaguggccgaggcccugcucuugucggcaaggcucugcaccgugggaaggguucuuguccccaaguccugcugcagggagucgugaauuccugugaguucaagauaacauuggccaaccuccuucaaacugccuccuccguggugggcaagcugcccucugcucugcgcugggcugccaggacugcccugugaagcgaugagcaagcccucguggaggugccaguguugucugugcgaggccugaccucaucaggcuucauggaguggccggcaggguugcacccccacagccucacaguacgggagaacaggaggcagggggagcccgaguccuuuugugggcucuggagggaugugcugggccugcagggagcacauguggccugugcuuguggugaugccgugcacccugacaggggccaccugccaacgaggacacacgagagaaggcugcccaggggaucaaggcuuucgaggagcuccuugugaccaaauguaagagcccuggccggcccugcggcaccccugagcuugggacaccuccccauggcccuccuuuccccaguuucuccccaaguucucagaccucucucuguugugaccucauggcuccuucaggccuugaccacugggacuggccccuugacuccugccuuuccacacugagcagguccuuuccagaacaccagucacgaggggcuagccaggccgcaccccacccucuggcucagucuccccgcccuugucuugggccgcaaagcccuguggcuuuacgugugagcuggcgccaggccucggguggagcucugucagcuggguggaggggccacgucaguaggucuggcgugcugcuuacucgcuguggggccccccaccacugccucgggaagugcacaccaaccgugggggcugggccguggagaggauccagacccccagugaugaugcuguggcuucuccucagggaaaaacugggaaaaggccuugcuccgaaagucaguggugagugaccgccugcagcgauugcuucagcccaaguuacugaaguaagucuaaaaccauaagucaaaaacggucuucaggcugggcauagggcucaugccuggaaucccagcacuuugggaggccaaggcaggaggaucucuugaacccaguucaagcccagccugggcaacauggugagaccccaucucuucaaaaaguaaaaaaauuagcugggugugguggugcacaccuguggucccagcuacucgggaggcugaggugggaggaucgauugaucccaggaggucaaagcugcagugagccaugauuguaccacugcguuccagccugggugacagagcgagacccugucucaaaaacaaacacaacagccuuuccuggccaacaggaaaagccaaggcugguugguuugggcuuggcagagguucagcuuagcuguaugcccguucucugcagcgggucuugccaggccauggagagaugcucaugccuggacuuuaugccccuuccccaugaagggggcuuccccauggccgggcgggcggcuaagcgcaggaucaguccacacagccacgaugagggguguggcucggggcgcggggucgguccacacggccacgaugagagguguggcucggggcauggggucgguccacacggccaugaugaggggugugguucaggcagcuucucugggcuucccuuucccauuccugaaaccugcuguuugcugauggggugauaaucacgugaccaaagaaggcacagcacagccuuacuguccgcacuugauagaaggcgcugcuguccugaugacuuuggucaaagacagagcugcucccagagcccagagacccagcagcaccugguuggccacucaacagcacagcagguccccaucugucuucuguggggccaccaugagcucucaaggcagagggggugccuuuagaauacaagcugccagggcaucucugggcacugagagggcuuuggccaugccaggggucccgggucccgccugccccccguggccugaugugcauggucaggguuugcagugaugacggugggucucuccucaggcucggggagagcuggguuuuccucccuggccugcucuggggagugguucuuuacuguggccucacagccucuggccuccucacugggcaccagucaggauaucugccuacggcugugucucugugccaggcacaggcugggagcuggggcacugaggcuccggagggcuguggcgaggcucugagacacgggggccagcaggcgguagccucugugucagcagacacugcagcccuucccaccccgguggcagccuggaggugggugcuacagcuucccucaugggugaggaggccgaggcagggagggugagggaggcucggaaucucugcugagcucacacuccuugcccuguaaugugcagagaaccugccccgccccgcagcccucgugccccagcccuucugccucugcucugcuuugcaggcucgaguacuugcaccagaagcagagcaaagucuccagugagcuggagaggcaagcccuggagaagcagggcagggaagccgagaaggagauccaggacaucaagugaggggggccucccgggagggcccaggggagcccacaagccaggcguggugccaauacccucaucccuuccaccagccagcuuccagaagaggccuugcugggaaacaggcuggacagccacgacugggagaagauuuccaauauuaacguaagucaggggcaggucugagccccaagcagcuuggagcacagcucccuguagcccgggugcaguuggaauugggugguaaggccacacccucccuggcaacagguucugcugugaccccccacccacccgggucaagcacaugucccacagucgggaauggcgaguggacucacgagggccuucaggcuggugcacggcccuuucugagauggucuggagggcucccggccuugcaucuggagccaagucuacauguuuggcuaugcaaggccuagugaguuggacgaagauugcgcuuacuugcagccguggaagccuccagcuggcggagagcaacagcucagccuggagcugcgucuagggugccccuggggucaguggccugcaaggcugagugucucugucggugcaguuugaaggcagccgcagugcagaggagauccggaaguucuggcagaacucggagcaccccagcaucaacaagcaggaguggagcagggaggaggaggagcggcugcaggcgaucgcggcugcacacggccaccuggaguggcagaagauugcagaggagcuggggguaagggccuggccuggaccccaggggccaggagaccugagggcgugugggcccuauagcgggaggcugcuggacgggugcgggguccccagugcucacucaccgccagguuucuauguguugccaccuccaggcuguggcccuagggaaggagccugcccagcccucucugccacuaggccauugccgcagcuccucugggccuucccaguccuccaggucuccccaugcagcggugcaugcccaguuuaccggaguuugucuccuuucuuauuucuagucuucuucugucuccaucagccucgggaguuuauucuguugauguuucuaaagcgcuuuuuccucgugugaguucuugccgcuuuucugguuuccugaguaaggacucaguucuuuacugacuugggucucuugucuugauaacgaggcuuguuaggccacccugagaguagcuuggcgugaacucuucuucucauagauuuccaaaguagcucuaguuuccauuuuuauugccucuuuggaccuagguguaucuaggaguguauguuuccguuuuuaaauaguuggauuucugggaguucuuguggugguucuuuaucugaauuugauuggaacaugaacuaggggcgagauguauaaaaucuccauuuuucaaauauauuuuacuuuuuuauggcagagcaccugauuauagcagacccagcuaaacuugccaaaacuguuuuuaagaaaaagguauguucucuguaaguagggccuacucuauaucagcuauuaaauugaguuugccuuuaaagaugcuuaauucugccgggcacaguggcucaccccuguaaucccagcacuuugggaggccgaggcuggcggaucaccugaggucgggaguucaagaccagccuggccaacauggagaaaccccgucucuacuaaaaauacaaaauuagccgggcgugguggcgggcaucuguagucccagcuacucgggaggcugaggcaggagaauggcgugaacccgggaggcggagcuugcggugagcggacgucgcgccacugcacuccagccugggcgacagcaagacuccgucucaaaaaaaaaaaaaauaaauaaauaaauacaaaucgguuuuucuucuauguauauuuuacugcuacauaguuugguacacauaacuuuuuuuaaucggggucugcuuucuuuuuuucuuuuuuguuuuucauauuuuuugaguucagggcugugugugcaggaugugcaguuugguuccguaggugagcgugugccauggugguuuguugcauagaucagcccaucacccagggauucagcccagcuugcguuagcucauuagcucuuuuucuuuccuuuuuuuuuuuuuuuuuuuuuuuucaaacagagucucacucugucgcccaggcuggagugcaguggcacgaucucagcucaccgcaagcuccgccucccggguucacgccauucuccugccucagccucccgaguagcugggacuacaggcgcccaccaccacgcccggcuaauuuuuuguauuuuuaguagagacgggguuucacuguguuagccaggauggucucagucuccugacguugugaucugccggccucagccucccaaagugcugggauuacagacgugagccaccgcgcccggcccaucccuguauuuucagccuuuuaacaaaucgucauuuccaaguguuuucaugaaagcagcgugcagcuggguuuugcuuucccacccgccugaccagccucuggcuuugugggaggguggguguuccugguguccuccugggucuggugugucgaguccguuuuacuuuguggccucuuuuccuuccacucugucuugcugguuugaugaaacuguaaguccgguuuuucuccuugugauuuuugggaauucaacugucuuccauccauuaauggcuuuuucuccuucgaacacauagucagacaugcuucucuguuaauaucagaaagcgugacgccagcacuuucccccgccagauucuuucuccuuccagggaaguguuuuuagucacugucaagaaaagccaggcuaaggccucagcagccucccuccagcuucacuccagccacccuccagcccccuuugagagcugcugcucucagcuacccgagcagggcccagcucugaaucccgccccaccccccaguccuuugccuucccaacuccuucggcaggcuugggaugggugugagaagggucucucuuuccacugguugggaagcgccagcuugaguguaggaggacgggugaggccuugaguguguuauguucccagaagcacucucuugggggcgugcgggcgaggcucacacacguugacuaggauugcccugcagcuugcacaccccgggguggugguuuuguuuguggugaacgagucucagauagaccugugauguagcgagcugggaaggacuugguggggaagaaagccuuggaagcaaaacucacagcucagcggcaccacauccagcucugcgugcccucugccacccagcagcucacuuucagaaaaagcaaaccucacagcacguccagccccacgcgcccucugccacccagcagcucacuuucagaaaaagcaaaccucagagcauaucuagcccugugugcccugugccacccagcagcucacuuucagagaacaggguucagguagcacucaucagcucuuggaaaaccccuugagaagaugagugaggaaaagauuugggcagaugguccacuguguggacugaggguggguuugcugagccgagccacacagggaagcugggagagucauuuuggggcacucucuucugagggcgucuccugagacauggacaccaaaccaagggcugucccguaccuccuccaccccauaccccuuagcugagagauacucuagagcucgagaagggagagaaggugcuagcaacugcauuuagagagcaugccacaugcagagcagugcgucucccagcccuugccaagcugggaguuucuguugagugaguugcagugugguuuuggagucauaucaguuuaccuauugugaauuuuucuuaauauuuucuuaagugaagguuugauuccucucucaccugguccuuccugguccuauuuagugaguguauugucuuccuaccguggggugcucuccaucagcccacaggagucugggaggaggagagcuggggucugcagaagggucaccccaguggcucaugggcccaccugugcccuggggcacucagagccagaucuggacauccugccgcgcaguaacacucauuugcuuuuguuugggccugggaagaccagccgcagcgccuuccagugccugcagaaauuccagcagcacaacaaagcucugaaacgcaaggaguggacagaggaggaggaccgcaugcucacgcagcuggugcaggagaugcgcgucggcagccacauccccuaccgcagaagugaggccccuccaccccgacggcucucaggcugucacagggccccauaucaggacacuggagacuugcagggaaaauucacagagaagcaacaagacagacgagggcuuagacaguccuggcuguuccacaguucgcuucuuggugacucaagugacuuuuuuuuuuuuuuuuuugagauggaguuucacucuuguugcccaggauggagugcaacgccaugaucuuggcucacugcaaccucugccucccggguucaagcgauucucgugccucagccucccaaguagcugggauuacaggcaugcgccaccacgcccagcuaauuuuguauuuuuaguagagacgggguuucaccauguuggucaggcuggucucgaacuccugaccuuaggugauccgccagccucugccucccaaagugcugggaugacaggcaugaugccacugcaccuggccaaagugauucuuuucuaugugacccaucuggagggugggugucucggccccacgggacccuguugucccuagcugucuacucuauggagggugugugucucggccccacaggaccucccuguuccucugucccuaguugucuacuauauggaagggagagacuccaugcagcugaucuaccgauggaccaagagcuuggauccuggucugaagaaggguuacugggccccggaggaagaugcuguaagugugcgggacccuaggagaacugggcucugggaagguaacgcggcuguguucagcggcugcugugccccaguggucccuucucugacuggguucaggguggggaggcugcagccguaccugcagaggcuucacuugucugccugucccuuccugcagaaguugcuucaagcuguugccaaauacggggagcaggauugguuuaaaauccgggaagaggugccagguaggagcgaugcccagugccgagaucggugagucgcacagcgcugagcgagggaggggcccgugugggucacugaccaggugcacucuggugugggcugugggcgggcugggggacagcggccagcgcugggcgagggaggggcccgugugggucgcugaccaggugcacucuggugugggcugugggcgcuugcuugccaggguuggcccggcugagcuguguuuuccaagccugacuucuguauugcugucugccggagcaacgcaugggcuccacuugagacagcucccugggcggcuuuuccugacccuaguugucucaguucucucagaaugcugauaggcaggaccucugggcacacagcugcagcucccuccuuuuccugcuuauuuuccuuucaaaaacagcuucguugagauaauucacacaccaugcgaugcguucauuuaaaguguauauuuccgaagcugggcgcaguggcucacgccuguaaucccaguacuuugggaggucaaggcaggcggaucacuugaggccaggucaaaaccccgucucuacgaaaccccaucucuacuaaaagcacaaaaguuacccgggcaugguggggguggcgccuguaaucccagcuacuugggaggcugaggcaggagaaucgcuugagccugggagguggauguugcaguaagcugagaucacgccacagcacuccagccugggugacagagcaagacugucucaaaaaaauauuaauuaauuaauuaaaaugaaguguagaaggccagguucaguggcucacgccuauaaucccaacacuuugggaggccgaggccggcggaucaccugagguugggaguuugagaccagccugaccaacauggagaaaccccgucucuacuaaaaauacaaaauuagccgggcgugguggcacaugccuguaaucccagcuacucgggaggcugaggcaggagaaucgcuugaaacugggaggcggaggaugcagugagccgagaucacgccauugcacucuagccugggcgacgagugaaacuccgucucaaaaaaaaaaaaaaaaaaaugaaguguagagguagaggucagugguuuuuaguauuuaguauucauugagcugugcagccaucaccacaaucaauuguaaaacauuucaucacccgaaaaagccauucaacgacaaaaacaacccaaucuaaucgcgggcaaagaacuugaguggccgucucuccaaagaagaugcacagauggccagugagcacaugaagagaugccuggcgccaugagucauuagggaagugcaagucaaaaccacacacgcguugggauggcuguuaauuaaaaaaaaaaaaaagucaccguguuggcaaggaugucgagaaauugaaaccuuugugcguuguaaaaugguccagccucuuuggaaagcauggcaguucgucagcgaguuaaacauagaauuauacccccaagauugauaagcauaaaacccaaaagaaucgaaaguaggagcucagauacaacaauguccacagcagcaucauucacaagagugaaaggccggaagcagcccaagcauucaucagcagaugaguggaaaauaaaauuuucauacaagggaauauuauucggccuuaaaaagggguuggcagggcucgguggcucacgccuguaauccuagcacuuugggaggccaaggcggacagaucaugaggucaggaguucaagaccagccuggccaauaugguaaaacccugucucuacuaaaaauacaaaaacuagccacacaugguggugggcaccuguaaucccagcuacucgggaggcugaggcaggagaaucacuugaaccugggaguuggugguugcagcgagcugagauugcgccacugcacuccagccugggcgacagugagccuccgucucaaaaaaaacaaaaggggggggagugggauucucauauaaauaccgcguuucuguaaauucugauacaacauggaugaacccugaaaacauucugaacauuugcuugcacuuuuuuacauagauaucuguuuauuucucucagcuauauccugcgagugaaauugcucgguccggguaacgcuguguuuaaccuuuugaggaauggccagacuguuucccaaagagguugaaccauuucguauucccacuaggaauguaugagggcuccgguuuuccacacucucaccagcacuugugaucugucugugauucuagccaucuuagcgggugugaaguggugucuugugguuuugacgugcgcuucccuguggcugauguggagccucuuuucaugugguuggugacuguucauagaaauagguuuuuagagaagugucuguugaaguccuuugcccauuuuugacauuacuugucuaguuaugacugacuuguaagaguucuucauauguuucagauauaaguccuuuaucggacacgugacuugcaaacguucucucccagccuguacacuuucuacuuuuuugaugguguccuuugggacacaaaagcuuuagcuuuugaugaagucuacuuuaucuguaguuuucuuuuguugcuugcgccuuuagugucauauccaagaaaccauuaaagaagcuuggggcagcagcgggcggcgucucggcaucuaaaacguucuuugcuuuucaugucacguucagguaucucaggagauuacauuucagcuugaaaaagggucgguggaauuuaaaagaagaggaacaguuaauugaauuaauagaaaaauauggugucgguaaguugcugacaguuuguucuucuaguuucuuuuuuuuguuuuuuguuucuuagaaaagagaucaagauaaagacagagcaagcucugucguccaggcuggggugcgguggugcgaccauagcccacugcagccucaaacuuuugggcucaagccauccucccgccccagccucccaaguagcugggacugcaggugugugccaccacacccgacgagcugaguguucuguagcgaagucuuugcuuauauuugcaauguccccuuagaguaaauccuagcugugguauugccacguucaaggacacaccagauacuguggcucugcccugugagagcagcacccgugcuccuccugcugccccacacugugaagagcgggaaucgugggagguggcuggugcggaagccuggggggagcagauaugugagggccguggugugcgcuuaggacgauuuuuccuucucaguuacauguuuggcagaacuuuccuaaggggcugagcauccaaugagaaucagaugcugccaaauuguaggcacccaacaugcuugaccccccagcgugagagugcacaggaggcuccacucugauggggccacggcgagucuccuggggaacagcaagccuguccuggggaagaaucuuuggaugaaggcauuuccaugggguuuggcuuuugcaggucacugggcaaaaauagcuucugagcugccccaucggucuggcucccagugucugagcaaguggaagaucaugaugggggugagccacucgcuccuucuuuaucugaaaccagacaauggccuggucaacugggggguccagcaggcaggaggaggggaggggaggggggcguucgguuucuggucuuggcauuucuucuucuggguggccaagggcaaagggagacccugccucggcagcggcugcucuugaccccggaggcgcccccgcuugggccucuccccaaagggcuggccugcuugcugccaucaugggugaaccgggcuugccaaggccucuaaguagcucuuuccuccccucagaagaagcagggucuccggaggcggcggcggagggcccgucacagcguccgguggagcucuaccagcagcagcggcagcagcaguggcagcaguggagggagcagcagcagcagcagcagcagcagcgaggaggacgagccagagcaggcgcaggccggggagggugacagagcgcugcuguccccacaguacauggucccggacauggaccuguggguuccugccaggcagagcaccagccagccauggagaggaggggcaggggccuggcugggaggccccgcugccucccucagcccucccaagggguccagugccagccagggcggcagcaaggaagcuuccaccacagccgcggcuccuggagaggagacgaguccggugcaggucccugccagggcccacggcccugucccgaggucugcccaggccucccacucagcagacacucgcccggcgggcgcagagaagcaggcccuggagguaggccccggcccuggguguaccacgggaagugcacuuucggcacucgcucgccagggcugacgcuuggggauagugcagcagcaggggccccaggguucgugugcaucagaacgugcuacuucuggcugagcucuggacagcugugcgucggggggacuguuggggaagccuccauuuuuccuggcuuguugacuguuucagggguauggcugaaugggcacuuggaccuggaggcauuucugaaacauuucacccccaagccaggguuggggagggcagaggcagcagugggaggagccccuccucccuccucgugagccugugcaccuggaggcccucccugggaagggccuguccaccugcuugggacaagccuggcuuguggugugucugcucgucuuggcuggucuucaccgugucaggcccaucucuggccaugucugugggagcagucagaguugaacaggcuggucuguccugggagucauuggcagggacaguggacacugaagcuacuggcagagcuaggugcauggggcucgcugcugcacagccagcaucucccuaggccggggcgucaccuggaagggcugcugcugucagccugaggaacuggcuggggggcaugggacccuguuaaugucccaggagccaggccuagcugggaggcccugccuggggaacccacgcuucccaugguggacguucccaugaggcagagcagagcuguacacagccacgcuuuggagccugggugaagaggcagucgugugugggcagcgaggggagggcccccaugugucccguacaccccgcgugccucgccucaggcagcuuucucaucagggugggaggcgucugcugacagugccuguggagaccgugcugagggugcucagggccaacacggcugcucggagcugcacacaggugaggccugcugcagacacccacgcgcacgccaccacgugccccgcccuggucugagugauuccucuccccgucgaucaugcccugauggggguggagggcagcacuggccacugggcaggguccacuccgggggccgagccuggccaugggccccaggugcugccuucuccuuacagaaagagcagcugaggcagccaccccugcccaccucauccccaggggucagcucuggugacagcguggcccgaucccaugugcaguggcuacggcacagagccacccagagugggcagcggcgcuggagacacgcucugcaccggaggcuccugaaccgcaggcugcugcuggcugugaccccuuggguaggggacguugucgugcccugcacacaggcuucccagagacccgccguagugcagacucaagguauggccuggggcuccucugggagcauccugggggcgaggggugaggaugaagaguacauccagccuagcagacgguggcuacuuggggaaguggccucagcaggggagucuuuuuggggugggcgccaccucuggucagcuucccgucccugaagguuuccaggacacccagucacagccagcccucccucccuaccccaccacucuuccugggccaagcauguggcagcuugguggugacagggcucacagggcccacccuuguccaggcguggcuguggggugcugguuccaaggccuccccucccacccuggccuggcucccagagccgccucgaaaggcacgugggagcuggggcugcuuuccacccaucccccugugcccaugggagcuggggcugcuuuccacuuaucccccugugcccgcagcggauggccucagggagcagcugcagcaggcccgccuggccagcaccccuguguuuacccuguuuacccagguaagcuacuugggcagagcuucguuuuccuuugccuuguaaaaaguuuuuggugaaguuuugaaaucugcaguagauucauuccuuaaagucuagcuaucuaaaguuuucuagccuugaaaaugcacuuuucaugccuuacacuguuagcaagugaauguggaaggggugccggcuacagugugcacugcccccaucgggcuaaacaguguccggggaaggggguccccggggccccaguaugaguggaagaugccgggggaggagagcaggccugggucucaugggaggccauccuggauguccacagccucauggccuccccugcaucugcaucagaagggcaggaaggcugaggucucaagguagccgccccagccucagggcugccccagguucugccuaggccucuggagcuucggagcugcucccgaaagcagcuaugguuagguugccuccugugucccgcagcuguuccacaucgauacugccggcugcuuggaggucguccgagagaggaaggcccugccacccaggcugccccaggcuggugcucgggacccaccaguucaucuucugcagguagcaggcacuuggggugagaagugaggauggccacugcccgccccggcguuggaguggguuuccacggaggcuggcugcccgccccacccgcuccaccgcagccccucagggaggcaucugcacuucccaccugaggggacgcagccuugagaggcccuggggaagucaggcaggugcaggucggggcugacacuggggcccacgugccuguuuucccccauagccccgcugggcggucauggacaugggcgcugucugccggggaugccugguucuugccuuucugcuccagaaaccaaacucacagaaguucagcgaggccuccucacccuugagccccgucaccuggggguggggugacaaagcagugucacucauuggaggagcaggaacagcagugggguaccccugggccucugugcuuccagcccccccgccucucccugcagaccccacccugcccccaaccccccagaagagcucuugagggcacccuuaggaggagcugcacuggcagggggaacaaggccaggccuuugccugcugugcagggcacgacaacguccccuacccaaggggucacagccagcagcagccugcgguucaggagccuccggugcagagcgugucuccagcaccgcugcccacucuggguggcucugugccguagccacuggacaugggaucgggccacaugcuuggcuccuucuguggccccggaguuccuacagaggcgugugggaggccagcaccagcccuuggggccucgucccauuucagggaguggcaggggauaguccagaugcuaggagaggugguccaagccagcagaggacaccugagcugcugacucuccucucuuucauuuccaggcauccucaagugcccagagcaccccagguaacucugcuucucugcccugguggggaagagaccuaaccuggcccuggcggggaagaggccuaaccuggcccuggcuuucacccacagcccccaagcagcacagccuguggccccuggugacagagcucccucgagucccaccacagggaugagaguccggcugggccagcuuggagcucccugggcuccccuugcagcccuaaggcuuccccagcauggggcccagaggcaggggucgucuggagcgagcguccgcccaugcccaacaccggcaagcugggcugccggcugaucucagccagcauuaaaugggcuggguuucccagagugcccacugcccuggcuuuggccggagcauugccaucugggguagccacugugacuugggagacccaggaugugccgcuugacccucucuuggcucaagaccccaggcuccccacauggucccuccugaugaggggauggcagcgaggggcugucccugggccagaugccuggggcuuaucaagugugggucuuuccuccccacaggccaccucuucccaaacgugccggcucaagaagccucaaagagugccagccacaaagggagccgaagacuggcguccagccggguggagcgcacccuaccccaggcgucccugcuggcuucaaccggcccccggcccaagcccaagacugugucggagcugcuucaggagaagcggcuucaggaggcccgugccagggaggccacccggggcccgguggugcucccgucccagcugcuggucuccucgucugugauccuccagcccccucuaccacacaccccacacggccgcccagccccgggucccaccgucuuaaauguaccgcucucugggccuggggcccccgcggcagccaaaccuggcacuucuggcuccuggcaggaggcugggacuucagccaaggacaagagacucuccaccaugcaagcccugccccucgcuccugucuucucagaggccgagggcacagccccugcugcuucccaagccccugcccugggccccggccagaucucugugagcugccccgagaguggucucggacagucucaggcccccgcugcaucccggaagcagggccugccugaggcgccacccuuucuccccgcagcccccagccccaccccacugcccguccagccccucagccugacgcacauaggagggccacauguggcgaccagugucccccugccugucaccugggugcucacagcccaggggcuucucccuguuccuguaccagcuguggugagccuucccaggccagcagggaccccuggccccgcagggcugcuggccacucugcugccuccccugacugagacucgggcggcccagggccccagggccccagcguugagcagcucuuggcagcccccagccaauaugaacagggaaccggagccuuccugcaggacagacaccccagcuccucccacacacgcccucucccaaaguccugcagaagcggauggcaguguggccuuugucccuggagaggcccagguggccagggagauaccugagcccaggacguccucccacgcugacccuccugaagcagaacccccuugguccgggaggcugccagccuucgguggugucaucccagcaacugagccaagggggacgccggggucccccucagggacacaggagcccagggggccucugggccuggagaagcugccccugcgccagccugggccugagaagggggcccuggaccuggagaagccgccccuaccccagccugggccugagaagggggcccuggaccugggccugcugucccaggagggcgaggcggccacacagcaguggcuggggggccagcggggggugcgugugccucuucugggcagcagacugcccuaucagcccccagcccugugcagccugcgagcucuguccggucuccuacuccacaagaaggcccuggagcacaaggccaccucccuggugguggggggcgaggcugagcggccggccggagcacugcaagccucacuggggcuggugcgggggcagcuccaggacaacccggccuaccuccuguugcgggcgcgguuccuggcagccuucacccucccugcgcuccuggccacccuggccccccaaggcguccgcaccacccucucaguaccuucgagggugggcucugagagugaggaugaagaccuccugagugagcuggaacuugcagacagggacgggcagccgggcugcacgacagccacaugccccauucagguagggugggcgcccagccccacuuccccauggcaggcggcggucccuggggugcccucgccugccuggagcaguggggugggggcugguggaaguugcgggcaggaaggcuggcugcugggugucuuaggaggaggaagcugguuccuggccugcccaguugcguguagauucugcagaaguggccucccuuuggggcaguguggaaaaggggagaagagaggccucauucucgugcaggagccuccggccauccugaugcugcccagccagguggccuugucugagcgagaagcucugggauggacgcugacccggcucugagccgcacacgccacacacacgugugcucccagggugggccaugggcacaguggagggugguggcuguguuugucucuggauuucuggggucccaaaggucccucucugcugucaccucucugaguguccuuggggagaguuuuccaaucucuguaggugaaaccauguuuggaacccuggaaagcauguggagcuggggcccccagagaggccuccuccccuggugccagggugcccacuugcagcagcugggaggcuggccucccugagaaaccaccagaagcaggcagccucagcuggaccugugggccugucauagggaguguggcagagggccuuccaucucuccccaggguugugucucgcaagucccugggcugaagugugggaggaagcaauguccaagaguuggggaggaccccggccagccaggggaagaggcccucugugccccauccauguacagccuccugcccugccugggugugauggcugucccaugggggagugggaggcccaccagagggauggcuuggauggggucagagcccccgagggagggagugcacagucacguguggccccaggagugccuggagcagcucccgccugagcugagggugcccugucccaagugggacacucacccacagggccccuccucacucccgucccuuccccguccaucauggcucgggggugucacucuuguccccacugccuggauuuucuuucagggagccccagacucugguaaaugcucugcuuccuccugccuggauacuucuaaugacccugacgaccuggacgugcucagaacccggcaugccaggcacacccggaagcggaggcggcuggugugagcagcaggugaguccugaguggggaggccacugcccuacaacccaggggacagagugguguccagauggcagggggccuuggccucugcucggcucuuuggcgcucacagcaggugugcuggguuaggugggcagguccagggucauggaggcccuccagggggagaagcauuuaacccacauccuuccugcuggccacccaugccucgggccuuggcaccacugugccccugaccauaggcucauucccugccuuuggggucugggcuccucccuggccgcugugcucugguggugcccuguucccgugcauugcugcgucgucucccagcuuguaaaacgaucaccauccccaaccgcagccaccaggcuggcucuucacugcuggagcccuggugcccuggccuggcccuuggcgcaugugggucagguuuaccaagcagacugggcguggccggcgcugggguggucuugguuccuguuugucugucccagcccugcuuggggucuggcuggggucaagggcaccccccaccugguguuccuguguuccaggacaagcacuuucucagaagcccguggcccugcugacgagagacagcccacccccagccugcaagagaggcagccagaggccagguaucugcuggccgcugacugaccagguccgcagugaacagaggcgggccugccgacugacuguguggcauggagcauggcuguuccccaagugcacaccugaacacuuggaggaauaaaguucuguuuuuaauuguggagcugga

SEQ ID NO: 13101 - RNA, 59983 nt, Homo sapiens
cacgucggcggcgcggcggccgcggagacccgagccggaugugccaagauggcugcggcggcugaggugucugugcucgucgccagcgucgggugggcuuucgcccgcggcuccugagggaucggucucagccgcgcgggugagggggcgagcgcgggugagggggcgagcgcgggaggaggaaggcggaggccggccggcggagccaggccguggaggucggggcgcggaggagaggaggcggcugggcccagccccgagcgggcggugcaucucgggucccgccggggccggucgaggggacagacguccgggcccccgggccagagcggaaggccggacgcggcgcgggccgccgugggacucgagggacugacguggacccggcugggcugcggugacgccgguucccggggcgggaggcuggacccccaggcaccccucguaagacucuuaacuuuucaaaugagcgugucuuguccucaccggcuagaaggcuuccuuagcgaugcuggugaagagacacauuuacauuugaaccaaagagcagaguuguuuguuuguaauuucuugauugggcgaucaggauguugcaacagaggccgaggguuagaggagugugugugauccggcucgccccuuugugauggaaguguuacaguagagccuucagaaacaucagagccauuuaaagucaguuuuugccgcuuaagaacacuuuuaaauggcuuguaaguuggguguggauuguauauuaagauuuuguuuuacaugugugaugccgauguuaaccaaagagguauuucccaucccccauguggcaauacgaagcaaacggaaccgcagacgguucuuccuagaagugauacuuuugcaaguuucagcacaaugcagccucccugcguuuuuuccucauccccuuucuuaaguuucaggugcugguaucuuguagacaagaggcaaaauagcgugucuuucuuguuccuuguuccucguuuacuguuaauagugguuacuacagugagucucaaaauuguacuuaaaguuuucuuugaggcagugggcacuuuuuuuuucuuuuucuuugucuuuuuuugccaaauccagcaagaggucaugguaguggguaaauguuaaugugauuucuucuucuguaagcaucuuucaugaauaccagggucuucgucauuuucaucaguguuaggcugcuggccuccucugucgcuggcuuccucuucaacaucuaacuguaugugguugcgauucuaacuuagaagaguuggaguugaucaugucuuugugucaagcaucccacagucugacagggcgucacuagcagccaccgugagggagacuguaggcaguagguaaacucaggggcuuccuggcacacuauuguuuuccucacuuaaaauaugaagccaguggcagcaagaggagaggggugugcaugcauuuuaaaugccucaguucuguagccagaacuguacuaaaaagaguuuugcuuagguauccacaugguuacaaggcaguuuaacugacuagcuagguuuaugaauacugcauuuucaagaucagcuggccucuuuggaacaauaaaagaauuagaugacuugagguuacagaauaaaauucccugggccgggcgcgguggcucaugccuguaaucccagcacucugggaggcugaggcgggcggaucacgaggucaggagaucgagaccauccuggcuaacacggugaaaccccgucucuacugaaaauacaaaaaaaaauuagccgggcgagguggcgggcgccuguagucccagcuacgcuggaggcugaggcaggagaauggcgugaaccccggggggcggagccugcagugagccgagaucgcgccacugcacuccagccugggugaaagagcaagacuccgucucaaaaaaaaaaaaaaaaaaaaaaagaauaaaauucccuguaguggugacauaggugauaggcaguugcauuguuuuucuccuggugaguagagaaaaagaucaaaaaaaucaguucaagucacaagauuguuccaaaugaaaguggcauguugcuaaaaagcucucaauuagggagcaugaagguuggaaugcuccuuguaagugauaauguuugccauaaaaaagcucuuagucuaggagagcugcggaauaauuuuuuuuuuuuugagacggagucucgcucugcccaggcgggagugcaguggcgcgaucucagcucacugcaagcuccgccucccagguuuacgccauucuccugccucagccucccgaguagcugggauuacaggcgcccgccaccacgcccggcuaauuuuuuguauuuuaguagagacgggguuucaccguguuagccaggauggucucgaucuucugaccucuugaucugcccgccucggccucccaaagugcugggauuacaggugugagccaccgugcccggccaccccuguuaaacagcaggugggauuaggacaucccagaauccacugugaguagaaucucauaagauuaaacccggguuuuuuaggaaaaaauaaucacaucgauucucgcauuuuauagacaaaaauacauugcagaaagaggaguggcugccucgagccacucaccuggacacucaguuuugcucucacagcagcagccaaggaauaaaccucuaggcccgugcucuguguuuaaagcaaacaaaagcuuuugaggaugauaaggaucuucccggggaaggccaugucuugagagaugagguaggaccccaguucuggcagcagaguuucaggaggugcuuggaaguuugcguguucuggccgugguugcaggugucgcugugucugcuguggcugugcagcugguaggacccaguggaagauaaugccagugcacagaucagaggaagaugcucugccuguucuccuuucaguccauauaaaauagagcugugaacauucuuuguuuucagaugagagccuaaaaccuccaugaagccuuugcugcuguuccuaguaaauagcuugacuuaaaauacauugaucaguguuuucuucuuuuuuuuuuugagacaguuucacucugucgcccaggcuggaguguuguggcuugaacaaggcucacugcagccucaaccucccuggcucaagcgaucuucccaccucagccucccgaguaguugggacuacaggcacgcaccaccacgaccggcauuuuuuuuuuggugaugggguaucgcuguguguugcccaggcuggucucaaacugcugaacucgagugguccuccuaccucccaaagugcucggcuuacaggugugagccacugcaccuggccaguguuuucuucuuuuaucugaauaucagaaagauuuccaagagaccaaaauaauauacaucugcaaagauguguggauuggccaggcacgguggcucacgccuguaaucccagcacuuugggaggccgaggcggguggauuaugaggucaggagaucaagaccauccuggcuaacauggugaaaccccaucucuacugaaaagacaaaaaauuagccuggcaugguggcaggugccuguagucccagcugcucaggaggcugaggcaggagaauggcaugaaccugggaggcggagcuugcagugagccgagaucgcaccacugcaccccagucugggcgacagagcaagacuccgucucaaaaaaaaaaauguguggauuaaacuacagaguccuccccuuugguuuaauuuuuccuuugauuggcuaaacuuaucuguuuguucaugaggguggugcugacaagaagaaagacugauagaaagaaaagaacuuuccuaaagauauaguccuugaauuuuugccuuaagaggccagguuaacuauucaaguuuguaucuacuauguuuuauuuaaaaacugauggagguuuuugccccuuucuuuucuguaagagguuucuuggcaauucugccuguuguugaaaguguuggaauccagucugugccuuguaaagcugcuuuaaguuuccugggaguuuccauuccaggcacaguuacggcuccaguucaaagguaacaucuugcuggugguccuuucagaccuuaagccagucacaguacaaaaacggagaccuaugaagaggugugauaaaaggcauuuagaugaauauauuuauuuugcagugcuuuuuaaaaaaaugauugugucacuuuuuauuuauuuauuuuuuuaaaauagagaccgucuugcucuguugcccaggcuggaccgcggugguauaaucauagcucacugcagccucgaacucauggacacaagugaucuuccuuccuuaacccccugagucccugggacuacaggugugugccaccaugucuggcuaacuuucuucuuuuguagagacaaggucuugcuauguugcccaggcuggucucgaccuccugggcucuggcaguccuuccaccuugaccucccaaagugcugggauuacaggcaugagccacugcacccagccuauuuugcagcuuuuauaacuauacuucauaaugcucuuucaucaaagaaaauggaagaaugaauuuuaaacuuuuguaucccuuuugaaauuuaaaauuaacauguauggaaaguaugauauaaaguuuuccuuuuuuuuuuuuuuuuuugagcuagggacucacugugucacccaggcugaaggguaguggugcugucauagcucacgacagccucaaccucccaggcugacgcaauccuccugccucagccuccugaguaguugggacuacaggugugcaccaccaugccuggcugauuuuuguauuuuuuguagaaacgagaucccccuguugcucaggcuggccucgaauuccugggcucaagugguccucccgccuuggccucuuaaaguguugggaguacaggcguaagccaccauaucuggccaguuuuucuuucuuaauagaagaguuggcucuuccuggaucuagggaugguuuacaggaaaacauugaguaucugugggucugguagcauaucacagcaguggucagguuccgcacugucccuguuguuguggcgcgggucugcggcagcaaugggcccugugaguagaggaucccaggggagggaguggccaucuagacauacuccaucagcucgcagccaggccauccaggguucucacucuguccccugccccccagaacaguuccucagggacagguguucucugcuggggugggguguaggggagagagaguccuugggauuuaagugacauaaaaucauguucaauguuucucuuuuuccuuaguuuuccugauugcagcuaggacuuugaauauauggauuuuaugcugauuuucucuuuuucuuuuccagcuccaauuaaggaacagcuauauccugcuuccuucuguaagcagcaucgacuugugcaaggguucagucaugcagccaccgccccagacggucccgucuggcauggcugggccaccuccagccgggaauccucggagcguguucugggcuagcagcccuuacaggagacgggcuaauaauaaugcagcaguggcuccgacaacuugcccguugcagccggucacggauccauuugcuuuuaguagacaggcgcuccaaaguacaccacugggcaguucguccaaaagcaguccaccugucuugcaaggcccagcccccgcaggguuuucucagcaccccgguuugcuuguuccucacacacaugccagagauagcucucagggacccugugagccccugccuggaccucugacacagcccagagcacaugccaguccguuuucuggugcauugacaccuucagcaccuccugggccugagaugaacaggagugcagaggucggucccaguucagagccugaaguucagacucugccauaucuuccucacuacauuccaggaguggauccugaaacgucucaugggggccacccucaugggaacaugccugggcucgaccgaccccugagcaggcaaaacccacaugacgguguggucaccccagcagcauccccuucccucccucagccuggucugcagaugccaggacagugggggccagugcagggaggcccacagcccucggggcaacaucguucacccugcccugaaggaccuguucccagcggggugcccugugccaccagcguuccucauuuccccaccccguccauccuacaucagggcccuggucaugagcaacacagcccucugguggcucccccagcagccuugcccagugacggaagagacgaggugagccacuugcaaaguggaagccaccuggccaauaacucugauccugaaaguacauucaggcaaaaucccagaauugugaaucacugggcaagcccagagcucaggcagaauccaggagugaagaaugagcaccggcccgccucugcucuugugaacccccucgcccggggagauagcccagaaaaccguacgcaccacccacugggggcuggggccgggucuggcugugccccgcuagaagcagacucaggagcuucaggagcucuggcgauguuuuuccaagggggagagacagaaaaugaggagaaucucucaucugaaaaagcaggcuuaucuggucaagcggacuuugacgauuucugcuccagcccugggcuaggccguccgcccgcaccuacacacgugggggcaggcagccucugccaggcccuucucccaggccccagcaaugaggcugcuggugauguguggggugacacagcgagcacaggggugccggaugccagcggcucgcaguaugagaauguugagaacuuagaauuuguucagaaucaagaaguucugccaagugagccccucaauuuggacccuuccuccccgagugaccaguucagauaugggccccuuccugggccagcugugcccaggcauggugcugugugccacaccggagccccugaugccacacugcauacagugcacccugacagcgugucauccagcuauagcagcagaagccacggaaggcucucaggcucagccaggccccaggagcugguuggcacauucauucagcaagaaguuggaaaacccgaggaugaagcuucagguaguuuuuuuaagcaaaucgauucuucucccguaggaggugaaacagacgagaccacugugagccagaauuaccguggcagcgugucccagcccucaaccccgagccccccgaaaccuacaggaauauuucagacaagugcaaauaguucuuucgaaccgguaaaaucucacuuaguugggguaaaaccauuugaggcagaucgcgccaacgugguuggugaaguaagggagaccuguguccgccagaagcagugcagaccagcugccgcccugcccgaugcuuccccuggcaaccuggagcagccaccagacaacauggagacccucugugcaccccaggucuguccccugccucuuaacuccaccacggaagcugugcacaugcuuccgcacgcaggggcaccgcccuuggauacuguguauccagcacccgagaagaggccuucagccaggacccaggggcccgugaagugugagagcccagcaacgacucugugggcgcaaagugagcugccagauuuuggaggcaacguccuucuggccccugcagccccggcgcuuuaugugugugcaaaaccucagccaccuguuguucagccuccagaagaggcgauguccgggcagcagucacggaacccaagcucggcggccccggugcagagccgagguggcauuggugcuucugagaaccuugagaauccucccaaaaugggagaggaggaggcccuucagucccaggcgaguucugguuaugcaaguuuauuauccucaccgcccacugagucucugcagaauccuccagucuugauugcucagccugaucacagcuauaaucuggcucagcccauuaacuuuucuguguccuuaucgaacucucaugagaagaaucaguccuggagagaggcuuuggugggggauagaccugcagucagcaguugggcucucgguggugauucuggggagaacacuucuuugucugggauuccaaccagcucuguccuuagcuugucucugccuagcaguguugcccaaaguaauuuuccacaagguucuggugcuuccgaaaugguuucuaaucagccugcuaauuugcugguucaaccaccaucccagccaguuccagagaacuugguuccagaaagucaaaaggaucguaaggcaggaagugcucuucccggauuugcuaauagcccugcuggaagcacaagugugguguuaguuccaccugcacacggcacccuggugccugaugguaauaaggcaaaccauuccagucaucaggaagacacuuacggagcccuagacuuuaccuuaagcaggacuuuggaaaauccuguaaacguguacaacccgucccauucugacagccucgcuucucagcaaaguguugccagucaucccagacaaucugggccuggggcgccuaaccuugaccguuuuuaucagcaggucacgaaagaugcccagggccagccuggccucgaaagagcccagcaggagcuggugccaccccagcaacaggcuucucccccacaacuacccaaagccauguuuucggagcugucaaauccagaaagucugcccgcacagggacaggcccagaacucagcacagucaccagcaagucugguucuggucgacgcgggucagcagcugcccccucggccuccucaguccucuagcgugucucugguguccaguggcuccggccaggcagcugugccgucagagcagccguggccacagccagugccugcacuugcccccggcccaccgccucaggaccuggccgccuacuacuacuaccggccuuuguacgaugccuaccagccucaguacucuuugccguacccaccggagccuggcgcagccucccucuauuaccagguaagagucgagucguauguguaacccacuuuucugucugugcuuugaccaguugagucucacucacaguguauuccuuaguaguguuuguucgcuugguuccggggucacccacagucccgcaggcgugagaacaguauuccaguaacgcuuccugaggacagggcucccggcuccagaaccuacucucccaagcacaggccacccuuaguucacaccacgcguuagcaucuugaauugcuuauaauacuugcuuaggauuugaaccagccuccccagcuuaugugacaaaaagagcccuccauuugcugucaccccugcuccugcuggcugucugcagaaaaguucugucuugcaugccuugggaagcugggcuagccucuggaagcuuacgucagaagcauuggguauaaccauaguccuuuaaaugccccuggagaauaaaaacauggagagaaaauaguuuuggagcaugagccacacgcaucagcuaagcgaggcggagucccgcaagcugcugucagcacgugguggugcgggcagcggcucggggaccggcugugcucgugcagaagauucuucugugccucuuuuucacagggacaccagcucaugagugacauuugaguuagguuccgcauaauccugcagucguucgaaaagugucuguguacacauuugaucauuaucugcuuuuccuacccucuaacccaguucaacauacaccgauuggguucaccgauucagugucaccccagguagaaggauugugugauagggaauuggaaaaccauggucuugcgguauguaaggccaguuggaaccagacuuggggccacacaggaaggccuugcagucagaagggggcccgccccgaggagcaaggcugccguggcuugcuggguacugccccggggaauggggcugggccucccccaugggccucgagcaucaugguuugugugcgugugaccaggugcacaccugaccccucagaccuguguagguuccagaaggagcccaggcacuuuuuauuuccauacaaggacauucagcucugcugggagcccugggguggggcuggugcagagcgacgggaagccguggccucacuucggguccuuuguccgguccuccugcugcgagccaccucccuccgcaggagugcacuccucccgccgugccucuugcugugguguccggguggccaaggaugagucuguuuugcugugauuucacauuuccugccaggcagcggcagcgucgaggccuugaggcuuugaggcgcuuaagcgugaauucuggcguguguccggggcacugcaugucuucagauccucauguguccacaugggccccguugggaacaauucuguggccacgaauugguuggugauggggcugaagccucccgagaauaaagcacgguccgcuuuuagaggcugcuccuggcuggggcucuguucacugggacccugguucucugacuuaacugagguggcaucugaagcgggacgcagggguuguucaaaucauggcaucuccacacuggacuuaucaggaagcagaaaccuaacagccccuuccagaagucgccacagcccccugggguugucugcugacaugcuggugcccuggguccauccagaggucuccugaacagggccagggcugugggucuuaggacacccugcugccuguggguguggcugugcuuuggaggucugugugguuguguaugagggaagggccacgcucaguccugcuggagagcagccaucugcgauguuucuagcucaggcugguuguuggacgagcuugcucuugguagguaucuaaugcugcccgcccucugcaauguuuccagcucaggcuggcuguuggacgagcuugcucuugauuggugucuaauccugcccaaaugcuuccucccacaggaugucuacagccucuaugagccucgauacaggcccuaugauggugcugcgucugcuuacgcccagaacuaccgcuaucccgagcccgagcggcccagcucccgagccagccacuccucggaacggccaccucccaggugcggccgcgcccacccuggcugccucucuguccuacucagacccaugucuguguugcuugcuauggggauaacuuagugacucaaaaaguucuguauuucugaagaauuguacaaacuuaucuaacauauguugacauuuucuugguauggacaaauuguaggguguguuuuuaaaugaaauuaaacacugccccagguggucauuagcugugcuggucaguuagcauuuggcgccaccccuacuggggccagacccugcucagggcugcagagaagcagccucugacuugucugugagccccucuugacggggcacgucuguugguccggccauuugcuaaugggguguucaggcuccccagagacacggcagcuuuucaccggucuccggaggccugggaggacuggucacagaggugacuuaauucuuagaccugucaggcuggcuacagaaagcagggcuugaaagccuguguuuccucuucuuuuuuuuucuuuuaaggcaggucucacucuguuguccaagcuggagugcaauggugccaucuuggcucacugcagccuugaccuccugagcccaagcaaucuucccacuucaaccucccgaggagcugggacuacagacaugccccaucaaacccagcuaauuuuguucauuuuuuuuuuuguagagacgagggucucacuauguuggccaggcuggucucgaacuccuggccucaagggauccuccugcccuggucucccaaagugcuaggauuacaggcauuagccacugcgcccggccagccuauguuucuccuugacauugccgccucugcuugaaggccagccauuccucuguuugccauuacagaagagggguuuggaaagaccuguggcacuguggcuucagcugaguagcccuuuaagccaggucagaguccuccugggcccuagagcagaggaggcuguuguugauuuucaucuccacucagggaggugcgcagagcccugcgaggggugggcgugguccuggccaccgcgcuaggcugcgccuuccagggccuuagcugcacuugcuccuugugagaucugagagagacugucucacagauagagccuuccugcaaggggauauugcuucuuaaacuugguaauagagaaaaagcuacucauuaaugaagacuuuguaccugcacuuguuuuugaaagguuccucgugcuuauuagagguuuuuaggagcuuaccuaaagacaaaggcucugucugugaaccucugcccacgcagcuggcccugguguacucggcuccaagggcaugcacugggcggugugcagcuggauguuggaggugcuuugugaagcaggcggcacugugaggcuucaccucucuggaggcuguaauugugagaaaauucccaggauuugagcuacugugugucacccugucaccugggaagcgggguuugaaguuaagaucauauuccgauucaaagccuuccagcuccgggugagggugagcagacagguguuuccuagaggcccugagaggcgagagcacggaggagagacagccagggagcauucucacuguuccguuuuccuucugcugcuggccgcccugccaggcucaccuaggaaccgauucugagaggccagugguggcucgugcuacggagaaggccuuucaccagaggcagggucaggucaccacaggaguggcuuugucaccagauccgcaggcuuacucuuccuuccuguguucggauccugcggcugccuucagcccuggcuugcgcaggcucuggggaauccuuucugcuccuucccccgcuuugguuggggagcacacgucuugcauguuuguucagccuccgugcuugugcguggcauggacucaacucucugggccugguguggucagauccccgcaggcacugccugucuuagccuuguuguuuuugagacuguguugcuccugaugaaugacugggguuggaaaggucggcugaggacacggcggcuccuuggaaaccccaagucagauaauuucuccagaaccugcuguggccacucaggcugucggucagcagggcucguuacuguggcugagcaguuggauguagggggacaagugggccgggccccaugccacccagcagcagccccgucucaugcagaggugcugcgccaaccgagcagccaaccucagcggcgggugugcagcucccgugaugucuccugaaggggcgugggaagggucacguuuuaaaaauuaaauauuguaugaaaauuauaaaaugcucuuacauccuuucaagagucuuuuuaggucucacccuuuuagccaggcuggagugcaguggugccgucauagcucacuguagccuuaaaaccugcugggcucaagccauccuccugccucagccuccugcauagcugggacuacaggugugugccaccaugccuggcuaauuuuuuuacuguuuuauggagacagggucucacuguguuuaccaggcuggccuuucaagaaucuugaagguaccagaaggucugauacuugaucauuguacuaacuugugcuucuccuguagugagagucaggaucauggcuuggucuacaaaaccagccuuucuggggcacguguaggaaucugacaccacgucagcuccaggagaccugagggggagguggggccauuagaaucccgcuccaggagcacacacacgggcucugacggggguacccugcacggguacagggaguaccaacagccaguggucuggggucgaggcugugaaacuggcauuuuagguugguuugaauggcucagugagaccgggcacugugggucacuccugcaaucccagcacuuuaggaggcugagguggguggaucgcuugaccccagguguucgagaccagccucggcaacauggugaaaccccaugucuaugaaaaauauaaaaaauuagccaggugugguagcgcgugccuguagucccagcuacucagaagcugaggugggaggauugcuugagccugggagguggagguuguguuaagcugagaucaugucacugcacuccagccuaugcgacagagugaaaccugucucaagaaaaaaaaagaaagcucaguccauuuuguccucuacugagcauaauaucaaaaauucuaggacuuauuuuagcauugacuuuuauaggcuacagcaaugagaacacaaaaagggucaguucuuuuuagccgaacggcucuuaguuauuuuaccaagaugaauuugaauuagccguauggugggaaauuccacagucucauccuugcuacuguuuugaaucuucuaauuggaauuuuuguacaaccaaagugcuuugaugaaugcccauugcuuugggaaugauuuguauuggcugaugucacacuuuaagaaauagguaauuuguguuuuaacagcacuguguguuuuuucaggcaaggauauccugaaggauacuauaguuccaaaaguggauggagcagucagagcgauuacuaugcaagcuauuacuccagccaguacgauuauggagguaugucaaggaacuccaagcagcuggccuuagcaggugccuugugcaaaagacacugaugacaugcagcccuggccagccagcaccugcuggugacuuccaggaaauguccccuuuuauuaaucucuuuauguuuuugcccaaaagccaaaauaguugaaaauacuuuguauuuggaaauaauuauauugauauuuuucauuacuaaauuacaucuuaaucuuagcaugagugcaucuuugucauauuggcagauuucucugauuuucuaguggaacauaacuagcaguucgagagcugcuguguccacacgugccuucguaaacauaaacggaugaaaaggaagugaaaugaaaaaccaucuccucggucccaccagccguguuucccgcacuccugaccacaggaggcuggcagcugcugccuggggcgguguggacaugggccaccccaccgggcagcgaccugggugcucccuggcgacguccagcugcagccacaucuguccuccaugcagugugugcggcacaguggccauguccccgggaagagccuccuccggucacuccugcccuggcuguggccucuagugcucugggcccugaauccccuugacaaguaucaaauauccucuuugauauuugcaccuguuuuaaauauaaauuuaaaaaagaaaagacaucuuuagaaaagaugauaaaagaccuuuuaagaacuuuuucuuaauacuugcuaaaaacacuugcugaaaaugguauauccaguuuguuuagagcccuuuuaaaguaaccuuuuaauauugagauuauuuuugaaaaccuuaugagucacauuaaggagaagaaauaguaguaaaauuuacaguuaggggauuaacuagucaaaagcagcaaccgugaaagagaacuggcugggcacaguggcucacaccugugaucccagcacuuagggaggcugaggugugggagaagcacuugagcccaggaguucaagaacagccugcgaaacauaguaagaccccaucucuguuuaagaaaagaagaagaaaaaggacuuaauaaagaaaucuuuuagcaccuuuucuaaaaauauuuuuuccuuuuaaucuaaaacacuuguauugagagaaaaaucagccaguugccuuuagguagcuagggcccuccagaucucauggcuuccuggugucgugcugguuuccaggaagaagcuggguuucucgaggaguccuuggagcauaaaguccugggguggugucgcuucuuuagugauaucugaggcauuucuucuuuugcauguuacuguauuaaucauuaauuccuugcucacagauccaggucacugggaucguuaccacuacagugcuagagucagggacccccgcaccuaugaccggagguauuggugugaugcagaguaugacgcauacaggagagagcacucugccuucggggacagguugguggagcaccccuggggaggcagaggcugggggcagccagggcgcgcuagugcuucucugcccucaugucuggguuuuaacaaagagcugugguaguuugggugagcaucugccugauguuuuggucccugucugaaaggaaggagggagcagacccucccaggguucccagcuuggacuguuagaggagaacuggccucagcaagaggacuguucagcaccucugggagcaccugggagauugggcucacucuuucucaucgucccuucuuaccggucgcgcccugcagcccagagaagugaccacacuggagacgcauucgcaguacuucucuaacguugcacgucagagggcccugagugucgggugugcuguguugugccucggccccaggggucucggucucagcuccugggcagcugcguggcacauggggacggggccuccggcacucccauuccucugccucugucccccggcuuccucuaggcccgagaaacgugacaacaacuggagguacgauccucgcuucacggggaguuuugacgaugaccccgauccgcacagagacccuuauggggaagagguggaccggcgcagcguccacagcgagcacucggcacggagccugcacagcgcacacagccuggccagccgccgcagcagccucagcucccacucgcaccagguacgcggcggcgccucacagacacgcggacgguuguguuuagaaccaccauccuguuugcaauguaccuaaaguuuuacugcugugccuggggaauugauuuugcccguuugcuuuguuuucuaagagucagauuuacagaagccacaauguggcugccgguuccuacgaggccccgcuuccuccaggcuccuuucacggcgauuuugccuacggcaccuaccgcagcaauuucagcaguggccccggcuucccagaguauggcuacccugccgacaccgucuggccugccauggagcaaggugugugcucagcaggacagagggauaccggcuaaccccacuggggcggccacccagccuggcaucugaacacgggagucagggcugggauuggaauugugauguccuggccuggcucugacccaauccguccuuccgagaagcagggugugucaggacgggccgaugcugucucuucgauugcaguuugguuuaaggccugagagcugcccugccugccccgacaugcguuuuaaagugugacucugaggacagcucauauccaggcucugggcagccccugaucacauccccaucgcagaccccguggcucagcaggcgugcaggagggagcugcucauuccccuuggagacuccgcuccugcaguugucccgcgugucagucagaguucccuuccaggaugcucaaaugcuuuuucuuggcaaauugcagaaauauacguaaagauauaaaguuacagaauuuaaugguaggcugaguuuuuuuguuuguuuguuuuuugguuuuuuugagauggagucucacucugucucccaggcuggagugcagugaugugaucuuggcucacugcaacuucugcaucucggguucaaacgauucuccugccucagccuccugaguaguugagauuacagguguuugccaccaugcacagcuaauuuuuguauuuuuaguagagaugggguuuugccauguuggccaggcuggucucaaacuccugaccucaagugauccauccuccucggucucccaaaaugcuuggauuagagugugagucacugugcccggccuuacuuucuuaaaguauuguuucaguuaacauuuuuucauuucuuuuuuuuuaagagacagagucucacucugucacccaggcuggagugcaguggcacggucauggucucugucuccuggguucagguggcccuccugccuuggauccuuucaaagugcugggauuacaggcaugcaccacuaugccuggcuccuuauuuucuuuuuugcuugagguguuuugcuguccuuuuugcugggugcuguguggucaucgcagucugaauuugauuuugugaaaauggaagagcucgggagugggccaggccugggaggauuacgcaccguggcaggagccucagggcggcucaugaggguguugcgggagcuuucucaguguacaagggaacagcuuucaugcuuaaugauucagacauuuuucuuuuccugacguaugcugaaguucuacuuuuaaguaugauauuaaacaauuaccgacuuuugaguuggaagucugucgugauaaaucuaaccugugauuuaagcugugugagcacauugaaaaucuaggcucagaagcaucagugacaagcugauuguuucuuuuucaauuuauuuuaaaugcaguuucaucaagaccaacuucuccugaaaaauuuucagugccucaugucugugccagguuuggcccuggcggucagcuuaucaaagugauucccaaucugccuucagaaggacagccggccuugguggagguccacagcauggagguaauggcacacgcagaagcguggcgucacugcucugcugcccuggggaacucucugcuuugcaguuugucaucuucaauugucagaccuugucucuggacauacguccuuggaaaauguuuauuccugugaauuuucaauuuguaggguuuuucuucuauuugaucauauauuuuuccuccuagaagucaguauuguaagcgucugccuuggguguucaacgugguuugauuguauaugcauuuucuguccucguuuuggggauguuugcuuuauuggugcuuuucaaugauagaugcagugggugggcccggugcugcccaggugaggggggcgggugggguggacgugcacggcgcugccgaggugacgggggcuggcaugcgccucuuccugcagcuucugcaggcuucugucacauguauugggguucugccucaguauuuggggagagaaaauggauuucacuacuuaaaauaaaguuugaaaucauggcugugguccacacaggccauguuccauguaacagccucgacagagccuucaccugcuguggggcggggcaggugggccaugccauccucuccucucacgggcagcauccgugccuggguuggccggccugccagcaggguggcugcgcacuggcugccacugacccacggcccucuccucguaggccuugcugcagcacacgucugagcaggaggagaugcgggcguucccgggaccccuggccaaguauguuccuuguugaggcauuucuuugugagcccggccuugcagacaucacugcucacuguguguucuuucugcagagacgacacccauaagguggaugucauuaauuuugcacagaacaaagcuaugaaauguuugcagaaugaaaacuuaauugacaaagagucugcaagucuucuuuggaauuuuauuguucucuuaugcagacaaaaugggguauguuucuuucuacuucuagaguguuucuucuugcuggucuucauuucgucuugggaaugcucagccucccgaaggagcagggcgggauccgcguggccagcuaugggagccucgagggcccccuuaggaagcacacuguaguggcuggguagggagggagagggaacgugcgguugggaugggaugagguuucagcccagccuugccagccuuucggguaguugugggucuggcuguguccaggguggggcuuugugccuguggugguccaacgcguccucaccugagagccguuguucuccuuccuguuccuguugacccaaacagaccgugguagggaccgacauugcggagcuucuguuacgagaccacagaacaguguggcuuccugggaagucgcccaaugaagcaaaccugauugauuucacgaaugaggcaguggagcagguggaagaggaggagucuggugaggcccagcucucuuuccucacuggugguccggcggcugccgccagcucgcucgagagagagaccgagagguucagggagcuguugcuguauggccguaagaaggugcgccuccucaucauggcaccuggcgccugcacauguccacugggucgggccuggugcgggguugcagccuucagggagggacguggcccccucuugggagcauccgcgcugcaguguggggcuucgggucuugcuguuuccugaacaaugccugacucuuguaugccauccuucuggagguguuaauguugguuuccuucuaacuguuuccaguguuggagaccugcagauuaaauuuucaguuauucgauaaaugcacauguugagcacaggccgugccccugcugugugugccaaaucucggaugaaaugugcaugacacaaguuguggcauucucacaaagucagacucgaguccacagcccagaagucauugggaguugggagggcacacugaaccugucagaggcgcagugcauggaaaggccaugggcaagagagcagccagugcguguagcguccagugacuggggucacagcagcguggggacuggggcagguggggggccugagacaggagccugcucugggacagugggguugggggguccauagugacugcagcagugacacuaugugcacaggaggggcugucuagggugcaugauguuugcuuuggaugugcuaagcaggagagaggccagucucagaagcauguguggcccugaacagcagagacaugggauaggcugagaguuuucuguccuuuuauaucaugauaaacucagaaagggcauauuugaccaguauuuuuauuuuuuuauuuuuaauuuuuuuugagacagggucucacucuugcccaggcuggagugcaguggcgugaucacagcuuaauguggccucgaccuccuggguucaagugauccucccaucucagccuccugaguagcugggacuacagcugcaugccaccacgccuggcuaacuuuuuuuuuuuuuuuguagagacgggguuucaccauguugccaggcuggucucgaauuccugggcucaagcaauccgcccaccuuggccucccaaagugcugggauuauaggcaugagccaccgcgcccggccugaucaguaugagucuauuauggauguuuuauaacugauugaagucauguaaccuguuagcuuuuauuaacaucuuucucuacuguaacguuuuugccucccagccagaaguucuaaauuaugcccuggaugauuuuggugaaaggggaggcugccuuacuggagucacucuccguguugacaggauauucgcggaggccuccuguuagaacuggggaguugacucgagcguguuucccaguggauggggcggcguggugggcagcgcugcgugauuagcccuguuugugauuagcgugcuuguguuuuaugcugaaaauggauaaaagcagcaaauaucuacaaauacccacuaccacagggacuuugaaacucaggaaaauaaugaaucgcuacgugucuuuagucuccaaauggugaauaaguguguuuuugaggccuuuggguuguuuguguaucugcugcugcgugaggacacauggccugucuugacucaugucacgugagcgccgccgauaacccaccaaggucccugaaaugccuuuugcaggaugcuuuggagucugcaaugaagaauggccuguggggucacgcucugcuacuugcaaguaagauggacagccggacacacgcccgagucaugaccagguacagucccacaguggccugguccaguggcgagcccugcuggcucccuguagcacgcggcguccgcacccugggggcaggcggcaggcggaucucacuugacugugcugugcucccacacgaacucgggcuuccuuggccucgaggcuuccuugggucguguuguggagagcuuaaaaaguuuuuaauuaacugcaugguuuuuaguacuucauguaaaaucucagugaauuccucagucuucaucuuuuauagcuuuuuuuaaauuuugaguuuugcucuguugcccaggcugaagugcaggggcgcgaucucagcucaccgcaaccccugccucccagguucaagugauccucacgccuuggccucccaaguaguugagaccacaggcacccaccaccacacccagcuaauuuuuuguauuuuuaguagagguggguuuugccauguuggccaggccggucucaaaacuccuagccucaagggaucugcccgccuuggccuucugaaagugcugggauuacaggcgugagccaccauaccuggccuuaucuuuuacagcuuuuuuuuuuuuuuuaauauugagauaagaaagaaaaauaaaauauugagauguguguacuuugccuaagugaaauauaagucuaaucauuacaucagagggcuuagggcugauuuuuuaaaaaauuuauuuuauuacuauuuuauuuauuuauuuuuuugagacagagucuugcucugucacccaggcuagagugcaguggcacgaucccagcucacugcaaccucugccuccuggguucaagcgauucuccugccucagucuccugaguagcugggauuauaggugugcaccaccacacccggcuaauuuuuguauuuuuaguagagaugggguuucuccauguuagucucuuaacuucugaccucaggugauccgcccacuuuggccucccaaagugcugggauuacaggcgugagccaucauguccggccggcuuuuuucuuuuagcugagccagcauggggucuuucuguguuuaugucugccuagguuugcuaacagccucccaaucaacgacccucugcagacagucuaccagcucauguccggacggaugccugccgcguccacggugaguggcacugccugguggcuugcacaggcuccacugccuguguggaguuugcucgugggugacgcugucacaggccgugaggugccuggugagcccagcuguguggaauugaaauggcgcuggcuuccggggaugaggcuucguuuuguuuuuccucauguuagugcuguggagacgagaaauggggagauuggaggccgcaccucgccauggucuuguccaacuugaacaacaacauggacgucgaguccaggacgauggcuaccaugggcgacacucuggguaggucagggguggagaugggcauugggugucgcggauggagcgccgaaggcccgguugucuguggcguuggcagaaaucaccagaacccggccuucucgguccggcuggcgucucuggugccuucugugcgcguccuugacuucugcaagcgcucccggucgcugagcccccgccgugugucgugucgucucuccgcagcuucaaggggccucuuggaugcggcccacuucugcuaccucauggcccaggcgggauuugguguuuacacgaagaaaacuacaaagcuugucuuaaucggauccaaucacagguaaagaaccaagucaguguaguccuguaaguuuuccuuucaaaguaaaacaaaauccuucuccuuuagugaauucagaaauggccagaaucaugucuuuauuugucacguggugggacacacuucuggaugauuugcuccaagguugacuaugccaauaauuggccauuuuuuccaaaucaaaauaauucacuuccucuacaguuugccauucuuaaaguucgcaaccaacgaagcaauccagaggacggaagccuaugaguacgcccagucccugggugccgagaccugcccccugccuaguuuccagguaagcaggugcugccagccugcagcugucauggcugggcaggcacucagugcuaacaagcuuuuggcuacuuagauuguuugaauugguaucgaaaaaaaugaugugaguuuuuugggggaggaucuugagaagacauuugaucuaaaaugcuaagaaacaagaucccauugaauugaggcuuuccguuugcauuugauuucaauuauuuucaugagcuuuuuuuuuaagggagacagggucucacucuguugcccaggcuggagugcacuguuuugaucacucccaggcucaagugauucaccucagccuccagaguagcugggacuacaagcagcacuaccaugccacacuaauuuuuuuuauuuuuuguagaaaaaaacuguguugcccagacugauccuaaacuccugggcucaagcagucauccucucagccucccagaguguugggauuacaggcgugagccaccgcaccuagccuguaugagcuuuuuuuuuuuuuuugagaccgagucucgcucugucacccagacuagagugcaguggcacgaucuccgcucacugcaagcucugcuuucugaguucacgccauucuccuuccucagccucccgaguagcugggacuacaggcacccacgaccacgcccggcuaauuuuuuguauuuuuaguagagaugggguuucaccguguuagccaggauggucuugaucuccugaccuugugaucugcccaccucagccucccaaaguguugggaugacaggcgugagccaccgcgcccagccguacgagcuauuuuuaauauuugagggcgguauucucugaugcaguguggggguggugucuauaaaacauacaugagaggcugagcauggcggcucaugccuguaaucccagcacuuuaggaggccaagguggguggauuaccuaagcucaggaauuagagaccagccugggcaacauaauaacacccugucucuacaaaaaaaaaaaaaaaaaaauacaaaaauuagccaggcguggcagcaugcaccuguguucccagccacucggaggcugaggugggaggacugcuugagcccaggagauugaggcugcagugagcugugauugugccacugcacuccagacugggugacaaagugagacccugucaaaaaaaauaaaaaagaaugaaguaucuagagaaugucuguggagcagcuuaagcuacacggaaggcaguggucucagugccgugcucuuggggcguugugacugugagagccgaguggccccaugaaagggguuggggggaaagcagagugaguuugcuaccagcuuagucguuuacuuugcucuugaaaucccuuggggaacagggacuaggacuguggucagcgggcguggugggugggagacgaugaugagugaaguguccagaagaguucacagcucacagggcgaugcucggaugcaggggagccucagggcaguacaaggcuuuguccaucggcgaugcucggacgcgggggagccgcagggcagcaaggcuucugucguuucagguguuuaaguucaucuacuccugccgccuggcggaaauggggcuggccacgcaagccuuccacuacugugaggccaucgcgaagagcauccugacgcagccgcaccuguauuccccgguguugaucagccagcuugugcaggugcugccccuggcgccuguccucgggaugcugugcugacugcagggaaggagggcuugccagagcccccgggcauggggguagcgaugguucagacgcgcauugugguaggcgcucagaaccugccucuugggcggauaaagaucuuugaauggcuucguguuuugcgucuuagccugggaacucucaggcaccgugugccagcacagagccuuggcagcgaguuucacaaucagaaggaacuaccuguaggauacucuucuuuuauugagacgcagucucacucugucacccaggcuggagugcaguguggugcaaucucggcucaaugcaaccuccgccucccagauucaagugaugcuccugccucagccucccaaguagcugggauuacaggcgccugccaccacgcuuggccaauuuuuuguauuuuuaguagagaugggguuucaccauguuggccaggcuggucucgaacucuugaccucaagugaugcaugcaucugccuuggccucccaaagugcugggauuacaggcgugagccaccacgcccggccaggauauucuuauuuugaggcaauuuagucuggugguugauagcuuaaguguccagaguccagcagccuuugcuugaguccuggcuguacugcugcaggccucaguuucuucgccuguaaaacagaggcggcaugacugacgagaguaugggaggcgcccguguugcaucaggaucuucaccucuugucaguaguuccauuugugagaacgugcucaugggauacccaaaaacuguauuagggacauuuuuagacccauuucaaaguucagagagucauucaugcaugcguccuuaggugcucaucccccaccuuagugguuacgaacacagggccaaacuuguguucugcccccucugucccgcucugcaucccccaaauucccgaugaaagcaugcagacauuccugggggaguccagcuuuugcugagucagguccacguggucaggugguagucucgggccaggccuguuccaggggggugccuagcacugccaacccagugcccgugggccaagaggucgucuacagcaacuucccagucacccagcgucccaugugcuguguaugucaccuaagcacauacuagaaacauauaggcagcuaauuaaacuuuauugccagugaacacugaagcugcauugcccggcauuuugaagacggcucacuugccaucacccgguggugacaggggccuuugauuuuugcccgugucuagauggcuucccaguuacgacucuucgauccccagcugaaagagaagccagaagaggaguccuuggccgcacccacguggcugguucaccugcagcagguggagcggcagauuaagguacagccuuggcuugggguggcacagaggcgucuggcaagguggcuucugucccugucauuuccacacugaaaguauguaucuguaaagacaguguaacugcaaacgugugccuaugagaauucccuaauuccccagaaagggcuuugagugccuccuguccugaaguagggacacagcaagcgcggugguggcaggcgggcagcgcugcagagcggccacaggcggcuuccacagggcaggucuuguucucccucaggagggggcuggaguauggcaucaggauggagcccucccgcagcaguguccuggcacuccgaguuccgagauggagcaguuggacaggccaggacucagucagccaggagcccuggggaucgccaacccucugcuggcggugccugcaccgagcccugagcacucgagcccgagcgugcggcugcugcccucaggugagcccaggugcgcggcugcugcccucagacaagccccugcuuccugugggcugagccauggccugcacccuugccuccuggagaacugcuuucagauguggacuguuggaggcagugucucacaccaccucggugguuguggggcuccucggucuccucccucuucccuucaugcuuccuccccugaggagcccauggaggggaggcucauggcuuuccauguccauaaauauccaugugcuggcgacacugcccugagcgcccgcugccugcucagccucccugcuuguuucuccgggagccucagccgcaccgugucugggcggcgcccucggcugugccccucuguaaccugcuucucccagucggccccgucgguggaagggccagcccagagcuccagggagucaaguccagaugcccccuccucucucgcgcuucucggcuuccuucgucagugaaccucaccagcgcggccugcacgcagguccgcaugccuggaugagcacgggcuccuuccugcucgccuccugcuucuuccccagacccuccagacucuccaucucaccugaggacaagccaggguccucacgguggccacaggcccuccaagcuuggcccugagcccuccugcccucgugccauguccacucccacgcuguggaccagccacacuccugauuugggcccacugcccacccucccugccugauguccagucugcuucguccucagacaccguuaccacuuccugguugauugcuguccuuagcgcuuucucuuacucaguucaucugucccgacccccaugaggacccagcauuucuuuuguuguugaagcauccagggcccagcauggugcugguaggcagcagcccucucagguuuuauguugagucggaagaaugaaggaaugaacgaguggccugugugaccccuggccguggaggaggggacucgggccuagcagagcucugugccaggcggccgccaugggcuugcgugugggccgggcccuggagcccgcgugccgcugugacugcucaagugccccuccccuagaaaaggaagcggauacucugcuuuucugcaaaccacggauggugcgguggggugguggcuucaggcuuucugcucuguuggaccucccuuauaaaagaaauggggcuguacaaaauaacuugucauaaacacgucgagugucagcuccuuccaguaacucaagcuacccucaguaaccccagaccucuucuccaccguucccaugcagcuccgcagacgcucccugacggcccauuggccaguccugccagagugccgauguucccagugccacugcccccggggccccuggagccggguccuggcugugugaccccagggccugcacuuggcuuccuggagcccuccgggccuggccucccaccuggugugccaccucugcaggaaaggagacacuugcuccaggaagccaggagcccagacccagguggggcugcagagaugcugucucgagagcagaagcagcauggggugugguguuuguggggauugguggaagagauugaaguuauuugagcuugaaacaacuuacauuacuugucuuaacguagaccagaaauucuggaaguuacagacuggauggguucagagucucacuacaacagcaguguuaaugccaguuccuuuuguaacuuggcuuuuuguugugaagcuuaaauggccauuuggggcagggcaugguggccaugggucuccuggggucugucuuuagacggcccugcuggacgccuggugagaugcacaggggcaggucaugaacugucuggaacucgauuugguggaucuugucccuggucugugccuaugucuacauguguguauauggacaaagcaaaacauaggccuaguuuuaaaaaugaaagagugugcacacaugugggaagauguucagccuugguuucugcagaucaugcugguguggcgguagcugggugggaagguggugugccuguugaucugugcgccacacacacgucccgccuucucgugacugagaucauaguugcucucuuucccguugacagggauagugccgcaggaggcgccuguuggaaacucacuuuccgagcuaagcgaagaaaauuuugauggaaaauuugcuaaucugguacuuugucacauuuucuuaaacuguuuguuuuccauaaaguucaucgagugggcacccagacuccuuguugaguuguaagaugaugguagugaggacuaugaaauuguuucuaaaauuguuucuuaaagugaaagugcuucuaaauagcuuucauccuuaaaauaugaagaguuggugaaaacacuggcagggaaagauggggaagagagaauucaguaguguaaaaacaguuacuuuaaguagaagaaauacccaaauaucaugaaauccccuuauuaauuuuaauucuuccaaaauggguaccuucucugauuucuacaucucuuuuucuuuuuuuuuucuuuuuuuuuuuuuugagacagauucuugcucugucgcccaggcuugagugcaguggugcgaucucggcucacugcaaccuccaccuccuggguucaagcaguucugugccucagccucacaaguagcugggacuacaggugugugccaccaugcccggcuaguuuuuguauuuuuaguagagaugggguuucaccauguuggccaggcuggucuuaaacuccugaccucaugaucuacccgccucagccucccaaagugcugggauuacaggugugauccaccaagccuggccuuuuuuuuuuuuuuuuuuuuucccuaagacauaguuucgcucugucgccuaggcuggaaugcaguggcgccaucuuggccacugcaaccuccgccucccagguucaagugauucuccagccucagccucccaaguagcugggacuacaggcaugugccaccaugccuggcuaauuuuuuguauuuuuugguagagacaggguuucgccauguuggccaggcuagucucgaacuccugaccucaagugaucugccugccucagccucccaaagugcugggauuaaggugugaaccacugcaccuggccaucucuuuuuuuuuuuuuuuuuuuuuuuuuuuuugagauggaguuucucucugucgcccagccuggagugcaguggugcgaucuuggcucacugcauccucugccucccagguuuaagcaauucucugccucagccuccugaguagcugggacuacaggcgcccaccaccacacccagcucauuuuuuuuuguauuuuuaguagagaugggguuucaccaucuuggccaggcugaucuugaacuccugaccucaugauccaccugccucagccucccaaagugcugggauuacaggcaugagccaccccgcccagcccggccgucucuuuuucuacaguagaauuucuuuucuaauuuuuugaucucacaagaggauguccuggaauucaguagaauuucuaacauugucacugguuuuccugaaagugagauuuaucucauuagacauguuugguauaaauaccuccucuguuugcucuacuccuaaccaggagggaugguugcuuuuauacagaccgcauucuggaaccuucuuuacagauacccagcccuucacgggcaucccaucaguaggcgauugcuauaguuugaacuugcauuagguguuuuacccuuuaaaauacugugucccuggaaaaguaaaaaugaggguugagcuauuaaaaauugggacuugacccaggaauaaauauuuuuaaaaaucauuguaucuuugagaacacccaucgccccccucuggccagucuucccucagugcaugcucacacuccguuucuuccagcccggaaucuccaucgaacgcccucauuugcauucugagugcugagugcucccagacggagcugcuuauuaagugcggcuggcucuucucuagucaggccagguagaggcucugggaggcccagucagggggcugcucuccccagcccccuuccugccucccucuggucaccagagucauccggccucucagugauguauuuaggaaacacgccuggggaauugcaucccccucucucuuucgguuccugugaggagccccaggagagccuguucugcauuuccuugcgacagacccccucgaggacggugccagacucggaggcccccccagggugggaucgugccgacucgggucccacgcagccaccucugucucucucacccgcucccgaaacaaagagacccggacaggcagccaagaaagaaacgaaggaaccuaagaagguaguacagccugcccacggugcgccuggcggccgggaggguuugggcaggaggcacgcuucccagagcgccauccucuuaauucaccacacaugcaaauagccuccugauacaaacagccgagugucuacagugcacacggcaugaugggugucuguguauuugugccuucagauaauaggauaauagcccacccaggucagcauggggacacagcccggcccccagaggucgccucuggccacuaccugucagacccacccgcaagggaccagacggcagccgcugcuuugucacuguggugugugccugcugccggcucacagauccuuucucccagccguggacuuugggacugcuuucaguguggggcugggauccgucaggccccaggagccuccuugccuaucuauuggcgaaugcgcuuguuuuucuuaggugcgugccaaggagcugaggguuuagcucgcaggaugagcguguguucagcuuuaggagacacugcugagcaguuguccuaaaugguugguugccccaagucacacauccugcagcagaggacaagggcccuggauaucccucaucuucaccaauacugggcagugccgguucuuuaacuuagccauugugcuggggcugaugacaucucauugugucuuccucugcaucuccacagcgaggugugacgcugggcaccuucucgugucccuguuaccaucucaccacucuuuuggggcagugcuuguucaagucucuauccguuguuuuuuuuuucccccauaaagauggggucucacuauugcccaggcuggucucaaacuccugggcccaagugauccuccugccucguagcugggacugcagguguagccaccacaccuggcuuuccuuuccauuuuuaaugguguucucuucaggacuugcaggaguccuuucuguauuauggauauaaguccucuguuagguguauuuauugugauaucuucucccaaucuguagauugccuuuuuacuuguaaugguuuuuuguuuguuuguuuguuuguuuguuuugagacagggucucacucugucagccaggcuggagugcauuggcaugaucuuggcucacugcaaccuccgccucccagguucaagcaauucuccugccucagccucuccaguagcugggauuacaggugcccaccccacucccagcuaauuuuuuguauuuuuaguagagaugggguuucaccauguuggccaggcuggucucaaacuccugaccucaagugaucugccugccuuggccucccaaaguacugggauuacaggugugagccaccaugcccggccuaguaaugguauuuuaugaaaaauaucauucuucauuuuaauaaaguucagugaucagauuuuucuuuuauggcugcugucuugaaaauaaacacacauuuaauuccaaauuugugugagcucugagauaaaacaugauacuugagcagguuuccagugcauaggcuaucacaggccuccccgggacagcuugucuggccaguagaacucacagagaaacagaauugaggguguguaguagcugcugaggcuucuccucuuucuucaguagaagugaagugcaucaggccgggcauggcggcucacaccugucaccccagcacucugggaggccgggcgcagcagcuccugccugucaccccagcauucugggagucagggugcggcggcucacgccugucaccccagcacucugggaugcugaggcgagcagaucaugaggucaggaguucacgaucagcguggccaagauggugaaaccccaucucuacuaaaaauacaaaaauuagccaugcaugguggugggugccuguaaucccagcuacucaggagguugaggcauagaacuacuugaacccgggaggcagagguugcagugcgccgagaucgcgccauugcacuccagccugggggacagagcgagacucugucucagaaaacuaacaaaccaaaaugaagugcaucaugugaagaauaaaguaaaguuuccuaauaaccgaauucuccacacaugggaaacacagagggcuguaucugccuccgacacacacugacuuggacagcccgccuuccacuucucaaaggggaggacgucggaagcuuugucaguguuuagacguaaaaaguuccugaaggcacguuacuguucugaccuauuuaaaugacaguaaaauacacagaacaaaaugcacauuuuuaccauuuucugagugcacaguucuguggcaccaaguacauucacacuguuguguugccaucaccaccauccaucuccagaacugucucaccuucccaaacagaaacucugucuccuugaaacgaaacaacucccgguucccucccaccuccauccuccuggugucucuggaucugcuucccaccuccauccuccuggugucucuguggaucugcuccccaccuccauccuccuggugucucuguggaucugccccccaccuccauccuccuggugucucuguggaucugcccccgaccuccauucuccuggugucucuggaucugcuccccaccuccauccuccuggugucucuguggaucugcuccccaccuccauccuccuggugugucuggaucugcuccccaccuccauccuggugucucuauggaucugcuccccaccuccauccuccuggcgucucuguggaucugcucccaccuccauccuccuggugucucuguggaucugccccccaccuccauccuccuggugucucuguggaucugcucccaccuccauccuccuggugucucuguggaucgccccccaccuccauccuccuggugucucuguggaucgccccccaccuccauccuccuggugucucuguggaucugcuccccaccuccauccuccuggugucucuguggaucugcucccaccuccauucuccuggugucucuguggaucuggcgacucuggggccucacagaagugggucauguagaauuugucuuuuugcccuggcuuauuucauggaacauaauguuuucaaaguuguucucguguuuuuuauauuuagggugaauccugguucuuucguuggcuaccuggaaagaaaaagacagaagcuuauuugccagaugacaagaacaaaucggugagugcugucaaauacgcacgggacguccgaagaauuguaaugauuuuucugucacuuucagagcagaccugaguagguguuuccugaaguuuugaagugucaucauuaaucagaugcuaauucuguuuagguucagucugcugaccuuuuuucuuuuuaaaaucuuggcagauuguuugggaugaaaagaaaaaccagugggugaauuuaaaugagccagaagaggagguaaauugucauucuaguuccuguugggugugaggugugaguggagggaacagccucauguggcccugugauauuuggguggcuguugccccuuuuggagccuccugacugugccaucccaguggguuucugugcacacagugggugucugaagcuguguuucccucugcagaagaaagccccgcccccaccuccaaccucgaugcccaagacugugcaagcugccccgccugcccucccagggccuccuggagcccccgugaacauguacucuagaagagcagguaaggguggccuuggagugggagcuugcuugaacgauuaacugucccagagagagaggccaauguguagcuguugugcguggggaggagguggcuucccgcacgucccugcgugcuuuuccucugacgcagugagcgcagagcauuuggaagcuggaggccaccuggcgcguucaccucaauuugcuucccuccccuuugcagcaggaaccagagcucgcuacguugacguccugaacccaagcgggacccagcggagcgagccggcucucgcuccugcggacuuugucgcuccacucgcgccacucccaauuccuucuaacuuguucgugccaaccccagguagguagcacgagcaccagccccuccaggucagcccccagucuccugaccuuugauccucuuucuaugagucucuccuaaaucucccguuaaaagaaugaccuggccagcaugcagagagccugggguugguuugugguuuuuuuuuugauuugccuguuucugcaugagugugccgcgugugcagugugaaacucucuuccucucggagugucuucagugagaccccagggacguucgggacggaaugauggccuccucgcucucucauccccagaugcagaagaaccacagcuuccagacgggacuggcagggaagggccugcagcagcuaggggccuggccaauccagagccugccccagagcccaaggugagcggguacggugggaaaggggaaagguacccagugaggaggcaccuccccauccugccagacagggccuugccuucugcaagucaguauccaauguguacguagaguguuccgccuuaaacgccucacacuuauguaugguagagacggaagguagaaugcagggugccgggcgggacagagcuguuugggaagacggagaucuggggauaguggcggugaugguugcucagcacggugaaugugcuuaaaacuuaaaaaugauuaaaguggcaaauuuuacaguauguauauuuuacaauuuuuaaaauuggaaaaaguaaaauuaauuacucuaaguuacagagaaauuaccuaccgauaauaaaaguuaaguauauuuucauccaaaaaaaaaaaacaaaaaacaaaugacucccaugugaaguagaacagcucagaccagucgggagugguggaugaugccuguaaucccagcucuuugggaggcugagcugggcgggucaccugaggucaggaguucgagaccagccuggccaacauggugaaaccccaucucuacuaaaaaaaaaacaaaauuuaccugggugugguggcgggugccuguaaucccagcuacucagaaggcugaggcagaagaaucgcuuggacccaggaggcagagguugcagugagcugagauugcgccauugcacuccaucccgggcaacagagccagacuccaucucaaaaaaaaaaaaaaaaaaaccagcucagacugcacucuguacggugggacaggccugggccuaauccuguucuccauucaucagcuguguaaagcauggggcagucacucaccugucuaagccucaguuuuccccucuguaaaaugggaauaacaguagccccagauugcaagccugucaugggcacacacaggcaccugguagagagcugcaggggucuagagucaacaggguugugcggcuggacccacgugugaggcacuuuucacuucucucugaggagcacuuuacguggaagagggcguuuguaacccaggccagaacaguuucauauuuuuuggccuggugugagagacuuaaauucccugggauuugguugcugcaauucuucuuuuccucggcagguuuuaagcucugcagcgucacucccuggcucugaacuccccuccuccaggccugaggguucccagggaggagagguaaggagugccgacgccagggccccccgcagcccaggccuccccagcagcucacuguccaggcgccucuuccuuuauggaggggcgguacuggguaggaagaggcaguuuagaaacaagagcaccucgaaggugguguuccugggggaaaaaaaauugcacuuguuuuaacaaaacuguuugggagcuccaggaggggugcaggggguuugaguugucgccucagucccgguccucucccuucaacagcacgggaauugucuugaauugugaggugucaggaggugaagcuggcuuaggccgaggcuggacuuuuccucccagcccuccccuaagcuaaugguuguuucgggauaacagcuuuacauuaagacaggaaucuuaagcuaacacuggcuuuuuuuucccuuuugaguuauguugauucuaauggcaucacaaagcuuuugaaauggaacugacagcuuggauuggacagugacgugcauguugacuuucguccguguuuuauguguguucuugcuguuuuguagcuuucgcgcuguaguucaaugaguucauuaucacgugaagugagccagcauuuuaaucagguaccugcggcuggugguccucacuaacaugagagcuggcgugugccgccuguguuccugagcacgcggugccgguucgccacgugcgcuuugccacuaaccucgcccguugucucccucagcgucacgugaccaaggguacaggguuccuuuuuuuuuuuuuuuuuuuuuugagacggaguuucgcucuuguugcccaggcuggaaugcaauggugugaucucagcucaccgccaccuccaccuccuggguucaagccauccuccugucucggccuuccugaguagcugggauuacaggcaugagccaccacgcccagcuaauuuuguauuuuuaguagagacgggguuucuccauguuggucaggcuggucccaaccucaggugauccgcccgccucagccucccaaagugcugagauuacagcaguguuccuuuaaauggccuuaaaggggguuuugcuguucagucuccacauacauggggcaacuggaucgacccugagguguccuagucaaugaguggguucugucauuuugcucuuuccaaauugguuuuuccaaugacgggccugggucguggccucgccgagugaguguuuccccggucaggaugcucuccuuuggaaggaagauugcuccuuucugaucaagcaugagaacguugguuugaggccggggcgggugcagcagugaccugcggccaaugugggagggaggugaacgaacgcuucaucuucugccuguccaggcaccagcugcagccguggcucagcagaaaggcuugcagcgacccuuccgccugcaaaugagagcccugggccucgugucauggcuggagccuuagagcugcagccgugggcaccuccucaccaccucgcacgcucggugccaccucagugcugugugcaccuucccauugcauguuccggugcuuaaaacauuggcucugcacguugcuuugauuuucaccauuuuucucugaaccauuaaauaacuaaauccaguguugcaagaagugucuuggaucugcuucuguagcuuauguaaaaguacuguaaaucccacccagaagcggugucuguaucugcacuugaagugacagcugcugugcagcgcagcccugcugaggugacuucucugugcuucucaggcuccuggcgaccucccugcugcagggggcccucccagcggggccaugcccuucuacaacccugcucagcuggcacaggugagugacuccuaccuuucccuacgagacccuaacacgcccacugacgaccugacccugcugcucagugauggcagcuuucugcccuagauccucuuuuucuuucuuuuuaaaaaauauauuuauuuauuuauugagacagggucuugcucuguugcccaggcuggagugcaguggugcgaucucugaucucagcucacugcagccauaacuuccugggcugaagcaauccuccugccucagccuccugaguagcugggacuacaggcauggucagcacaccuggcaaauuuuuuauguuuuguagagacggucucaccuuguugccuaggcuggucuugaacuacuaggcucaagcgaucuucccaccucggcuucccaaggcacugggauuacaggcuugagccaccgugcccagcuucucuuuucugaaugaaaguugcacaccuacuggguggcaguccacagggcacugugaggagccaggcugggcccuccccggcugccauuucucccuuuguguggacaccaggcccaccgugcucagcucugcguggacaccaggcccgccgugcucccguguggagcucugucgacacgaggcccuccgugcuccuguauucgcuuugccuuuuccuagguuguaguuuguaaaaugugcuuggcuuucuacuuguguaucccucauucagcccccagcucugccacgucugcuauucuguucuccuggagcccguggucucugagccgagcgugaucucuccucccuuggcccgggcacccgggucuccccggagugggucccccagcuuuggaauccuauguugcugccuuucuuaguuacucuguuugucuuggugacacacauccucugguagcucuugcuuuuuuuguauguuuuuuauuucuuuuuccuaauagcuucuugacagaaaggucccagggugacuugggagaugccuuucacgucuggagcugccuuucuccuccggccuaucuggcuggcugguagaauucuugggccaaagucacuuucuucagaacugcaaguggccuuagguuuccugcugccugugguugcugagaccccagggccguucugccugcagccccuuucaggguccguuucccugggaccuggagggcuucacccucagcccccuugggccugacugcaugcccuucagcuggggaguguucuagaauguuuccugugguuucccucccucagccucgucucuccuccccucucccuugccuguggaguauagacuggcugccaguguaggggagcugagcgggguccaaggucuggggccucuugggauucagccccauugucaccccagccugcccucacagccucacacacucuugacugcaggcuuccugggcuggggcccagcacuccugcccugguccucuacaaacgaggccgaggcucccaggaccacugcccccaagcuggccccuggcugucaccugcuuuucagcauccagacuagucgauuuugguauuguccugcucccuuuaccaugugguuagugccuuuacaaaaauuccuuggcuuuccccuccaugaggcuuugcgagggagcaagaguggaugccugcauuggccagcugucugcaacugagguccccgcgucccaugcaguaggccaggccuggccaccacuugucccuggacucuggacagccaggcuggcucugcagagcagcuccaggucucauggcccugaugaaaccacggcaccuccuggccacccucacaguaaacauugaugguuaaggauacagugcuuucaagggagcccaggacuuggcacugacuugucgguuuccagaggcuuuuggaaacaaaaacgaagccuucagcuugucagcgccaauggcccgugugguucauuauguggaccagccccugccacgcugcagccgagcacugcucacccugggggcaggcaugcagaggucaugcuguugauuucauuccaggccugcgccaccuccgggagcucaaggcuagggaggauuggccagaggaagcaccuggugcugaacuaggcuugcccugcugugaacuugcacuuggagcccugacgcugcuguucuccccgaagaacccgaccgaccuccgcgaucuccgucccgcccccagggagacacagcagugacucagagcuggucgcacacugugccucccuccucaccgcccaucguaaugaauuauuuugaaaauuaauuccaccauccuuucagauucuggauggaaagacugaaucuuugacucagaauuguuugccgaaaagaaugaugugacuuucuuagucauuuaggaugauuuaaggauauaguauuccuggucauuuaagaauguucauucauugaagccggagcugucucugccacaggagagccacauggucgguaguaaccagggccucuccaagcccagcugugagucacugcccagugagucccgcgcuuccuuuaaggugcugggagcaaagagagggugacugaggcagaccccaaccccugcucugcaccaucugggcccucgccguguuugaaccuggcugaaugaguggagggcgcuguguucucaaucagcgccuccgaggagccgugggguuccuucggcauuaguucacgguuuuugagagaggccuuaguuacugcagugaauuucuuuccuguugcaaagacgcuuccagccucacuuuacuuucuguggccugaugaggaccaugggugauuuuguguacccaaagcgcuggggacugcccaccguguggcccagucacugggaaggagccccagagagccggcugucugacaugauggcucaggguggucauccagguugaaaacugaccgugugauguuugauuugggcuucauuucguguguaggagcacgguuagacucacuguuaaggaagcuggaugcacuucucuaaaaggcugcacuuuccgugagcacuuuucgugguacaauccacaugacccacuuucuccccugggggacguugguucagagguugguagcacuuggggagaguaucuuaacacaguuucuugacagcagcucuggaacuuaguauuucugccccgaguuuugccacacugagacuuugaguagcuccugguggacucaacccuguucaacucagagacgggccuccucucacugaugcaaagcuuuaaggcuucucugacuguucugaaacucuucguauucuugucaagucuaaagagacugaagaaaagauuuaaauacuaauaaaaaucaguagauaauuucuguagguucugcuggaggaauacaaacuguuugguguuuuaaauuuaaguguagaaauuguagaauguggaauuagcacagauccuuccuggcuuucuguuucacuugaucauuuagcccagaccacccaggauguuuuccaaaauguuccacaggcgugucccgcuggauccauuuguccuugucacuuggagaaaggccagucccugugacggggcagcccucucugucccucggucagcucgugugaauccugggaccucuuccggucggcucugcccgcuguucuggggucgacugccacgacuuuugauucaagaagcuuccuccaggcgggagcggcuauuuuuccuaaaugagaauuguuacauugcaaauuguugaauaaaauauuuugcgcuccuucaagcaccuucaccugugguucccuuugguuugcuggaagcgagugagugcagguguccgcaggccucggcgcuguccuggaccgcacccagguccucuccggggaccugcaccugccucgcugggaccugccggacugcggggcugccggguugggaggggcgugggagacccguccggguccggugcggcgcaguccuccggccgccaggggccgcugugggcggggccggggcgcggggcggggaccgggcgcggccccgcggcggcgguugcugggucccggccgggcugacuccgcuucugggcggccgggccuccgcgaguaccgggucgacuucggagucugcgagcccagccaggggugcccgcuucccaccccucuccccgagcggcguccccgucggggucgaaccucccccgcgacaggcgcccagccgccuguucccccaggccuugccugcggaccgcccugggaacggcgucugggagccccgaggggcuggcgggacucggggcccgggccaugcggcagccgcccccgccccuccgcgaccauccccggcccaagcgggagccgcagcggcguuucugcuccucgcugcgccggcgaccccggacccggcacccgugaccccucgcgcugccugcggccucgcgccgaggccugccccgggagagaccguccaugccguccaaggcggagaaucugcggcccuccgagccggccccgcagccgccggaagggaggacgcuccaaggacagcuucccggcgcuccgccggcccagcgcgcgggguccccacccgaugcuccgggcuccgagagccccgcgcuugccugcagcacuccggccacgcccagcggcgaggacccgccagcccgagcagcacccaucgccccgcggccccccgccaggccucgacuggagcgagcccugucccuggacgacaagggcuggaggaggaggcguuuucgaggcagccaggaggaccuggaagcccggaaugggaccagucccuccaggggcucagugcagagcgagggccccggggcccccgcccacagcugcuccccgcccugccugagcaccuccuugcaggaaauccccaagucccgcgggguccugagcagugagagagggagcccguccucgggggguaacccucucucugggguggccagcagcuccccgaaccucccgcacagagacgccgccguggcggggagcucgcccaggcugcccagccugcugcccccgcgcccaccgccugcccugagccuggacaucgccuccgacucccugaggacagcaaacaaggucgacucggaucuugcagacuacaagcuccgcgcgcagccgcuccuggugcgggcccacagcagccugggccccggccggccgcggagcccccuggccugcgacgacuguucccuucgcucggccaaauccuccuucagccuccuggcgcccauccgcagcaaggacguccgcagcagguagggagggccuggcgggugcagcgcccgcgccgccuucguuguaguguucaggcugcuggaaccucgugagaccguucccaucagcagcguuuaagaugccuaaccggaaagaacgaagcgggucucccgcagccaccccaucucccagccccaccccacagcagcgcccuucccagaacuuuuccugugcguuucagaaccauucgugggcgugacguuguguuaagguagacaggauggcauccugcauacaauuacguaucuggcgcuuuuucuuguuuagucuugggaaaugucgucaauguauacgauccgccccuuugguuguuuuuguuuguuacucucucugucgcccaggcuggagugcagcggcgcgaucccggcucacugcaaccucugccuccuggguucaagggauccuccugccgcagccuccugagaaucugggauuacaggcgcccgccaccacacccagcuaaauuuuguauuuuuaguaggggcgggguuucgccguguuggcgaggcuggucucgaacuccuggccucggccucccaaagugcugggauucccggcgugggccacugcgcccggccugcccccuuuguuuuuuucugcggcaagaggccccagauguguugaggcuacuuucguuuagccacuugcucaugaggaacauuuuggugggcuccagcuguugcuggaaggaacugcagcugaacccaugaccucucccaagccuggucuugucuuggggucucagucugggggccuguccugagaugcucccacuaugacuuggcagagucaccugcacccuucuuuuccuccccccaccccacugccauggugcccaagucuugucugucagccgcggcgggaggcaggacaggugugagaagggagaggugugaggugguuucuguguugguguccuggggccguuguaacucaugaccacagacugggaggcuugcaacagcagagcuggacucucucccaguucuagaggccagaagucuaaaaucaagguguggccacgcagccucucuccagaggcucaggggaggguccucccgcugccucccgcuccuggggccccacuuguuccuuggcuuguggccgcaugcuccagucucugccucugucuuuauguggccucuucccugucucucuguguuccccucucuuuuuauaaggacaccagucauugaauuuacugccuacccuaaauccaggguggucuuaucucgagauccuuaauuaaacacguuugcaaagaccccguuuccgaauaaggucccauuccaagguucuggggcucugggaguggacauggcuuuggggaucacuguucagcucaccacaguccccgaagguagccucacuuccccgcgucuguggugcaccagcaggcaggugggcucaggccuggagugagggcccgugccuggcgcccccaccauacucuccuccugucauggauggagcaggugcgaucacauccagggcaagacugcugcuuuuguuaaaauaauucacugcagggcuucucguaaagagugagauuucuuagugcaucuaaagcaucacauuuuaaaauuagauccgguugacguagauacaccuguuagagaaaaggacagucgugucucaaauuuggacccucaagucauuguuuucaaacaaccaggaaacgaggguugacguggauccuuuaacccaguucugcugccuaacagcuucccauuuccagaccuccggucuguucuagaauaggagucggcgcacucuuucugucaagggggagacacagacaguggggaccaaagggcgucugugugccagugagucuauuagggacauacauuggaaccucgcucuuuuuucuuucucugccguuccacacaguaaaacccauucugaguuugcgggccgcgugugcacgggcuggguccgcccuguuugagaauggcugcuggcuuuugccagugccuuggggcugccagggcggguuagggggccuuuccccacccguuccuuuugcucggagagcuggcccaggcuguggcagccagccugagcguccucaugcagaagcugugcaguguccuggcccuggauggggguccgaggcagcucugccccugcccgugucuagacacaggaauggcugugagggccgccccuggccugcuguuacuaaccaugcucuggacagagcugggcagacugaccacguggcugcugguguggacaugaugggcgcugccggcaaaggggccgugggccuccagccuggugaccgaggagccccugcugggcccgggaucacuugacaggggugcccacaggaacgcucucugucccgaaugaccacugugugaacacagcugucccgaccgggauugucgacaguuuuaggggugagguagcgagguuccucccugcugacaugauuuaacguguccagugaagcuuggugagccgcagccaggguugaagaaguucucgcgggaggucacaggaauccggcacuaugcucucguguccccuugcggaagggaaccaugucagaagacggcguauccagaaggagccgcacaaguguuacuuagagagggagcggggaggacggcuggcaagccuagcccacggcguuucuguauagucggcgagcugagaacggguuuuacauuuccaaaugguuggaaaaagucaaaaccauucuaaugauguuucauaguacaagaaaauuguaaaauucagauuucagugucuguaaaucaagcgucucgggcacacggcugcaccccuuguguccacauccccugguggcucuugcaccaccguagcagagcccacggcgacagacacuggaugucccacggagcggcaggcgugugcgguugccucuugacggguuaccagcccucguggcagaaggugcugaguguggggaggggcagggacguugcugugccacacgguguuuaaccaucugugugcaccgccguauuaaaaucugaaagcaucagccuggacaacguggcgagacccuguuucuacaaaaauaaaaaauaaauaaauaacuagccgggcgugguggcacugcaccuggagucccagcuacucgggaggcugaggcaggaggaucacuugagcccgggagguagaggcugcagggagcuguguuagugccacugcacuccagccugggcacggagugagacccuguccccacuagaaaccaaaacaagcaaacccaaaagugcgucaaagccacggggugucgaggagauggacgcguuuccguguggcucguguggucucuguaucuuagaccguccugccuggugcuggggccaaaggagaaaggaggaggaccagccccuccccgaacagcacccugugcccacugccuuggcuuauaguuugggagcuccucucuguggcuuuuccaggaucccaccaccaaaaagcccaaaccgucacccucucaugccucuucccgggagguagggagggggugugaacccgcucuggguguuugugcaaccaggucaggccuuguguuccuggagagcagacagcagugccgcgggggccaggagaguccuugcuuggggcugggggcagcuccugacauuccauggguuuugcuauugucccuggggaccuggcccagacccccagggauguguccugugccuggcccugagcuugggguccucccgucacaggaguuaccuggagggcagccuccuggccagcggggcccuguugggggcggaugagcuggcccgcuacuucccagaccggaacguggcacucuucguggccaccuggaacaugcagggccagaaggugaguggcuguggguggugcugggcggggaagggugggguggugcuggacaaaggcgggugagggggacggggcagcucugugccucauccuggggccaggagggcagagccccgaggugcaccccacugcuaaccgcaguacaggagggugagaguggguaaggacccccaucccccagagcucccaccugcaccucccuggccacguggcugcagaaaguaggggaggggguuggggcaacgggccuggccgagaaucaccugcucaaggugagcgggagggcggccagcggggcacgcguagggguggcucagggacagggugggcagcacgggcuggggucauggugacgggagggucauacagggguggucguuggacagacucgugcuuggagagggaaacaggccgagggccaacgugaggcguguuuggugugucagaggcugccucggagaccgggcagcucccuuuuuggcccuggccucaguuuccccucauucggaggagucgcugguacucaaggcaccgcagugggauucacccacaggcgccugcagguuucgggaggagccggcccaccacaugcucccuccuuccaggagcucccgcccagccuggacgaguuccugcucccagccgaggccgacuaugcccaggaccuguaugucaucgggguccaggagggcuguucugacagguagggcggcugcaggcccugcagugccugcccaggggcugccgucucugaagcagcugggugcugagaccuguggucauggcugggcacgggucugcagugccugcccgggggcugccaucugugaagcugcugggcgcugauacccgguucguggccgggcacagaucugcagugccugcccgggggcugccgucucugaagcugcugggcgcugagacccggguggcggccgggcacgggcagccuccacgccugggugggaggcaugggucagauuuuuuuccaguggcaacucggagaguuuaaaaucaaugagauuugauuuugguaacaaacuguuggcgugcgagaguagaagggcagccggagcagggccgggccccaaggccucccgggcccccaugucauggcgggaacagcagguggcugccgcccacacaggugcucugggggaaggaguugaggugggccccaccucccuggcccaugagucccucaggcgggaggagcucugcucacuggggucucggcggggguccaggggagccacucaaguggaacuggggccuguggcccccggcaggucccaacucuggcccaccaggccuucuggcaauugcuucuccgcgcaagacaccaaggccaggucgugggguuucccugguagcuccucgaggggcucugggcagcaggucuggggguggcggagcugggaggccaugucccccagccggccgugcuuccuccucugcaggcgggagugggagacucgucugcaggagacgcugggcccgcacuaugugcugcuguccucggcggcccacggcgugcucuacaugucgcucuucauccgcagggaccucaucugguucugcucaggugggcgcggcuggaggggugggcgcggcuggaagguggcagcgucccacaggugagcugagggcugccccucccacagagguggagugcuccacggugaccacacgcaucgugucucagaucaagaccaagggggccuugggcaucagcuucaccuuuuuuggcacuuccuuccucuucaucacgucccacuucaccuguaaguugcuuggugcccgcaccgcaggugcugugugagaacagcuuccucuccugaccgggacccuguccaaggcagggguccugaccgcuggcuucaucuuccacccagggccguggggugggcaccacgcuugcuaagaugcacgccaaggacccccggcagaccccggcaccgagggcgugccgugcugggcccgugcucuguccuccgaggcggaaaugucacuggcugggcccggcagcggaugcccggugggguugcgucugccgggggugcgcagucagggcacaguccagaggugcggcgcuuuagggagacucgagcauccggaacccuguggucccuaccccauuucuguucccacagcaggugacgggaagguggcggagcggcugcuggacuacaccaggacuguacaagcccugguccugcccagaaaugugcccgacaccaaccccuaucgcuccagcgcaggugagggcguccacgcugcguguggguggugccgccgugguucgcacacgggcgcccgucguuuuuagggcaguucugaagaggcagcguccugagcuuugggaagcgagggccgaaacguccagugcccccagcgcauggccccucgcgguucuuuagcacgguuaguggggugggcggauccuguccacucggcguggcccacuagccuggguccugguccucgccacugcccgccccgccgccuccccuggcuguguggagaggagcagggacguggccaucgccugccaugggcaucgucugcuccugaggcugcuccaggugccuucuggaacugucccagugcgaaucccaccccugagggcccggccccaccggcuggcgcccaagacccacuuccccugagagccacucccaggccauguucuggggaaggggaaggaccugccgucccucugccugugcccacacauggcccacugugccgcagcggacgucaccacccgcuucgaugagguguucugguuuggagacuucaacuuccgccugaguggcgggcgcacagucguggacgcccuccugugccagggccuggugguggacgugccggcgcugcugcagcacgaccagcucauccgggagaugcggaaaggugagggccugggggggcgggcauggagggagaugaggagaggugagggccugggggggcgggcguggagggagaugaggagaggugagggccuggggggcgggcguggagggagaugaggaaaggugagggccuggggggcgggcguggagggagaugaggagaggugagggccugggggggcgggcguggagggagaugaggagaggugagggccugggggggcgggcguggagggagaugaggaaaggugagggccugggggggcgggcguggcgggagaugaggaaaggugagggccugggggggcgggcguggagggagaugaggaaaggugagggccuggggggcgggcguggagggagaugaggagaggugagggccugggggggcgggcguggagggagaugaggagaggugagggccugggggggcgggcguggagggagaugaggagaggugagggccuggggggcgggcguggagggagaugaggagaggugagggccuggggggcgggcguggagggagaugaggagaggugagggccugggggggcgggcguggcgggagaugaggaaaggugagggccugcggcggguggggggagggugggcguggugggagaugaggagaggugagggccuggggugcggcggcuggcacaagcuggucugagccaguccgagugcccauccuguggcaggguccaucuucaagggcuuccaggagccggacauccacuuccucccaucauacaaguuugacaucgggaaggacacguacgacagcaccuccaagcagaggacgcccucauacacggugaggccugcccaccgcugcggugcagagugcuuccagggcaggcaucucccacagccgggaaccgaugccuggcgucaggggucugagccuggacggccuggacuugaaacucagcucugcaccuuggccuuguggcaaguccccuuugguggagaacggcgcccucuccauggguguuuucaaggcugggugagccggcuggcacacagggcaccagccaugcccucgccuccggccugcagagccucugcccucugcccguugcacccucgcucacccuccugccaggcccauggcugcaucucugggcaugucccgauaucuggauaucugcuggaagccucaagaagccacugaggcagggcaggguaggagcagccgcuguccacagggucucuccagcggcgagggacaggcccuggcccagcuggccacagacgccaggcaacaaaaugggcaugagugucaggggucccagaaggcuuccuuguggggggcgcuugagaacagcagggaggugagcgggccacgccccacggcuccucacaaguaacuggaccuccugccucugcaaucuucccaaaggaccgcgucuuguacagaagccgccacaagggugacaucuguccugugagcuacucuuccugccccgggaucaagacguccgaccaccgcccuguguauggccucuuccgggugaaagugaggccggggcgagacaagucaguguucucccgcucaccuucccccuugggccugggggucgugccgucgucccaugagcuaagagggucccugucaucgugggguuccacuuggggcuuuguucugggaccuucagggcuguguuccccgggaucgguuggacucauccuggagcaggagaaggcaggaaggggagaggcucuggaaagugaagagaggcccagcuggggggcuggguguggccagcuggagggacgaaggccuuaagcacucaggcauccgcccuguccuuccugcggcucugucccaggaacaggccuccgugugcuuagaggcagggccaaucugggccagugcccaccuaacagccccucauccuggcccuggguguccucuuaaaugcccccuccuccggggccggcccccuccuaacgcccccuccuccuggcccugggugcccuccuaacgcccccuccuccuccacagcauuccguuggcagcuggcaaauuugauagagaacuguacuuacuaggaauuaaaagacggauuucgaaggagauucagaggcagcaagcacuacagagucagaacuccagcaccaucugcuccguuucuugaaguuugcugaacgaggacucacagcugcaacguggggugauuguauugaucaaaacccacugggaaggacaaagaguuugccgccuuucggggauccgagggacuguggcgaccgugccucugugccagcgucccaggaaggaagccaacccugagcgagccuguccucuguggcagguccacacggugugggugggcagggcuuggacccccgucuccauggcagguccauacagcauggguggcaggguuuggacccgcccagcagcaccacggaccccagccacucucgggggcagacgucagaauccguuccugagcagcuccugugcccugggggcagucacagagccccccaacacccccgugcucugcaccagccucucccuccacacccgaagcaggcguccaucuguguccuccuggcagccccucaaacacacaccaccccaugucacacggguauccagagcaaggcuggaucugggcuaggugaccccuggggccucagaccucugagugggccccagagcccagcugaggaagccacacagccuccaggacguggcacgguuccccuccacuuggcugcaagucgccugccauggggcgaggaggccugcaccccaguauaagggccuccccagcugaguaagaagcugcuuccccuccucucauaggccaagccuauugugugaaaccaucucauggucuuggugacguagaccauuuuugaaaccgucucauggucuuggugacguagaccguuugcuucuuuaacuccagccgcggaaugacauuaguggaaccgggcuagggaacugcuggaaguucaggaugccaccaccuugaacaccuaggccagggauccccaccaugucccggguuucuuucuucgagaguauagaaccguucauucuugcuuugugucccauuccaucucuugaaaaaauguagucuuugaaugugugaaaaucuagggacauucaaucuagucuuuuaaauuauuuuuccauauuuauauuuuuaaauaaaugcauauauugagucuuaaaaucucuuucuggccaaagacugaaaccuggaagcaacaauauacaugcauaucccguucucacaauguccuuguuugaaaggcuguaaaauccacaggcaaaaaguuuggucucaacccucaacagcugacuaugaucuuguccgguucaucucugcuaucuuuaaaauccuacauucggcugggugcgguggcucacuccuauaaucccagcacuuugggaggcugaggcagauggaucaucugaguggugggcaaaucacaaggucaggaguucgagaccagccuggccaacauggugcgaccaccccugcaucucuacuaaaauuacaaaaauuagccgggugugguggcgggcgccuguaaucccagcuacuggggaggcugaggcaggagaaucacuugaacccaggaggcaaagguugcagugagccgagauugcgccacugcacuccagccugggcagcagagcaagacuccaucucaaaauaaauaaauacauaaaauccugcauuccuaguucacugcccaagagaucagcguuagauggaaaagagucuuuugaggaaaacacaaauacuugagaccugaugaaccacgcugguuaucaacaauucagugaauaauagaaaacuuuuauuagcagcaucuuaaaaaguagggaaacaaacacccagucucuugauaaaaaugagucucuugggccaggcgugguggcucaugcuuguaaucccagcacuuucggaggcccaggugggcagaucacaaggucaggaguucaagaccagccuggccaaauggugagaccacgcccccccccccccaucucuacuaaaaauacaaaaauuagccgggugucuguugucccagcuacuugggaggcugaggcaggagaauugcuugaaccugggaggcggagguuguagugagccaagauccaagaucgugccacugcaucccagccugggcgacagagcgagacuccuuaaaaaaaaaaaaaaaaaaaaagucgucgauagaaauuccauuaaugagagggcacagccaaucucaucuaauuucagucaacuagucugauguccuguauguauaacauuuugggcuggguguggcguguguaacauuuugggcuggguguaauucuagcacuuugagaggcugaggagggcagauugccugagcucaggaguucgagaccagccuggauaacacagugaaacccugucuguacuaaaacacaaacaauuagccgggugugguggugugcgccuguagucccagccacucaggaggcugagguaggagaauugcuugaacccgggagguggagguuguagagagccaagauugcacaauugcacuccagccugggcaagagugagacucgucuccaaaaaaaaaaagacuuugccugaacaaaugugcccuaaguuucaaauuaauucauugaaaaucuguaccaagauguuuaugguaauggggcuucaaaugaguccgcuuuuauggcuucuuccuaggccucuucuccgacccaaacaauuguuaaagagauucugguccgacccuggaguguguucacguggcuugacaguaagaggcuccaagucuuccggcggcggcgguggggagggcaggauaugacgugucuaguaagaucauggaucgaaagucaggugauucccuuggcacucaccgcuagaucuuagauuaauggaauuucacucagaaaggaguuuaaaugaaugcaaaugauguuggccaaucucuggaaaauaaaagaauuguuaaauacggccaggcacaguggcucacaucuauaaucccagcacuuugggaagcugaggcaggaggacugcuugaagccaggaguucgagaccagccugggcaaccuagugagaccacaccucuaaaacagcaaugagcacgccuauagucccagcuauucaggaggcugaggugggaggauccgcugagccccagugguuaaggcuaccgugagcugugcuugcaucacuguacuccagggcuagccugggcgacagagccagaccucaucucaaaaaaaaaaaaaaaaaagcuggcucgauaguaguggguucuuagaaccuaauauuagugucaacuuugguauccuauccuccagugcuaaauuuggcaaaagaaaaaaaaaacguggccaggugcgguggcucacgccuguaaucccagcacuuugggaggcccagguggguggaucaccugaggccuaggcggcuggucaggaguucaccaccagccugaucaaaauggugaaaccccgucucuacuaacaauacaaaaaauuagccaggugugguggcgggugucuguaaucccagcuacuugggaggcugaagcaagagaaucuguugaacccaggaggcggacguugcagugagccgaggucgugccauugcacuccagccugggcaacaagaaugaaacuccaucucaaaaaaauaaagaaaagaaucugugaaauacgacugugugagggugguuucaaaaauacagcucucggggccaggcacaguggcucacgccuguaaucccagcacuuugggaggccgaggcaggcggaucaucugaaguugggaguuggagaccauccuggcuaacauggugaaaccuugucucuacuaaaaauacaaaaauuagccgggcgugguggcaguugccuagaaucccagcuauuugggaggcugaggcaggagaauggugugaaccccggagauggagcuugcagugagccgagacugcaccacugcacuccagccugcacgacagagcaagaccccaucucaaaaaaaaaaaaaaaaaaauucagcucucauucucucaagcaugcuuugcuugucuuuuguucagcaaguacuuuccuagcucugcuccaggccagacggucuagccaccagcagggacacuggaaugagccaaauagccugcuugggggaggugaccaucuuaaaaaggcagccgacuauaaacaaauucaagugcaccuuaguuccaaagaagugaaguggggcugggcgcagugacucaugccugucaucccagcacuuugggaggccaaggcgggugcaucaccugaggucaggaguuugagaccagccugaccaacauggugaaaccccgucuuuacuaagaauacaaaaugagcuggcgugguggcccaugccuguaaucccagcuacucaggaggcugaggcaggagacucgcuugaacccaggaggcagagguugcggugagccgagaucgcgccauugcacuccagccugggcaacaagagcgaaacuccaucucaaaaaaagaaagggaaaaaaaaaaaagcgaaguggggaggaguguggcagggagggcgggugugcgaccuuugguuagagaggaggcagcgagggagagccagcuauguggcagggaauggagagaaccuuuguuggccucggcuuccaaaccacagacaccgagggcuaauugguagcaguuucuagaauguccucgggcuacucgguagguggagcaggacugugcuucaccggaaucuucagaagcucaaccccaggccugacgcguguggcgccggagcucugcguucacugugcagcugaacaucaggggcugcgugcugccgggagcuucugucccaggugugguuaacacuaggauguuucuaacaggaaguccacuguuagaacagacaccaucguccuccggcuccggcccuccaaucccaccaggugggcagcaagcugacgcuucccacaugggcaaauucaagcagucaccgucgcuggaguguguguguuguaaaggcaccaggucuuacagaaacuacaacagccagaggacaguaagaggcuaagaggaguaaagcuuacaaguuuaauuuccugaaaauauccacucccucucccaucgguccugcaaagaggcugcaccucucagcuacucaaaagacaggaccagagacguucucuccuccugacaaaacugugccacacagcucugugcagcccacggagucacacauguaggaagcuacccuuggacuacaggcagcaccgcagguggcccaugcagguucccaggcccgaccuccccacaccccuuggagcucccgagguuucuauggguguuugagaaccacguuacaaguuuuaacuuguacacguuuuuugcuuguuuuuguuucuuuuuuugagacggaguuucacucuuguugcccaggcuggagugcaguggcgcgaucuuggcucacggcaaccuccgccucccggguucaagcgauucuccugccucagccucccaaguagcugggauuacaggcaugcgccaccacgcucagcucauuuuguauuuucgauagagacgggguuucuccauguugguccggcuggucucaaacucccgaccucaggugauccgcccgccucggccucccagcgugcugggauuagaggcgugagccaccgcgcccggccucuuguacaaguuuuuacaccacaugaaaggcuaccccguagccgcuauucccuaagccaugcggccuuucggaucucuggaaacacccacaucugcggccguuccucggcuuggcggugcuccccaccucuaaggcaccugcaggcuucgcugccggucaccauuaccccccgucaccccaccccaugcaugcugcgacaccccugacaucagcacgucgcacgagaacaggcuucaagacacggggucaaaccggacgacugacagggaggaaggccuccauguuagaaaagcugccaauucagacagcccuuaagaaccgccccuccccaggcgagaaggaaaacaccgugcuaagaaagaugccagcucuuuauuaccagggaagcugugugcacgcgcguggagcgcgcuccuuggagcugaccgggcccuuaccuucuccugcuugucagaggugaguccugguacccagcacgguggccuccgggaggcuuugauaggucagccuuugcugccucccagcucagggcuccuccaaggaaccugcggggccccaugugcccacagcccgaggagggaagcaccgaccgcccuccucguggcacgcugcacuccagcgcugggcacuucaccugcuuccuggcuugcgguggucaggcucgauacugacuccacugaucggcacauugaguuccaaaagaaugcaaaccgcgugggugcuguggcgacauuguuugcaccguuuauacaaccagacagcuuuuuagacuaaauucguguccaaacuaacacgcacgggaacgggcuccagcugcagcucccugggucugucaggccggggagcgguucuaccggaagagccgguacguccugggcaggcgcccguccuuacucgacagggcggucuggaugugcucauacgugggcaggucagucaggucacccagggcggccacugccggcuucccucggagcaucuuagaagcgacucucuucacaucuuccggcuucacguugcc

SEQ ID NO: 13102 - RNA, 7209 nt, Homo sapiens
gcugagaggcugcggcggcugacuagguuuucggaccgcggcgcggcggggaagagagacugcggcgggagggccaggccgugggagagacgcgggaaagugcgggucgcagaggcacuugaccaccccgcccuaggccgacccggcggacgcggcgucuggugugcgggcgcuggggcggguaugaggguguggugggggguggggauggagggggggugggugugugggcgggagugggggugggugggugcguaggcgcuggggucggagauccccuuuccugcgugugacuuauuucccacaccccgccaaaaaugggcacaaacaaugcgagugcguccaggaguccgcucggucgugcgccagacuccgaaccuagggggccccgggcccucccugagcaccgcgcgcaaaggcccggccccagggccaggcaacuccagcgccgaggccguccagugcggcuggagggcagaggccgagaggcgcggcgcggaacuugagccccuugucccggcgcaccggggaaccaugagggauguuaagcgagggaguggaauuaccccccuuuuuuuuuucuuuuggagacguagucucccccugucgcccaggcuggagugcaguggcgcgaucucggcucacugcgaccugugcuucccggguucaagcgauucuccugccucagccucccgaguagcugggauuacaggcgccugccaucacgcccggcuaauuuuuguauuuuuaguagaguugggguuucaccauguuggucaggcuagucucaaacuccugaccucaggugaucccugccucggccucccaaagugcugggauuacaggcgugagccaccgcgcccgguuggaaugaccacuuuuuaggaccucuucccugccgcgcagagacuggagggagcggggcccgcagugcagggaugaggucuggagcggggcagccugagugggaguggaaggaaagcguggauguaggcggugcagaggggucgaauuggaaggacucuucggaugggagggcguggcgaagguggcggcgggcuaagaaguuaagccaagggcuggggacggggagcugguguugaguuugcagggcucccugggacacgcugugggccuggacgugaagucuggacuggagcccuggacagggcuuggagggcuggccaggaguuccaggaugagcuugcucuggcaaaggcggggccaguccuggcacccccugcggugucugcugauggaaugaguucaucuguguuucagugauugacuuuauuuggcagaaagggaauccccagaaaucugcguguucugcuaagguuggggcauagaggguggcugggguagacucugccugcacucagaggucugugcugcacucuaggucccaggucuccccgcugcgcugcuugaggcucagccauggcccagcagagagcccugccccagagcaaggagacgcugcugcaguccuacaacaagcggcugaaggacgacauuaaguccaucauggacaacuucaccgagaucaucaagaccgccaaggugggggugggguggcccaccaaggggagcagagucugagaagggguggagacaggagaggccaggggcugagcagcgcgagugaauaguguucuaggcaggaagcacccagugcacagggagcuggucaguagauaagcaaaccaaauaauggcacguccagcccuuacuaacaguauggauuuggauggagauuucacuuuuuagugccucaguuucuccugcauggugggguccuugugaugacuggugaguuuaucuguguaaaacaguuaccucggggccuggcacacagccaaugagcaggagaaaagcagacugaggggagaagugggggguggccuccaggcagguggagcggucagcacuggggccugcaagccugcugaccacugcagcuacagcugcaucagauugggcuggaucccuccuggcugcugcagaccuggcaggcuccauaagcgaugaugaugaggauggaagcuagcauguacuuagugcuugccauguaucaagccacguugugagguuaucugugccuguucugcugaaucuucaugaggacucugugaggugggcacuguuguccucuucauuucaggaggaaacccaggcccaggagacuuagugacuugcccaaggucacucagcucacaacuggcugagccaggauuugaacccacgaagucugggucuuaaccacugaggguaccugacacccaccccgaacugagccuuugcaaggccugccgggaagccccauccagccucgcuuggccaccuauacaccagggguggcaggccaggcuucugugaaacuggcauggguuaaugguggucaagugcaugacacagccuggcaccugggaagugaucaggaaauggucgcgaaaaaaaacuuaaaucaucccuucacucauccaacaguuuaccaaaugccaagcaagugacaacgguuccuaccaaacagggcucccacagcccaaaaagaccgggccaagauaagcccccaucccugcaccuagcacagcaagcagcguggguugccucuauuugucuugagcaaaggugcauguugucucccauggccagaacaagagaggguggaauugaaccuugucagaggucuggcugacagcgcuuaggucuguagauggcaccacagacagguuguggccaguguggacauccuggguagaugacaguuaccguaagcugggcugggccgggccagggguggggaugccuuggcuggguugauuucuagguuuucuuguuuucccccagauugaggacgagacgcaggugucacgggccacucagggugaacaggacaauuacgagaugcaugugcgagccgccaacaucgugaguggccaggguggagggcacggccugggcuccaagagcaucaguccccucagguuuccuggguggaguggagggggcucuggggcuggucuggucuucuucccccgagaaggagcagaaggaggcaaauguagagaugcuuugguuucaccacucggcagcuuuaaagaaugaggugggggcaaaucauuucucaggagacuguccucacguggggcacuuggaggagggcugggcagagagccacccaugcccguccuguagccgugcaguggccagaaagaggguagcccuuccugcuaacucaggaguuccuaaggucaguugugagugaaaagacaaacagccgaauggaacuguaggcgccauuggauuccuucggaucacaggagaaacacagcaagcagauaauuccgcaggugcacguccagggcucaaaaugcauggaaaaaggucccacaggagcucugcccagcuggcagccauguuaauccuaccccggggcaggaggcaaaaugggaucgcaguuuuaucugugggguuugaguuuuucaugagcagaauguacaccugcauaauuggacuggaggccaguccugcaggaguggaagccagaggcugacgagaggggagggccugcccugcagaacugacaucccaguuuucucacuuaauucucacacaugaaccuguggaggucagggguagagucccacuuugcagaugaggaagcugaggcuccuagagaggccaucccuugcccagcaucagcuacuuguaggcaaggccgcuguccccccucacccugugcccgcccugguucugauggccacagguccgagccggcgagucccugaugaagcugguguccgaccucaagcaguuccugauccucaaugacuuccccuccgugaacgaggccauugaccagcgcaaccagcagcugcgcacacugcaggaggagugcgaccggaagcucaucacgcugcgagacgagaucuccauugaccucuacgagcuggaggaggaguauuacucguccagguauaaauagcgcuggacuccccaugcagagcgggagccugccuaccugggccuggccagcaggcagggcugccuucugcuuuuucaaauucuugcuggucuuagcaguggagccaugccuggguuucagagcagagcuccuggccagagcguuugaccgacagacaauucacauccauaugccagggcccugggccuuucccacagugcaaugugaugaaaaccacaggacucacgccagucggauaggccgagucuggagaagggaggcgccuggcuguaucccccgcaggcccucuuccgagagccuuccuccucgggcagugcguucuggggcugugcugcuccuguuaccuucugaauccauauguagagauuucagccaaggcugggccagccuuuuuugggcagucagguccacaccuauguccagggcaccagggaugcaauuccauguggaugucaccaaaccccaguguggaggcagggacagucaugggaaugugggggaugaagcccaggcagggaauggccuugaaagccauuggagcuccaauucgugacccacucagccuuauccacggagcuggagccaaccuacgugccaggccccaugcugggucccagggaugcagaagggucaaaacccaucauccugacccuuguggggcuccguaagaagcugaaaccuucgaccguuugagcuggaggggcccugagaaaucagagucuacguaucauuuacuuagggggaaacuuaggcuggagacagggaggccuuccacucugccccauuagcuuagaaaaucaagauucaguccagcagaugcagaguccauguccaucuugugccuucuccuggacaaaccuuuccuuccuggugguggauuuaaaauacuccuuucugcccauuggccaugcugggagccacagcuauccagagccagcaugaccuggggcuugguuucccugcccugggcucaguggcacugcugagcugcagcaguccuagaguuuuccaggggguucugagggaaucuuugguccccaguacucauuaacucagcagacaugaggcagcauuuccuccacacuaggguggcugagagggguccugggguguuucagacccuucugggcaucuccuuccacagcuguucaguuugucggucucuuugaggcagccaccgucccugagggccccugcacagagcagcugugggccuguaauucagccugccugccuugccuuggggcagggagagagggaaccugcucacggcccugcagcagagcagggcgcaaacccaggacaucugugccaggcuucccaugcccucccccaacagucccucagcuucacccagcggggcuuccaggccagccuguguccccucccgcaggccuccuguccacaccagcgcccccuggggggccucacacagccccuguggcagaagcaguugcccuccucuguacauugccuuuaagcgaccagguccuggccgaguuuccucugccccuucuugcuggucccccaaagggcgcuccgcucccugcccugcccugcccugcccuguuccgcaugagcugcgccucugugcucgccugcccccucucugcuuguuaguugcucuuucuggcucugccucuccuuugcuuuccucgggaugccacucugugcccaggacgguucugagacugaacacugagggcaggagcaagggaggaagccaggggcgaggcaggccgcgggaaagccagggccccugccugcagguuagaaagaggcgagcguggauugucacagcugcgggcaugggaagggcuagcugagcucuucaccugcauccuggcugccgugaggauuccccguguuagagguggggacgccugcuggaggccgccuggcugauguagggcuaucgggaagugccagggccuguguucccaacugucgcccccuucaggcuaagucucaggcagggacagacccagaaagaacacagucugcccucagagagcucuuugcaguguagugacacugggguuucugcagucagggaggagggaggguggccaggcugacagcuuuuugcaagaggagggggaccagcaccagcugggaggcauaggcuaggacaggcccacguggaggcugggcaggaagggccugcugaggucacacagcuguuggugguugggccagggcggcuuccuccuuucagaaugcuaggguggcucucaccacuggccgccucuccuugccaggccugccaacucaggggacagauggagcaggaguggagaaagggaaaggcaggucugggguguggucguguuuucuuaacucugcuucugucuugcucuccccuccccuggcuuuccucucugccugcuccugucucucccugggguuucuggugguggaaaagcucaagccuuugcgaagcuaaugaccugccucugugcgaagcuuacgggaggcuggaccucgacacagacucugcugauggccucucggccccucugcuggcguccccggagcccagugcuggcccccuacagguggcagccccugcccacucccaugcugguggcccuggccccacugagcacgccugagccuccggggccacgcuucguucucaggaacaaaaccugaggcagcccuuuggaugcccucacagccuugcuucucucagccuagguucccauuuggggacuucaggaccccagagccacuaggacuuccuugggaagcccguuagcccagggugggucccaccaggacaguagggaaacaguuguuucccuagccauuuccgaauagcccaucauuccgagucaucaucucuguuugcugccuuccuggccagccagguggaagaaaguuuccaagcuaggucuggcccguuggggaucucagcaguggggcaggagggugccugauuucggggaguccugacccgagccuguugucagaguugggaggggcucugagcaguguugggcaggccgggucucccaucccgaggccagcguuccugugcagagccccauccacugguucuugcccugagccacauaugucugugccaugggcugagugccacgacaggcccgugugacagcugcugcccacgcauguggaagcuaggugggacucauuccuaauucugccguuguaaugagacuugauuaaaacaccgccacuuuuuugcauugcug

SEQ ID NO: 13103 - RNA, 5233 nt, Homo sapiens
ccaggauuuuaugaugaaccagucaugagcucauuuaagguagaaggccagaacuuuauaccaguagcacaugauccagcauaaaggcagucuugaaauacugcauuauccagggacagggcuucagcagcugaucugucacacaccaggugucccacguaggaauuucuuaaaccacagguaggauguagcugcagagaguccauaccuagggguugaaagcaagccagcauuagcaggcugcuaggcugaaggggaggaagccagagggccgcuggggacucaccaggucacgauguacugcagaugcucguuccucagaguaacucugguuugcccuccaauggguccuccagggacugugcucucuguggagacagcagacucaaguccacccccuacuggccugccagccucugcaccacuuccuaguggcugucauuuuugcguggccaguuggaaguccuguauggccuuuacguugggugaccauccccgcccuuguccgcucaguacuugccuagguucuuugcugaguugcugccuccucccacccgccauauacacaugugagaacauaagccacaguagugacugggcaaugaggguuaggaggaaggacaguauucacaaaagcuacuuguuccgagaugggcugguccacaacguacggaaguuggcaucaaugaagaugggcucugcgccugugauucuggccauagcuuccaggucucgauaaugccagugguuccuuucuggauuguucucagggacaaaaggcugccugguuucugucagccucaccaucccaaugagguccacuucucccucaaucuauaaaggaaggugugugagauugcauggagccugguggacucccagagccuucucuaaaguaggaagaguccaugucccuuaccuggccuuucugccggguuucaggauucacuuucuuccugggaacgaacccucuauuuaccaggauggugacucuaggguaaugaaagugcuacuucagguggggaggguuuuugacuaaagacagucacucauggucacucaggcacccauaggaacaacuagagcaccaaggaaggcuuuuaaaacagggcuggcucaguggagcccuggcagugccacacaggcaaagucuuccucucuugaggcaccuucgugguugguaaaaggcucccugccaccaucacuaccuuuuuaccaguguggcuuuccccuucuaucucugcuucuuguggucuaccuacuacaacgugcaacuggugagcaacgcugccacgccagaguuuagaccccacaccucuccccugaacuauggcaagagcugucuccaaucccuccuccuaaccaaggcagccgugaggagcagcccuggcaccccagccugcuggagaugaguacuugggccccaucccagcccuaaaacaggaacccauggguuaacaagagccccagguauuuucauuuuuacgugaauccuccaguucccuaguuaaucacacaggugcuccuguaccugucauuugcuuugccuggaauguucuucccaucucuuaacucccaaauagcccucuagggagccaccccugccuccacucccucaagguagggcugggguccuuucucuugaaguccucuugcuggccccucauagcuugccaucaucuaaugugugggcaacuagacaguucuccagaggcagggccccuguuucacgaaucccuccuuucccuucagaggucaacauacagaaauuauccagucauaaaugagcuggcugagaagauuaagucaaugucacaauuagggacuuaaacuaugcaaggaauugaaucuccuggguaucuuggguuccccaggguccuaccaagguuggggauugugaaggaaauagugauguaaauuaguauacccugacugccucugccaggacagccagcucccacauguccuacucaccccaggucggugcaguggaagggagugaccacauaggccccacucugaguugaggaggagaugaggccgcccucccgggccucccggacaggguccaccaugguccggggcaucauauacagcuccuuggaauggucaaagcacccccugaccuucacuggccuauacuccagauuuuucaguuccauugggcugcauggagauaagaacaguggccgagcaagguuuggcuggaaaacgaauccccugaggguggcagacuacacagcccaccagggccagacaagugaaggagaaaggcaaagggcgugcucuucaaaggggaacuuugaugccaugugggaauguggaucugcacugccagaguccaacuuuacaagagaggcuaaaaaucuggacuccucaaugaauauuuuaugugaaauuuuaaaaaauaugugggccaaaaccccaucugcaagccaaaucuggcauacuguuugcuacccugaauggaaaauguggcugaauauaccuaucucuguagggcauauucuagggagagagcagacaaaucauucagggcacuuuuucaaacgaccacccucacggugagaccuacauuaucugcccucagccacagggccuugggcccuguggaggauaaguuuacuauaccugaaaaaagggugacacccaggacucaaaauaagacuuuccuccauaugucaggaggcggucucagguagcuucacaagggcagucaggugucaacagcaagcccaacagaugacugauaaugagagcucccaccugaggucaaggcagugacuaaaagucccaccaaaaggggcaagcuggccagcagaagccagggcucugcuguugaacucaaguaaaacaggcccuaggggggcagccaugcacucacucggcuggcagagggacaggcucagccagaacucuggacuccaacucugcaaucagguucagcuuccacuuccgacgcuggaccuacagugacagagcauaaggccaagcagauggcagcaaggucaagggcccagaguuacgcacaccagaugccggucuuuaccugccauguccccaagccaaaggcagucacagggaugaggagcaggacccacugaagaaaggagucaucuuccgcuuuuguggcagaugcuucugcugcagaacugccacaucugcuuggccuccaggccaccccuggagaguuucacaacacugacauggagccagaagcccucgaacacagaccuggagcagcccguuccaagacagacuccaguacugccaaucaaaaccugcugccuagagccaacuagcagcaccuguauccagcccagcuccuaacccggugcccagaacaaggcacacacaguacgucugccaagugaguaagugggaucuagggcucagugccgguuugaccaccaaccacgacccugaguaacucaugccuuuuuacucaagaaucuagauguauuccacugcacuaagaugcaccauucauccauucaaaaugcauuuaauaagcagcuacaguuggccgggcacgguggcucacgccuguaaucccagcacuuugggaggccaaggcgggcggaucacgagaucaggaguucgagaccagccugaccaacaugcagaaaccccaucucuacaaaaaaaugcaaaaauuagcugagcacgauggugcuucuguaaucccagcuacucgggaggcugaggcaggagaaucgcuugaaccugggaggaggugguugcuguaagccgagauugcgccacugcacuccagccugggcaacaagagcgaaacugucucaaaaaauaaaaaauaagcagcuacaguuacuaaguagcuuagucaggcacuagugguuauuguguuauguagaaaaauauaucaauucaguaauggcucacagagcucucuuaacagcuuuccauuuuuacaacucaucguaaauguaaagagggaagaauguacacagaaagugccuuuaagcucucagaggaugaguuccauccgcugaaaagcaccaggggccuugcggauacuauuuuuuuuuuuuuuuuuauaaaaaggcaggccuggggcaggcuugcacagcacucuacacacggcaaaacagcccugugcugcacacugagaggaacacguaagccgcggugguuagauacgcuuuacuuucagagcccugggcuuucagccugggcuggccacccauuagcuggaugggacguucggaaguaacucucgagccuucucuguaacaggggaacgaccaaggagcuaccucucgcguugugaggacaaagcgcucgcuacaugcccggcacacgaccacaauuccacugaaagcauuuuaauacggaacuugucacucccagggagccuccgcucagccggcaguugguucauuucaauccccacgacaacccuucaaagugcagggcagacagcagguggcucugcccaggcgccuggaucacagcccggccugcagcccucaccugggcgcggggagacccugaggacgcuccuccaggcggcgcuggccggggccugcggacacggacgggcgggcugagcuccgggaccccuccccgcgccccgcaccccgcaccccgcaccccgcaccccgcaccccgcacccggcgcucacccgucccagccccgccgcccgcagccccagcugcaacgcagccaccgccgccaucgcacccggccccgcgggcgcuuccgggacgcaggaggcaucugcauccggggcgccgcugagucccgcccagagccccgcccccggcuccagguucugcgagcggcuuccgccgggcugcuccgcgggcgcgucggccaugagcgaguugccgggcgacgugcgggcguuucugcgggagcacccgagccugcggcuccagacggacgcccgcaagguucgcagcgcgggaggggaacggaguggcggagaagggcgcaguugggaugaggggcugaggggagggcaggggagaggagagggcaggggagaggggagaggggagagcaggagagaggggagggcaggggagagggcgcggcgggaucaggggaggagagggaagggggcgcggcaggagggggcaccagggagcggagcccuggcccuccugacguccugcccgcccacgcguccgcaggugaggugcauccugacaggucacgagcugcccugccgccugccggagcuccaggucuacacccgcggcaaaa

SEQ ID NO: 13104 - RNA, 5258 nt, Homo sapiens
cggggcgccgcugagucccgcccagagccccgcccccggcuccagguucugcgagcggcuuccgccgggcugcuccgcgggcgcgucggccaugagcgaguugccgggcgacgugcgggcguuucugcgggagcacccgagccugcggcuccagacggacgcccgcaagguucgcagcgcgggaggggaacggaguggcggagaagggcgcaguugggaugaggggcugaggggagggcaggggagaggagagggcaggggagaggggagaggggagagcaggagagaggggagggcaggggagagggcgcggcgggaucaggggaggagagggaagggggcgcggcaggagggggcaccagggagcggagcccuggcccuccugacguccugcccgcccacgcguccgcaggugaggugcauccugacaggucacgagcugcccugccgccugccggagcuccaggucuacacccgcggcaaaaaguaccagcggcugguccgcgccuccccggccuucgacuaugcagaguucgagccgcacaucgugcccagcaccaagaacccguaggugguccgcggcggcgcggggaggcccagggcaauuaggacagccccuccgcuggacuccgccagugcugcagccccuacucuuucagaguugggagcccugggacccaggugggcgcccgggugcuggaaucaccugcggucccagcggcgaggccucuuggugagcucguuugcucaccugagguuuguccugugggguguggcugcuucccagaugaguagaggcuugugauuugucaccugagguugugaacagcguuggguucuucccuuaaccccagaaggggucuuugauuuagcugggagcuaggcuuuguaauaaucgucaaaacagagauaggauguuuccauucauugagcccuugcuccagguggagccauccucuugcaugaacucauccuggagcagucagugaggcugccaugcgugcuuuuccgguaaacauuaagaggcugcagucggccugggucagacgguuccccacccagcuucagaguggaauugcuccgggagccuuuaaaagcccgauguccaagccgcaugguagacuguccagggaugaguccaagacacagccaccagucugaauccuugcugugaacugucccuacaaauuuggucucucugcucuguaggcaccaguuguucugcaaacucacccugcggcacaucaacaagugcccagaacacgugcugaggcacacccagggccggcgguaccagcgagcucuguguaaauguaagucccaguggacccccaucagugcaucgccaucugagugcaugcccgccuugccccagauggagcgugcuugaaggcaggucguccuucagcgauccguguugaugcaucaggccuguuuuuuggcacagugaagagagggaugauggccccugaccccacagcuuuuagugcaggcaggcacagagccagaagcaggcucgggagugagugagugugcguggcaaugcgaggugugaaagaaacugggcgagggauguggggugggcuugcggagacaggagggcuggggagacucgcugagggauucgcucgaggcugaggcuggagggaugugguggcaguggggucgggggaacagcaccccagggagaagccaggguccauggaagucugaggcaaaaauguguuggcugagguaggcuccaaaggacuggcugggcuagugugcacagcccggaugacccagagaccaggccaggagcacugcaguggguguguggagaggguugggugggggcugcauggacagugugcaugguugagaagggaggacuccuugacugcggucauccaggaaaagacgguggguuuuggggggagaauucagagucccuuugaagguuuuaagcuugagcuguauuaggaaagguguguauuagggaaguaucgggcuuuugaaacagggacacccgugcuggaugaaggagaugguugcaccguggaucugggugagcacccggcgagaguuuagagaagggagagaggccugguccugagccccaggaagaggcuggaaguccucccgugguacugaagggaagaugaggacagaaaaaugauagauuugauaacacagaggccccuggcaaccuuggugaggcaccugaagcuuggcagggacaccuggcuagaguggagcguaggcugcagcccaugagggcaguguccggccuuaggcaggugcugggucaccagaaagccuuucuggaguccagcuaaggagggaaauggacagaggcuggagcggacagauucagguugguuugcggaugggaagaugcgucuacgggcuucugaugagugcggagaggcaguccagcccucccgaagcaugaguguggauugagaaggcaggaccaggguuucucaaguagaaggcgggcaccuugcagaggccuugcaggcacaagggcugccagccugaggcuuggacuuuuuccagccaguguguuagcugcucaggggugggcaggaaggcucuaagugcagggggccacgggguucccaugaagaaugguuaugaugguggacuguggagcugagaugggacuggggcgccgaggucacugcaaggcagugguccagggaaguccaaacguggcuguaagggggcucugccuucacguucugguggugacaaggcugcugcauggccauggggguggguggcagagacaaggagggaaacagcccuggagaugggccgccacaucaauggccagggcccagcagggcucaugcagcccaugagggaugaugaugguagcugcgcugggcuggagggcaagccccagcagacccuccaauauacaaggggacaacgguggugacuccagugaggucuuuccauggaagccuugucccaacucccuucucacccacuaaggggcagcaaaggccaggcagccaaccuccacugagccccgcccuccgggacggggucucccaugugcugagggaggacuucaggcugcuggggagaggguggcaucacugccagcccgaguugccuuugagaggccaugccaagcucacuggggcacaguuggccuugggccuggucagugcccuccuagccguggcuuccuaggccuggcuagaucggggaugagugguaaaggccccguagaccucuaccaucuucuugccuccuggcugcagcccuggcccaccacccucccugcacaccugguaggaacagagcugaggcacccagcagcugcucugguuuuuguccagggcgguggggcuguggggcccuggccgagugcaguccucauaaguuagcuguggcccagaggaccgugggggguguggagguacccagcacgugcuggcuuaucucccagaugaagaaugucagaagcaagggguggaguacgugccugccugccuggugcaccggaggaggaggagggaggaccagauggacggugacgggccucgcccgcgggaagccuucugggagcccacauccagugaugaggggggagcugcaagugaugacagcaugacagaccuguacccacguaagcagaacgggcccugcuucucccugacccucuacugucagcagggagcagacuguggugcugccuccccugcaaagguggcagcgaacucagccuaaaauaacugucagccaaucccuguguuccucccagcugagcuauucaccagaaaggaccuuggaagcacggaggauggggauggcacugaugacuuuuugacagacaaagaggaugagaaggcaaagcccccaagagagaaggccacugaugagagcaggagagagacgaccguguaccgagggcugguccagaagcgcgggaaggugagcugucaccuccucuguuaguguggcaguggcuuccccuagugaugguuuuccauuuguuuaaaaaaagaaaacugaaccuuuuucacaagugaaaucccaagccaacaacacacaagaaccauagaagccgaggccgcuggcuggcggaaggccgugagugccuaccauugcuucccagccagccccuuguggaagccaggcucuguggaccacggucaagaccacugguuugugaggacacccuccuaccucagacuaugagcugugguguguuuguccuuaccccugggcacagggaccugauuacuagccaccaccuuugccuuugccaucagggcaggaguggagacuuccccgccuuugguagauaagcaggaccaaggccaaaagaggacaagguccuaaugaguguguggcauugcacuguacuccucugaggcccugcugagcggggucuaauccugcagcuguuaaggaaacggggguggagaaagccucuguggguauuugaccgacaccucugaggcuguguggguggggagagcccugcacuccagggccccuucuccaugggaucagaaaggcucaguaaucagaauuuuguuuaucccacagaagcaguugggcucguugaaaaagaaguucaagagucaucaccgcaaacccaagagcuucagcuccuguaaacagccagguuaauaaaagcacaugccgugaaguuucgagaaagccuucagauauuucccccgcuccugaucaaaccguguguccucugaaugaucggcuguccccagugucuucucuacccacuuauccuugucucaugacaucugcugcccucuaaggcagggcugagggagucugucccccacacccaggaagcagcagggacucugagggacuaauucucucuggacauggcuucugaguggucuucagagaagccuagagaaguaaccucgcucacuggcauccugaggggagccccauucaggcugggcaacgcuauaggaucacacugcauacaacaaacgccauuauuuauuuugauguguuuccaaaaaucaaaacguuuucaaacacaacuaagauauaaaauacagcauaaaaugagauuuagaucuguuucccacauaaagcaaaaaaaucuuagaaauuguuuugccagaaucaauugguagaucccacuuauccuccccucccugcaaaggcaucuucccgaaucaggcccuagcccacccagggccaggagaaacaggaacacccacuaggacggaggcgcugcuggugcagaacuggugcugacugcucacguggcc

SEQ ID NO: 13105 - RNA, 5258 nt, Homo sapiens
ggccacgugagcagucagcaccaguucugcaccagcagcgccuccguccuaguggguguuccuguuucuccuggcccugggugggcuagggccugauucgggaagaugccuuugcagggaggggaggauaagugggaucuaccaauugauucuggcaaaacaauuucuaagauuuuuuugcuuuaugugggaaacagaucuaaaucucauuuuaugcuguauuuuauaucuuaguuguguuugaaaacguuuugauuuuuggaaacacaucaaaauaaauaauggcguuuguuguaugcagugugauccuauagcguugcccagccugaauggggcuccccucaggaugccagugagcgagguuacuucucuaggcuucucugaagaccacucagaagccauguccagagagaauuagucccucagagucccugcugcuuccugggugugggggacagacucccucagcccugccuuagagggcagcagaugucaugagacaaggauaaguggguagagaagacacuggggacagccgaucauucagaggacacacgguuugaucaggagcgggggaaauaucugaaggcuuucucgaaacuucacggcaugugcuuuuauuaaccuggcuguuuacaggagcugaagcucuuggguuugcggugaugacucuugaacuucuuuuucaacgagcccaacugcuucugugggauaaacaaaauucugauuacugagccuuucugaucccauggagaaggggcccuggagugcagggcucuccccacccacacagccucagaggugucggucaaauacccacagaggcuuucuccacccccguuuccuuaacagcugcaggauuagaccccgcucagcagggccucagaggaguacagugcaaugccacacacucauuaggaccuuguccucuuuuggccuugguccugcuuaucuaccaaaggcggggaagucuccacuccugcccugauggcaaaggcaaaggugguggcuaguaaucaggucccugugcccagggguaaggacaaacacaccacagcucauagucugagguaggaggguguccucacaaaccaguggucuugaccgugguccacagagccuggcuuccacaaggggcuggcugggaagcaaugguaggcacucacggccuuccgccagccagcggccucggcuucuaugguucuuguguguuguuggcuugggauuucacuugugaaaaagguucaguuuucuuuuuuuaaacaaauggaaaaccaucacuaggggaagccacugccacacuaacagaggaggugacagcucaccuucccgcgcuucuggaccagcccucgguacacggucgucucucuccugcucucaucaguggccuucucucuugggggcuuugccuucucauccucuuugucugucaaaaagucaucagugccauccccauccuccgugcuuccaagguccuuucuggugaauagcucagcugggaggaacacagggauuggcugacaguuauuuuaggcugaguucgcugccaccuuugcaggggaggcagcaccacagucugcucccugcugacaguagagggucagggagaagcagggcccguucugcuuacguggguacaggucugucaugcugucaucacuugcagcuccccccucaucacuggaugugggcucccagaaggcuucccgcgggcgaggcccgucaccguccaucugguccucccuccuccuccuccggugcaccaggcaggcaggcacguacuccaccccuugcuucugacauucuucaucugggagauaagccagcacgugcuggguaccuccacaccccccacgguccucugggccacagcuaacuuaugaggacugcacucggccagggccccacagccccaccgcccuggacaaaaaccagagcagcugcugggugccucagcucuguuccuaccaggugugcagggaggguggugggccagggcugcagccaggaggcaagaagaugguagaggucuacggggccuuuaccacucauccccgaucuagccaggccuaggaagccacggcuaggagggcacugaccaggcccaaggccaacugugccccagugagcuuggcauggccucucaaaggcaacucgggcuggcagugaugccacccucuccccagcagccugaaguccucccucagcacaugggagaccccgucccggagggcggggcucaguggagguuggcugccuggccuuugcugccccuuagugggugagaagggaguugggacaaggcuuccauggaaagaccucacuggagucaccaccguuguccccuuguauauuggagggucugcuggggcuugcccuccagcccagcgcagcuaccaucaucaucccucaugggcugcaugagcccugcugggcccuggccauugauguggcggcccaucuccagggcuguuucccuccuugucucugccacccacccccauggccaugcagcagccuugucaccaccagaacgugaaggcagagcccccuuacagccacguuuggacuucccuggaccacugccuugcagugaccucggcgccccagucccaucucagcuccacaguccaccaucauaaccauucuucaugggaaccccguggcccccugcacuuagagccuuccugcccaccccugagcagcuaacacacuggcuggaaaaaguccaagccucaggcuggcagcccuugugccugcaaggccucugcaaggugcccgccuucuacuugagaaacccugguccugccuucucaauccacacucaugcuucgggagggcuggacugccucuccgcacucaucagaagcccguagacgcaucuucccauccgcaaaccaaccugaaucuguccgcuccagccucuguccauuucccuccuuagcuggacuccagaaaggcuuucuggugacccagcaccugccuaaggccggacacugcccucaugggcugcagccuacgcuccacucuagccaggugucccugccaagcuucaggugccucaccaagguugccaggggccucuguguuaucaaaucuaucauuuuucuguccucaucuucccuucaguaccacgggaggacuuccagccucuuccuggggcucaggaccaggccucucucccuucucuaaacucucgccgggugcucacccagauccacggugcaaccaucuccuucauccagcacgggugucccuguuucaaaagcccgauacuucccuaauacacaccuuuccuaauacagcucaagcuuaaaaccuucaaagggacucugaauucuccccccaaaacccaccgucuuuuccuggaugaccgcagucaaggaguccucccuucucaaccaugcacacuguccaugcagcccccacccaacccucuccacacacccacugcagugcuccuggccuggucucugggucauccgggcugugcacacuagcccagccaguccuuuggagccuaccucagccaacacauuuuugccucagacuuccauggacccuggcuucucccuggggugcuguucccccgaccccacugccaccacaucccuccagccucagccucgagcgaaucccucagcgagucuccccagcccuccugucuccgcaagcccaccccacaucccucgcccaguuucuuucacaccucgcauugccacgcacacucacucacucccgagccugcuucuggcucugugccugccugcacuaaaagcuguggggucaggggccaucaucccucucuucacugugccaaaaaacaggccugaugcaucaacacggaucgcugaaggacgaccugccuucaagcacgcuccaucuggggcaaggcgggcaugcacucagauggcgaugcacugauggggguccacugggacuuacauuuacacagagcucgcugguaccgccggcccugggugugccucagcacguguucugggcacuuguugaugugccgcagggugaguuugcagaacaacuggugccuacagagcagagagaccaaauuuguagggacaguucacagcaaggauucagacugguggcugugucuuggacucaucccuggacagucuaccaugcggcuuggacaucgggcuuuuaaaggcucccggagcaauuccacucugaagcuggguggggaaccgucugacccaggccgacugcagccucuuaauguuuaccggaaaagcacgcauggcagccucacugacugcuccaggaugaguucaugcaagaggauggcuccaccuggagcaagggcucaaugaauggaaacauccuaucucuguuuugacgauuauuacaaagccuagcucccagcuaaaucaaagaccccuucugggguuaagggaagaacccaacgcuguucacaaccucaggugacaaaucacaagccucuacucaucugggaagcagccacaccccacaggacaaaccucaggugagcaaacgagcucaccaagaggccucgccgcugggaccgcaggugauuccagcacccgggcgcccaccugggucccagggcucccaacucugaaagaguaggggcugcagcacuggcggaguccagcggaggggcuguccuaauugcccugggccuccccgcgccgccgcggaccaccuacggguucuuggugcugggcacgaugugcggcucgaacucugcauagucgaaggccggggaggcgcggaccagccgcugguacuuuuugccgcggguguagaccuggagcuccggcaggcggcagggcagcucgugaccugucaggaugcaccucaccugcggacgcgugggcgggcaggacgucaggagggccagggcuccgcucccuggugcccccuccugccgcgcccccuucccucuccuccccugaucccgccgcgcccucuccccugcccuccccucucuccugcucuccccucuccccucuccccugcccucuccucuccccugcccuccccucagccccucaucccaacugcgcccuucuccgccacuccguuccccucccgcgcugcgaaccuugcgggcguccgucuggagccgcaggcucgggugcucccgcagaaacgcccgcacgucgcccggcaacucgcucauggccgacgcgcccgcggagcagcccggcggaagccgcucgcagaaccuggagccgggggcggggcucugggcgggacucagcggcgccccg

SEQ ID NO: 13106 - RNA, 16813 nt, Homo sapiens
gcaaaggccaggcagccaaccuccacugagccccgcccuccgggacggggucucccaugugcugagggaggacuucaggcugcuggggagaggguggcaucacugccagcccgaguugccuuugagaggccaugccaagcucacuggggcacaguuggccuugggccuggucagugcccuccuagccguggcuuccuaggccuggcuagaucggggaugagugguaaaggccccguagaccucuaccaucuucuugccuccuggcugcagcccuggcccaccacccucccugcacaccugguaggaacagagcugaggcacccagcagcugcucugguuuuuguccagggcgguggggcuguggggcccuggccgagugcaguccucauaaguuagcuguggcccagaggaccgugggggguguggagguacccagcacgugcuggcuuaucucccagaugaagaaugucagaagcaagggguggaguacgugccugccugccuggugcaccggaggaggaggagggaggaccagauggacggugacgggccucgcccgcgggaagccuucugggagcccacauccagugaugaggggggagcugcaagugaugacagcaugacagaccuguacccacguaagcagaacgggcccugcuucucccugacccucuacugucagcagggagcagacuguggugcugccuccccugcaaagguggcagcgaacucagccuaaaauaacugucagccaaucccuguguuccucccagcugagcuauucaccagaaaggaccuuggaagcacggaggauggggauggcacugaugacuuuuugacagacaaagaggaugagaaggcaaagcccccaagagagaaggccacugaugagagcaggagagagacgaccguguaccgagggcugguccagaagcgcgggaaggugagcugucaccuccucuguuaguguggcaguggcuuccccuagugaugguuuuccauuuguuuaaaaaaagaaaacugaaccuuuuucacaagugaaaucccaagccaacaacacacaagaaccauagaagccgaggccgcuggcuggcggaaggccgugagugccuaccauugcuucccagccagccccuuguggaagccaggcucuguggaccacggucaagaccacugguuugugaggacacccuccuaccucagacuaugagcugugguguguuuguccuuaccccugggcacagggaccugauuacuagccaccaccuuugccuuugccaucagggcaggaguggagacuuccccgccuuugguagauaagcaggaccaaggccaaaagaggacaagguccuaaugaguguguggcauugcacuguacuccucugaggcccugcugagcggggucuaauccugcagcuguuaaggaaacggggguggagaaagccucuguggguauuugaccgacaccucugaggcuguguggguggggagagcccugcacuccagggccccuucuccaugggaucagaaaggcucaguaaucagaauuuuguuuaucccacagaagcaguugggcucguugaaaaagaaguucaagagucaucaccgcaaacccaagagcuucagcuccuguaaacagccagguuaauaaaagcacaugccgugaaguuucgagaaagccuucagauauuucccccgcuccugaucaaaccguguguccucugaaugaucggcuguccccagugucuucucuacccacuuauccuugucucaugacaucugcugcccucuaaggcagggcugagggagucugucccccacacccaggaagcagcagggacucugagggacuaauucucucuggacauggcuucugaguggucuucagagaagccuagagaaguaaccucgcucacuggcauccugaggggagccccauucaggcugggcaacgcuauaggaucacacugcauacaacaaacgccauuauuuauuuugauguguuuccaaaaaucaaaacguuuucaaacacaacuaagauauaaaauacagcauaaaaugagauuuagaucuguuucccacauaaagcaaaaaaaucuuagaaauuguuuugccagaaucaauugguagaucccacuuauccuccccucccugcaaaggcaucuucccgaaucaggcccuagcccacccagggccaggagaaacaggaacacccacuaggacggaggcgcugcuggugcagaacuggugcugacugcucacguggccuccuuugguccacccuacuuuccaccaaucagccaaccaaccuugaccacagagaaaccgugacuuggccaaggucauuugaugggggcugucauacggcacuaacagggagcgagguguggaccaagagacagcccuggugagguugaaacacugagacaagccagucuucaugcagugagcacuugaaugaucacaggagaagagaacccauguccugaagccauugcucgaucuuaccaauauucggggguaaggaaguaggcuaccaggggaauauuugcaaacgcguugggacuaguucggcuguguuaaaaagguaggugacuuccaaaagcacuuaugagcagaaaccugccucaccccugcccugcagagccaauggaugagaggccaagagggaggcaggcucggggcugggccgcagcagcccuggagacaggcugagccagccuguccccagauaggucuaggggccagagagguguucgacuacccuuguggcauuuacuauggugcagacgacagggagcaacaagcaguuaagcucccccaaaaagagaaacacaguauaaggcaguguuagaaaacuuuaaauacaggauuaagaucaaaucgguaaggcaucacaaauuguaaaaaggaauuuuggcugcauucggcauagcaaacggacaaucugagugagcgacagccucaggaaaguggugugucggggcuguccacagggcgagugcagcugggaaagggcggugcugcucagccagggcggccugcgcuuucgagaccuugcucagaaaaggccccaugugagguaacuggguugaguccgugggucuccagugcugggagcuccugccacacccccugcccacagcggcugcggcucugcaagcuggucugagcagcuggccaggcuggcuugcagggugcugcugcuggggcuaccccuguguggucucacuagcccuucccacugccagcuuggaggccagcagcacccagaccagcagcuuccccaaggacuucuugccccuccaccuugccucaagcuacuaaaacucccaggguguuacccaauaaaacacuuggcaccaauccaagcugauuuucugaccgaugacuuuuaucauaaacagcagcuucuaccaccccuuuaauacugcaucauucuuugggugucccuaaauguuuucacuauuccuauaaaauacaaugcggggcagaaacaacaucaaagccacuggugugauuuuaaaccagggagauuaacuguuuugagguuuggcugaaccacccaaaauaauuuaguaguuuccgcuaaaaauguaaacuuacaaauaagagggagacugcuuugaaugauaauaccaaugcgucugcucacaguacagcuugaaggcccccuccuguacccccacaaaaaaacucaaaaauaggacugagaugccacagccaagcgggcuguucacuccaaagccucggcgugggggaggcuuccagcugccaggcuggccugcacugaagggucagacgccagacuguggcuccagagcagacugagccaucgauucucaggugucucugcaaauaaaguucucaaaacaucugugccuuuaccaagggaggggaagggaagaggauacauaaaagcuggcaguuuuguugaauccaccccgaaccaguccuugacggccacgggucuuagccaggcagguagggaucugugacuguuaccacuccuucuucuucucauccauggagacacccccagggcccagggccaccaccaggagcaagcccccaaucaccgacauggucuggaagaagucguauuucaggaagucaugcaugggcuuguagacuggaaugguccagaaggcguugaaauauacguugauggcaaagagccacacaacaagagucaaagcagccagcuugguuuuaaaaccaauggccacuaaaaucaucagagcugugcccacgauguucuggacaaucugcauagguugaaacguaagaaauucaaaauaaaugugaggaaaagagaugcuuuauaaacaaaaguuccagcugcugcacgucaugaagucucuauccaucaggcugauguagcuacugcugagacggcugcuggugcaaguagggagauaaaagccaaagggaggcaggaggcaauaaagcaccagcuuugaaauguggaagguuuggggaagacugaaguucccaacuaguaacaggcugugauuuaccaagaugaaucucuaauccauaacuaaauucccaagugcuucuuggcccacccagccauccaggccagaaacauccucucuccucucuccauggcgccaggagcucuuccuggacacuacccggccagggcucucagucagcuccggaggugugcucuggaagcuccuggaggccugccccugacaccugacacacaggaauuacuugagaaagauacgaacagugaggaaagaaagaagaguaaggggagcccggguggagagccuuggccaaccaagggccaagcacacuccaccaaggucagagguucuggccuucauuugcuggaaagaaggcuugacacacaagagauugacgauguuuuggucuguuuuaaugggaucaaaaaguuugcuccgccgagcacgguggcucacgccuguaaucccagcaauuugggaggcugagacaggcagaucacgaggggucaggagaucgagaccauccuggcuaacacggugaaacccugucucuacuaaaaauacaaaaaauuagccaggcguguuggcaggcgccuguagucccagcugcucgggaggcugaggcaggagaauggcgugaacccgggaggcggaacuugcggugagccgagaucacgcacugcacuccagccugggggacagagcgagacuccgucucaaaaaaaaaaaaaaaaaaguuugcuccauuucagcagcucccccaggcugugguuaauacccaaccagggaggggugagcagggagggggugggggagggacagcauucacaggaaaccagaccgguucaggcaaguaggaauacuuacagaaaagaagcuggcgucaaagugaaggagggucaugaacaucagaaccagcaagacccugccuccgagcugcauguacuguuugggggagcucucacgcaugguggggacgcccgcaaacaugcucuucccuucagaacgggauucugcuaggagcagcaacaggccuccucccagggccagguuccugaggaacagauaugugggcuggaagcuaagccucaccaggaucuggccugucugugagaccaggugcagggagaccuugcugccaguauaagaaggcccuuacuucccuuucuccaaacccagugaucugccaagcaggaccaggcaggcaugcgcacaggaccucagacucgaguuacacccauguaaaaccuuacauagcucaggagacagagguaucuuuacaacucgacagugacaggcuaccugaacacacacacaaccgaguccuagucacagcuucaguguugaccagcuggguccccguggucaggucuguccuccacucagacccggaguccccacacccgugaaauaagggucagaagagacggcuucagucucuacuauucuaggggcucugcaacauccucuucagaaccuguuucuaagaggcacaauuuagacagggggguccaaucuuuuggcuucccugggcuacccuggaagaacugucuuggccacacauaaaauacacuaaugcuaaugauaggugaugagcuaaaaaauaaaacuuaaaaaucacaaaaaaaacucucaauguuuuaagaaaguuuuugaguuuguguugggccauguucaccccguggaccacaggcuggacaagcuugguuuagacccagagaagucuacucaaaccaauaguuaacugaguuuagaaauacagauugaguaucccuaaccugaaaugcuuaggacccaaaguguuucagauuuugguauauuugcauuauauacuuauuggcugagcaucccaaaucugaaaauccaaaaccugaaaugcuccaaugagcacuuccuuugagcgucauguuggugcccaagauuuuucccauuuuggagcauuucagacuuuggauuugcaaugcucaaccuguagaaggagcguauacuaaaaccaaccagaaugcacauaccucaucaaaaacuucaagucccauaaaaugcuguaggcaaucgucugaggggaaagaagagagagauacuugagucucagccuuuccaaaggcauuuccacagacuucauaauacauuaggccgucucuccaaugucagcuggagucuaaaacacacaaaaccauuguaggagaccgaggacagaucuaagcucaaaaaugugguucuguauuucucaagaaaugugcuaugauguuccagagaacaaagugauucugagaccacugauguggauucagauauucuguucccagcauuucauucugaauaaccaaguauucuucuuuaugaagcaacgugauaacaagacagcauccuggcugcagccaagcucgagacuucccuugucacgguaaucauagaaaugggacaaaagauggcccaguaccgaaugaccugccucuacagcccugcuugggcucacgacuuccccagaagagaaaggagcuccaggcagucagagacaugcagggggcugaagggggagugacacugaacccucaaggaugucuuuucagaagcucugcuccaccagagcaaagagaagggagccccgaccacgcggcccguguaccugcagagcuaugauuccaaagagcccgaagcaggcguacugcacgaaguuccugcucaacaccaggacgcagccagcuggagagaaggacaaggguuagggggccugagggugggugccggcggggagcacugucuugauacacugcuaccucaccuggcccuuagguccagaggcagccaaaccaccuacccaagcaaaagacaacuucuggaagaauuaaugauaggcaaggaccacacaugguaagcugacuagacuuaucacaaacaccagaaaguggagcccuugccgucauaaagaaugggcuguuucccacaaucagcucccaagucagccacccaccugagguaggcaauuaacugcucuacuguggacugccagccagacuccagcaucuccugcuuugggucccugacagggaccauguccuauuuccuuagcaagcucuaaagcagugagcucagggcuagagacuaagcguccccaccaaggcuugcagaaccggacuccuggccuggcacagcugagcuggagaagaggggaauggaggggggacagcaguccaggagacccccgaguucacacacagccucccaacugcuaacgaucauggaacaagacgcccagugaauccugaccacccgcaaagccacucacucagcugucccagcaaguugaggaagacgaaggacgaggccagcagguagccgcaguuccagguggugucgauguagucgcgcugcucgcuccacuggaaccacauacggaugccguccuccaggaaggugcugaucagacagaggcgcgccacguggggcagguacugcuuugugacacggaggaacugcagggccacagaaacccaagggugagguggcugcggcggggagcaccaggccgcugccaggcacguccuugggcggggugugugaggaacagacgcuguggaaggcaagagcucuugucagccccggugccuucccagggcagacuagggggcucucagugcuugcuccugagcgcuacccugugagucuggacacaugcaacaauccaaggaucagucccggagaugcaugacuugacguuaggcccucuggggcagauccuauagggcagcagcccuaacacucugcuaccgugauuucccccagugccucggcaggcaacuacagucuuccaagguggcacugccacaagacacagagcugcucuuuucggucaaaggcauuuacaaguuggaaucacagaaugacaucugaaaaggcacuuagaggucaucuauccaacguuucugcaccucagcacuacuggcaucugaggccaggccacucuuugccgugggucauccugggugcugcaggcuaugacgcacgacaugucugcccacgacaugccagcagcagccucccuccugaggcaccgcugcacuuugccaggcaucuccgcugcucugguccaaccccucaccuuacaaauggcuauauuaaacccagcgggaagggguuccccuaggcuucgcagaccugauggugcaaugccaagacuugaccccagccugcaggucacacauggcugaggugccaagggccuggaccucccagccugcccagugacgcccagaguacccugacagaacaaggguuggcuuaggugacagccagggugccacaccuagagggccacaugguugacugaauaguaagaucacguuuacaguuauccgaaaaucuccagagcagcaggaggaggccccaggcucuggacagcgcaugugugcuguugcaaaccagggcuggcgcuucccagcccgacggagcucuccccugcaagcucaggaucugacguggggacugugugugcagcaaccgucagcgcagcaugaagcugguaccgcuaauggcuagaaagcgcugggauuuugucaaagccugcauaaucucgagcaaauuaaaacacacuaacaaaugggauggacagcuguuucaacagcaaugaaacgcaagugugugaaaucacugucaaaugucaaagggaaagaaaacauuuaugacuuccugcugugcugugagucaggucauuuaugacggcuggguuagguagccaacaugcacuaucggaugccagguacaaaugucacgcagguucaccccaugcacuuuucucuuaucacccaugcaaaacugagauauaaagugaaagaaauacuguaacacagcaaguccuucggagaaagaucaggggacccauccaccaacgcauguugggaagccagagucuaaagagcacccgagaggcugacccccacgggaggcgagcgaacgucagcugcacaggccuccuagggcugacuaaaccuacuguuggaacaaaggaagauaugcguguuucuuauuuuucagcauuuuuuaaaguugcuucaaaguccuagacacugcugaagcugcccaucucaguuaccacgccccuggguguucaggucacccuccagccugucagguggggcccugacuaggucagcacugcagauuggcucccauguggcagagaacggaggcagagauuacaaagccagguggccauucuccccaaacccacugcgcccugcagugucaguucugcacacauuuacucagccuuugacuccacggaagugaugggagaaaucacagugaccgacagauacccagagaaucaccaaguggguuugggagaugaagugcagguggagguucugaggcccugugaucucauccugcccugguaccauccagccagcacaccgugugaccuggacacgcccaguuacuuuuuugagagugucucuacuauccugcaguagagugaggccaccugaacuaaugguugguaagaugcuuuccaacuuuacuaggaggaagaccuuguuucacuuuuuauuuuuaaaaaggccccaaauacuccccugugaauuuuagggccaaugcagagaaccagcacaagaugcccaugugcacagugugacgcaaccugcaucacacuggguggugggaaaggugacgccacacacccuccccagguucugccucauggccccguugcucucuaaaugcccagcaacaguguaaucacccauauuccauggaagagagaaagcacaccaccguggcacacgaugugccacugcucucaaggaauggccucacaucguggcccagcugggaagccccagcaaggacacaagccuuuaucucaucugaaccuggggaaaagcaaccacugggaaggaagagcucaacaggaggcuguccagaccucugagaugagacggagccguggugggacucccagggcaggguguggguguggggcguggaccccaacagcagcagagagguagacugcaauccauacccaagacagacaccagagguguucugacuugcuucuaaaaugagagcugugagccacucacuggccugagaugagcaaaccagcccagccaugggcugcggucuaagccucccccaguugcaggaccugcauuuaacaugcucaucuacgugcacagcccacgagauugaggcaguguuuaaaagucucuuugaaugagucugcgacucuuaauuugagugucugggucaagaggauuaaagagcaaaaaagagagagaaggugggacaggcaauucacaccuccuucccugcgcaaacauggugacgaaacagacacagcucuuggcuuuggggaaaaauaugcaaaaaucuagguacugccuucugaacugagcacaccuacugcuuggcuguccugguuuucaaaggcaagccugguccacacugaaggcugaagucaggcugaugcagucuccucuaaacuggccaccauuuaaugagcaucuguuuggacugaacacugaaaaagccacguuuaaagacaaggcccaacauuaaccuuauuuccuacaugcauguuggucacaacuacuucaacuuggccacuggaaccaugucaugccacucuagaacacgucccagagccaguguccccucagcacagcagagaagagcccucaacacaggcaggacacacagcaccccaggacagacaagagcagccgcacugcaggcacuaaggccauugcugguagccagcacacaggugaccuguguaaacacggcgagcacauaaaacuugugacagucccccucccccccauuagagaacugcgacagcagagccagagguggcuguugaccuggcaggcugcaggaagaagaugacaguuagcucaccucuguggccaagcuucucauuaagucucuccgagaaccgcgccaucaagcaggauaugguucauaagcagugacagcaucugaggggcuuaacaggaagacugauauuucucucaaaggggugguuauuuuagacgacugaaggggauuuuagaaacguaauuaauuauauccacccugagaugacuuccugggcauccagugaucacugucacagccaccugcagcucccacgccacacagaaaacuccacuuucucuucacacucaggacagaaagaaauugaggaaagcagcuugcaaauucguggugaaugugaacaucgacgaaaaaggcaggucagauuuccuugaucaccaaggacuggggcugccuuguucaaagcccaacucaggucccacacauccuagaaacaagcaccugcggcccagcggcuucccucacaucagccugucagagcuggcucgagcucacuggcucacugcagcuccagaacuuccccgagccccgcucccaugcugcucuauagguucacacugcacccugcagggccagaaaggaugucgccagcccaaugugggagaugauggccuggcuuuacuaaaaaacugugugaucaaaaucccaacuauaggaaagacguaacugagaacgacugggccccauguucugggaggagccccgcuaaccacaaccuccucugcuccucgcccgcacuccccugaagagugaguuuuaaccucccguuaagaucaucgcacaaagaaaagugagucagcuccucuuugccuucucuccccacuccuucaugauauagggcaggguaugacagagccugccacugucaccaggacuuugccacaccagucaccagcaugguguucaucgggacccucacagugccugugccaccugcaaguucagggguccucaggccuauccuugcuuccccagcacuucaacuagggccgaggccagcuccuagggcccaggacuagcucugccacucuugaggacagguuaaaaacaccaaaggucacacuggagaggaaggccccaugcagcuuuucugucaccuuggugaugagccaccaggcagaacccauuaagugcuaauauugcuguuuauggguauaaacugcuuagaagcuacauuuuacagagugucuaauaggcaaugaggagcagcugcaggcauggacauuaguuuggauugcugaguucauuaguuucuggacccuucccauggcuuccaaaugccaagcuccugcauagagcacgucucagcaguuucuacagagcauggcuccugggagcaagaggacacugucccuggcugccagagcaagcagcuugaugccagaggcagagagacaagagaugcaacuguggggagccugccagcagaaacuaaccagacugcucguccccguggaccagccucugcaggccagaaggaaagaucagucaaccaagcagugaggaacccagccuuugggguaacaggaugcggacucagucuccaggccaccacaagccagugcggccagccaaccucccucugcccaucugaagauggugacgcucuggccaaccuccuacagucaagaaguucacaaaaggaaugucuaucauggacccggcccagugaaagacuuaaugucauugucauaauacuggaagacacugggccugggaaacuaagcuuacuuaggucuugcuuucagcagcccacacuuucuggucaaaucuugucacuucaguuuugcucuuguuuucugaagaugugaaaaaauggaugugucacuuuaucugaucagugacuuccaugguaauccucuaucggcuucaaauuaggucauuuucauguaaaagccuggucuggcagcuuuaaguacuaugugaauaaagagaaacaaagccccaccugggcuuggucagauucuguccacaagaagccauauuuugacuucgaacccuguuuacuugccugcaucugucugauugggguuugggcgaguacaaguagcugcccucccaagcugcccacaaaagggcauggaagcucccacagccaugcucugccaccaccuagacggacucuuaaggagaucaucugacggcggcagccugcgcugccuuacagauauggugccuuacagauaugguccuaacccacuuggguuuuguaugugagcagccccuucacccgcuagugcucuucccuugacuugugccagaagagcaacaccaggggcugggggcgcuggggaccaagacccggcuuuucuuggucuuggucacaggcaagucuaggagccugagcagguuuggccuccccucaguaaccugggagaggucgacucugugcccccucaagagccuuuccaguuccaagcuacugcuucuuucauuuaaaacauaacagaauacaugaugaaggcugggcgcgguggcucaggcauguaaucccagaacuuuaggaggccaaggcggaucaccuaaggucagguguuugagaccagccuggacaacaugacaacauggcaaaacgcugucucuacuaaaaacacaaaaauuagcggggcgugguggcgugggccugucaucucagcuacugaggaggcugaggcaggagaauagcuugaacccgggaggcggagguugcagugagaugagauugcgccacugcacuccagccugggugacaaaguaagacucugucuccaaaaaaaacauaauaacaaaacaugaagaaaaggcagggcaggguggcucacgccuguaaucccagcacuuugggaggcuaaggcaggcggaccaccugaggucgggaguucgagaccagccuggccaacauggggaaaccccgucucaacuaaaaauacaaaaaaauuagcugggcgugguggcaggcgccuguaaucccagcuacuucgggcugaggcaggagaauugcuugaauccgggaggcggggguugcagugagccgagaucgcaccauuacacuccagccugagcgaaauucugucucaaaaaaaaaaaaaaaaaaaaagaagaagaaaacaguaugugaagacacugggaacuuuuuuuugucaauaggggagucugucauuugcuagugggcagcagcuugacuggagacauuugaucuagauuugguuaugaaauucacuugcaaauccagguuuuccaggacaaagagcgaguguauguagcucucauccuucccucagcuaugaggagccaucuucuuagggagcugcgacuuggagaaauauaaaugggucacuauaaauuaugucaaugaaaacugacaaaccuaaaaggucuaccugguucuugagagcuuuugauaugaauuguuuuuaaaauugugucuuuaaaggcugggugccguggcucacgccuguaaucccagcacuuugggaggccgaggugggcagaccaccugaggucgggaguucgagaccagccugaccaacauggagaaacccuguuucuacuaaaaaaaaaaaaaauacaaaauuggcugggugugacggugcaugccuguaaucccagcuacucgggaggcugaggcaggagaaucgcuugaacccaggaguuggagguuguggugugcugagaucacaccauugcacuccagccugggcaacaaggucaaaacaccaucucaaagaaaaaauaaauaaauaaaaauaaauaaacaaauaaaauugugucuuuaagcacaaaaucagaaucuuagggaaaaaaugcuucgucaaguugauuacuuuuucccuccaaauuuaaaauauuggcucacagaaaguguugcaaugagaaccgauggugaggucacacuagaaagagaucaccccccaggaggaacggaagagcucaauagcugaucagaaaacggucacuuacucuuuucuuuuuuuuuuaaaccacacauauacaagccuuccgauaagucuaggccucagaguuugaugacucacuaccaccuccagaaaaauuuaaaaauuuaaccaucacuacuuaaaacucuagcaaagccacacgaacacauuaaguaaaccgaggaaaaaacggcaagugggccacacaaggcucucccugcggggauaaggcuguuaauuugucgacauaacgggauucuuuuagaaguaaaaggcauaaaucugcguaaccaccaccaccuuuuguuuuuguuuuuuuguucugucaagcuuaaucaagaaagagggaagggaguugugucccuucacuuuguaggaucggauccuguccacccaguucccgaaugcucucaacaguuacccaaccgccuguuucaaaggcuucccuguugcucagaaugccaccuggacacuucuggaaggagacuaucagggagauaggcuuccccuccucccaggcuguguacagguccccacucaauccagcccagggcagaguccaaacggggagggagacgcagacagggucaaagggaccccaagaguccagcacaucugggaaagagaaaaggaaaaggugcuguggcuuccuguagcuggggcgcacgccagcgcgcccccuuuccucugggaggacccccggcccccguucguccccgagcucccagcccgccuccgggagccccagugagaggaaaaacgugcggggaccccccagcagcuccaaacgccgaggcgcuccccgcgagccucagacccgacccaacgccaggacucgcgccgccggcccgggaagaaacccccacagcccgcgccccgggcuggcuggagggugggggcggcuagccaggcagggcgccgaggcccgggcuccgggagcggcccagcgggcaggggagacugggcccggaggccggguuuggggcuguccagccgggacagagggcccgggcgggggggucccucugugggaacaaggagucagggggcggcccgggccuggcgcccugcgcugggaggccgacuccggagcggcccgggcggccugggucgggaccggggccgggggaggagcccgcaggccgcaccuggucggcgaaguccucggccgugcccaucaggucguucuggcccauggcgacggcgggaggcucggcucggcucgcucgcucgcucgcuggcucucgcccgucggcgcccgcacccgcugcggccuccacaggaagugcccggcggccggccucgcuccgcgucggcugcggcuccagcggcugccacguaggccaagccuuaaaggggccgcgcgccgcccgggcccgccccggugcgucuuaaaggggccacgcgccauccccagccucccgacccauccgcucgaagccacgcccgccgcgcucgacgccacgccucucacgcuggaggccccgcccgccgcgcgcaggcccugcggucccucccggcccggcggaacgcguc

SEQ ID NO: 13107 - RNA, 12081 nt, Homo sapiens
agccgguuguggagagacgagcgcuuccggggacuggagcgugcgugcugagguaugcgcaacgcgugcggggucucuuccggagucuuuuccuggacggggucccugcgguggguguguuucggccuggccugggcaggcgcuugugcugccagggcgccgggcccggggaggccggggucucggguggccgccggcccaggcgcuggacggcagcaggauggggaaggcgaagguccccgccuccaagcgcgccccgagcagccccguggcuaagccggguccugucaagacgcucacucggaagaaaaacaagaagaaaaaaagguuuuggaaaagcaaggcgcgggaaguaagcaagaagccagcaagcggccccggugcuguggugcgaccuccaaaggcaccagaagacuuuucucaaaacuggaaggcgcugcaagaggugaggcuugagggggcccgggcggagcgcugcgcagcucauucccgcagaacgcgacggagggaaagacuuggguagccccaaaagaccuguaaaggcagauuugaaucgaaaucuuguaaacagcuuuucacaagaaagguggccuguugagggaggucucgaacuuguuugcuugaaagaaauugaugaaagaauuauuucaaguacaaaaaagcaaagauaaacccuuguaccuuuugcauaaugaacuaacuagaauggauuuuacaaagagaaauuuagcuuaaaaucccgaaaccaggccgggcgcggggccucacgccugugaucccagcacuuugggaggccgaggcgggcagauccccugaggucaagaguucaagaccagcccggccaacauggugaaaccccgugucuacuaaaaaaguacaaaaaauauuagccgggcgugauggcgcgcgccgguagucgcagcuacucggggagccugaggcagaagaaucgcuugaacccgggaggcagaggcaguaguaagccgaaaucgcgccacugcacuccagccugggcgacagagcgagacuccaucucaaacaacaacaacgaaagaacacacuggucuguguagcaagacagggagaaagaagauuccuguguagaagugaaaagcagauagcagacaugugaugggguucuagcgacacuuacggucuugaaguaaauacuaauugagcuccuaaaaaugugcacucugccaugugcucuaugccauguguguugcaauccccacaauaagacugugagguggacacuuucaucaucucuauuguacagaugaggaaauaggcuggaaaaguuuaaauagaucaucuaagauugcggcugggaaccagguggcugacucuggaguccaugcuuuuaaggcuguguuguaccugcugucucccuagugaccugcacuucuguagagguugccugcucucucccagacacucuuccacgugcgucacucauacauucuuaccacaucccuuggagcucccuuggagcuaccuccuguuaggaucauagcucacugcugccugggcuccagugauucuccugccucagccucccgaguagcccacacguguaaucccagcacuuugggaggcccaggcaggaggaucacuugagcucaggaguucaaguccagccugggcaacauggugagauuccaucucuaaauaaaaguaaaaaguaguuuuuuuaaaaaagaaaugugauccccagugguggagauggggcccauaggagguauugggucauggggguagaucccucaugaaugacuuggugcccuccccucaguaacgaguaaguucucacucugcugguucauuugagagcugguuguuuaaaaagagccuagcaccuuuuuugcuugcucucucaccacgcaacacaccugcucccccuucaccuuacaccaugaugggaagcuuccuucggccucaccagaagcagaugcuggcaccaugcuucuuguacaaccugcaaaaccaugagcuacauaaacguuuuuucuuuauaaauuaccaaacacagguauuccuuuauagcagugcacaaugaacuaauacagaugggguuucacuuuguugcccaggcuggucuucaacuccugaccucaagcaauccucccaccucagccuccccgagcgcuucuugaaccuccuaauacucugcacaguaucucagugcagacauuccugucuuaacacacaggaccagucaaauucccgugggcagccccaggguucugugggauuucuugaacaccaacucuucuuccuucucccaagaaagaaaagcaaaauaagugaauggaagggaugugugcuauagggaaacuuuggaguguuuucuaauucauccaagaaagucagcccuucaguucuuuaccuaucacagaacagguaaguagcacccgccucaucaucgcacugugguggcgcccacucccacuggggauuugaacacagggaggaagcugggcucuaagacuacaggagccucugcuugggugacagccaagguguguggcugcuagcaguucuucagccacuccaguuugacagaagcuuuucuuuucauuuaugacaccccccaccuuccugagaucuucacagcaguagcaaaccagggaaucuuguaaaaaaaaaaaaagcgauuucuguguagcaggauguuggcccaagcugugagggaaguuaacuccaaaauucuuucuagauaagcugaaaagggaaguggucugugguguccagccacucaacagguacccaagguguagaaugaguuugacauuuuguaugcaugaaggagcaggugcaaaaugcauuauaauaagauaagcaaagaaacagcauuucaccacaagugacccaugagaaugaaaaagagcuuuuuccaaaccguuugaaaaugaauuucagugaugcggaugggaauuguauagauguguuugguguauauguguguauauacauacacacguaaguuuuuucaaucugcuguguguaauuuccaaauucaaaugcagcauguauuuuauuuugggucccaguggcugcugaaacaaaaaucucaggccccagaaaagccucuugucaucucucagauggguuccaaaaagaagcccaaaauuauccagcaaaacaaaaaagagaccucgccucaagugaagggagaggagaugccggcaggaaaagaccaggaggccagcaggggcucuguuccuucagguuccaagauggacaggagggcgccaguaccucgcaccaaggccaguggaacagagcacaauaagaaaggaaccaaggaaaggacaaauggugauauuguuccagaacgaggggacaucgagcauaagaagcggaaagcuaaggaggcagccccagccccacccaccgaguaaguaugggccaccucaccacugagaaccgaggcacagcgacuucaccaaggccugucuccuuauggaggcugguggccucaccgcagucucuccaucacuuuacccugaugucgucuguuccuuuguuuacucgcuguuacuuguuuuccccuagagugugcgcaugauaaggcagggccugcuucuuccgagcguugagcagagcucagcauuuagugggugccaguacacguguguggaaggaaagcgugcugaagccagaaagacccaaguaugaggccugucccugcuucucgccaguugggugguuuggggcaaguuucugacguccucugugccuugugguagucaugguggcaucauaaggagauugugagguuggcacucuuggcucagugccuggugauuacuucaacccugugauggagccaggugugguggcuguugccugugaucccagcuccuugggaggccaaggugggaggaucacuugaucccaggagguugaggcugcagugagcugugauugcacuacugccuccagcccgggugacggagcaagacucucaaaaaaacaagugaaaagaauaaacccugugcuggccacccacgugggguggaccgggagucaguggccuucucugaaugguucagcuggaggugacguguucauaaguuacagcuggcuucauguugccuggguguucaggacacagucgcugauggcugaggaaugagccauuugggggccucccuguguugugcuaggcaggcugucugggauagaguucagugaggugggccugcuccucccucuugaggcuuauugucaagugcaguagacagacuguaaacugcagcuguugauuaaguguggucaggauaaaucuagugaggagaagguauugggugccuggaacaagagggacguguccauucaguggggccaggaauggcuuuucuaaggaaaugacauuuaaccuuagcccaagagacagauuccccaggcagguguuacgugccugugugagcuuccuaguacggagggcaagggguucuguguuuccaucuuacaggcauucugucugucuguuuccuaaguguucaauaaugaacguguuaccuucauaauuaaaauguuagcacucauuacacuugggugguggguuauguguuucuguuuuauauucuuuguguuugucuguguuccuaaaucuugaauaaugaguguauuuucuaauuaaaaagaaaagagaugaggccaggugcugugacucacaccuguaaucccagcucuuugggaggccgaggcagguggaucacuugaggucaggaguucaagaccagccuggccaacaugacgaaaccccguaucuacugaaaauacaaaaaauuagccaggcguggcagugggcgccuguaaaaucccagcuacuagggaggcugagacaagagaaucacuugaaccugggaggcaaagguugcagugagccaagaucaugccacugcacuccagguugggugacccagugagacuccaucucaaaaaaaaaaggaaaaugccaagaugaucaaaauagcagaagcagcagggccagcagucggggugucuggggccagccugugggagaggcaggcugugccaucgcuccacucaccugcacagucagccccacagccccaccccaccaguugcacuagggucuucuggugaucagccuguuaucuuugccuuuuagggaagacaucugguuugacgacguggacccagcggauaucgaagcugccauagguccagaggcggccaagauagcgaggaaacaguugggucagagcgagggcagcgucagccucagccucgugaaagagcaggccuucggcggguacgcuggucucagggaguggggucugcuggggaugcuuagccguggagggcggggcuucuucaaggaagaggaugcuuuccucucccugaggugaaugaggcaagcaccucccaggguccugcuaagaaccaggaccacacagagcuugucacgugggugcaaaugagugaggggcagagagcuuuucucugcugacacuuaguccauggaucccuggggcucugaccuggagcccuguggccugccguguuuauuaaacuacagccuuugguuacccuucagccugacaagagccuuagccuuggacugugagauggugggcgugggcccuaagggggaggagagcauggccgcccguguguccaucgugaaccaguaugggaagugcguuuaugacaaguacgucaaaccaacugagcccgugacggacuauaggacagcggucagugggauucggccugagaaccucaagcaggguaugucauccacagcucaggaacuuagaagggaaaguaguaacuggauucguuuucucccuuuuguucccuuuucugucugagaccacucacugcagcugguuuugaugcgucuugucuccuuuuggggcgauggguuuuaaaauacaaaaggcauccuuagacggcuuuacacccauuuaugccuugcacuucauugccuccuguccgcugacuucaagaccaggccaguagcugggcacgguggcucaugccuguagucccagcuacucaggaggcugaggagggaggauugcuugaacccaggaguucaaguccagccuggacaacauagcgagaccucauuucuaaaaaaaauuauuauuuuuuuuugagauggaguuuugcucuuguugcccaggcugaagugcaauggcacaaucugggcucacugcaaccuccgccuccuggguucaagcgauucuccugccucagccucccgaguagcugggauuacaggcauaugccaccacacccgacuaauuuuuuauuuuaaguagagacaggguuucuccacauuggucaggcuggucuugaacucccgaacucaggugauccgccugccuccgccucccaaagugcuggaauuacaggcaugacccacugcaccuggccuucuaaaaaauauuuuuaaaaaauuagcuggucccacuuggcucgggccacccuuggucuaaucaccccuguucgggggguacaagugggguuggugguggggugguccccagaagcaggcaaggcugccucuggagcccagggccuagggcaacacaucucuacccauuuuugugggggcaguuuuguuuuuauuuccauuugggaaauugucaaguaaaucaugagguugaauaggcagaaccacgcugccaggcggcucuaaaaguuucucagugccuacacucaacauaugcucuccuccagccaugagccgacuuugcagacuguguggagcacuuuauuccucuccucagaggugguucucgcagccaccccugccaggggcccacaaggcacuucucccagggggguggguggaugugguggcuucgagucacccuccguaguggcauugcaggccugaccauuugucuuaggucugaccagggguaggagcggggcugccuccucacagaaugauggugauguguguguugcaaaaaaccgcuucuuuguguugauuuuccaggagaagagcuugaaguuguucagaaggaaguggcagagaugcugaagggcagaauucuaguggggcacgcucugcauaaugaccuaaagguacugggcucucuccuggggacucagccugccccugcuccguggguguuacacucacgcccuugcuguguuggggaguuuuaacaauguguggguuugugcucuauguugggaauacuuugguaauaauaucagauaccgcgugcugaguucuuacuguguuuuaggagccaugccaggcucuuguuuugagagcccccagcgaaacugggguacccauaccagagcagcuggcaaccccgcccuaaugagaaaugaaggugcugauaccccuuuuaccuggaggaaggccuaauguccaguugucccauccgugaccagggucccuccacaggaaacaaguuuauccuggcagaugcccuguggcccauguucagguuacgcuugccuaaccaucacccuggcccugggagcuugccuuugccuucuuucuggcgucccgaggaaaaucccgccuggggcagccccugguucuucagauggaaagugcaaauucagacaccaccaccgugggaaacaaguucaaagacauauacagacccugggcagggaaggcgucauggguggggagggcagccugccaucuccuggucacccgaggcaggaaugaagagucaggcagagcgaguacguguguauuuacaggagaacagggugggggucacuuugaguuuaugggcaaaugccuggauguugguuuaaaggacacagugggaacagcggggaggccagucugcuagaugggagagacacuuaaguugucaccucugcccaccggcuugaagcacuugaguguggugaggaacuugaagccguucagaaggaagugacagagaugcuaauguucaggcagcagccuuugcuauggugcucccgugacggcacuguagagaucccuugaauccauugaagaugcuggagguguucaugcuuguuuacagagggugaaacugaggugagaaccccccgggcaguguccucacagaaaggucuucugugugcuccugcuguacccccucagagacugcugccguggggacucguccuucccuccugacucugacuccaucccuggcaccuugcgcagcacauguucaagucuuucuugaagaugaugcuaaggaccagacacaguggcuuaugccuguaaucgcagcuuuuugggaggcugaggcuggaggauugcuugaggccgggaguuagagaccagccugaguaacauaggggagaccccaucucuauaaaaaauuuuaaaauuagccaggugugguggcgugugccuguugucccagcuacucaggagacugggguaggaggaucaguugagcccaggagguuaaggcugcagugagccaugauuacccuauagcacugcagcccaggugacagagugagauccuaucaaaaaacaaaacaaaacaaaaaauugcaugcuaagauugcaagaugagcuguuaaaauguguuauuugcaacuuccugauguguagaaccaacucaaaauacaaguauaauauaggaauaaguugguugcugguuaacuguugacuguuuuucuccuacuuccuugauuucaagauuuuguuuuuauugucucugacuguugggcaucagcuuaagucagugcaauaaauuuccuucuggaguugaaauucauaucagugccuuguuuccaugugugugugacacacuuggauucccuacaagauguuacuugcagggcagccgcguuggcucacaccuguaaucccagcacuuugggaggccgaggcggguggaucaccugaggucaggaguucgagaccagccuggccaacauggcaaaacccugucucuacuaaaaaauacaaaaauuagccaggcaugguggcgggcacuuguaaucccagcuacucgggaggcugaggcaggagaaucacuugaaaccuggggucggagguugcagucagcaaagauugagccacugcauuccagccugggugacagagcaagacuccgucacacacacacacacacacacacacacacacacacacacacacacacacagauguuacuugcaaaagguggcggggggaggggguucugcuacuacaaaccaaaaaugaaaaugauuaucauuauauuuuauuuuucuagguacuauuucuugaucauccaaaaaagaagauucgggacacacagaaauauaaaccuuucaagagucaaguaaagguacuuagaaugagugugacucaagauacuguauuucuguuuugcuggucacuucauuguuucuggucacugguggcugacuuguugguuaaaggguuuuuguuuuuucuuuuaaccuuuaaaacuagaaggaauguuuaaaaauagaguucugcuaauugcugaccuuaaaaaugauugcaacggagggcaaguuauuuccacucuaaccucugaaacagggucacugacuaagggccugguaccacugucguaucugcucuagagggugccaagggcagagccguucuucauccuuuuuuuuuuuuuuagacagggucuugcucugucacccaggcuggagugcaauggcauaaucuuggcucacuguaacugccaccucccaggcucaggcaauccuuccaccuuagccucugaaguagcugggacugcaggcauaugccaccaccccuggcuaauuuuuuuauuuuuauuuuuuuagagauagggucuugcuguguugcccuggcuauucucaaacuccuggguucaagugaucugcccucguuggccuccuaagugcugagauuacaggugugaaccaccaugccuggccagagcugucccucuugaaauaagcagggaggccucaagaugggagauggggaugcugacuccuccccuggcccucuccuuuuauuggcugauagggguguaucaccagcccaucaugcuauaaauggcagcugguggcuaccacccuaagugccaugagcaccucuccacugagaggcaaacuguaggucgcuugggugagguucaguagccaaccgcucccugcuugguggggugacccucuuugggccgagccugcagaggcccccacccgccucuucccccuuugcagaguggaaggccgucucugagacuacuuucagagaagauccuugggcuccagguccagcaggcggagcacuguucaguaaguguguccugugggguaguucaugggguuuggggcgguuucccaccuggaaccagacaugagucaccugacacagacaugggggagguggggcuugggcaccuacuuauccuacgaggcuauuggucaaaaaaaaaaaaugguagagcggaguuacggaauuuugguuaaauucuaaauaugcacauuuaacgaauuuaacacuuaacacaaaaguacugcauucucguuauuuggagaaaaaguugccaaauaauuacaaaggguccccccacccccgcagcccuccagcccugcccugcccggccccacugagcagcuggcucugccucuguggagcagucacccccugccaacguggccucagugcuuugggcccuuuuugcccaucugcuugguccuugugccccugugcccagcacccaaccugccaucacccugcacucagagaccuaaaaaggcagcguguuuguugcuucuccucuuuggguuucccuuucuucuccugggaggggugucugagucacagaaguguggggaccaucaggucguugcucccucugcuucucuuguguccucccuccccguccuggugacaucucguggccagguccaugucucacucaguacaucuguagcagaguggcuagugggagggcucagucauugugggguugacugugggcugcggcuaugccucgucaccugcugggauguuucaugucgucuagauucaggaugcccaggcagcaaugaggcuguacgucauggugaagaaggagugggagagcauggcccgagacaggcgcccccugcugacugcuccagaccacugcagugacgacgccuagcaguccugcccugcugcugcugccgccccgcuacagaggcaaugugaccagucacagggacagaucacaucuccccagaguggcaacucuggugaaaccuuuucagaaucauggcagaggggcguggcguggugcuacugagaagguccuccuuccucuugacuuuguggucugaaaccuggucuuacuguccauguguguuugggcccggauggucaggguggggagcagggacggccaugggcacgccuggccacgcuuuaccgacugcugacccccugggccaggugagguuggggccugugggccgccaguccauacggugcugucacugcccaucuucggugacacccuggggugaggugcucagcaccuuccucucgaggagccacauuuuccuccuuuguguuaggggacauaacaagcucugcugggcuugagggacccagaccaggugucugcagucagcuccugagacacagcuggccggcacaacagguguuacaucagggguuuccuguggccguuugaacuuugagcauuuaucuaaauuaaauuggcccaggguuggcuggugggucacccagcagaggcuucuccccauagcacgaggauguguugccugggcacggugacugcgguuauuccuggaggucggcagacaugccaaccuugggcuauuugagcuggagaagcuaugugaugcuagccgguggcuuucugggcuaggccccaguuugaggcuccccugggaacuagagccaggaacagccaguggcacugacaaggggacggaguccaaggcguuauugggccaccugacagcuggacagaaaaggggcagacacaccgaggaugcgauuuaaaauaaaugcagauguuuacuuggaauggagccuguggaggcucaguguugacucucaucuagaauggucuggaaggacugcucuguccaggggcgaggucuauagag

SEQ ID NO: 13108 - RNA, 1937 nt, Homo sapiens
agccccuccuccuccagccccuccuccuccagccccuccuccuccucuuccaguuccuauucggggcgggcccagccccuccucgcggagcgaucgauggcuugggcucgucgcacacgccugcccagccucugcgcucggcucgccaggccugcggcgcugccauggagacacggcccagcggccgccggccccgcccugggagccccgcagugcgucgcgccgcugcccgcaucuccgaggcccgcgacgagcggugacuggggcgggcgacgugggggacccggggaugcgggcagacgauagggggcuggaggauggggcgacccagagcgcgcggggucuggggcgcggggaugggggccgcgggccacgcgacggggaccccagggugcgcgcagguggcggggacgcgcgaugggggcccgggaagcugaggcugaccuagcgcaggcaucccaggaggggaggucccugacgcugcgcagcugggaaggcguucgggaguggguugcgaugcuucccuguuuguuuucuccugacaucguuuuuguuuggguccaggggccucacgggagcuggaugcucggagcagcaaggcggcccugggggccccuuccggucccggggcugacgccuggcggcgucuccgggaacccgcgcccuuucaagcgccgcuggcuccuguuucacagauggagacccugaagccccaacaagcagccuccccagcaccucccagugacugaaaaagcuggcacugggcgcccgucucacucuccacccagcucccaggcugccccacgggacguaaguagcucgaucuaggccgcugacccccagagacuugaugcugcgcugcagacugccgccgcugccggggcgcuugacuuccccucuccugacagcacguucguuccuuugcagcagcaccuuuggggagagacgagaccugaacaaacgcuggggcuggauccccagggugggucagaacagccguugcccugaaagcuggcccggacagaugcgugcggggcgugccaccggagcuccuuccagcuugcgucuggggccaccaugucccuuccucagggcacuggauccaucucuucaagcucagugguccaggccaugguggcagaaucaccccccagggugugacgccucgucccugucaauuccacacagcugcacccggaagagcuguggccgggcgccgcucugaccugugugcgguccccugaaugggucucaggugucuucagaauggugaggccgccucauuuccucaccacacaacccuccugaggacguugccugcaaaugggcggaauuccuaauuucuaccauucaguuaaacgagggauccuuaagccccaaagcugggaaagcuguccguuaauuuagugcgcgugggccgucucagaacagcaggguucccaggaguccagcgggacgggggaggggaugaguggccgugucccccuggcagagaaggccuugucugaaggcuacgcccgccuccgguacagggacaccuccuugcucaucuggcagcagcaacagcagaaguuggagucggugccaccugggacguaccugagcaggagccgaagcaugugguacucacaguauggaaaugaggccaucuugguccgagacaaaaacaagcucgaggucucuagggacacagggcaguccaaguuuugcacaauuauguaauuccgaugugagcaccugaacccaggaccacacuuugaggaaaacagaccugaguuucauucaguugucuuguugauuuccaauccuugcuggaagauuuugaauaaugaacgugaagaucaaacugugguguaagaacccaagaagcgcagaauuggcccccgaaccccucagcacagccgcggugugacuggugcacaggacacuuccccucu

SEQ ID NO: 13109 - RNA, 203440 nt, Homo sapiens
aagugaucaaaccucggggccccucugcacugguucuuggagcauggccaggugcgggcaccuggggugggaacaguggggggaccagggugggccccugggcuccgaggccgccccaggcccgcccgccuaccggcucucagagaaagaacagggggccgcgcccgccccacguccgcuccgccccgggccagccccuuccucgcugcgacucgcccgcuguccccacccccucgcccgcggcgcccagugggaggcgggggcuggccucgccgagcccagcgccgggcucugauuugcugcgggcguuggggaucgacagccuccgcggcugccuuccaggagagagggagggaggaaaagggggaaaaaagugcuccgcgccgaaggcgagguccgcacucuccguccccgcggcuggcgcaggaccucacucgagcggagcgcccacggggagcgggucgcggggcggcggcggcgaggaggaggcgagaaggaguuggaggaggaggaggaggaggcgagggcgagcuagcccagcggggucccggccgccccgcgggccaaagucgagcccucccgcccgugggcgagcgcgccagccgccccuuccagaacagccgccgccacaaagaagaacggggggugccgagguccccaugaccuccuaaaguggugcggucccugcugagugcgcugcccgggccgugacccgcgccccugugcguccccgcgcgccuccgagcgccccugugcgccccggcccgcgccccgccggcauggacguccauacccgcuggaaagcgcgcagcgcgcuccgcccgggcgccccgcugcugcccccgcugcugcugcugcugcugugggcgccgccuccgagccgcgcagguaagggcgccccggggcgcggggcugcgggauggggcgcgcgcagcccgggcgccgcugucauccccgggcgccuucgcccgcagaacuuuucuuccuuggccuguggaaugcacgggccaagaccacgaaugccauuugcugggggcccccccgagaugacgacacgcagacacaaugcccgcgggcgcgccgccgcccccuccccagacgggcgggucggguggggcugucgcgcgagccgaggaaggaccgagggcuggaucagcaggagggguuguccacgaggcgggcaaacuuuugucccaaaaaccuuccuucucugucccacaucacaggcgcccagcuugggcccucacagcccuacagcagaacuuccucugcuccaaaccgggcagggccgcccccuagaguuacagcccuucaaaucccgggacuccuggggauggggggaaucccagaagccugggcccccagcacugaacuucccccaggcacugucacucuaggcugagcuggcgcccugcuuuccccagggacagcguuuccugcagccuuggucaccuaaguguucgggggcacuggggaccccugcagggugguagacagcccugcuccuaaucccacccccaaacuucuugaucccuggaaggcagcuuuuccuggauucgcugcugagagaugggaugcguggagcaaagccagagaugggcuugcaggcggggcugugagugguugggaugauaugcagaugugggauuccuucugccaagggucagcccuuagaaggaggcuugcuucccggggagggcgcuucaaggcggggacugucugcgucccugccuggguucucgaggguucaacucucccuggcgcagcuuccugacgggggaguuuuucuaggcaucgcucuugguaguuaguggcgggguggguuuucacagacucucgaacaucagagcccccagcccuggaaggucccccgaauccuuauugacaggcggggagauggaggcucagagcugugugcugccaggucaggagaaguggcgggcagagcgaugggacggugggcucagcgaacgucuggaccagcccgccgccugccagcaagaaugcuucucucugcuucacgauuggaagacaagugggaagaaucauuguccguguuccgcuugucaauuaaaacacucuuuuccuuuuucccuggcacgaucagugcuuguugggcuaacuggaugagcuggagucugggugugggggcugcccuggggcucugggggaggagccaggagccuggccuggcucccaggaccugggaucucaucccugggccgccaccaacucucuccugacccugggcuaacugggcuuguguuucuccagggguuagcugaaggugggggacaacagagguccccagaaaaguggagaggagaaggaagguguggucagggacugugccauugccgggggacuaggcccugucucagcgccucuggggacuuuuccccagaaacucaggagggaguccuucaggggaaucgucacccuagacagcuggggcagggcacugccuggggaccaugcaccggacugggcuugggguuccauuucccucccugcccaucuccccaccuccacacugucuuuuucccucucugguugcccucgcuaaucgaagugcggcucguuggaagugggagugaggauggcccagagcagcaggcuauggaguuggacauuuugcuuuugucagaacagacuuuuagaagcauguggagagaccacuuuucuuagugaguuuugccaacgucucuccaccucccagggugggaccuauuuggaagucauccuucgagcauggccagagggggcggcuguccacuggagaugcaggcgcuggggggagggggcggcuguccacuggagaugcaggcguggcggggagggggcggcuguccacuggagaugcaggcgcuggggggagggggcggcuguccacuggagaugcaggcacugggggaagggggcggcuguccacuggagaugcaggcgcuggggggagggggcggcuguccacuggagaugcaggcgcuggggggagggggcggcuguccacuggagaugcaggcgcuggggggagggggcggcuguccacuggagaugcaggcguggcggggagggggcggcuguccacuggagaugcaggcgcuggggggagggggcggcuguccacuggaaaugcaggcguggcggggagggggcggcuguccacuggagaggcaggcgcgggggggagccaccagcaagugccugcugucuucuccaucuucggaucugccagauguuuucugaggguuuucugaacacaguucuuuugccugcuuucuuuuggccaagugugugaaggaaugaaaaguaagauugcauuuggggcugcugaacaguguaacggggaaggagaguaugggaaaugaaacaugaccccaauauuuggaaauugaggucaucuccucuacacgccauugguugacuccagucacgugauugcuuuuugcaauaauuuguggggagagucggccaaguuuugugagacuugacagguaucaaaugguuaaauuuccucugacucaaucaaguuggcuggaaagacauccuuuuccauccucugcccccucccucccucuccccauaaaagagcagugagugggaggagcucagaagccccaagaauuccccaagcccucucccugcugugguccagauuugccggagggguuggaguuuugguugcuacccagggcugugcccacccagcagugcggcagccccaggcaggggcgugcucccagugccaggcucacagugguuucuccagugauguuacuccugggcugcuccugcggggcuggccagagccugcucuucaccccgcccugcagauauuucuggacuccccaccgccacgccucagccgaacacagcuggugcugcccgucccgcccugccuucucgcugccuggccugucugccugcccugccuccucccuggaccgccccaucccaccuccugggagauagaccuugauagguggaguaggggcugugcagagcagugagcugccccgcuggagggcgaggaugaguccccaacacuucccgagggcacccacauaggagccugagccaagcugcaucuggaacagugcaggaccugucccugcucggucacgugacguggcucugggaauggccuugggagacaaucacacaugggaauggaggggcuggcacuugccuggccuguggugagcaucagcugcaccaucucacugcacccucacccgggccugagaagggacagagccuaggagucagggggcagggaugccaggcagaugucuuccauuccugcuguggggcccuaagccagcaacggcccuucgccuggcauggucacucuuugacuugucacaguucccucuucucacuucccaucgguuuaucagcucuccccggggagaaggccagggcccugagcuauaguccuggccugggggcccaguccaaacaggguccugggagcagagccauuccauuuggccaacacagcuuuuaaguuccuuucuuucuccuucccccuccauccuucccuccuuccuucuuuccucccucucuuccucccucccucucucccauccccuuccuuccuucccuuugucccuccaucccuucucuuuuuacuccagugccuucaagagggaugcagcagccacagucuccaccacuucccaggccucucugcacaucagcauaaccugccuggacccugaaggcuuuugccuuuucaccugggucgggccuaucuuggggagaccgaggcaaaugggaugggaccccucguuuccuuccaggagcucacagucugacaggcagaccauugugaauuuuacucagggcccuccaugggaugugcugggucuugcauccgacagucugggaggguuaauugcacuggggagagcuggggagcuuccuggaggaggugaugugaaacuggccuucccuccuucucuucuccuuccuuuuauugcagaaaugacccuccuucgugggguccuccuccaccucuggcuuuaaucuugcucucuucccuccuucugacaggacauuccacaccgugucccagagcucuccugggcggcucccuuggcuggaaagccccucauucacgggcuuggcaggugcucccaguaucuguuugccaggagaauacaagugccccuaagggaaguggcagauccuggcagcuuccuuaacccuuucucugcccccguuccuccuguuucccuuugacgagcccugcuggccuggcacagugagcccagucugcacagcucugcagacagcuccacagcuguggauuaggaugugggggccucugggggugauuuuggguaccugugcugggugacagguggucggaugugggaggggacauuccuuggcaaucagauuacugaacuccaggccagcaaggucggugugaggcuggagcugaguuucccugccucugaggggcugucggaugggcugggcgaggacaagucacugcaccucagcuuccccucgugaacauggggagaaccacauuucuugcuuugaggcaugguugugaagaucgauugaggccacaccugugagaagcuuugcaggcugccugaccuguacucggcacuggcuguguggggacguuaccaucgcccccaucuucaguggugguuuugcaggaggaaagagcaguguucccacagcccucuuuagcucccagaagcacaggcgagggaggugugccuguguggggccuggcccugcugagaccccuggggcucugcuguugcccgcuuagccggucucugcugccccuuugccuuccuuggccucgguucuuugcuuucccacggaaccucauggggucauuguccaggccguggggugugaugcaugugaaaagcuuuagaagccaauuccaggguuugcacucaugugugcguuuguguguaugugugucaugugugcgugugugugugugugugucaggccgugugcacguguggacaauguguauaucuccccgcgaucugccugcacacauguguuuguggguauacauguguguuugagugugcacgcaugcgcauccuugcacauguaccugcguucacaugggugucccuggcugacuccacgugcagggccugguguguuugaggagcucguggcagggcgacguuucucuccuuaccgugacccggccccagcuggacgggagaggaggagauggcacguggaaccugccgguugagcgugaggcuguggguucugccgcagggcaagccggguccagcuggauccgacaauuucaugucuuuuuaaacucccgggagggcgauguuacauuauggcucccgcuucuccucuauuuacauucucccauauaauugacucgucugcucucucucagugcuuugccaagugucgguuuuaaaguuucuggccuggcugguggaugugccucgauccugcaggcggagcccacagcggcccuuguggugguuacuacugagugucaauuugauuggauugaaggauacaaguauuaauccugcgugugucuaugagaguguugccaaaggagauuaacauuugaaucagugggcuggggaaggcagacccaccguuaaucgggagggcacaaucuaaucagccgcuagcagguguagagcaggcagaaaaacaugaagagacgagacuggcccagccucccagccuacaucuuucuccugugcuggacgcuuccugcccucgaacaucggacuccaaguucuucagguuugggacucggacuugcucuccuugcugcucagcuugcagacagccuauuguggugggaccuugugauuguguaagucaguacuuaauaaacuccuauauauauauauauaauauauauauauauauuucuauuauuucuauuccuauuaguucugucccucuaagggaacccugacuaauacagcucugcucauaggcaggacugcaggacugcagccaccaggacauggcauagggaccaggguggccugcuggcaaaggacaggcagccggcaagacuccuggauuccuauccuggcuccagugucuaccagcagugcauuuucccacccugugccucacuuuccccaucuguaagaaggggguggugacuguaacuacaguaggguuuuagugaugucuaauguauuacucauauaaagcacagaguaagaccccauuacugcccuugccaccaggggccccagugcagcaggaggcugugaggugguuuggggcccucuacucgcuggccugugcgugcucccuugccauccuguguggugucacacugcugcuucccucacuggguacgcaggagaaaagguaaggcaguaagcaccaguggucaguucagcggaucgcucgcugcucgcugccucugaggcucugagccugagccaggaaggugcauccuugggcagucgcgggccaggccaaguucagcccgcagaguggcccuccccugccuccucuggccacuugcucuuuacaaggaacggagguccaggagguggauggaccugugcaccucccagcugcaggccucuguucugucucugugaugugauggcggugagugguggcugaucacugaaaggagguguuccaggcaggggugggugaaguuggugcgggcgggguguggggggggcuuugccaucucagauguuguuuuugugccagcccagccccaggccacuggagagaagaccguggaaugaaugaauugguggcuggaugcucaguggaggggugcgggucacuuugaguuauccaugucagauaguccgagccgucacacccucagcuuccuaucagcagaggaguuuuucuggaggaaucucaaacuagguaauaaccucauauuagcaguaaaugucaccauccuuugaugacucagaccuaagaaauggaaccacagccugacccacuuuucucaaaauuuaauuacucagagcucuggggacaugggcucagccuauuugccgagaugucucugcccaugaaauggaagcuuccuuuauuuucuguuuccuagacccguguucuuguagggaaauuagcucuucuguccuuuucuuccuugccaggaccucggcaauaggguuucugguggccucuuuuuuuucuguaaauaaaugccacaaaaugacauaaaaacaguguggugauuccucaaggaucuagaaccagaaauaccauuugaccuggugaucccauuacuggguauauacccaaaggauuauaaaucauccuacuauaaagagaaaugcacacguauguuuauugcggcacuguucacaauagcaaagacuugcaaccaacccaaaugcccaucaaugauagauuggauaaagaaaauauggcacauauacaucauggaauacuaugcagccauaaaaaaaggauaguucauguccuuugcagggacauggaugaagcuggaaaucaucauucucagcaaacuaacacaagaacagaaaaccacaaacaccacauguucucacucauaagugggaguugaacaaugagaacacacggacacagggaggggaacaucaugcaccagggccuguugggggguggggggcuaggggagggagagcauuaggagaaauaccuaauguagaugacagguuaaugggugcagcaaaccaccauggcauguguauaccuguguaacaaaccugugcguucuguacauguaucccagaacuuaaaguauaauaaaaaaaauuuuuuuaaauguguguauguagcaggagugacuuaaguugaaaaacucugacccuugcauugggaaacagugaucucccagugagaacacaugagcaucguaaccgucuuccauuggaagcgaccgucuuccauucugcuggcggguggccugggggaccagcacucuuucccguguguggguacagagggaacagaugggguccauaugcaaagacauugggugugucagcagguuugcuuggcagcauuuauggaccccuaacaugagacggaccugugcggggggcacaggugagcgauaggcgagccgucugugcccuacugggucuuccgcugcggcgggggagucagccaucugaacaggugguuuuacccagugaggugcaguagaagugggaguaggguguggccaaggccagucuagggaggcaccugccagccccauggggcgguggccagucagagaccagccugcuucuccagggccagcccuuugggaugcaugcgccugaaggcaggcucccauugguggaugcagagggcacguucccgugcauguucuuccucuggcucuuguucauauuuucauauuuacacuggacccugcucugagggugcucccgucagcaccugugauccucaaacccgcccuucgugccaggugggaucggcccauucugcagaugugccagucuagcuccuugaguccagcuggcacaaggggaugaaaaccacccuccacgucccaguggucacacggccugcauguuggugcagguccguacagucacaugcauggacgcaagcagccucuguccauucucaaggccaggugagggcggcguggcuccgcucccuccuguuuguuugcuggcgccagccuccauggcagcugggucccagugcuucagaaggggagccauggccccaggcaacagugcguaccugaagccucugccucgguuucuucuucuuccuuucagaugcauaaaaaugcacaucaagccugggcaccaucugguggccucuuuauuuuuuaaauaaaugccauaaaaugacauaaaaacaguguggcgauuccuccaggaucuagaaccagaaacaccauuugacccaacaauaccauuacugggcaccaccucuacagaaauuucagaaacaauuagccagguguggugguucgugcuuguggucccagcuacuugagaggcugaggugggaggaucacuugagccagggaggcugaggcugcagugagcuguguuugugccacugcacuguagccugggugacagagugagacccugucuaaaaaaaaaugaaaauaaaaauaaaaauguacaccagagagcacgguggucucagcuuuuccagcuguaguuucgucuuucuucuggaggacagaggcccagccaucugcauccucagcacacaauuaggucagucacuggggccuguugugggggugacaggcaagccuggguguggggagagccggcccguugcccaugggcucugcacagugggugggugcaggugcgaugacaggcgcgggacagaggggccccuggggggacuuuucucggguccucugccuucccaccacuguguccaucagggacauucccaggaucugucuuugcugcugguugucuucccuugauuuuuuguuuuguuuucuuucuuuggggaugaucugaaauccucuuccugugcuauuucucugcucuuccccuggggaaaggagagugaggagaaagugucccguguccacguuccuguggacguuccccuuccuucuuucuaaggagggauggugacucccagagguauuaaggaaaggagaaagugacacugacucuucucagagccuuuggcuacagaguguucccgcggucgagguggggugaagggcguucucgagggaaggguagggaacgauuucugacugcgauuguaagagcuuucuagguaauuauuauucaugcuauuuagggucauaggucucaguaauggucgacuaggucaaaaaguacugcuugagcaguggagauacucagcugaagguugagaacacacagggcguccuugggccgguguggcgguaacagugagcuggugacagcaggcagacccaguguaacacggcucugcuggguggggcaaggagaugccccagguggagccaucgggagagggagagggggugggagggcaggggagcgacuguccugccagggaugccagugucauccuccugccccugaaacagguggacaucauggcuucucagcccaggccauuuggggacauguggcaaugucuggagauguuuucugauugucgcaccuggggugggggcagggcuaucggccuguaguugggggaguccgaggaugcugcucugcaccccacagugcacgggacagcccccaccaaaaagacugacccagcccggaggcugcaggaaucgugggauagaggaagcaaaggugagauuccguggccucaccccauggucuucucauggcucauugucagacaggagggagggccucuucuuaggccggguccagcguuucuccucaugguguagaccagcaguucccaaacuuuaccaggccccagaauccccccgaggccucucuuaaggcacagauuguuucugacucaggaggccuugggugggcccaggaaacugcauuucuaacgaagucaguucccagaccacgcggaugcuggagcgucugggggugccacacuuugcaaaccacgagucguucugcguccucgagcccagggucuuggauuucagcauuaaugguggucgugggguggggagggcaccugccaggggagaagcgcuggagagaagagaggaggguguggcuguuccuccacccaucucaggaaccucccgcuuucuuuauggugguccccgcuucacaaagcacccauggugcuguuccccugcacaccuggcagcggcacucacucaucuccaaagcaaagaccccacuauccggcaggucuuagggagcagggagacccugggggugggggugagcuuccagagaagggguuucccauggguuuggccaugagauucugcuguuguugauguucuuauuaugggaaggcucagacacagcgcagcaaaggucguguucugccuggggccacagggaccagcccacagccaaccccguuccagccagaggccagcccacgcccccgcacccggugauuuugaagccagucccugacaucagcugcguucuucgguaacuauuucggucuccgaaagaggaggaccccuacuccaaacucaccucagcuugcuggccgugugccgucugugcgucucccaagggcgccccccucacccagaccuccccuccauccguacugugcucgguccacaggaccaggcucugcagagccagggaucuguaggacugcagguuuauagggcuggggaucuguagggccaggguucuauagggaugguggucugcagggcugggggucuuucaggcagggggcuauagggcuggggacucugcagggcugggggugucugcagggucaggggucucucaagcuggggaucuguagggcugggggugugcagggccgggugucuguagggcugggagucuguagggccaggcaucuguagggcuggugucuguauggcugaggguguguagggcuggggguguguagggcugguguauguagggcuggagguguguagggcugaggguguguagggcuggaaguguauagggcugguguguguagggcuggagguguguagggcuggaguuguguagagcugguguguguagggcuggaggugugcagggcuggguguguguagggcuggggguguguaggacugggaguguguagggcuuaggguguguagugcuggggguguguagggcuggggguauguagggcuggagguguauagggcuggagguguguagggcuggagguuuguagagcugguguguguagggcuggagguguguagggcuggggguguuuugggcuguagguguguagggcuggagguguguagagcugguguguauagggcuggaggaguguagggcugggguguguguagggcuggggguguguagggcugggaguguguagggcugggguguauagugcugagaguguguagggcugguguguguagggcuggagguguguagggcuggagguguguagggcugguguguguagggcuggagguguguagggcuggaguuguguagagcugguguguguagggcuggaggugugcagggcuggguguguguagggcuggguguguguagggcuggguguguguagggcuggggguguguagggcugggaguguguagggcugaggguguguagggcuggggguguguagggcuggagguguguagggcugguguguguagggcuguagguguguagagcugguguguguagggcuguagguguguagggcuguagauguguagggcugggguguguguagggcugguguguguagggcuuguggugucuagggcugggguguguagaccucguguguguuuagggcgggguuuguagugcuggugguguguggggcucguguguguagggcuggaagugucuagggcuggggguguguagggcuggggguguguagggcugguguuuguagggcuggggguguguagggcuggggguguguagagcugggggaggguagggcugguguguguagggcuggagguguguagggcuggggguguguagagcugguguguguagggcuggggguguguagggcugguguguguagggcuggagguguguagggcuagggguguguagggcugguguguguagggcuggggguguguagggcugguguguguagggcuggagguguguagggcugguguguguauaaggcagggguuuguagggcugggguuguguugggccgggcgucuguagggcugguuuauccgaaugcacuggguggccuugggcuuuagggccugcacuuuucuguuuugugcaucgaugugggaggcagggugaguccccacccgagggaggcggagguggagcucagagaagcacagagccccgggaggcccccagccgggaggguggagggcggcugugucccauaccuuuagccucucagcugggcugugcagcguccucaugagccugagcucagugcugcuaaggcaguucguagcaccuuccugugccucaguuuccccaucugucaagugggcaugagaauaauaccugucucacaggcaugcugagaggacucaggauucacauguguaaacugcuaggaccaccacagcuggcuauggucauuacuauuacugugugucccaggcaugccauugguucagaggucacagguggcccccaugaggugacuugcaggagucugcugagcccauggaauugagcugggcuugugaaagugccacaggagacaggaaugugugaccaggcuggacucagcccgaaggcugugggugaggacccagagggugccaugggugcugugcccaccaggcuguccuauggcacgugggcuugucagagccucuggcaccugcagcagggcuccccuguccugcccuccuugaauguccuggcacagagggcugguaccaagacagcagcugcacugccauuuugcagaggguuggaguucucugggucuguaacccuggcccggaguugccugguguuuucugggauugacuggaagcaaaggagggugggcagguccagcuuccugcaggguggggcuuugcagggcucaccaccggaugccagaggaugccggagcuuggagccugggacccucacaguggacaggugcaggagccccggggccccaccuugcagcuucagauugagggucugagguggagccuggggccugcggcuccucguccugcccgcccagugcagcggcagugaccaguugaggguacuuugggaaacucugagcagaggagggugggggccugugccucccuccagcccucuguccuucugcagagccugucccuaucaccagcucacagucaccucuuggacuuuugcaaagagagcucaggggaugaggagggaagcagugauucucagggacaccgggagcuucggaggccgagagagcagguuugaacuccuggcugugggaucuccaacauguuacuuaaccucucugaucugaggcagcuuaucugcauaucagaggcaauagcaccaccuaccuggacuggcagcugugaggaucuaaggaagcaauacugguguggaugcaaagcccuaggugugcccggugugcaggacaucgucccgugcagugcaagcaccaggugcacucgugguauugauaacgaugccugcugcuuuuauugggauggucgcagaugguaucauauaauucuuauuagagauggcuguuauuuuacauggcuguuaauacggagguugggaggcaguaauuguaacuuuuauaaagugugaaagaaggacuaaagcugcuguuugcagcuucaggcccagccagggaccucagaggaugcuaaaugguuggcacaaaagggccagagguuccaauuggcagggcaagggguguacauuauagauaauaugggggacggggcagggggugcacuuuauagauaauaugggggggugagacagggggugcaguuuauagauaauaugggggacggggcagggggugcacuuuauagauaauaugggggggugagacagggggugcaguuuauagauaauaugggggguggggcaggggguguaguuaauagauaauaugggggucagggcgggggugcaguuuauagauaauaugggggcaggguaggggguguaguuuauagauaauauggggguuggggcagggggugcaguuuauagauaauaugggggcaggguaggggguguaguuuauagauaauauaggggucggggcagggggugcaauuuauagauaauacaggggugggguagaggggugcaguuuauagauaauaugggggugggguguagguguaguuuauagauaauaugggggcugggguagggggugaaguuuauagauaauaugggggugggguggggguguaguuuauagauaauaugggggugggguggggguguaguuuauagauaauaugggggugggguguagguguaguuuauagauaauauggggguggggugggaguguaguuuauagauaauaugggggugggguggggguguaguuuauagauaauaugggggugguguaggggguguaguuuauagauaauauggaggguggguuggggguguaguuuauagauaauauggggggugggguagggggugcaguuuauagauaauauggggggugagggcuguggaaccuuccucuguauucaguucccaggagcuucuccagaugaguuuccuuugcccgggggugccaggccugacggggaagggcagggggugggacaggaccugccuggacuccuggagaggacucugaugucuucuggggagggggcacagagucaguggccuggcuuauggccugggggccguuuggcagaugaauaagcucagacuuagaagguguggguuccuggugucacaggcuggugaggaguggggagaccaggccugggaguccuggccugucgggugggcuucacugacgagggaugggccgggcacggagaugcugcuggcuauggcggacugcacucggaguccugucgcuggggaaagcaacccugcccgucucuugccaccgucaggggacgguguucaaaacugggucuuuucucagccucagugggcuggaggggucccaggcuuucuaaugcaggggcuuucugcccagggcaggcucugaggaccaauguucacccuacaaccgugguggugggcagcucgccccucugugagcaggcagcacccacgcugggagguucuggaccccggccuccgcagcccauagguuucaccauuacccugaaaaucuccuugcucaccagugauaaaggaaagcagcuccgaagugcagacacccgcucccucuuucuuuccuuuucuggcugcccgggucuccaguucugcugggacagcccugggaggggcagcccaagccaagccugcaugugcccccgccccugcacguccccccgccccugcugggccuguccuugcacgcccugggccccuucacaugcauacgcucccaccuccccuuccugcagcuagggccuggccgauuacaaacagcugccuagcccucaagcaggauuugcaggccccggagaggggcuauaguccgagggcagugugggccuaaaggcaugucgggggucuuaauggaagccgacgccccucuuguacccugcccggcuucuguccccuggaggguggcgggggguggggcaggcacccugugguugugcggagagcagcugggaggcucuggcuccaggccuggaggggaggggcugcugggcuccaggugggcucugggguccuggcccucuucaaggucucuccggagcccggaaacugaaaugucaguuaagguagaaauucacaugagacauacgagggagggguucgcugagacuuuucucugcaggugaagaguaggacucucugggacuugucuucuucugaccugaccccaagugccuucacacuguguuuuaucccgauggccucuguguaaggcaggaggugucaucccauuuuacaggugagaagcaggcucagaggcccugcagcuaggaaguggcagaguuaggccuuuaaaauagccuuugaggccgggugugguggcucaggccuguaaucccagcacuuugggaggcugaagcggguggaucacaaggucaggaauuugagacuggccaauauggugaaacccugucucuacuaaaaauacaaaaaacuuagccgggcgugauggugcaugccuguaaucccagcuacuugggaggcugaggcaggagaauugcuugaaccugggcggcagagguugcagugagccgagauggcgccauugcacucuagccugagcgacagagacuccaucucaaaacaauaauaauaaucauaaucauaaaaaagccuuugaguugugggcauuugauucuguccagcugcuugggaacaugccugauaugaguccaggccuuccgagagugccaaguagccaaggaaggugggguuuuggucccuaucugaaggacgguugcacuuuuuuucuuuggggucuucaucccugcaguaggcacugagagagaggagcaggaggaaugugaaguccggugaccccaccaacaacccucuguccucccugcccuccugcaucaccauggcccugguggcgggucucaggagggagcggggccuuuuggauccugucacucagcagccucuuccaaagcccacagagccgugggcuccacaggcgccccgaguaccguccucgaugagaucugcggauuagaucuggagccugugcccagcugugugugcacuguuugcuuaagggggugagcugcccuggucugagucaguuuuuccauuuuagcgggaaggaaagagugauaggggaggauuaucgccagguaggugcugccuguuuaguuucagccgacacacggccaaggagaaauggggcccagcaagccagaugcuauagcagauaaggcgcaggcgggccagggguagaaauggaccagauguuucaggaacugagcuggaauagcaucacaaaaccccuccugggucagggaccugggccacgauccacaucuuuaaaccaucagcauuucagaaaagaaaaaugcaaacucugagagaagcagugccccaggccugauuuccaaguccacccuuuauccuauuagcagaacgauguguucuaugugccaugagaguccucagguuugccaaggaccaggcucaaaagaguuuuacucuugguuuucacuuaaaauggaccaugaguccuaaagaauugucaaaguccucugaagauucgcuaccuggguaacucaccuacgccuacuguaugccccagacagauucuauuaggaaaaguuaggaaguuucaauuuauuagaaaccaguggaauagagaugcugcugcauauguggucuuaggcauuucuaguuucaggucaccucaguagccagaauucacuguaaacagugguaacccaaagcccuaguucaugcucaugacaucaaagccucaaacuucagugucuagcuagagaccaguggugggaguggugccccuggagguuaaggaggguauugcaucccagcucuacuagacauugugaaaaccuaggcuuggccuggguuguacuagaguacucauggugcgaccucaaaaccauaacuuucuucugugccucaguuucuucauguguaaaauggagcugaugaugucucucuaccucauagauuuguggugagcaucuaaggaggcacaguuuagaucucuauagaaacaggcaaggucucuuugaguucuucuugcaucucagagugccugccacugugaggugcucagugaauggucacuggguugaauugugagugcuuuguaaacucagagggugcugaccagcccagagaauugcuauguuuugaaguagcucucugaagugggguggagagcagauguuagaagcugugaaccaugcaccuggguucuuuuaggggaggauggaagguaccagaagagugaucucagcuuaccacacccaccacuggcuggcagaggugggguaugcuggguuugcugaccccaaagaggcugggugggagaggaagccgagaguugccuaggguggccuggggaguuugguuggggaagugucggggacacuauucucggugcugcauccagggaagcugcccaucagccuuccuuggauugggaucuuugggaucagggauucacuaauugucccacaucugacauuaaucugggcucagccauguguugcugagcuucacacagcuguuugcaccaccccagaucuuucaagggguccccaagcagaugaccaguuugcagcagggcgugugugugagguacaggagccuccaguccugugggcagaugcugacggaugggcugauggcucccagcaccaacugcuuucugucggugacuuucacuccacccaccaguccugugaggucaguacgguucuccugacucugugaggacgugcccaguugacuuggccaauagggagcagagcugagacuugguggcucucuuagacgccaguguccccucugugcugcacccauaccccccuccccaugcaacccugcccagcccacugcaucuuccugagaguuuucccagaugucacccagcaccuucuuagcuguaaucucuccaggcccuuucaaccuaaaugucuuuaauucugggaucaaucaucucacccuauaaaugacucccaggagcucuuccagcugugcuccagaauuccuuaagcagugccaaccucgcuguuccuccgaccgcuucuucccuuuccagcccuucccuccagcggcuucuguucucuaggaugcuaaggcgagucccaggauggcauucaacuggacacggaugccaguguugugagugcuccaugcugaaagccgccuucucuggggcgguuacucacgcagaggcgggaaccugacucugugccugucuguuggcuuccguaauccagcccucccugugcugaguuuaagcccaaaugaaauuacugggcucuaaguaugugccuuucuccauaaaaugugaugccuggucaauaucuuggccaaaaaaaaaaaaaaaaaaaaauuccucugaaggaggguagucuggucucuuucuagucacuugugaaaauauuuccugaucugaucucugcagucguguacgcggccagcacauaacugcccccaggcagggcccugacuuccaggccgcucagggcagcuacccucccugggauaugucaagcugagggcuucgcacauucuucucugacaacucagcugguuuccagcccaguccggcugccuccuucuuuuccacuuugacuuuccuaacagccugggaagcucugaagccuguguuuucaggccugccggugccaguggagcuggccuaggccuccccagcacccuuccugaccccuacguagaugcccagugcugccugccaaggacuuugaaucucuccaguggggacauuccgcgcuccuugggugaugggaggcugaggguagaagugaggguugauuuaagagagcagcccagauggaagggccucuggggguuguucuccacccucaugcucugcagcccauaucucuccucugaucucucucccggccucagcuuucacagcucuagagugagguggggacauggacggcugccagcuuggauggggacgggcuaacucgcaugaaacccucugggcugcaaagcgaugcucugaaucuguuguuaauuacaucuuccucgggccgcaaguucugcaccagaguuggucacucuaaaccuggggcuguuagcuauaguagaaccucaucugccucguuagcagagaccgaugaguguuugcugcacagcuacugccugcucugugagccuccauguuuggaaauuuacuaaaaauacugccuuugcauucaacucgccacacauuucugugagcauguacgaugucaaaggcccuguggguggcuuugcugagggggugguugaagagaccauguucucaaaaugaaguucgacguuuccugaacaacuguucucugcacguugcugugcugggugcauccaucggacgcagccccuaucuggaaggagggccgugugggccaagaaagaagagaggaugccuggccugaccugggcuggcccugaggcuuugaacaccugggcuccucauccuggagucagugugugguggccgggggccugucccagaacguagcacacuucuccucucugcuguccccauacuguccugauagccuaagagggugaagggcuggggcugggggagggaguguggcccagguguucagaggccucgggagucugcuggggaggugcaaggaggccgcccuggccaaccuggcagggcugggaggccaugggcacuugaggggggaggauaaaugucacuugagcauuuuccuccuccuccaguuccuucuuuaauaucuauuuuuaaugaaaauaauacauuucauuauagucauuuuggaaaacaccaaaaaguauaaagaagaaaauaaaaaugacuguaaacccagauucucccaaacccagauuaugaauacagagaagaaaguacagagggaaaugcguugugguggcggauggggaacgccuagaccaucccuaggccucugcccugaggacuuggacuuggacuuugucaugccacauuagagugcaggcauucucuuucauucacgacagcugucaaaagucuaauuuaaagugucgccuauuggauauugggguggcucccccuuuuugauacugcaagggcagggguguugaggaagcuugcuguggcgggucaccagagcugccaccaccggagggugcuagaggccuucuugggcucuccagggggaagggaacaucuugggggugcugggcaagcagcagacccccugcccacccucgggaaucagucagcuggugggaaggcagagcuuuugcccuuuaaagccagggcacuggcagaaauguaggguuugguaaagacagccugucauguuggcugggaaagacaggauucaucauugaacugggcuagaguguugcagaauccgucugggaaaaaaagauuggauccugcccuacucuucuaccaaaaugcauuccagauggaucugagaugcgaacuuuaaaaaugaaaccauaaaacuacuagaagaaaacaugggaggccagguuuuacagucuugggaugggaagcuuuuccgaguaugacguaagccccugcaguuauaaaagaaaacaguuugaccccauaaaagucaagauuuucuaucuggccaaaagaaaagcaaaaaaacaacuggucaccguaagaagagaaucuacaccuaucugacggaaagggggucgaccugcaaggaacucccacugaucagucagaaaaguccagcaaacaaacaccaagauggccgacacacauggcaaguucucaggaaggaaaauacaggugacuuuuaaacaugugagaagauguuagacuuuacucacaaggagagaauggaggugaauccccagggagaggcacugcucccucggccagauggacagagaacagaagcugagagucugugacacuggcuccugugaggggcaguggguguucccauggugccuucucugaaaggcauuuggcaauaucuauccaagcauuaaaacacauguacuuggccgggcaugguggcucaugccuauauuuccagcacuuugggaggcugaggaggguggaucaacugagcccaggaguucgagaccagccuggccaacaugaugaaacuccaucucuacuaaaaauacaaaaacuagagcugggcacgguggcucacgccuguaauuccagcacuuugggaggcugaggcagacagaucacuugaggucaggaguucgagaccagccuggccaacaugguggaacccugucucugcugaaaauacaaaaauuagccaggugugguggcgggcgucuguaaucccagcugcucaggaggcugaggcaggagaaucacgugaacccuggagacggagguugcagugagccgagaucaugccacugcacuccagccugggcgacagagagagacuccgucucaaaacaaacaaacaagcaaacaaaaacacacauacucuuugaccagcaucuccaguucccagaauguuuccugcagauauacguguguguggagaaccgcugugcagcacugucuggaagggcgagagccguuuagguggguuaccaugcagaacaaaacaagcacagcagcuaagaagaugaaguuuucauuugcugagguacaccaaucuccaagauauguuaaguaaagcaaagcagaaugaagaauguucgucguaauggauccaucucuacucaaagaaaagacacacaaaucuaggcuugucuaugauuauugaaaagggaugcauacaaauugggacucguguguaguuucuguagaguggacggcugggugcacaggcugcaggucucuccugaaucuuuugaaagggguugaaugcguuguuguucagcaggugggucuuuggaagguggacaguugugugugcacaacacagagcagggacagggacguggggcuggcggcucugggagcugagaaccuuuccagcaagcaagcagcuggccuuuggcugaaaugacuuagucaauuaaaacaacuuguggucuuaaaaaauaaaaaggccaggcauggugguucacgccucuaaucccagcacuuugggaggccaaggcagguggaucaccugaggucaggaguucaagaccagccugaccaauauagugaaaccccgucucuacuaaaaauacaaaaacuagcuggugugguggcacaugccuguggucccagcuacuugggaggcugagacaggagaaucgcuugaacccgggaggcggagguugcagugagccgagaucgcgccacugcacuccagccugggugacagagcgagacuccaucucgaaauaaaauaaaauaaaaauaaaaaaaggacaaagacaggaaacaagaucaacccaggcagaggcuggauugacuauauaugaucacucaguaaugcuccgaaaauaggagugugccccuguagaugcucagaacugaaacugucguugccauccuucauccacucauuuuacagguggggaaccugaggcugguaccuaccucuccuggugucacuuaguaaacugggggcagagaaacuggcacggggucccugggcucagcacaggcuccuggggccauucugcucaggcccauggccuucuucucuggagaguggcuuuuggccucaggcgagucuguccagaaaggagaauucucuucuuggggaggcucugggccuugggugucagugggcaugagcaggcuucaggggacucguucucaaaggcacacagguugggcuggccagggacagucccagccuggcaugcgucuuccucuucucucuccuggaugacugagagcucgugaaggucaaggccuuugccucucuuguuuggccucagggugggguaagcuaguuuguccuuucucuaccagggggcucccucacugggggugccuggaggauggaguguggcuagcccaucgugacccuuuucuucugccagcggguauggggacacaaaccugggcuggccuugauucagcacugagucugugagauuugggggaguagacucuuugggacucaguuucuucaccugugcgauaggguaaaacauuuugguccuucauuaaauucacuauuuucuucuuucacgguauacauguugagcugccuuugcaaaauaacucacaucuccucgaggauggggaugacaugaccccagugcugaugacagggugaugacacauaaccauuuuuugauuacuuccugugggucuggcauugaucucuagacauuauguuucagucaucgggcauaaugacgagcuuguuuuagaaaagaggaacaugaaggaaauugccaggaaccauacgacugagagcugggaccuuggaucuagcugcuuauggugacuuucccagcacagaacuucugugggcucagugccuguccuguuauuugauguucacccguggaauggaugcacacacauuguaccuuauucacaauuggcagcauccuggccaugcauggcaccugucccuagccuaucuggugggcacuggagguuuggaaaugccuccaggcccucucaggaucaguggcuguggaacgcugaccaccagggccuucuucagggagucagagggacaaaggaugugacagcauuugcagugggaugggcucuguuuggucacuggugcucagcaguugauggcuuggaagugguguggccggugaccuccagcccugccagcaccaccccacacccuggugcucacuugucacucauaacugcaccaucuccaugcacugccccacuagggccucaccuugguguccagcagcagggccaccugcugucgcuaggcuuaucucuuuccacaucacagguauccuugcagucuuccuuucuggcugauucucugcuuagaggugccccaccucccaggaagccagcccagacacaagauuugaagguccuucaccuggaaguccucaggcacagacagucaugggagggggugacaagugccugacucuaggacagggggcucuguggagcaauagggauccguucauccuagaaaaggagcugaaaucccucacuuccuagggcguuuugugucuuguuucuaugcagucccugcuggaacaugacauuucccccaaacuucagccucugcucuuccuaccagguaggcugagcuggucuguuguguuggaacacagagcugugaggggugggaaggaguugagaccugcucauccaccuuuucagcugacaguguuguggauguaccaggcacuuugggucagucauagccccaaaugucagaagcaaaaaggugaaguguggucccugcucucgaguccuguguccugcugggauuggacaaucagaagaucuugugauccauguggaauugcuauccuguaggccagaaugaucaaacauuggccauuucacaugguucaaucuaaugcuauaagaauaaacacauaggauggccacugauccagcaugaggcuuaaggagcccuuucagagguagcaaugucuaagaugaggucuaggagaugaauaggaauucaccaagagugggagucgggggaagaggaggauuccaggucugaggaacagaaugugcaaacgccugaucacugugugaucuuggucuuugcgugaggcauuuagcuuggcuaucacucaacaccagguaggguagcaggagagaacagcaagaaauugggugccuuaaauuuaguuuaaaucagcaaagguguauuggugucuuuacccacccauucauccaucaaugcauccauccauccaucuaucuacuuguccauccauaccauuaaucuacccauauauccauguauauaccaacccauccaucuaaacuauaaauccauccaaucagacacccacucacccauccauccaacuguucuuccauccguucaccugugcauccauaucauuaaucuacccauccaucuguccacccauuuguccauacuccauguguccauauacucauguacccauucacuguucauccaccuguccacccaccuauucauucaaccaaccauccaacuguccuuccaucuauguauccauucauccauccaucuacccauucauccaucaauccauccauccauccuucugcccauccaaucauccauccuuccacccacccacccauccauccauccauccauccauccauccauccacccacccacccacucacccaaccauccaucccauuuauccauuuacucaccuauccauucaucuacucauccuuccauccauccauccacccauccuuucacccauugauccagaccauauaucuauucaaucacccacccauccacccucccuuccaccuacucuuccuuccuucccucccuccuuuucccuuucacuuuuccuuucccuuucccuuuccuuuucccuucccuucccuucccuuuccuucccuucccuucccuucccuucccuucccuucccuucccuucccuucccuucccuccccuccccuccccuccccuucccuucuccuuccuuccuuccuuccuucuuuccaucccuucuuccauccauucaucuacacauccauucauccauccauccacuuauccacccauccauucaucuguccaugauuuugucauagcacugggcugccuccucuaccauagcgauuggcauuuuuguguuagggugguuuacgaccaucucagacuuccacugucuacacuaggcggccaggaguggcuaacuuacuaguuucugcagugcuuugaaugguaccagauacaacuagauucucaagcuguuuuguuggcuugaacugagagacaagagaaauccaguugcagcagcagccgacgguacagucagaaucaucaugaggugcugagugcuuuuuaagaguuaugagaggaggcagccuaccacgccggaggaaguggggauguggaaguaacccuggcucuccgcagaggugggguguggaugggaggggagaagugaggagagcauuccuguugacaguaagacauaagacaacuccauggugggaacugagaacugggaauuuaaaguccacauguuccuggauauuggcuuauagauucagagacgcaacucauucuccaaauaacuuuguuaacuuuucuugacucuaaaaggaacgcauacucauuauaguacauuugggaaauaucaaaaugacuuuauuuuccuuuccucacauuuuuucuuugcaugguugaacucaugugcagaaacgguguugugcccugcacuuagacacagagauuuucugaugucauuaucagcucuuuguaaauaucucaacggcugcugaacauuccaccgcauguuuguaucauaguuuucuuaacuguuccucucauguuggguuuggguuguuuccaaucguuugcuguuauaaaugacacuuggaugaacaucuuucugauaaauccuuucugucucucugauuauuuccuuagggcggauucuuagacauugacucacugcauccaagcauagggacauuuuaaagccuuuuuauugcagaauuacauuccaaccaacaggcaguugucaccugagcaacugugccccaggcaguguuauccuuagguguuaaacccagguggaccccauguccgagaacuggggcugcucacccaugcuaagccaguuacuucccccucucugcuccuagagaggcaguggggagcugugauuuaaugcuugggcccuggugugauuguuuccugggccuguggcacgucuuggagacccuuuuaggcaagcccccgggucguugucuggaggauggagcagcacuuccugcuccacaggcugucccgagaagcugaauuacucuuaagaguggaaacucacaugcauguagagcuuuagaccucuccucccauugagucagaaaauguaagggaaucuucuagaacccagcagacauucacuagaugcucauuacuuuccccuccuucccucccuuucucuggccaucugugugcugaguccccacugcggugauggaguggacagcucugucuguguggggguucugcugacuugcgggucuucuccccaccugguggcugcacuaaacgcaugugccugggccugccuuccacacugaaauaccacaaggccgggagggagcugaugucuggagguggcugguagagaggugggccugggcugcugugaggagacgugaagucggggccugcugcagcuuuggggccgcagccugacucagucgucuggggcagcagguuggauucuugcagauggauuuuuucagugugaaaaugagcuccauguggccccacacacuugugcuucacccacuucugggagggcagacggagcuguucagacagcuccugcgcaugagacaccuggagagcccccagcugcccaccgcggaggggaccuugaagcuuggcuccauuaacccacugggugugcagacucacaggggaacgucagcuccaaguccugcccccagugcaccaauguguggugcauccuuuguugcgucucugggaucucgcacaguacaguuauguguucauucagggcccauguagcugguuuugaguccauuucuaguguuuugaaaacuugcaaagcucucguaauugaaaaaugccucuggucccggggaaguaauguaaaauauuccucccaaaggucacagugacccaccacaauguuccuuuacuugcaucaaagaacugaauaaaauaauuucagagcugagucagcagagccagagaggaaccccacugggcucacccgcagcucuaaaguggcuccccucggaugggugugaggaaccacacaucuggacgagugcgugaaggguugaguggacagagaggggcuuucauuuguaacuggaaguguauuccuuuuagcuuccucuaucacguugucuguuuugcagcauuuaauaggugcuaaaccaucucccggggccaauuuccuuguauuucuaaaucugcccguuguaaugaaaccguaaaggcaagugcuguccgaugccagggcuggggaagaacaaugagccaacaggcgcguuugucuuuuguccacauuccacaguuuugucugaaagggcaagugcaagcugcacuugggccugaccaagggcccugugaggacacuuggugugggggggcccacuucaaaugucacacuccugggaaguggagacauuccugagaagugcaaaugcaguuuuguuuuauaaaggccaguuaaaaauugcccauuaucaaggcaaaggccaaagauccaugacugucuugcagcuucaguuagauauggagagauguuaaauaucuauguacuuaauuauguaaugcaauuuccugcuagaugccaauuggcauuuauuauuccauucauuuguuauaaaagcaauauguguccaugauagaaguguuaaaagcuaccaaaaaguauaaaaaagaagaugaaaaugagucauaaugucuuauuuguuuaaaccauuaugauggugauggugaugauuaugaugauguuaaugauguugguuucuauuaaguauaaccaaacacauuacuaaaggaacauuuugauguauuuacuuucuacuauuuguuccaugccuguauuugcaaaauugggauuacauacuacuuuguaguaguuuuaaacuuaaaacaugaugagcaaaucucaauaaauuaggaauaaaagagaagccccucaauuugauaaaggacauucauguaaaauccacauacuaaaugcuuucacccuaagaucaggaacaaggcaggaacgucugcucguaucacaccuauuaacauuguauggagauccuagcuggugaaauaagguaagaaaauaaaauaagaggcauauugauuggaaaggaugaaguaaaacugucuuuauuugcagaucacauuagugacuaugugaaaaaaauucuaaggaaucuacaaaauaacuucuagaacuaaaaaguuuagcauggcgacagaauacaaagucaauuuacaaaaauucauuguauuucuagauacuagcaaugaacaguuagaaacaggaauuuaaaaagcuguuacaacaauauuaaaaauauaaaauacuuagagauauaucuaaugaaaauaugcaugacuuauucacugaugauuacaaaauauugcauagauaaaucaacgaagaucuuaagauuuaaaugcaaagauauaccauucucauggaccagaagacucaauauuguuaagauauuauuccaccucgacuugaucuauagauucaauucaaugucaauuaaaaucccagcaggcuuuuuaaaaauagagauugauaagaugauucugaaauuuauguggggaugcaaaggaccuaauauaaccaaaacaauuuugaaaaagaagaacaucggagggcuuaugcuuugugauuuugagacuugcucuaaagcuauagugaugaagacaguguaguguugacagaaagacauauagaccaauggaauagaaucaaguccagaaauagacucacauguaaauaaucuuuugguuuuccauaaaagugcuaagaugcugcagugagccgagaucacgccacugcacuccagccugggcaauauggcgagacuccaucucaaaaaaaaaaaaaaaaaugcuaagauacaauggugcugaaacaacuggauaucuauuugcaauagaauaagccaugacccuuaccucaaauaauauacaaaaauuaagaugggucauguauuuaaagguaagauuuaaaacuuuuauaaagcauaagacaaaagagaaaaucuugaguuuuuuuaccuugaguuaggcaaagauuucuuagauaggaaacaaaacuaugagccauuaaaagauuaaaaagcugauaaaucagacuuuauuaaaacaacaccuuauacuuuucaaaagacacuguuggaaaauggaaagguaauaagauuggaagaaaauguuuauaaaacacauaucugauaaagaacuuaugucuaaaaugcauaaaacauggucacaacuccacagcauggaggcaaaugaccccacuuaaaacugggcagaagauucagacaaauguuccagaaaagaagacagaggcgugccaacaugcaucugaaaagauguuugucaggguuagucauuggagaaauacaacuuaaaaccauaaggacauacugcaaaagugugagugaggauguggaaaaacuaucacccauucuugguggggaugcaaaggggugcaaccacuuuggaaaacaguuuggcuguguuuuauaagauuagcccuuccuuuaccacaggacaaaguaauuccauguauaggcauucauccaagagaaaugaaacaugcguccauacagagacauguaugugagcacucaugugcuguguuauugcaauagccucaagcagggagcagcccaagugcccaccugguacggggacaaacaagcgggaauacugcuuggcaacagaaggcaugagugcccgaacaggguggcacgaaagcacugugcuaagcgagagaagcagacacgaaagacgcaggggacacgguuccauuuauaugacauuugagaaaaggcagaacugcagggacagaaaaaagaugagugaggagagagacauaagggaacuccugggggugauggacauguuguguaucuugauaguguguguguguguuggaugaggguguggaggguacagcacuauccauuuguccaaacucauucaacugcacacuuacaaagaaugaauuuggcuggugcgaugacucacgccuguaaucccagcacuuugggaggccgagguggguggaucaccugaggucaggaguucgagaccagccuagccaacguggcaaaacccugucucuacgaaaaauacaaaaguuagcuggguauaguggcgcauguaauccagcuauuugggaagcugaggcaggagaaucgcuugaaccugggagguggagguugcagugagcugagauggcgccacugcaccccagccuggguaacagaaugagacuccaucucaaaaaaaagaaaaagaaugaauuuuacugcauauaaauuauaccuccaugaaccugacuuaagccacaaaugccuugagcauuuccucacguuucaauauucccuuauuaauacuaauaauuauuaauaaaugaaauaaaugguaauauuaauguaacauuaaggcacagaugaguggcuaugguauucuguugguuguacagaguguacugugauaugugcaguccucuccaguugggacaucugcuuucuuucuauguuuuuucaguauugcauguaauuguugggugagcguuuugauuaagcauuuguauucaucucaaauucaguguuaaacucccauaggagcauaaagagaaugaaugucccucagacuuucaguacuaagugucaaacuguuuccugagaggugucaauuuagacuccuguggguacugaaugagaauuugcauccuugccaaaaauuggucacuuaaaaaaaaauuugugccaguuugaugggagacaaaguccucuugauuuaauuuguauuuagcuacuaguaacaucgaauguuauuuauuuguuccccccuuuuucuaguugcaagaacaucuccuguguauuucuguuguacacaucuuguuguuuauugccuguucuuuuuuguuguuguugugguucucuauugcugcggaacaaucacuucaauaccugguggcuuaauagcauccucuuauuuugugugugaaucugcguuuugagcacgguuuguuggggacccuuugugugcuccacaugacuucagguugaguggcuuguuuggggcugggggauccauuucuagauggcuuuuccacaugugugguguugauccuggcuguuggcugagggccugggguucucuucacauggagcccuccaaggggcugcuugagcuuccccacagcauggugucuugguccuaagaaggagcauuccaagagacaugggaguagagucucccaguuucuuaaagccuagacuugugagccagcaguguugcuuccaucacgaucuaucagucagguggccacaaagcccaccuugauuuaagggaggggacauagaccccaccccuugaugggcuguuauguuagauacuuuguggccauuuugaaacuuccacacuuuaaaaauuuuguuuuggcauuuuuuuuuuguuaacaaaauuaugccaguuguauguggcuaaguauuuacacaauuuuuaugaaguggagggauauagagaaugauaagcagaccuuccccuucacugcuccaccaaaccucagccccuuuccagaaguaaccccucaacucucugaucgguauuguucuggacuuacugguguguguauuugcaugguguuuuaucagaugacauugccaucuuuuacuuauuuuaagaugaaagggauugugcuuuauaaggauuuccauggcuuaaggacauguugggccaucucuccaucucaggccgucugcaugaaccccuuccugucuggccucugcagcauauuuggcaaaugcagcuuuguugauuuaaccaguucccgauugaugggcaugugcuuuguuuucaguucuuugcugcugugagcaagccuuggauguccuggcacagagcaagccuuucuguaggauucagcccuaaaggggggcauggcaggucaaugcauguguacaucugcauugagauccugcaaaauugcugcucccgaaaggcuccuucuuccacuggcauucgucuuggagccacgaaugcacaguuccuuuguuuguucauugguugauuuguucauuuagucccuccuuuauuugcugguggggguggugcuucauuguucacuuauugucccuuaguugguuuguucauuuguuccuucauuugcucuuugguugggucauuccugcauuuguucacugguugguuugaucaucuguugauugguuccuuugguuauuuuuuccuuuguuugcucauuggcuggcuuccuccuucuuccuuccuuugagcgcuguaccaagcaucugcucugagcuaagcucucuucucugcuguggauuaagggcaagacuugucccuucccuaaaggagcucacggucugggaaauagcaagucccuuggagcaccugcugccaguccugggcuuggggaggccauggagugcucugguugugguuugcuggggagacacagaagaggcagggacaccaggaagcggcgguccauccccucgugauugguggcagggccucucaucuuccuugagcuucaugaaggaacagugucucugcuggaugcuaccuugaauauucagaauaacuuacuugagagugggaagccugaaaguccagccuuuuuauccagaucucagcuaccagucauggcuucucggggaaggcaggcccugguauuacaccuccuuuccugcaggggaaaaggcucagggugguggagcugcccuugguucucagguacauccuugugcuggguuccacugagcauuucaggacagcaggagagguuucucacugccuucuaaaucccgaaucugcccacacaggcaggaauccagugcauccaguagagagaggccaugugcaaaugcucagguucguggagccaggcucuugccccugaugcugaaaugauaggagggugagguuuaucagcgggaucuucggggugaugacauuccuucccccaucacuccuuggcacagccacccuucauccagccgucccuggggccauucuucaagcgcccuuuuccauccuguagugagccaucugucuauauccaucccuccauccuuucucaguccggccaucuuacucccuguuccuccuucaucucuucacgugucugugugucuguccuugagugagugcccagcugcagugugugguugagacaguggaugcgggaggacugugaauaggcugcuuucuccacagcugccuggaacgccccauggcaugguuccacgggaggggcaucuucugccuggcccuuguuccaccgcugggggucucaagauucucugucgccccauagcuuggguauggagggccuccucuccaugcaaggccuccuaugguccugaacauccugugaagaacaauuccgcucuuccucggauugagccucgcucugcccucaucauggccccagugcucuccccagcgucacucccuccgcagcaggguaucugcaggggucuuggaggcauucucccagcuugcagccccauggugcagaggaaagauuuuggacccaaauggaugcugucugaaacucagguggucuguaucucugguggucuguggcucugaagccaugggcagcuugcucuaccucucucacgcugaguuuccucauguaccagugaaggggccgacacugugggccaaguugaugaauaagggaaguguggcagcugggcgcagagcacauaacaggugcacaguccucagcugccccucccccauggugcucgggugcauggauggugcccaggguccagucccccaacaacaggcucauugcaguggccugccgccccggugugugucccugacucaggggucccaucggcagguguguuggcuggugccagccccgggaagcugucugcaucccugcagggcaagcaccugcuucucaccaccugcugcuccuccauggucucuucagagccuguuuuuauccuggcugcugucauuccugagcugaugugcacuccugcagugagcgacagagacccccauuuccuucccuguggcugggcagcuggaccacccaggaugacagcccaagugauccaccaggacucucgcagugcagacaaaaugaaacuggcccucgcuggaggaacgggugggccgggcccugggugaaggggcuggagcuaaaugccguuggaacuggguggccccugaagugucugcuuuuugccaaggcagagccugggaagagggagcagggaucaggcugguugguguuacccccugcuggggggcaggcguuagaucugugcagggugaggcuccgaggcuugcugggucagucccauucaguggcucuguguuggggucacgugguaucugcccucuguuauccgagaugccuuucaggccuucaguucucaucaauucucaguucauuuggagccuccucuucacuacuugacacccuuaaagugauacccugccaucagcgcugggaaacugaucauccuuuucuuccuuucgcucucugggccuccuugucuugugucuuguguggaaagagcagucuccgaggcccuaaccuaccaccccgcagucccuccccgaucuguccccugcacuguggggcuggcuagggggcacugccgggcugguuagggggcacugccgggcugguuggggguacuguggggcuggcuagggggcacugcagggcuuauuagggggcacugcagagcuaguugggggcacugcggggcugguuagggggcacuguggggcuucuuagggggcacuguggggcugguugggggcacuguggggcugguugggggcacugcggggcuucuuagggggcacuguggggcugguuaggggcacuguggggcugguugggggcacugcagggcugguugggggcacugcggggcuucuuagggggcacuguggggcuggcuaggggcacuguggggcugguugggcacugcggggcugguugggggcacugcggggcuucuuagggggcacugcggggcugguugggggcacugcggggcuucuuggggcacugcggggcugguuagggggcacugcagagcugguuacggggcacuguggggcuucuuaaggggcacuguggggcugguugggggcacugcggaggugccccggugcucuccgguggucagaucucaggcuccugccagccaguccccucgcgaggccccacugccaauaugucccucuuacagauaaugacaggcagccucugggaugggacccacuuugcccaggaccauggggcuuguacaugggggguuuaggauccaagucaguccaccccgggagugggguggugccgggucaggugggccugugccuguggggaggguggucuagugucagacacagaugagccauagauccuuugcacagagaaucucauaauaagcaaugcagugagagcagugacacugucaucuucaggaaggacuaccccggaggcccuuuggacgggcccuucauucuucagcaaggaaugaugagcugggagccaugaacaagcgcagugccucuggguaccucagagcccacucagggcagccauccaggcgaagguuaacauagagccuccaggcccggcuacaggccauuuucucacccugugaaacacugcgggucggugcacaggugucuggauguggacuuagcucaguccugaaggcucuguugacagacaagcugggcaggugggcagagucauuuuuacaaagguugguggcauggagggguggggacagcaggccccuuccaggugcgagcucccugcccggcacaccuguaccuguuccuccaugacccauggcugaggacaccaaccugguccccgcuguggagggcggagcuggcauccugacuagcccuggucaguuccaaacugcugcucucugcuguaccauguccggugagguccugaagugcaaaaggccuugagguggggccccaggggcuuggggaggguggccaugcugugcacugcacaaccccagggagcgcuguucuaaugcaccaugauggggucuugcaggacggugacacuggugaggagauggaccugugacagccagggccucccgggaaaauuccacaggggcagaaggacgggugagggccgggacuuugacaucaggcagaggaguuggacguugaugggagcuuuuaggugggugcauggaaccugcuuuggcgaaguggcagugagcgcagggacaggcugggaguuugggcucaggucuccaggucuccgccuggcacugcagccucggggggcagcgggagaggccgggccaucugccauccucccaggaugguguccucggccugugcugcagccccaggcccucugugcauuucccacccccugccccuuugcuuugcucccugguuuagucauugaggaagaauuucagucgcagccuccagagcgccucuguuuuucgaccugcuggguugaccucacugaugaggccgccugccuugcagggagggcuggggugggggggccucagcccugggccagacccucccugguggcucgauggcucggcccucagcccggcccuucaagaacuguggcucucuggcuuccaggaaauacaggaagggaacuaggagggacagccgcccuuccccggcucugcagggcccuuuacaaacagagcaaauugauggcuucgugaacaauuucugcgagcaucugcgggugccgggcugugcggggccccugcccuccugcaguucacagcccguggaggagacacacgcugcccauggaacacacauagcagggauaugguuccagugauggggccacgggugggaccggaauggaggcugccagcugugucuggagaggccagcgugugccugugguuucgggagccugucacuggcuccagaguggaauagcgcuugggacugggguggacugggcacugagggugacucccuugcagccccagcauggcaccagccugcgagugaccaugcucaccugcccuguaccucgauuccucuuucccaaugaaggcucuuagcccagaugcuauuuaugacuccuggcucuaaaauuagaguucuagcccgagaauugugaagaccucaagcuugggguuauuuagagacucucaaguuuuucuugaaguuaaggauauugacuuuggggccugcagaaaccuccccucucuuccucgcucuuccucucuuucucucucugucucucccucucucuuucugucuguguagcucucucucucucccucucucuccccaucucucccucccucucucucucucuugcucucugucuguccccacagcugccuuccccgaaccccugauccccagcucauucuaucaaguccacccuggucccuuggcugugcaggccacagacauuuggcaggacguggccugggcucagugucugggaccguggugcugaguguuuggcggugaccucuggaggacgggccggggagcuuuaagggccaggcagaaaugcugcccuguucgggcugggggcuggacuggguguccccagagccgacagcacuauucggcugggugccagggacccagccuagugccucgccuucccccagccaugcugccuggaggccggguccugagcggagcacucuguaccugugucacccaagagcugcggcuuccuuuagccaccacagcgggcauggggaggggacugugcgggugaacauggggcagagagaucgggcugggccagcacacuuccccagagacccugaccccaggaccgacggagccagcccagugccagggacagaguuggaaauaaccuucuaaugagauaaggagauaaagaugauacuagaauccuaccacacugccugguggggugggggagagccugcugcccaggaagggcgcaggaaucccggaggucaggcaggugggcgagucagaacugaggggcacuccuugacuggaaaguaacagugggcacugcuccggcucaggggggcaccgggacgggggagcugaggaaaagucacccccaagugaccacgagugaccagguggaaucugcugguguguugugguucuggggccaggggagcaucccugugcauuuguuggcaaaaaggagcaggcucugauggaucgcaaaugcccagccuuugggagcggggacugcggccagcacaucauccgguggggacagacagccugggcuucaaaggcagccgacccauagccagugcuuaaagauauugaacuuguuuaggggaaaaaaaggaauuagagaaaaagauccaaugcagaccccagcaggccucguaggagcgugcgaucccacggccucagacccggcuuccuuccugggcaggggaggcacccuccccucuguucacagcuugcucuugcucugugagggccgccaugagacggugacagcagaguggcacgccaggcugaagugggcuuuuauuuagaaaaguagaacggcuguaagguggucaggggucaccuccucccguggcagugcugaggcuacagguccccuggcugcaggaguccucgaacaccggcagagaggaaaccuguguggccaucccgucucaccuccaaaccuucugcccuugggaaaaaagugggacuuuccucuugagcccgucgcgggcugaucaccauuccucccuggggaggagggccaggccagggagcggggaacugauagcugaggaggcccacaccacugcacccagagaugggcacuguuuaguagcagauguugggaucuaacucuacuuggcguuagcauaaagguggauacaccaguuucuguagauguucaggcacagcuugauccagcuacucaaacuguguggccagucugucucucugcauccucuuacacccucucccaggcuguuguguguagaagcuguggguugcucagucguucagcaaacacggcugagugcccagugugugugggcuccugugcaggccccgguccugcccugcaugcaagggcucuguuccugccgcccuuugauacucccucuccaucagggcccaccccaccugagagugggugcuugugcccugggagcagcucauugcacccccuuuccuggggcgccggcacccggugggcuuuucuggcugauugucuuuuguucugaagacccguuccccacuggggagaugaggcucugaggucagcacuuggcagggugcccccaagcgucucccuuccucgaggcuggcaggaugguggugcuauggagcguccaggcucagguuccggauuccauucugaggacacaucugcgucacucaagaggguggccccagaccuccacucuccuucccgaaagcagcggacuucugcagcguuucuguuguugguggagaagcguucuuucaugaggggccccacuuccaaggggaggggcugcugagccugagagaugcucuccagcagggcaggcugugaccgggccgaaguugccucuuccuugcuucugagcccucggaggagugcucgggcaccaguggacgaccaggaacugauuuaaguucccgcuaaaagcagccaucucauuccaucagcuccuguaggugccggagcccuguacagauguccagcagccccccaggucucggggggaaacagagcguugcugggcugggugcugugaugcugcccugccaugucuucagccaccuggcugccagcauucauccuucucagcaggucugugagccucaggccuuaaggggagcccagggcuccauccucaugccucaccagcucaguuucaagcccucaucucugguucuuugugcugggccacauuaguccacugcugguccaggccaggagcaccugggugcgcugagcacuguaguccuugcaugaaguuucagcaucucauguccugcagcugugugaugagaggguggcaagcccuagagugacauggaaugcgguuauucugggucagcucuggaggagcagagaagcugaccuccauggggaucguggaaaugccuguuggggacagagaaaguuauccuagcaugguuaguggaggcauuguuauuggcugguggaaaggcugacaacuuagugcagcaauuguaaaauugcccuauaccuccugauuuucaccauucacuugcucaucuguucacugauugauccauccacucauccauccauccaccaucuauccauucacccauccauccauucauccauccauccaccauccauucauccauccauccaccauccauccauuaauucauccauccauccaccauccauccauuaauugauccauccauccauccauccauucauccauccaccauccauccaccauccauccauccauccauccauccacccaccauccauccauccaccauccauccauucauccauccauccauccauccaucauccucccauucauccauccauccaccauccauccauucauucauccuuccaucuguccauccauccauccauccaccauccauucacccauccauccauucauccauccauccaccauccauccauuaagucauccauccauccauccauccaccauccauccauccaccauccauccauucauccauccaucuguccauccauccauccauccguccauccaccauccauucacccauccauucauccauccauccaccauccauccauuaauucauccauccauccauccauccauccauuguccaucauccauccauccauccauucauccauccauccauccguccauccauccauccauccaucaccauccauccauccauccauccaccauccauccauccagcauccauccauccaucuauucauccauccauccauccuccauccauccauccauccaucauccauccauccaccauccauccauccaccauccauccaugcauccauucauccauccaccauccauccaccauccauccaccaucauccauccauuguccaucauccaucuauccauccauucauccauccauccauccauccaccauccauccaccauccauccaccaucauccauccauuguccaucauccaucuauccauccauucauccauccauccauccauccaccauccauccaucaucauccauccaucguccaucauccauccauccacccacccauccagccaccauccauccauccauucauccauccacccauccauccaccauccauccauccauccacucauccauccauccauuagccauccauccacccacccauccauccauucauccauccauccauucauccaucuauccaccauucauuuauccacuauccauccauucauccguccauccugcaugucuguguugagcuccuccuaugugccagugcugcagucuugcuuguauuucuuaucagggucuuugugcugccuuuuguggugcaugacacccacgcagaacucaaacuuucauuuccaaauuauucuccuucuuccuuccuccuucuccuucuccuuuuucuucuucuuucucuuccuuuuuuucgagaccagguuaugcucugucacccaagcuggagugcagugacacgauccuggcuuacugcaaccuccaccacccagggucaaacgagccucacaccucagccccucaguagcugggaucacaggugcaugccaccaagcccagcuaauuuuuguauuuauguagagacgggguuuuaccauguugcccagguugaucuccaacucccgagcucaagccaucugccugccucggccucccaaagugcugggauuccaguccugagccaccgcgccuggccaucaaauucuuuucagucaccucccuucuuccuuaaaacugaccuugcuggcguccauuccuuuauaggucuggggaccugaugccugguuauauccucaugaaaaugggccucugggaugccagugacaaauacuucuacuuguaacagugcaggggaugcaggggccaacuucucuaacucugaucaacucggggauggacaagagguauucccugggcaagcgaggcugugcaggaugccugaccccuaggugcuggggguaaacacuucuuguaguuuaaagauucugaugcccguggccuugugcugggcccaugucccauaggugguuccagggaggcuccugguuucagugcacacagcugaugggagcaagccacgauggggaaagggauugaaugcagggagucagguggauacagucuccgggagacccggcgugguggggucaggaggccccacuccacuaucccauuugggguugcaccaccauagcgaggcugccacccagacugcaggaaguugcugcugccaaugccgccuggugcccugaagcuggucccaggccguggcaugcgugggggucuggacaugaggaucaccuccauaugcugugucuggggauauggcccugcuggcugugccagggcggaggaggcugccaccucccucucacuguccagcuccaugagucucucugauuggcagauucuaauuugcacccugcauccuuaugcaaaggcaccugggaaguguaguuuuuagcuccccagacugcagagcaggauggugccuagaggagacagggcuggagcuuggguggccaaggcacagcaggacaccugcuauucucugggacuucauccauccauccauccauccauccauccauccauccauccaucauccauccauccauucauccauccauccauccauccauccaccaugugauggacugaccccauaggugauccggucauggcgaggguuccauggaaucaacaaaguuuuuguuucaugaagcuuucggagcuggccuucugugcaucagauggucggucucaggaaccucugggcacagcugcaugguccuucacuaaagaguaggcaccgggcuggguguggagaccacacgcgugaugccaucucgucuucacugagcaccugggcugcucgguggguccucugggaacugcuggugaugggccccugccuggcugucuaggagaaaagggcaaaagagaggggcucuuguuuguugagccgggaagugcacgggccagugugcgguggccacuguugauucugcagcuucucucacuggccuugacccacugggauccacccucugguggggggugccacuggcuucaaacccauguccaccuguccccaaagcuugugcuguguccaaguggaguuuucauccugauggaggcuggaagaaaagcuccugaaaggcugugcgccaggcuccuccugggcucuccccaaccuuuucuuuuucaaaaaguacuuaauguuuuccucugcucuggcacaggaagccccuggccagcaggagggguggcacuaggccugggaaaggucugguggccucuuaaacuuguugcaacagagaucugcgaacauguccaccaagccugcuggaaaacagcucuugccuucagcaauggagaaaacaggcuugcgagccugagucugggaagagcaucacgggcuuguuauggugugaguccaggaagccccggccgggauccuugcuccccugccccggccgcugccagugcuggaauugagucuuagggaugacccagggcucggcacugugucaucuucagcagguggaccggcagcuggcgcauccucucuuuccacgggcugcauccaggcccagggcugcgcggugcagccucaccaggcacuggcacucagcguuucuucucaagucaaaggcaaaagcccaccaaagccuucuuugcuggggccaggugggaggugccauacaugcccgagggggugacagagcugggugggcugugcccugcuuggcagccgaaagccacccaggaaaacagagaggccaugagaggccuggacgugggguguucugggucccugugccgccccuccccuuugucacuguucccacgccgcagugggaaauccucagcuucuccauguuucuggcuucuugauuuaauuggcagaggacugcagcaaagccaagcuguagaaaugacaccgucagaggcagggacuucagaacccugggaccuggguacuguggagccuuccagagaacuguggauggggaggggcuucaugaaugagaaaugcggcuucgauuucccuccacccuggucuccuucagagcccugcccaggcugcugucuucccugcacugucagcuggucauggcggggguggggguggcacagguuccugucuguaccuccuuguggccugcgcaccaagcacagugcccgcgcugaguccccuggagggacagggagugcuggggagacagaguccuccgucugggugcuccucuugcugagggccugcugggacaagcagugacacugcgccauugucucuggcagccaccuccucccguggcagugccgaggcugcaggugccccuggcugcaggaguccuugaaaaccagcagagaggaaaccugcguggccaucccaucucaccuccaaaccuucugcccuugggaaaaaggugggacuuuccucuugagcccgucgcaggcugaucaccauuccucccuggggaggagggccaggccagagagcggggaacugauagcugaggaggcccacaccacugcacccagagaugggcacuguuuaguagcagauguugggaucuaacuccaauuggcauuagcauaaagagggauacaccgguuucugucaggcacagcuugauccagcuacucaaacaguguggccagucugucucucugcauccucaggcaagcacucuccaccugcucaggagacaguugccagcagcuccagguuccuguucuguguuuggagccagcagagcagggaggauuccucuuucucaaaggaaaaaagccccaggacggagcuuccuuauccuggcuggucucacguccaucccugagcugaccgucugggacagggcggugucaugcucugauuggccagcagagggggcacggccaaccccguccacaucuacugggcagggcaguugccggcugcuggguuccuccaacucccaggccgccccaacacacaccauucugucgcugugaugccaacuucgaguuuauuuucucugccgggacucccagggagccucuugcucgugggcacaggagcagugcuuuucccauaaaacugaccuuguucagggcagguuccuggauucgcgccuugugguggaugcaggucugggguccucguggugugggggaaggaggcucuggcagauggggccgucuuuuguguuggagggugaccauugagcucccugguaaugaucacggcuucaguggccagaggucagcuuauccccuugcccuucccugagagccccuggauagagggucaggaaccuucuggaagggaugcgggggcugccccucccuuguucuuggcucugcauggucuggcgaugugggcaggggucuuccagggcaauggaaacugcacacccgcuguaaacggucaugggaaggcgacagacaguccagguggauaaugacggggggauaaacuaggccagugacauccccgugaccucuggaggggccucagguggggugaagguucucagggcugcagggcagauguugugacccaccgguucuccugugucauugcacagcacaccauaaggcggucagcuccgcagugggccuucuguggccuuccagcaucugccugggcugcucuccuuacguggccaaugagaagaggugucugggaggcuggguguguggccccugccagccucaggagccacgagagcgcagugaggaaggagggcgucgucagagcugggcuagcccgggucugccccugguguguggccgcugguggggacagggaugggacccucugggcuagccugggucugcccccgguauguggcugcugguggggacaaggaugggacccuccuccgcagcguggugcccugccucgcccagcacgcggcucuaagcugguccuggggcucuucugagugcccaggauucacaguggugggggugggggugcuuccugucaucccagcuuccggguguucccaggugcuccuuuccucuccguggcuaacucugcuccuccucugucauuucagcucagccagcagaucuccugaagguucuagauuuucacaacuugccugauggaauaacaaagacaacaggcuuuugcgccacgcggcgaucuuccaaaggcccggaugucgcuuacagagucaccaaagacgcgcagcucagcgcacccaccaagcagcuguacccugguaagugccgcacccuucuguuuggggcggugggucccguuggcccucuggccuccagccaggagcagcgcucaagccugcgugguggcagaagcgggcucagcuuuccaggaagccccucucacgagcccggcuucguuucacuguagugaaaaggcaguugcaacagugggauuuuguccuucuggacgggacugggcuuugucacuguccuucucugcuggauguggguggguggguguggcccagugcccuugaccuucuaucagcugugucucuggugguagcugggccgccaggacuccaagggcagaaagagucggauggguccugagggaugagguugagagaaaccucggggucgugggaaaggaagcacuuccagacagaagcuuaaccaggggcagugacauuaagagacgaugaaucaaacgucgugacuccuagcaagagcaugggaggcuuuuaaugagagucaacugcuaaaugccgggucucugcuuuuaauuacaugcccggagcgggaagcagcauuagcucuaagauacagcauccaaguugucccugucacccagucguggggcggcaccugccacaguuaauuaaacccucugggcuuaucuggacgugauuaacgagcuguugauggagaaccucaucgccuugacccagccacuugcucauggccuggacuaaaaugagcuccucuuucugauucagaugagaaagggacgggggauguagggcaggugaguucacuuuaugagaugcucuguaauuauuagaagacagcgcagcaucuuuuugguggaccuggaggugaccccggcauugaacccacgaucagggcagucuuugaaugcuccgugguguuucugaugaucguguccccacggggccccugaaggacacccucuuuugaggggcuguuucugcuuccacagacgugcucucuguacacucauccccagccauugcccagcccuccuuuacauccaugugaccuugaagaguuugucucugagagaaucugggcaguucuuuucaagaauguuuuugagaacgaguuauuucaagaaacaccuucgaggcaccgagucucugccuugcagcuugguggaggugaggugaaguggccugggaccccuggcagcccauauucucuuaaacagcccaccucuggguaccagaguggcccugggcuguggauccccagccucaagcguguggaacucaucggcucagacagccuguccccgcaaaggacugcagcgguuucguuucuccaggccucuggaggagcguucauaagcuucugggagagcaucucuuuuggaauuagccauggaauccucacuuggaccuuggcccagaaauugcacccuuuucugccccaugacccccgguuuagaauucgugaccuagagauccugggagggcugguccagggaagggcuuagagagcugauugccgaggaccacauggacucugggugugugacacgcugaggggcacccugggaaguaagcgcuccugcuuuccaaggggaucuucagccacuuuguuuaaucuucucugugucacccaauucuggggugugggcaccacacacucacuggacuuuguccuucucugcuggauuaucuuguggccagaaauauuacaguaucucaggaauacgggcuaauuauuggauaaauaaucuaggaucagcugggcgcgguggcucacccuguaaucccagcacuuugggaggcugaggcaggcggaucacuuaaggucaggaguuugagaccagccuggccaacauagugaaacuccaucucuaccaaaaauacaaaaauuagcuggacgugguggugcgcgccuguaaucccagcuauucgggaggcugaggcaggagaaucacuugaaccugggaggcggagguugcagugagcugagaucgcaccacugcacuccagccugggugagagugagaauaugucaaaaacaaaaaaaaaggaaaagaaagaaauggcuuggccuuccagcaguuucugcauagcaggcucucugugccucucucagcagggaccccaucccugagcagggcucuuaucuacagaucaguugguuuccaugucuguuuccggcuuuuaaccagaugcuaggugagcgagguuaccgugacacagugaagcagugagccgagaucgcgccauugcacuccagccugggcaacggagugagugagacugucucaaacaaaacaaaacaaacaaaaaaaccaacacauaaucuaggguaaauuucugaauagucugcgggauuuuuuuuuaaguccauguuuuuuuaaguuuuccaaagugcuucacuugcucuuccagagccuucugugaauuagcuuacagaguagaguggguccacauaagccaauugccccauucauggcagaugaagcuggagguugcuugggaaguauugaagcagggcugucuacggagucccuucugcaggucccaaaguguuggguugggaccugcagaggucccaagggacacuguuggagaccagugucauaggacaucauuugccuuugaauugacgccauaccccgccucgccccuuccgcccggcccuccgagcaaacucgccaccuguccucuguugcucggacucuguccaccccacuuggcuugugggccccucaguggagggacucagaagcucacuucagguuuucuguuugagaagugcucaguguguaggggccacacacaggaaagggcuguuugcuugggaccgacacggucucgcgccagccacucgugugggucagccuaagcgcuaggggagcuggagcugcaccaugcccugucucggggagcagcagcaucugcgggauucuagagacccguaccugccuggcaguuguagagguagaagagagggugcagcccagguggccacggcaaggccugggcuguggggaacugaguggagcaaaaacaguaucuguaaguaucucuuggcgagaggggaagcccgcauccaggcagcuguuuccccggcauccgauccccugacaaaaucccugagcaggcuccccagacuccccgaagagcucacacaccccucggcaaaucagcagccaaguggcccuggaucacggggguggggguuuggagacugagcugagcaggugacugggagccuccaccugggugcagugcccguccccgcccaggccgcacaggcguugaccucugcccuccacccacacuggcaccaccugguccuguaucccccacugggcacgaacuggcagagugaucugggugccagggagacacagccaugaauagaacagauggagcccggccuccucuggccugggagagcgagguucccuaggccacccuccucaggggcaccgcccucccuucuguacaggggaagaauccuguucccauuuucugcacuugggggcaggacagaggcuagaauuuccccccucauucgaagaggguuuucuagucuugcugagacccagcagucuggguucugggaucuguccgaccagggagcucaacccugagccacgguugcugaccgaucaugggugcuggguuguccuggcaccagggagaugaggcugcagggacugaagcccaggacugugacacaggggcugccagugaagcggggaggguugggacuuccuucccaguggggucccaggccucgguccccugugucugcagugcagacaucgccucacggugagguggccugagacccugaaggcagcgggccuggcuuccucaccaggcggcccgagcucugggauccacguccccacugggggcccgggauggugugcucccugccuuguugacccagcacugcuuguuuguaaugacccagaucugagcuguccccucugaggaugaccaggcgaggcaguguccccccuggucaccugacuuggggaccagccccaccugagcccacuuccuggaucagcacgcauccuccuccucggcucuggugcugugggugggguccucucuauuuuguccucuguaggugccuuuuccuccguaccccucuucagaccaggccucugagauuugccuccuacucaggacacccaggguuggguggaggccacggcucugcccacaccccccugccccuuggccaacacccugucuucgccuguggcucuccugcacccuggggccugggcuccagaaucagccucccuuaggcagaauguccugcugccccucgcugcccccgccaguaccuuccugccagagagcaagggagcagccaguugcgcugggcccugggacccuccacaggauugcgcugagugcuggacgaggguggcagggacggccgaacagggugccagcugcaggggcaggcugacgugaggggaagauggaggcagcggugggaggguaguguccucagccugggggcuuugcagacccucuacucacugagcagaugcuccccacuccccuguacccccauagagcaggauagggguucccugauggcugagaggaggggggucccaugaaauaagaugcgggguucccaccugggaaucuaccuggugagacuggagaccgucucuuccucacucuaucuucgaccccauggguuaguccagcccagggaauguaaacuucacuucuggccaugacaaaugcaguaaguuuggguccaggccagaagguuccagaaccaaguuaucccugcaggggcugccagauggcagcuuccucucuggagccccucaccugucccaccccaaugugggacugagagcccuucuggucgggacugaagauggcuggugaaauuccuucugcagggcugccucggugccccuggauccugggccucugcccugggccugccaugcuccccuuagcccggccccuccugggcugccaggguccagcugaaaccucagccgccccccagguuccuggcccccuguccaaaguuagccacaccccgcauucauuuccuauccucugaccucuuucugccacccugccccacugcccccugcauuauuugcaauuauuauuauuauuauuauugagacagagucucacucugucgcccaggcuggagugcagugguguaaucuuggcucacggcaaccucugccucccagguucaagcgauucuccugccucagccccccgaguaguugggauuacaggugugugccaccacacccggcuaauuuuuuuuauauuuuuggcagagacagggauucaccauguuggccaggcugguguggaacuccugaccucaagugauccuccugccuuggccucccaaagugcugggauuacaggcaugaaccaccucgcccagccugcaauuauuuaacuaacugguuugguuugaugauuucuguuuguaucgugggaguaucacuuucugaggucagggaccauaucuguccuuugacugugucaccccagcgccuggcaccaaucacuguuuauuaggggaucagucacuguuuauugaucacgugauccacuguagugagcaaucgguaugcuuaguaacugucggcucaguaugauuuaguuucaacacaaaugcauuuauuguacuccuacugcauaccuaaaaugcucuagugccuuuggacuucagcagaaguaaaagugaaaagcucuggccgggcgggguggcucacaccuguaaucccagcacuuugggaggccaaggcaggcggaucacgaggucaggagaucgagaccauccuggcuaacacggugaaaccccaucccuacuaaaaauacaaaaaaauuagccaggcuugguggcgggugccuguagucccagcuacucgggaggcugaggcaggagaauggcgugaacccgggaggcggagcuugcagugagcugagaucacgccacugcacuccagccugggcaacagagugagacucugucuuaaaaaaaaaaaaaugaaaagcucugagggaguccggagcccaccccucaacugugacuuuucuuggagaaaugaaacaugaaguguucgacagccgauucccuccucccagagugcccggacagcguagauuauaaaguaucagcgucccagcucaugucaugacucgaaugggccaucucacagugacaauaaauccauuguuauuuugccaggagagagauuaauguuaaacauaauuuauccuuucggguuuuaucugagcugagaaaauuuguuaccauagagauuucaaaacuugagaaacggcauuuuaaugagcugcggagauggggguucgugggccuagcggugccuugugccggagacaugagugugcgcaacucguucuuugaucuuuuaagacggaagaaugacucuggcacucaggguggcggugggguggggacgggagccagguggcccuuugcaaugagagugagggaguggacucagauggugacugugccaucugcccuggguguggacggggaccugagugcuucaggugagaccccaccuggcccucagugccccaugcacucccagggaucacguggggcugccaugguccugcuggcagccuugccauauggggucccuacggugggugggcauggcaggucccacucccuugccauaggugggaccagcuaaggcugucaucuccagagucccccgcccacauccccucauguggaaggaugaugcaaagccauaaucgcagcaguuugggaggccaaggcggguggaucaccugaggucaggaguucgagaccagccugaccaacauggugaaaccccgucucuaccaaaaauacaaaaauuaaucaggcguggugguguggaccuguagucccagcuacuugggaggcugaggcaagagaauuacuugaaccugggagguggagguugcagugagccgagaucucaccacugcacuccaaccugggcgacagaacgagacucuaucucaaaaaaaccccacaaaaaaacccaaaaaaacaaagcugauggcuugugucuagacaugggaguccugagccaguuccuccgugaaaccugccuuucccagauggccacacugacugucaucacccccaccuggggcuguccccagcuuugggggcaggugccuuggccaggcccaccuggggcccagucuccugugggaacagcugagucauggcuuggagcuggucaacacagggugcccggccacagcugggcagcccuguucccugucagugccuuagugagagauucgugacugcaggaugagccugcugcuguggcagcuuccagcgcucacgcaggcucuggguuggccugugggggccuuggaggguuugccuggaguaguggccccucauuuugcagaaccucaggagaucucccugcagcaccuuacagaggaugcagaggcugugacaggcagcauucuccucccccuuggaagccucaggaugcugugggacgagggggccuucagcguccccuuccucccaguguuguaccugcagcugugcuggagugaccaggggcagagguggugacgcugcugcccgccuugccacaauuucgccagcagagggugcucauggauagccgccuugcaggcgcugcugccgcagauccagacucugcugccccauggggucaggggccucugggccaccugguuagccuuuguucccacuucuaaagaaggggugggucugguaauggauucacgauggcucaagcccacccaccagaucccagcccuccguaguggugcugcuuguggggcggcuccagcagcagguccugggccccccuuccuuggcaugucccuguugacacccuccugggacaccgcuccuucuggcccguucugagcagcccacagccuuaggcccagcacuuuuggcuggcccaccggcaucaacuagccacaggcccuccaucagccccaggcucuuggcagaacugcagguggcccagggugagagcaucgcugccuuugccaccaggaucgauggacaggaggggcuggggcucccggucaugcccacggaugaggggcagauauguggagugggcuuaggugcuuguggccgggccagccugggucugccuuuuaaugaccucaaauugcuccuggcauguguuguaagagguaauuccucccguuaacauacuagggauauauuuuuuucuaauuuuaaauuuggauuaaauucuuuugaugaauuuccacuuuuucucuguuuugcguaucaaccaggaaaugucacaaaguacaauucuaguggcgguucgaggcuguugcuucccuucucccuuccucucucugcuuccucccuccgucucucucccucccucccccucccucccucccuuccuugcaugcugaguggugugaccucauggagcguacuaagacaccucagaagcagccuccauccagaggcagcucacagccugagagguucuccugagggucaacacacagauguguuaggcgcaggagcugagggcaggguguugagggcucccagcuggaaggaccaguuguguuucauggaggaguuugcauuugcacugagucuugaagggggcagguuuggccaagugggagcagggaagggcugcaggagcaguuugaucaaggggcagaugugcagcagauggcagugccccacgacgggcagcacagcuucccagggucccgggcuggcuuguuugcagagagccauggcugggugugguugcaggggcuccccgacugccuucucaccucugugcucuguuccagcgucugcauuucccgaggacuucuccauccuaacaacugugaaagccaagaaaggcagccaggccuuccuggucuccaucuacaacgagcaggguauccagcagauugggcuggagcugggccgcucucccgucuuccucuacgaggaccacacggggaagccuggcccggaagacuacccccucuuccggggcaucaaccugucagauggcaaguaagugggcacuucugggcaacugucccccugcuggaggggggaucaggccagcucauaccacugaccagauguggggcacaguagaggacgugcagcagccgguacugagacucccacagacgccgcagcagaggagagggugcugggcuuggaguccugaaaccuggguuauggucuugauucauccucuguggcucuggggagucacuucuccucccuggcccuccauuaucccuuuguaaagugcacuaaagcacaucaaauucccgccuguuugugucagaagggacacaggaaauugugagguuauacccaaccuuuuccagaaaggauuucagguauccuucaaggacacagguguguuaggagugggagugagcaugagaaaaagcgggucgugccagcacgcucuguugggugcagaccucaacaccagggguugucagucuccucuuucguggucagcacgugugaggucaugcccugauaaucuccgaacgucuucaauacaugauuucugaauucuucgccaagacuuucagacagauccacuccuuccaccauuucccguccacacccggucuucucuggcugccugcaguuugccaucgggguucagagggcacgugacaagugcucgcaugcacacagcaaaauacaacggccgccgcccugccauucucccgauggcugugaccgcaccgcagggaccacgcucccagggaccacacuccugggucccgagccagugccgagugcugugugcucccccuucccccuuucacuugggcucccggcugggcuuccaggguucagacagccauccuugucugagggacgaggguucuggggaaugaguagaucucauggcacgggguguugcccuaacuugucugauuccagaggcugggccuugaucugcuccgccccaccacgaucgugcaggaagugggccuucuuccugugucucgaggaauuugcagcaaaauugcuugagcuggcaucugugauccaagcccugucuucaccaucuguuucuuugcagguggcacagaauugcucucagcguccacaagaaaaaugucaccuugauccucgacuguaaaaagaagaccaccaaauuccucgaccgcagcgaccaccccaugaucgacaucaauggcaucaucguguuuggcacccggauccuggaugaggagguguuugaggugagcaggagggcagaccaaccccugugcccaccagggcacuccuccuguggagccacugugacugcuguuggaggaggcuccucgggccgggaccggcuggcgguccacuguggucaccgucucuguuggucagaagccucugcugccauccuaagagauguuuguggcuuucggaaauggaggggccagagcugcugccgccuguaggccgcguggggauggcaguggccgcccuugucccaagggcccaguacgugagucuccugggugcuggcucggaaaggacagggccuuuguccagccucgugcugaggcuccuggaaaccugcacacuccugccgucuguauccgaggccauccugggacaggggcagcuguccucugggugagcuugaagggcagagcugggccaccguguggacgcaccagggagaccugugccgacccaacucgggcuggccucacuccagucuagcuguguccagccaggggccuugcuuucccggggaaugccucagaggcuugggagucggggccugagcugagugggcucugggacccucacuucagcccauggagcccuucauagguugggguucugcgugagagagcaggagaaugccccgucccacugccaagaaacagguugagagcuucugcaggugaccagugauccccagcugccccgggugggggcguuggagucaccaggagccuguagggguuccagggcccugccuccuggggugcuggggcgacagccugcacaggguccuggacucugcccuucccaagggcacugcagugaccguugccuccgcggcuuggguuaggcggcagccaggaccccuccacugggcuuccuugucguuuauguaaguuggguuuugcagaagauuugguuuugcacccgggucucuguggcuaaaaccuguucgaaagccacuggcuuaaauggccuccgagggccauccuggcucugggauuuccuccuccagggcugcagagaugggacaaguuagggcagugucuccucccuaaauccccgagcgcugccgugagcuccuggcugugucuacacaucgguucugcauccggcugcccccguuucauggcugaggugggguccccagggccauguuucuucucggugacucggggucaccaaaccagacaccguguugacucaaucuugguguucugccaagggcacgcgaaggagacaucacacguacuaguucauuucuguguuaaagauaucgaugucugcucguggggacgggcacgguugaacugacccuggggcuuugagcgugugagaagagggcaauucugaaagucucaccuuucuaggaaaucauacuggggaccacguagugucacugugaacuggacauucagcagagugcuggccucagggcaagcccaccugggcucugucgauuguuggauuugggccucgggcaagcugcucugcuauuucucugucuuagggucuccgucuguaaaaugggaucacagauguggcugcuucaugagcuguggcaaagguuccaugagguugaaugcagugacacagcagcgcacugucucccuuauaggaagccccggcuuaaugucaaauucaguuguucuggauauuaauacagugucaaggcagacagaaaggcaggacacagccccgcggcccagugcagaccgcagaggaaugaucagagcagccacgcucuguggaaugagaugggccuguuagaagaaggcagggaguaggugugaaggugguggagauucugcugaacgugcaguuggcucugggucaguuuccaggaagcuguagccuggggcuucgguagagcagggcgggugcuuggauccugcuggcacagccagauuuugcaagcuauugagacacacccuccgggcacacuucugaacagaccugccuaggcgccuggaaggaacugcgggcacaggagccguccucagccaggcaggaggcagcuucugggcuauucuggggagcugggguuaaaagcugccuuggagucacacagacugggaucaagugcugguuuugccucuugcuggugggaggaucuaggcaaagcaggugacauugaugagcuuugagacucauuuguaaaacauuggucacaguaaggcuaccugcacagcugcaggggagguucugggcuuggccugggcaccugccagagucacccccaccgcugccuguuguucugugggucgaggcccugccucuggaugggaggccacgcgguggccucggguuuuuuuuuuuuuuuuuuuuuuuuuuuugagacggagucucgcuccgucgcccaggcuggagugcaguggcacgaucucggcucacugcaagcucugccucccggguucacgccauucuccugccucagccucucgaguagcugggacuacaggcgcccgccaccacacccagcuaauuuuuuuuguauuuuuaguagagaugggguuucacuguguuagccaggauggucucgaucuccugaccuugugauccgcccgccucggccucccacagugcugggauugcaggcgugagccaccgcgcccggccucaggguuuuaauguuugucaugcagucucuuuuuugugcugugucaaaucuuuguaauuucuaguguguucuguuguaaagauucaggaaaaagcuuuauuuuaucuuuaaaaaauuaggauccuaaaacaaauagugcuucauugauauucuaacugagcaggaaaagcuguuuucccaaaagcagauguaugugaagagucccuuaccccagggaagcacuagaaauccguguucagggcuggguuugcauccuggcuccacuguuucccaggggugagaucuucggugaguugucugaccgcuccgagacucaguuuccccaucuguaaaaugacaauaauaguacccgccgcaguuuugugugugugggaggcaccgugagaauuaauccaugaaaaaugccuaugaguggccgacagcaaacaugccagaguuuaccuccuuuaucagcaaaggaugaagguaacgugugguuuucaaaaggaaauggcucuugaauggaggaggcuguuuuccuacccuggcuuguucuuccagggaaccgugcaggucucacucugcagcuggcgccuggcaggcuucuggucgaacgguaagucacagauagguuccgaauucuguguuccuggugagccauuuuuuccugucguggaauucgauuugagccagaguggcugccaggaacgagagguuuuuauugaccacaaguuguuaauggucuggaggagguguuuuccuagccccagaguuuccuggcuguuagcugugcucacguuggaaaauuggaccugucuuucuuaaugaaguccagcaggaucagcgaugccuucagcugccccaagcaucuuuucuuuuuuuuuuuucccuuaacagugugaggaggaaguucggugaguuggccucagagucccagccaccuuuugucucauugcaaguggaagagaauuucuauuucuuuugaaguaaaagugauuuaucucugcuuuccagcgggcucugcauaacgacaccucccaucucagucgcuuggcugcucuagaaggcucuaaaaaugaggggcuggcacuguugagacauauuccuccagcagccccaaucuuccccuggaaggacaacuuccgcucauucaaagccaaucuguucuguguuuagaguuauacugaacaaggauucaccaaacucuaagagaguucguuuaaacagggacuggggguuuuuccuggggugucuguggccccacagaggcccccuuuguccaaagugaugcgcccuugagggacagagggagauagagacucucagggccaagacacaugugucuccugcagugcaaggccagggcuaacggcuggugcugugcccgcagccucccuggguauagacgcggagccugaguguguggcuuuggccgugucagcagcccccugcgccugcagaccaggcccucacugccucccagccccugagucugguucuaguggggcagccuugccaugcaggggaggugggacacugcugucccucacagagccacguacggaggaagugaugggcauggagggcauucugccggcagguccccccagccuuggacuuccuucccugcuggugacuuggagccccguguccucaucuguaaaauggggcgauagggccaacgcugucggauuuuggguuggugagaucaaaucuguguuagaugugaguaccuccaagggccgcagggaaccaccuuguccugggucuuuggcggugagagcugcucucuggcccauugucaguggucaucugccagugacaaugggccagagguggcccaucguccacaguggcacugucaugagcugucccuuuucucagcuuuucuggacuccccuuaugaauuagaugcugugaguccugccauaaagaugagaccccugggccuucaggaggauggagccgcugagagguccauggggaaagaacuggcugagggucccgccagccccagcuagggcgagugcuccggggcgccuccugcccguaccugcaccugccaucacagcagccccucagcaagguuuggguucgcaggccccuguccuccuccccuggcagagugccccuguggagcuggcaggagaucccccuggcaugggcugugucuccuaggauggggugggauggccaagcccucucaugcugccuguucccagggcgaguaugccggagcugccugggacauuguccugggaaguucucaucccaagucuugucccuucuggaugugccggugcccuggggccagcacuggugucagaggaggacucagggcauugcucccuaagccccagguuuccagaggugcugggcaggcccaggaccaccgugcaggaaggggaaggcagaggggcugggcuccccccagugcaggaaggucuuuuuauccagggcauagucaggaacgagcuuuguguuuucagaaacauggccucaguggccagggugagcauggggcauccugcagaagguggggaugugugaguuaucuucacaggcaaggagaaggcggaugggagagcagccagggcccacccccacugugcccuggaagaagagagucuugcugccacuucauagcuugggaagccagcaccagggagguugagucacuugccuaaggucacucagcaacaugacagcagauugggaccucggaaaucaugacacaacuguccccagccuggaagggaucccggggaccaguggcaggagacuggacucaggcuggccugacagcacugugggcccccgccuggcauucuguucuccuagcccuccccgcacaggcccugaggacccuggaguccccuggcccauggggucugugaaacucuggaaccuuccaggaagagccagcauaagcuguuagcaagggcagagggcccaagagugucccucccgugugugacaggugaccuggacccgccuagccccugucccagcaccuuccccagccuguggcgggcagcacggggcuaccuggcugcugauccggagggcuccaugcaccucucuagagucucaccucaucuaugggcccugagcuggcccagugagccacgucagggaggcugggaggcgggacuaagagggggccuggggugccucugccuugaggccugccguggaaggccccuccucugugggugagcuaugaccaggaggggggccguggaggggaugagaacugccccgggggacagccggccagcgaguucugggccaggagccaaaugugcuuuuaagcuguugaagguuucaaggggcaacaagaccaaacagacuauaaacuccagcucucccugcaaaaccccugggugcuggcgggaaagugauggcgucggcuccaagcucuaacgguccuccaucugucugccuucauuucagccuuugaaaaacaccgagcgguuuaccuaaucccugauucccuuuuuccaggggccuggcuuuuccacugacauguucuuucuggaauuucacucuccccggggcaggaguggggccugugcugagugggccuuucucagccauccacggaggcacccugggauuccugugagugggaacagaggagcccugggauuccugugagugggaacgucccccagggcgucaggcccuucaguguuagggccucgaaggggagagcaagggcuuuguuagaggcccagguccacguuugcuguaacuucccaggcuggggccuuuggagccucuggauccuuccagaacuaccuuguugcucacuggcuugcugacggcugccugggcugccugugggacacagcagguaggacucaggcuugggucuagggcagcucuggagcccgcagcccaucacugggcagccggggaagccccaggggagggaagcgcaaccgugaagaugagcagacuucccggcacacaggcgggcgagacugggugcugagcugugugcggcuggcggcuccgggacgugaggggauucugcugaggaccuuuccuccuggucgggggagggcugcggagcugggaaaacccaccucgccagaccuucccugggcccugcugcucagccucugcuggaugagcugcguuccccugugagaggacuggggagguguccggggagggagggcuuuccccgccuuggaagcugcccagaggggcacauuuggggggcuggcugggccaacucugacuucggacaugagauggaugugaugugugcaccugggcagggcagggcacuccaccgccucgggcagccccaggcacccugcuaugucgucucugugccuccaucacuggccaggcagcauggauaggccaggugucccucugccagggcuucucggaggcagugugugccugccccucccgaguccuggcccaagucccugcugcugccuggccagugcgccugccauugcggcucagagcaacucccggggugggggcucuggugcaccugcacugacacaggacacugucacccuucuagguccucgguccaagacccgcaucuacccagcccugcugucuccuuagcauccacuggugcuuucuguaggauccaccuccgcugucucaggccaccuguguggcagcccagaccccacccuggcagugcugaggcagccccuggcagcggaacaccagcaggugaagggcagaggccccuugucgugucuucagcucugccugcuuugcugagaccuccucuugccccuggaagggacaaggacauugcacucugcaugaucuccugggacugcugcaaccaacugucacagcccgguggcaaacagcagagauuuauccucucccagcucugggccagaauuccaagaucgaggugugggcggggccgugcucccucugaagcuuccagcgggggacucugccugccgcuuccagccccggguggccccagacacuccuuggcuuguggccacgucgccccagcuucugccuccgucuuuacacagccucucucuucccccugugucucucugugugacccacaaggacauuugucguuggauuuagggcccauccuaaucuaggauguucccauuuccagauccuucauuccaucugcagugaucuuauuucuggacaaggucaccuguggaucuagauucugggaguuccgaccuggacccaucccucggggccaugauucagccacuucccuacaccagcguggaaaagggguuuuucgucucuuaaauugccacagagcacgugugcuuaaaagugagccucugggcaugcauauuuggggccucuagcugaggcuucggggugggcugcugagcugugccuggcugaggaggggugggggggcuacuccuggcuagcaggcgguuggccaagccccgugggcaucucccuggugcaguaggcagcugccuggcuggcuggagccagugugcaguguggcauuggggugcaguuugguaucggggugcauucucauuugcaguucuggucuagggaggccugaguggugagcgagugaggccuggacuccuuccugcugcagguggcuggugacccgccugguaggugccagugacccugcuggugaucuguguggcacccagcaaggagggguccagagaccccacaggguugggcagggccugccucuucccaugugcuguggggccuggccccuccugcugccuggcccgagguuugggcuucagguuuguuccauggaaaaugugagccacagacccaucucccagcccagacaggaaugaugucaucuugggagccggccuuauccaaagauaucuugcugggcugacggcggauguucugauccacaguucccagaagauggcacugagggucucugggaagggacgcaugaugcuggagggucucuggaggggagugcccagggcaggcagggcugcgguggagggggagcaaaggggcagggcguccccugugggaggguccaguggcugggggagccgcccaccugagcggaggagcugcccucacacggcugacgggcgagggggcccacgaacgugauguccuucuuuagcaccguggccaagggggcaucugagggagccgcagucaagccccagcccuccgcccauccuucccauggcuuugagccagccugaaccucaguuuccucagcuggaaaguggggauguuaggcuuguggugcggaugaaaggaggcaaagccggugcggcccgccccgugcucacucagcgugguggcaggugcgccgcugugugcuggcaggcucuccugcccgcgcgagacgguggcuguugugaugaugaugaugguagucauagugauugugcaguauuuucauagcaucgccgucagugccguuaacccugucucauugaaaggggugugaagggucuacaagcucagugggcagguaggggagccaggaccuaagccugcuccccaucgagacgccccgucuguugggugcaguggugggggaggggccccguuuagugcaguggugggggaggagccccauuuguugggugcagugguggggcaggggccccauuuguugggugcaguggugggggggccccauuuguugggugcaguggugggggggcccauuuguugggugcaguggugggggaggggccccauuuguugggugcaguggugggggaggagcccccgucuguugggugcagugguggggaaggggccccauuuagugcaguggugggggaggagcccuauuuguugggugcaguggugggggaggggccccaucuguggggugcaguggugggggaggggccccgucuguugggugcaguggugggggaggggaccccaucuguugggugcaguggugggggaggggccccauuuagugcaguggugggggaggagcccuauuuguugggugcaguggugggggaggggccccgucuguugggugcaguggugggggaggggccccgucuguugggugcaguggugggggaggggccccguuuguugggugcagugguggagaggcccguuuguugggugcaguggugggggaggggaccacuugggggggcagccacaugggaagccgggaagggagcucccacagcuggucucugucuuccacagcuggccuccgccucugggcaugaauuguucggucggugguuuggugccuggaagaagccccugugggccugcagagucagcucggaggccagguuggcucuguuucucccccgucuaagggaggcugccuggcucuuccccagacccaagcagacgguccagguggucaggccggugacaccccacuugcagggccugggugcugucguauagaccgugcgccugggguguggggcugugucuugccagccaggugugcuaaugagugagucuugaucccagagcacauggaaaaucugucucagaaucacuuuucugccagcacccuccagucuguuugaagauccagcaguugggaagggcugcucuguucuaccacugcaccccauggugcccaagcacuaggcuggauggggcacugggggcuggugcaguggccaccgcuuguucagaaaacccaaggcuccgagauggagguaaagccagagagguaaagccaccugcccacagucacacagcugggaacagucagggcaggacuucagcccaggccuggaucuuucuggguuaagaguucccauacuuaggugaagaggggcacggcuuggggucccggauaggaggcuucugccuggguccugucuccuuauucucaugaccccuucuugcaucuccugauccaaauccccgcucuucagucacaucuccuguguccccuuucagcgucucguucuccagccccauagagccacugccuggcccuccccgcaaguggauggcgcugggccugagucucacacccuggacuccugggccugucugugagugccugacaggaagugaacccccuuuacccuggcccccuuccuguccccacuccuucccccuccuuccugucccccuccuuccuuccccccuucuuccugcccccuucuuccuuccucccuccuuccuguaccccuccuuccugccuuccuucuuccuaucccccuuccuuccuucccccuccuuccuguucccccucuuuccuguccuccuccuuccugcccaucuucuuccuuuccccccuccuuccugcccccuucuuccuuuccccccuccuuccugcccccuucuucuuaucccccuucuuccuuccuccccccuccuuccugacucucuucuuccuguuccccuccuucccccuucuuccuguccccccuccuuccugucccccucccuccugccccucuucuuccuguccccuccuuccuucuucccuccuuccugucucucguuaucccugucccuguuccuuccuucccuacuccuuccuguucccccuccuucuuauucucccuccuucuugucccccuccuuccuauuuccccuccugccuucccuccuccuuccugucccccuuucuuccugcuccucuccuucuugucccccguccuuccugagcccccuuucuguccccccuccuuucugccucacuucuuccuguugccccuccuccccucccccuuccuuccuguucccccuccuuccuguucccccuccuuccuuaccccuuccuucugcccuccuccauccugccccuggcuuuucugcuucccuuucuucuugcccccaucuuuccugccccuuucuggcccuagacccuggugcuucucauguucaacccugaguugcugcuuuuuguucaaauggccccacccuguucucugcugggguuuccuugaccacggggaccaggucuccccuggacgccuuuuuccaggugcccccagcccauacccauccuggcucuguccgcaaaccuguccuccagaagggccugugggugaccaggcugcagccggggacucccagcacuccuggagcccuggacucuccaaaccaggcgugauucccgcugugcuccacggccucucuccagagcccuggcugccugccguccaugccucugggaggcuguguguuuggaaauacuuuuuggagcugagaagugcagguuuuccugcgagcuagccacguggccucacccugcccuucuccuguccgauagugaguuuuacccuagaggcaguuugagccacgccacguggucuucuuagcaggaugccugagcccuaccccacuggcuucaugcugucagggaggcugggucacaggcccauuuacucacugcagggugugaugguggggagcauguggagcagccuggcuccuaacauaaccccagagcgcuccucccucccagucugcagccacagcagggcugugugcgcuccacagagaagugagggucuuccugacgaugguugauuugcagagacacccgggaguugcaucugucacugucccaucacagguaaagccaccuuacucuauugguugacagaaugaagacucagaagaucuuucaagcugggacuauguucucgaacugagaaaaugaaauucaaucaggauaaacgugagcuucugcacuuggguucaaaacaaucaauuguacaagcgcagggccaggagaagcggcagugaaguguuuuauaugaaaaaaacuuagggguuugugggugucaaacccauuaacgaucaucagugugguguggcggccacaggaaugcacgcugucacagguggcguuagggacagagggcagggugaucucaggucuggaaacugugcugaacagaagcugaauagaaagaacuggggucugaacccgggacagagaagguggguggaguggagaguggguggccccaguguggggucuuguccagaggagaggggaugagaccacagcagacugagaccagugaugggaugugaaccuuguagcagccaccuucuccuccuccaggcccagcucugagcaaccuucuccgugacgcucuccuugaccucccaggcaaagucuguugcuucugugcugccucccaagucuucucccuugagacuuacagucagagacccagauuuuuuucaucuuuaugucccuaagacuuaucagagagaugcaaaaaauacugguugaaugaacaaaagaaugaacaaucagagcugguugccuuccugcaggccuucaugcuacagaggcauguucgggaaaggcuggugagccuuucucagggauccaggacuguugaugauggugguggugguggcggaggagguggugguagugaugauggucauaaugaugcugaugguggugauauuaauggugaguaugaugaugaugauaacagugguguggugguaauggucaugaugguagugauggugguggugguaguggugguggugaaggugauggugauguuuauggugguggauaugcugaugauggugauggugguugugauggugugaugcuggugaagguggugguggagguuaagguggugaagguggugaugcugaugaagguggugguggaggugaugugguggugauagugauuuuggugaagguggugguggaggugauugugauggugugaugcugaugaagguggugguggaggugaugguggugguggugguggaggcgaugauagugguggugguggugaugcuggugaaggugguaguggaggugaugguagugguggugaugcugguggagguggugauggaggugauugugauggugugaugcuggugaagguggugguggaggugauuguggugguggugguggugguggaggcgaugaugguggugguggugaugcuggugaaggugguaguggaggugaugguagugguggugaugcuggugaagguggugguggaggugauugugguggugauggugauucuugaaggguggccugccccaccacaccuguggguguuucucguugggugggacgagagacugagaaaagaaagagacacagagacaaaguauagagaaagaaaaaugggcccaggggaccagcgcucagcauacggaggaccccugccagcaccagucucugaguucccucaguauuuauugaucauuaucucuaccaucucagagagggggauguggcaggacaauaggguaauaguggggagagggucagcaggaaaacgugaacaaaugucucuguaucauaaguuuagaaaaggugcugugcuuugaugugcacauacauaaacguaucuggugcauuaaagagcaguaugccgccagcaugucucaccuccagcccuaaggcgguuuuccucuaucucaguagaugggauauacaauccgguuuuacaccaagacauucuauugcccagggacgagcaggagacagaugccuuccucuuaucucaacugcaaagaggccuuccucuuuuacuaauccuccucagcacagacccuucaugggugucagucugggggauggucaagucuuucccuuccuaugaggccauauuucagacuaucacacggggaggaacuuuggacaauaccuggccuuccuaggcagagguccccgcggccuucugcaguguuuugugucccuagguacuugagauuaaggaguggugaugacuuuuaacaagcaugaugcugccuucaagcauuuguuuaacaaagcacauccugcauagcccuaaauccauuaaaccuugagucgacacagcacaugucucugcgaccacaggguuagagguaagguuacagauuaacagcaucucaagucagaagaauuuuucuuaguacagaacaaaguggagucucuuaugucuacuucuuucuacauagacacagcaacagucugaucucucuuucuuuuccccacaauucuggugaagguggugauggaggugaugauaguggugguggugaugcuggugaugguagugaugaagaugauggugaugcuggugguggugguggugguggugguggugaugauguuaguaguguguugguucuaugguuuuggugcugguagcacugcuggugguggucaugaugcuagcaguguggugguucugugguuuuggugcuggugguggcuguggaggcugugcuaguggaugcugauugcucuggggaguguucuggugcaaucccauuuaguccucugcucuaugagguagaucuuauuauccucuuuuaucaacagauggaggccuggaguaauuagucauacgcugacauccucacagaugacaagggagggacccggugcccaggccuccuguggucagugccuucccugugccauucuucucgggcagugcugccaagggucagguggcuuccuucuggggagccuggaccgagugaacauccccugugcucagcgaugccccgugugccauaaaacagugucugcaggcccgcugcuccgaaagucaagauguggagaaggagcagcucaagcgugcacugcccaagccacaagugcaggccuuugugaggucaccacccuuuggguggcgagucuuugaggaggugaacccccacccuuuggagagagcaagucuuugaggagguggaccugccccccagccccugccauuggugcugccauuucgucccuuggucuagagaugaggcccccucuccgaguuugcugagcugacccuucagucccuguggccagcuucagggugugcaugaggcugugaccugaucaugccccuucucugcacccaugcggcccacccccauguuggagacacagaugugucauuuugcagccuugcacccagagcuguugugaguagacuugacccuacacgucuugggcugguggcugcaggugagaauuggacugggacuggaggcagcgagcgaggacauggcggggacagcagaaagcaauuuccgacgacaugaaaauauuucucugacacucucguuaauagugugaaacucguucucacaggugcugugaaaaccauggaaaaaauuauuuagaccucacuggcuugggggcauuuuguuuuuccauuuuguaugacucacggaugaagaacaucaaagcgagauuguaaaugugacuggucuggccccuggcagcuggaauggggggaucugguggucuccuacgugcgcagcgcuaaggacgucaaggaagugccucguggagaaggggcaccgguggcguccggccaggcugcucuggcagugucugucagaauccgccgggcccagcgggagggaagccccgugcaagagacugcugaugauggcacuguacuugcggggaacgcagucguguucuuagcuccuguuugcagagcccagggccagacuccacccucccagcagccucuggggccagcguuguuccauccccagcuucagaaggggaaagaaugguuuaacgugguuugcgaacacaccugagaucacucagccagcaaggggcaggauucagaugugggcccaggugaacccagcuccagacccuagcgcugcccguggcucucccggccuccgucccucccagucagcguguuaacucagcugggcugcguuuuguaugggagguuggacaacgugcccgccugccaggacaggggagguuuguggcagggccuggcaguggcagaacaaucucucauggacaacaugcuugccgaccgcuucucccacagccucgaacaagaaggguuugucuuaaauaguuauuugugucucucuguuuaccagcacgaagugcucuggcuaaaauuagaugauaaagucugugggacaagcagagugcucagcugggauuccuguggacccuguuucgguuggacgaggagggggccugggugccaggcagucaugggggggcuggcucaacccagggaugggggaugggguugaaaggaggagugcaugauuaaauggcagaggaggcacugagcaugcgauuagagggagcagcagcaugagaagcagccugggcuggggggccgcggccacgggagccucuaauuuggugagguccauguuucccgucuccauggcuccaggcuuauggggcucuccaaugaaaacuuugcaguuuccucagcucacaacagagacgcagccuggauacggucucauuagcagaaaaggcagaacugauucucucagcaaaaugcucccaucucugccagagccaaggacaacaugcucccgccguggccgccgacccaucuuccgucgaacguggccgccaacugugccgugggcaggggcucugcagcagagcggaauggccguaaugacccuggccugguggcggaaacuuccagggcacuuuaaugaccuggcagggggcagaauccaggaauguaaagggggaaaauggucaguuaucagagcgagggauggcaugaaaacagcugccaccugcuucuuugggcagccacagggccagcugucuggagccgcuggugcugggucuuggcuuuuaaaguugagcagagugguucaggggcucagcccgggaagccaagacguggaacaggagaagccugaaucugccaggcgaauugggcaggugccugccccugcuccuagggcugugugggugaugggacaaaguuuugggaacugggagcccacggccguucugugugcaggaugugugacuuggcacgauguccuugacuccaaggugggcagcucugggguggggacugugggggcugcaggcagagacucaggagccccagucagcccuccucccauauggccugcgagaguggcgcugccucucagacccuccauugcugcaucugugaaauggggaugggagaguggaaaggagaccuugccuuccuccugggggggcugcaagaaugggaguagggccagaccuguaaggaaagucucuuuugccgaggcgugagguagggcugggaauugggucagugugaaacaccagggucuuucccgaagcaugccgggcacaggcggugcacgcugaggauaucugacaugucaacacaaccugucacguuggagcggggaaguggggugggcuuaggacaagcagccucaaagaacugugggcuguuguugagggaggggacugagucccaggcaccucggggccaucuccagugcugugccaggacccaugugugccacacacaugcauaccuguucacauaugcacacaaggcaugccauaccauauacauaugcauaaaagugugugcaugcacccaugucacacauacacaugcauguauacugugcacacgacguaggcauguaugucacgcacacacaccgcacaugugaaugcaaaacauaugugcacaguacacauauggccuccugcacccaugugcacaccugcaucaacacgguaccggacacaugcacgcacacguauguaugcacacacacagugacacaacacaccagccaaccccagauccuggcgcuuggccugcaagcgggccaugggccuacaagugugggguugcuggcugggcuucccugcguccaguggguguuuggcccugcaggagggcuggaaaacagcacgaagaggacagcagcaagggagacccagcacuucacacacucaucucauggccagggcaggacaggggcagggcggcacaucaugcuccauauccuggguggugaucggccucugccuuuccagggcaagggggcggcucaggaaguaggcggcugccaucguugguaagaggacggaggauggggagaaagcaaugaaggguggagaaggggcgugucugaagaaggucggaggugacaccuauugcccugcucagggauuggaugugugccaugaaaccuggcaguuagaugugacaucagaggagagccacaggccacugcugggcagggcaucagguugguuccuugcgcuugugugccaggggcucugauagcaccugggagggggacuguggggaccaugggccuuucugaggucguggucaggcugcuuggagguucuuggggucaaaguccacccgucugagagggcagcugcagcuaagaaauuccuggggugccucagugccucaggaagggucagggcacggcccacugggcaauucugaccuacagccggccucuuagagacccaggguuggguccuggaaggcugcaggcugaggucucucugggguuucuuuggcugugcgugcgcguugugacccagccccaagcuccagcuuccuguccccauccccugaaaagccacgagcucacccaagcccaagcaggggcugcccaccagccccuggcccuuuguuuccaggccgccagcaccucccgccggccagugccgggcaaggcuccaccaggagaggaggcuucaucgaccaauuuuccuggucuguaguuuggagcuugguuucauaucacaggaugcacugugaaaaugcucucagcauacaacaugaagucgugauccuagcuuuguauuugaaagacagugugcgccagauuauggcggucgggcugggcauguccucuccagcacacuggggaguggcugccggaagcccuggguugagaaggauucugagggcaccagggcagaguucugccuagggcuuucgugagcuucgggcagagcuguguguuugguccacacagccuggagggggucaggggaggcugagauuuccugugaugaaauggggagacuguggcucccaggggcugguugccuggcugguagguggcugggcuggacgucuccacaugcugaccuggcuuccagagaggagccgacucugagugaauguuccagaaggaggagugcaggcucaggaacugccaggguaccacugacagaaggaggggcguccccgcauccacagcugccuucaaggucugugaggggcggcuccaggccuggcugcaucuuagaaucucaugagcaguuauggcuccugaaucccaguccccgccagacccaccacauggagucucuggggaucccaggguuccgcgggugucaccugcuggguaggacacaguguguggcugcgcgugagucagggaagaugccucucucacccuggacccaucacaucuuucaucagucuagugauggacacaggucucagggaugcaggaggacuucaguguggcccucacugucuccauccaggaccccccaugauaacccucuagagcccccucaacuguccccauccagggcugucagaugucccccccaugggacccccauccagggcugcccaggcucccccauaguaccccaucuaggaccacccuguaaccuccccauaguacccauacagggcugcccaggaccccccaugaccccguuagggcuguucugugccucucgucaccccauggcaccccaugacuguguuuggaucccaucacuaucucgucucugcucugaacacuggacuagccaccaacccacagccccgagggcagagcuggaagucccaugcaccugggccucuggacucgcaggaaucagguggccccagggguggcccagggcagaggcaggugucucacuggaguccugcgggguggguuacagccuuucccucugcuucagcuccuccuccgcccaguccuugugggggugcagacaucacagagcccucuucucagcccugccuggaagguggcacagaaggagcgcuagcucgugcagccauggggcuggcccgugggagguugcugggcuucaggggaggcauccgcucugucuuggagccuggagcagaucccucacuacggccccaucugccugggguccugcagagaagcuccuccucaacagccuugcugggcacccagguguucaggguccccucccucaccugcauguguagggaagaagcagugggugggcuggaaagagcccugggccaggauccaggucuagagcgacccugcuucugcagcacucugagccugagccuuagcaccugcgccucgguuucuccuucuccacgggggugguguagggccuggcagacccuugcccuuuggcaguggugcccgcagaacacaccggcucuuucuagugugaaaauccaccugaggauuugguggggaaaugauucgaacgaagcacgugcauuugcagaggaggggguucucgaagugaagggaccucaugcccaguccuacuauugucuguucacugcugcagucuggggguguggugggcaggccacaaagcagggcuggcugagggccaggucagccugggaucagagcgccgggcaccuggggacaccucaggcuuugucccgcuucguggguguucguuaccuagccuugggcccugauggucgugcaggugugccugggugcugugugcccacaagcacugagaccagugccagcaccuuaugcagggccugcaagguauggccgcugugcuggacacccugggguacgggguugugccggacacgcccaugauccaaggagcuuggggcuuccggggaagcagagcuggauccaggggugcaucagggcccaggaccacagcugccccugaaggccccugaggcuucucuuccuucuuugaagugccuuuggagaacauauauucagaugucaaauugccaguugaaaggagaacauauuuuauuugaauuggaugaaaugugauccagaagucauguugcuuaauaaaagugugugguuuugauucacuguuccuccuugucugcuggagaauuugaaacaugggccaggagccucugacauccaaagaugggggagagagagaaggagaaagagggagagggaggugaggcaggugggcagcucugcuggccucagcggguggagaguggggcaucccguuugaggguuggugucggggagggaaggugugaaaugcugagggcugcgcuaaucagggccccacucuugcuuccuccucaaaaugcccccaguuuacugugauggggucucaggggcagggggcagcagcagguagcuguccucggucacuccccguccccgugcucugucccuuugugggucacagcccccgaggugaagucuggaaggagaggaaccugucacccagugcccuccucagcccagcagaugccccagcccagggaacaggugcaagcucagcucccgacgaccgccaacccucagcugcuuccugcaccgcuguccugaggcaccacuguccugaggcacccugcggagaggaaggacccggguuggagggggcucggcggugcuguccaugauguggggugaugcgggggguucagucccugaaacuucagaugaggcaguagguacguggcggccagggacgccccaugcucugggccugaugccugcagggagagcacccgucucugugcugcuccaucuguucugagauguggagacaggggaggcagggcugggucagcuagugucaggggccccgcugcacacauaggcuccagguccuggccacugcuucuguggcucugcaguugggaccagugaugucuccugucccagccucuucuaucuguuaaauggaggugacagaaauuucccuugugaguccugaguccugcaagggaacgggugcuggcgugcacccaggcaccggacggaccccugaacccuggcugcacccuucuggauggggcgaggcaggggcaggugggcagaagggcuguggccaggcuauggcacaguagugccgagaaagguggguccgucugccucugacccagaggcagguauggauguggauguguggcugaagucaggagcaggaacuuaccaccuggcagagcugcugccuggaauguugggugggcuuggggaggguucugagcuccucgcucaucauuugagguuuuuaaacacaaguuggggucacccacgauaaccacagacacauaccccacucucuuccccuuuuuggugcugagagccguuuccuguugagccccgagguccuccccucggccccugccucgcaccacucccuccccucucaggagcacuguccuggcugcuguggccucuucccugccacccucucacaccugcuguugggcccccacccuguguccugcaucagcccccugcugacccccaguuccuccaaaccuacugccugcugagggcuuuuccugagcacaugccuucccccauugaccucaaaaucuuuugcauuacuuauugagugccuucugcauacaaggaguuuugccuggaggacucuacagcucugugaggucaaugcugccguuuuaugcuaauuuuuucagagagaaagcagggagcagagaggugugugugaacaggcucaucccaggccacacagccaggcaacggcuggagcuggcaugugggccgggccuguccggcagcacagagcuuacugcuuuuccaagugugccugcgggcugggauucccuccgccccgcccgugugcgcagugguugugaugcucccacccgcuccauccaagucucagugccugucuugcuguggccagacccucgcaccaaaagucuucguggaagagagcagcccucggaacaaugaugggugugcgcacagagcucacagcugugaaugucucccagcccuucccagaacacuggcacccugggagugagggugacucgccagggucagaaguacacagcgcaaagccacgucacagccaccgcggcugcaggccagagucuucaaggcggagacaaagcugucacuagacuccuccuggcccagagaggggccucggcgggggagguggugccucugcuuggauggagugaagguuccgaugaaccaggcucaggugaaccaggcucgggugaaccaggcucgggugaaccaggcucggaugaaccguggagaacuugccauccuccagaugggguugggcacccugacccugcagcccgcuggcuacuguggcucuggaaaagugugcagaugugaugcaggguggcaagaugagcuccagacccagagcacucagcaccuggcccugccccaaguccccuugccugcggcaccgucucugguggcgggaccggagacgccaccgucuccaggaccggagcaccuggacaugguccuccaaguucuuuucccucccuugagugugguggggcguguagugguuggcaucuugcaggcugccuugggcugauccugccccagcugcugggggacccuggacaggugaccucacagguccucgguuuccucuguuguagaguggggauuagucggacacaauucauaggguucuugagggcacagagagaccaggugcaggcucuuuaccuuguacuugaucugugguaaacaugaucuaauucgucaucacugucauuacuauaaucauuacuauauuggucggcuucuaugcaucugauuauggucaaaagauccucugcuuuggaacacccagggugcugccagggugacuccuagcgugccugucaucuucaucucugcagauagcguuuaugagaccugcauuucuuauuccuacuagcagcccuuuuauuucuccuguguacacauuguggugagagaauaauggaauaaauuguuuacacaucaugguuagaggaagaaggaauaagugcuugcaugcuuuucccggcugacacaguuagaguguaggcugcucacaaugaauccgaaaguucaguuguuagcaguguggguucauccgccuuguaguguggggcaguacuuccuucccuuuugugguugaaugauauuccauucuaugcauauaccacacucuguuuauccauuuagcugucgguagacauguggguugcauuuaucuuuuggccauugugacuaaugcuacuaugaacacuuguauacauuuauuuguuugagucccuguuuuguuuggagggugaacugauuugggugaauuguuuaugcaucuguuucaguuccggagauuggaauuacuggucauaugguaauucuaguuuuaacuuuuugagaaaccagacaucaccucuuuaaaaauacucucuuccccagugguugagggguaauggcaaaggaggcaggguaccuccaagcccucggggucuagggcgggugagagugcaggcuguuucucacaacaggcaaaagcugccagcacugcacuggcaucuggcaggugcucaacaggugucugguaaauggaugagugaaugggugguggauugauggguggguggguagauggguggauagacagaugaauggauggguggauggguggaaggaugaguagagggacggagagauggauggaaggauguauguaucuggauggauagauagauggaugaauuaaugagcagauagauggcuggguggauggauggacagguggauagguagauggaugaauggaugaguggauggaugggugaauggguugaaggaugaguggauagauggauagauggauagaaggauguguaugugcagauggauggaugcauggauggauaagugaaugaguggacagacggauggaggaguggauggauagaggguuuaauggauggauggacagaugaaugggugaauggauggguagauggauggauggguggaugggagaauggauggaugggugaauggauggaaggacugguagauguagauggauagguggacagaugggugaauggaugaaugaaagaguggauggauggauggauggauggguagauggauggaagcauguauauaugcagauggauugauggaugagugaaugaguggacagauggaaggauggauagaugguuuauggauggauggauaggugaaugggugaauggauggauagauggauggauggguggaugggugaaugggugggugaauggauggaaggacugguagauguagauggauagguggauagaugggugaauggaugaacgaaugaguggauggauggauggauggauggauggguagauggaugagugaacggauggauggauggauggauggauggauggaugggccagccuagcuugagugucuuuugugaguggcagcuucuagggagaauguuuggcucugaggacaagcucgucuuguggcuuggucuggacuuuccccugcuucaaggcauggggcugugucucccagguccccaugcgagugcucugugagcugcuuuuucaugagcgucucuucuuuuccagggugacauccagcagcugcucuuugucucggaccaccgggcagcuuaugauuacugugagcacuacagcccugacugugacaccgcaguaccugacaccccacagucgcaggaccccaauccagaugaauaugugaguuaacucuggcugggaucuuggggagcaugagcagacuacuugggaugguuggugaagagacacauaagccaugggacccuuauuuuaaauaaauccacugggugagaauuuggagggaccuaggagguaaacauugggauaucugacucacuuuacuaaauagcacugcccagaaugauagggucacagaguuugucaucaauaacccucuccuuuaaccuuuugaacaagcuccuugauggugaaugcccagugcucucucacgcuugggcuugaccuugaugggguauuugugagcacagaugccacaggugucccccauggacucgauccacuggaggggccaugugcagcucgccaaagaggacggagccugggcuugucuacuguagaauggccagcccucggaucccuugaguguaaaguguacuguagaguggcagccgugccugacaccuuugucccucuuccugggacccgccauguccaugggucagcuguccucccccucccgcugcacacccucgcggcacugcaguuuuucuuauuugcaguucuuccuaucaccucugcaugaaaaugcucucccacucccugggcccacugccucucauuucucauccguaauauuaaauccuguuuauuucuccuugggucuuccuucuuucaccaccagucaggaaagaaggaaggguagcuuucaggaagcugugggaccccguggcccaggccacaucuuacaaaccccaggaggggcaggacagagcucccagccgagucccugcugccccggccuccugccaggcuccucccagcuccuggugugggaaugggcucaggacaaggccuacucugucccacugaagcccuacccguggggucccugggcuuugaggcuuggggcugaaggcccgggagccugcuggagacauggugacggcugcacagacugccauucuguugguuguucuggccuggguuccaaagggccagaagccuucaccuuugagggcucaucuuucucugacugcucgaggggaccugguguucccccugcuuucucucuugugcuucugaugaggcugcgucagcuuuccaaggagcuggagagggaggaaccccauccggggacccacagggagguucacgccuggggcuggacggggcgucguggcgugcagaucuggagguugcggaaggaaggacagcaggcuggucgcucugcgggcuccgcugcuuccucacggggccgcaauucgcuuucaguacacggaaggagacggcgagggugagaccuauuacuacgaauaccccuacuacgaagaccccgaagaccuagggaaggagcccacccccagcaagaagcccguggaagcugccaaagaaaccacagagguccccgaggucugggcugagcgggggacuggguugggcugggccccucgaggccauggugcaggggagggcgaggccaggagagguugugucaggguagaggguugggggcugucuggugaagguugcgggggcagcucagugagggagccggcuguugccauccgagcuuugcugucacggggcguaucgggcuuuccgcagugaggaggacguugggagaugccaaguauacaggggagcaucugccagcaucucugggcccuggccccgguccccacccuguacgaggcacagggcucuagcaggcccaggaugaguuugguucucggguuccuuaagugugggugcagcuguggugggagaggagagaggagagcucaggggcucccccggggggugacgcagucugaggucggccucggguccuccccgcucugggcugucauccccucaccucugaaauuggggaggguugugagggugcgugagcggcagugagagccggagggucacaccuagcagggcccgggccccgugcaggaguguguauggguggguguccuccuggggaggaggcuguccagccucagagccauugucagagguaaagaggguggggugugagcaugggcggugugugugugugcaugaacgagugugugugagcauguggcaugcaggcacgggugugcuugagccugcgugugugugagagugugugugagcgugugugcaugcgggcacgggugugcaugagccugugugugugagcgugugugagcgugugugcaugcgggcacgggugugcaugagccugugugugugagcgugugugagcgugugugcaugcgggcacgggugugcaugagccugugugugugagcgugugugagcgugugugcaugcgggcacgggugugcaugagccugugugugugagcgugugugagcgugugugcaugcgggcacgggugugcaugagccugugugugugagcgugugugagcgugugugcaugcgggcacgggugugcaugagccugugugugugagcguguguguauccuuccagggaaaggugaccuggucaucucacauugcucugagagccuggaguguuuugcuacuuuuguuuuuuaaauacugagauaugauucacccuuuucugguguguaacuggguggguuugaguccauucugagcacgcuuaguaacugggggcuugcagcugggcugccuucuucccacuugcucugcccccaagccccauggaugggggcggccccugcacccaagaggucucugggccucuugacaggccugggcuccaggcguugccacugagaugccugcacccggacaugcggcaagucccagaccuggcaccacugccggccuccgcccugacuccagcugucucuguccuuggcucccaggagcugaccccgacccccacggaagcugcucccaugccugaaaccagugaaggggcugggaaggaagaggacgucggcaucggggacuaugacuacgugcccagugaggacuacuacacgcccucaccguaugaugaccucaccuauggcgagggggaggagaaccccgaccagcccacagacccaggcgcuggggccgaaauucccaccagcaccgccgacaccuccaacuccuccaauguaauuucuuuccuucccauugguuuggucuggggcagugggccaagggccagggcuggggccacaaugcugagcucccuucuuacuccaguucucaccuugguguccucggguggccccuguguuccaccacacccuggcccugggcccuuugcagcuggguggcguaauacuucccaggggaggccauugcugaacaaguuuggaaucccugguuugcugaguucaucucaauguugucaauuuuuugccuggaaaauggguagaaugacccuagcccuuccggucuuugaggauucagguggaaauuggaugaggagggggguggcuuguggacagagucccugccuguggccuggguguggccaggcaggauggggcugggagccaggauccagacaaauacagcgaagcaggagcuggggccgcccuggcugggacgggggcugacugucagcagacaggccugaaagcucugcccgagaccuuggaaaguuagucugcgucucuggaccucgcgguucuccuuuccaacauggcacugacaguuccugucucugggggcugugaaguuuucagauucaggaggagccuugcguaguguguagcacauggccgaugcuuaacauagccacugugugaugcagaaucuccacugccagagaggacaccucguuccagcagguccagaccccugcgucugcagcaccgcccugggaugcauuaucgcaagacccuggggcuguggggugcagccccugccugagcgggugcacgggugugccagcuccauggugugccagcuccgaguugucagaccuggagcccucagaggaggucucucccagaggggggucucugcccaguugaccggguagccauggugccagcacagggccugauggaucugggaucucugcccaguugaccggauagccacagugcccgcccagggccugauggagaggcagugccuggugcguuugcgaggcaacccugcgccuuccucucccucugcagccagcuccgccuccaggggaaggugcggaugacuuggagggggaguucacugaggaaacgauccggaaccuugacgagaacuacuacgaccccuacuacgaccccaccagcuccccgucggagaucgggccgggaaugccggcgaaccaggauaccaucuaugaaggggugagagggugcaggcccccguuccgggugggguuggggggcugguggggcaucaugggggcuccugcccaagagccuccucaggggugggccucuacgggcagcucaaguguuacacccuauucccaaaacuuuauuuuuaaagagaccucggugccucgaauuugcucugaauaacguguguaucggagcauacucuccucugggccuguuucuucguuaguagucacaugggcucccgugggccuggccucugucacgcuccugccauccuccugggccuggggagaugcccagcuacgauagugcccucggccuugcgaaaucgggcagauuuuguguaaucuggacuuucuuucucacuuuucucucugauucucuuuccaucugccuuuuaucacccccagauuggaggaccucggggcgagaaaggccaaaagggagaaccagcgauuaucgagccggugaggacauuuucucauucccucccugcgccgggguguccgcugcucggggucacagcgggguguguagggugugaacagguccgugggccccugcaccugcgcgcacugggucacuucgagcaaccaccuggucucguggaguccacgcaccacuuguccccaggacuugugaagaauccccuuggguaggggauguucuggacugugauggagggggcgggauaggugcugaucaaagccgguccugcacccaagcucugggcaucucagugcuggucaguuucaccugggaugaaaagcagcucagagcuaucgaggcggaggcggaguccccuuugagggguggaggagaggauguaaauggcccauuccguguaaaagaugcgcgcggcagugguagggaauaguuaacacguggucguaccucucugcgucuguuaugcaaccguuuggaguaaguuuacagaagcuguugaaacauggaauacuguuuaugaaacuuuaucaagggaaugaaauaaaacagcacugugcugaaauuccagcugaguaaaacccaacuauguuagguaaugagaucacgggugaguucaaaaaguuacuguugauaaugcccucaagcgugggacuguagcgaggacguucuagaugccccuccugguuggcgcguuuggugggggcccugccccauacugggguguccuugucccauagggggccauggccuggcugggaggccuccaguucucccuggggucucagagccacuaaggucuugaugccccgccccgccgccggcaggcaggaugcccugugaucagcugggcagggaguccugccgcugcauguggugggcacgaccggagagcagggaggagccagcaccaaggcccacccugccauguuguccaagugcccacaggaggaggugugcguccugcaccacggccagucaugaggcugggggcagcuguuuguucugccgccaggacucaguuccugagggcugagcucaggauacaccuugggucucccagaagcccccugaccuugcaguucccagaaugugcagucacagugacccgccacccuacuguagagcuggggacauucucuuggaaccuugacggauggcacuuagcaggccuuuauaccccuggaaucucuuugaagcccguggccagggcagacgggaugugucccaucucugggguggaauucccaggguccagggcuucaccccuuccuggccuauggaagcgucuggauggcucuuguggggcucuaugcccuugcuccaggcccaacccaggggugggaccugccggugccuacagacacauccuuuucucggacccccuuuccagugcucucuggggguccagggaagacagagcuugucugaggcagaagggucaugggcugcagggcaaaggggugcagaggcaugaaaggagacucugaggccaggaucccccugcucagcauuguggaaaaccucagagccaggccugggcucagggaccagagcagcugugggggagagugacugccguccgccugggcggacucacccagaagcagggggcugcgggccuguucugcucugcccaaggguguuugccagaaggugaacaacagcagaggcuacauccaaggucccagccccaagcuacacuuguuauugagaggugggacauccgguugcauuuccccagacuuggcccccagguagacuugagguuggccuugggcuucuuuugugcuguccccauugcuucagugaaaggggguccuugcucggggaggaagaugggaucucagggugggcaggugccccuggcucugcaggaucccaguucgguuuccccuccccgcucugggagggccggacugaaaccuuugaaugagcuucguguuggcucauguucccgaguaagcuggcucugugaguguagacguggugucugggcuccaggaggggguugggaguguggggugggcacagguuuuccacugccaggcacccgggaaggcagcagugggcaagggugggccaaggagagggccgagagucgagguggccccacaggaacaucauggcucuggaaaguccaguucaccuuuguugggaaaagcagcagccguacaggaacaucauggcucuggaaaguccaguucaccuuuguugggaaaagcagcagccgucugggugcaguuaggaaggauucccucccccgggccccagccugcuccaaguguccuggggccuuuggccaggcccccugcagagaucacauaaacaguuggaauuucucaaccuggaacguugccagauauccuuggguccaagcugcacauaaacagauggccagguccuggggcccugcgggcgucccggccuguggaagggggugucuguugucugccccaccugagcucccucuugggagaugcaucuguuccaggggcaugcccaggucuuucccacucagucccgcucccucucauugucagccagaccagaggcucccuaaaaggacaggaauccacggaaccgagaggagacagguucauccuuauccuugugcuuccaggcaggaagcccccagacucaguggcugauuuuaccugggccacauccauuaggggcauccaaaucaccaucuccacuugacacuguuuuuuguuuuuaaaauaugugcuguuuaccagauggguggacccuccauugagauugucuugaguucugccaggucugaggucuuuuauuucuuuuguuaaaauuguaugcauucggccgggugcgguggcucacaccuguaaucccagcacuuugggaggcugaggcaggcagaucaccugaagucaggaguucgagaccauccugaccaccauggcaaaacccugucuuuacuaaaacuacaaaaaaauuaaccaggugugguggugggcacuuguaaucucagcuacucuggaggcugaggcaggagaaucaguugaacccaggaggcggagguugcagugagccaagauugcgccacugcacuccagccuggacagcgugagacuccaucucaaaaaaaaaaaaaaaauugugugcauugaaggugugcagcauguuugauagaguuacccaggcacagacagacacagugaagugauccugcacccaccaccaccaccccauagcugccucuuuuucuucuuuaugguaaaagugccuaaaguguacucuuuuggcaaaugacaucuacagugcaauaucauuaacuauaucgaggcguuuuccucucguuccucuuucgcugggucaauuuugagaguggcguccgugguugggugggccggggcgggagcggggccacagcuugccugggaagguucaggcauccccacccucaggcgcauucauccagcuguucccagcuuccuucagacgcugaccugggaugaucugguguuggcuucccugcaagguccccgcccgcguugccccaguucccugagaaaagcaauuugcgugucugggaaggcagcugcugucccuggccccuugauggccagugguuucucccuuaaucccagcucagcccugggcuuucucagcugccuuugucagagacggaaauuggaaaacuggcaucuuggaggcugcuuggaugagcucucuguguacagcacacacacgggugucucucugagugugcaucuguguaaacacagugcagagcuccccagcuggggcaggaugggagggguggggagaucgguguuccccccaaccgggaguccccucaucagccugguacccagcaccucuggugacagccucugguggccuguggccuggcuggacaucugcggcccccccagccgggaguccccuugccagccuggcaccuagcaccucuggugacagccuccgguggccugugaacuggcuggacaucugcagcccccuggccgggaguccccucaccagccugguacccagcaccucuggcagcagccuccgguggccuguggccuguggccuggcuggacacaaccuuugacuugucagaagugagcuuaguucauugugagcugcuguuacagcacaccacagucagggugauuuagaaugaacaggacuucauuggcccacaguucuggaggucaggaagucacauauagagggaccacaucuggcgagggccuucuugcuguguccucacauagcggaaggcaucgcauggugagaaggagcgggagagaaggugacugcugccauccugucaucaagagcccacucccacccuaacgagcccgcucccaucguagcugcauucacccauccaggaaggcagagccuggugaccuaaucaccuccugaagaucccaccucucaacacgguugcauugaggauucaguuuccaacacaugacuuuuggggagacacauucaaacccuagcacauucugucccagcccccaaauucauguccuucucacauacaguuuacauucacuccauccgguacccacaucaucucaaaaguucgaaguccagagucucacccaaaucagguacugaugagacuuaggcucaaauuaucuaucuugaagcaaaucccuguccagcugugagcuuggggaaugaaacaagccucaugcuuccaaacuacauggugauggggagggggacagguucccauuccaaaagagaagcaugaagaaagggguagcagccccgaggaaguucaaaaccccacaggacgaaccuuucuagaauaaucuuucacuuggugugccaccuccugggcacacuggagggaggcggccccagggccucaggcagcacugcucauacagcuuugcacagcaggucucaggaguuggagccucguccuugcugcccucccaggcuggcgcuguaugcuggugacgcuacaguccuggggucucaauggugccuccacuuccauagauccaccaggcgucaucccagggaacucucugcagagccucugccccuguggcugguuucugcacgggaccccaggcuguccaugccacacuuugaccucuacguggagggcgccauggccgcaguuccugccuuccuucccugcagcugcaggauaaucaguacccaugggugucgccgaggccacacccacacccuccagagcugagccagagcugccccugggccugcuggagccuuggcugggcggcugacgggugcugugucgcaacguggggagcagacacuugaggggugcagggcagggaaugcugaguuccuggguaccucuuugaaaauguggucccccagguccuagcuugccucaaagaucucuggcugccucggggucauucuccauugucuuguugaguagcaccugguucccaucugucagagcaagucccuugaggaacagucgcccugaagucgucauggaacacggaggacucuuggggcauugggggugccugacccuggcguugccaggucagaaguggagagaggaaucccgcccuggggaaggggucggaagugggggucucagggcagggagccccguccugcagggagccgcucccacugcugccuucacagcuguccacauugccuuucccagggcucaggcugacccaagagccaggaggcccuguccccauugggguuagagugaggccugggugugcuugaggcagaugggcccuguggugaggugagggccagaggaggagggcugagugggcagguggacauggcaggguuucccauggguucugggcugcugcgugcaugggaggaugcaccucuuaccuggagggaggcggggucuggagguugcagcccuggggccugacggugguccuggcuggggacagaaguucagccuggagcuggggcaccuauuuuucccuuauccuucccaaauccacccgaguccccuuguccuggcauccaccuccucccucgaguggcuuuggccuggcggaccugccuggcacuccccuuuggggugaugcagggagccuggcggucucggcuccuuuuccucaucucggcgucuucaggugcuucucguggcgcuggucuugcgggagccugugucugucacuggccgcuggcccggguugcucuucugccagcgagugccaggaggacagccacugaggccccaccacaggcccccuuugcagucugugcucgugacuccccaggacagcaggagcugagccagggccucuugugcaugcagcugaaggccguccacaccacuggggucuggggugucgggagggaugggcugcggucucagacgcccucucucugucuccccagggcaugcucaucgagggcccgccuggcccagaaggccccgcggugaguauccggcuuuauccugugacuugcagaaggugcucuugguggggugggguuggugacaccccuuaugucuccuggauggaaaagaggggggcucuccgcuuuugcagauccccugggagccggcgcuaucccacccccaccucugccuugguuggccaguuggaacuuggaccuugcccugcggccccaucuucuaacugccccaacuuuauuuuuaauucuagggucuucccggaccuccaggaaccaugggucccacuggccaagucggggacccuggagaaaggguaagagguugacuguguuuccugagaucacacaagguguggggcugcccacgccuccucuccacacugugacccgagcugucccugccuguggaggugacccagaggcuugugucuucaaauccccccucacccaggcacuccucacaccagccccguucagauguuucuggggcugaacuguggcuauggggagaguggggccccucggggcccagggagccugccagugcucagcccagacgguggccucaggacccugcaguugcccagcaaacggccgcagcagcaguaaccacagcagauggcuccggggccuuucccacuccucgccccugggcagccacaccacguggaauuggccaccccccuugcuggguuugggaacuuccuuggucuggguugcaccuggcucacaggcucagaggcauccucgggugucccucgccgcgggaggagauggagggagagcugcucccuggcugccgcgauuuccuucugacaccuggugggcgcuccaaguacugcggccuccugguguccggcggggcgggaguuuucucuuccugcuguuggaaugaauguggauuugagugcagaaggacuaagaacugauuccuggacagcuggcuugugggugggagaaacaagggcugcgugcggguguucgcggguguucacgccagggcccugccugcuguccggggcagagugaggacccuguggguguugugguggguggaugcagggcagggucuggucgugugagaaggugguucgugaugucagagcgcaguggcuagggaugcuucccagguuacugcacggggaggcguuuggggagugucuugugcagugccugguggcuuugcagcagugcucaggaaaggcgggccagggcgcaggacaguaaguccuggccuuggaccuggagguucuuacaggugcucaguaccccuggaaagcuggggaggggcaggacaggugaggucaggcagcaggaugcaggggcaggcggcggcagccuucuugggagcaagagccgagccaguggggaugcuugcuuggggaggagaugggagcacugaggccggccuuuggaggagaaggauucaggucagcuaugcgggaggagguuguuaucguucuguguggcugggugaccucugagggcaguacgcaucagauugggccacacaguaagauucucugccacguugcuuuucacggucagggauuuggagguccagaagaggcgggucuugcuccauggcaagggccguggcgggaaacagaguggggugggggcuuggcuggccucuggagcacaaagcuuucacagcauccccggccuggcagccacauuuccaaaacuccagacaggcaacagcgaguggccgcugcucuugcccagccagcaccggccaaaacuccagacaggcaacagcgaguggccgcugcucuuacccagccaggaccggcauggcuggagcucugugcugggggcugcagccaccccagcucgcucuggagaccccuucccccagauucgcgugagauggggcaacggccaagcuccuccuccgcagagcugccugcggauggguccacagguguggcuggguucguaugcaaaggagagugcauugcauggcacugggagcuguuuucucucccagauguaggacagggugguacccacagggcacaaaugccgguugacacacagggcacccagaugcugacugacacugccucagugguguuccacggcuccguccuccuucuauccauccagcguacagauuuguacugagugccugcagggcugggcacugcucuagccuggggaucucaauggugugaaccagaggggugcugguucacaccucaccaugcggucccugccuuugggcugauccuggcuugggagucacugguggguggcccugccagugccuugugacaccgugaccuacccagcugccguggaggagccaagggcccugacuggagaauaucguugguuuaggagcugguccuccucaaacucacaucaggguccaggagcaugaggacugagguugggguuggcagaggagccaacuccuccagggucugccauccguggagucagaggagagaccuggagcccaccggccuccccagggcccuuccagugagaggggugcugguuccaggagcugagagcugaccaccccucuggguccagcuccggccagccuuguucaggaagccaucccugcucaccgcucagcgcccucuugauguccagaucuugcucgaugcccgcuaaucagcugugaaagaucacuggcuauggggugaggcccugcagugcagccugcggugggccgggcucaggugccugugcggcggagaaacaacauugucucugcccucggagguugagcaucuggggccuccaaaagacagauuaacaagagaagaggcauacgauuuuaacacuuuuaaucuucuaugcacgggggcuucgcagacaagaaguaaaaaccaaaaaaagugcuuggguucgggagcauauauaccauuuuaacaagcagcaauaggauguggagaaguggcuagaccaaggaaaaggggguuugggcuucgcggggugacagauggugggcaagugacuaggaacuccauggaggaacgaauggaagauuaagguuaucuuggcaaagucuguugaugcagauucacugggggcuggccucccucucaggugauaaggggcgcucuccaaauccugguacagaagcagaggcaggaggguggggugggaggaggggguaaugcccugcuuuuaggcagaagaggggagguaagagaacucuucuugcguccgucgauucuuacuuggcuucagcagaaaauagucguucugcaggggaguggcgugcucuguccccuccgucugcuuggccuccugugccucugucugggagggccuuuucccuggggucuggaagagcccucuucucccugccacucccaaccucccgccuugggcuuccccagcccuuccucccuuccccaagggccgucuggccgugaccgguuugugccuuuucuuccucacuggauggugaguuccucaagacaggccucacuucugugcccuuccucacacccugcucccugugggcagccgugggcagccguggcaauuggcugggagccgucugugcaccugugccguggcaucccacuggguaucaugcagcccugaccagcugcugaagcccacacccugugccuccacuggcuggcccuggguguugcuuccuucacacacucuggugagcccugcacacucucccgcugcuccccuuggaugaccuuccaugcugcaucugccuucuagcaccucaaauccuuucuugcucuugugcccacggcugcccgcagggagcagagugcaaggagaggcacagaaguggggccugccuuaagaaacucaccguccagugaggaagaaaaggcacagaccaggcacgguuagacagcaagaauuaauuaguaaaggcauuggaggaagagcugggaaucccgagaugggaggucuggagcggcuguguccggguggagaaggggcucgaaccaucaucccauccaguuucccucaggugacuggugagcaggugcacagcuggggcaaugugcccgcagggagauagagguagaccugggguugaacucagaucuccuguggcagaaggaagguggccacucuuacuuugagguucagaggaaacccaagagagcugggaguccccaagugagcugcaggccagguggccguuacucagccccucucuggccuggguuucuugugggucuggcuucugugccaccugccagugcguuucuguaggggcugacucuuuugcgcauccgggaauauagugagauaucagugggucugaaaucaugaggcugugcauuugugaagguucccuaugaugccaugguggcagugccgugccccugugggucgcugagcaguguuugcccagcgaagcccuucccugggcuccucgggcaggugggggaaggagagggcuggggaccaucaguaaagauucaggccccagugagucccgccuuccauggacuuccagggcccacaccugcuagccucgauagaaacacccggaaggcaggcgccaccucugugcugcuugugagcgcccccuacauccauucgcgugugugccccagagcugguguccacggauauuugugccuaagaaauguucccugugaucagagcgucuuugaggcgagucccuuccuuucccuuccccgugugccucuccaaaagccuugcaccccaggcacuccuguguuuuaaggcagcuccugaauaccguccaguguuacuguggauuugauugcauuuuucaggaugcuguggccaaacuccuccugaaucuccgcaguccacuggagaguuuaacguuuucaucuagaaauaagcuugcuuaccgucuaauugacucccgagagcgccagcugguguugaccagccacucaucuauugcucuuaagagagacuucacacagaucuuuccaccuacagcauauuuauuacuuuuggguaaaguagcgaucugcuucugggucugugggcaggucccaccugcuggggggccuggauccuccucugggaagccccagggauucaguaugcagguuucuuucccagccgccucagggucagaguggaggcaguuucccaagcuuucuccaaauugccacacaggggcaccucgcucccugcacagugggaugcauuugaugccuugggaggaggcccccacccuucaaugaccccauuaugugcagaagcagccuggcaauaaugaugcugcccggcgcugucuuaucagccccuccugucacucagcaggggcucaaaccuucucccccucuuuuuuauguguccaggauuagccuuccccaugggauuuugcgugagugcauuuucugugccuugaaaaguuucguauguaagccaugcccugaaaaacagcagucacuaccucccagccagaaaguguggcucaccucuaccuaacagguucugguguggucuccccaggaccagccuuggggugaugcccugcuaugccauccccuccccauggccugcuggugcuacacccagggugggagaggacacaggcuagaucacuggcaacuugacagagugagcaaguccacucacgagcacgcagcugcugucugacuccgaaggaguuagcuucgagaaaagcuguggggaagaagcaagcagcaugggauucauuugcuuuccuggcucccaggcuccuguggaugggacacgccaauccagucucuccuugucuuuagaaguguucaggacaucuuggcagagcugcucagagagguucacacacacacucaagcacacacgcuugcacacucacccacacaugcacucacauucacaugcacucaugcacacacacucaugccuacgugcacgcacucaugcauacaugcccacacaugcauacaugcacacacucaaccguauaugcacacauguacacacccacacacgcacacacucauguguacacgcacacacucaccuauacauacacguaugcaugcacagucacccacaccugcacacacucaugcacacccccauacaugcacacucacacccacacaugcacacacauccacauauacaugcaugcacacacacuuacacaugcacacucacccacaccugcacacacacucaugcacacacucacccagacaugcacacagguacgcucacacacaugcacacacauucacacaugcaugcacacacccauacaugcucucacacaguuacacacacaugcacucacacaccugcacacacauucaugcacaugcucacucauacaugcacacacauacacccacacauguacacacauucgcacacucaugcaugcaugcacacucauccauacacaugcacacacauuuacacacaugcacucacacaccugcacacacacucaugcacauaugcacacacccaggcgugcacgugcacacacaucuacaugcacgcgugcgcugucuggguucaccuccacacggcccuuccauggaggcuggucugcaggcuugugugcccgaauccccagcagccuggucgugaaugacuucuggccauuucgagucacauuuaucuucaaagcuuaguccccugaggccacugauaggaaucuguccaagccucaggugccauaccaggagaucagugggaacuguggguuucucugcuguagcccuggaggcagugugugucucccaaagcgagcucaguguugaagauucauuggaggguauacauuaucauauggaaaagaaaaucaaguacaguuuguggagagagaggugaagggagcaaaggccucgggacauuucuagagugaagggacagcuggcaggagcugcaugaauggcgccaagugcacuaugcuguaggaccccaugcagggucugccaggguguucaucacggucaguuaguggcaauggcugggugaguccaggagucuuucucacgugggccccuuaaggccgcaggucuuacccagagccccgauuauugguggccuauggauaaagagccccuccuguggauuuucugguuguuaguucugguugaggggugcggucugaggcaucaggcuucuugauagggccccgcuuccagucuuuuagaugggcccuagggcuccuggaagagugucugucuagcucuuggaaggggcucaguaggaacccucucaaugaacgaacgaaugguggguucauuucuuugggauccucggacaauugaugaccaacuugggguuuaaagcaacaggaaugucuucucucuuaguucuggaggccagaaaucugaaaucaagguguaggcagggccgcacccccucuggaggcuccaggugagggucuuccucaccucuucuggcuccugguggccacuggccguccucugcccuuguagcuugccggcgcaucucugcagucucugccucugucuucacccagcccuccccugugucucugucacugccuccccuccucuucccuuacaaggacucaucauuggauuuaggacccaagaucucaucucaagauccucacucccauccucaaagaccccaaguaagggcacagucacguguuucaggaccuggauguaccuuugaugagagacccuucagcccaccgcgcguggucaugcacguacguguucugcacagccaggagauguccagcaggaagugaccacugagagcuucucccagccacucccgagcugggccugcccagggucgggccuggacagaaccacaugcacacaaagguucuggagagacgccugcacacugcccuccugcuccagcucuuuccgagaguggaagggagcuuuucaacacaaagccuccugcaggccuacagcuccucccaaaccugccaccaccaugaagagaaaaggcucagaguucucugcucacugcuuugacccaaaucccggccuggaaagaggccuugugccucuccccugagguugagccgagggucucguggggacaguuucacgugcugaaucugcaguggcagagggagccacuuugugaggcaucuggucacccagccacaucgucucugugcaaaggacgucuggacguccucaggaaagaaacccuguuagauaccaguggugccuucauuuggaaguaggcaccugauuucuucaccugguauagguaugacacugagagcccuccugugccagggccuucagaacauugcuguuugaccaaguuagggcacugauuugggggccagcuaauggaguaacaggaaaauacaugcaaauagcaaaggcaaggugggauuucuuauuuugccauauuuugccuguggcuggagccaagcagcauccgcaugaccugugugugggccugcuggagcguucccuuggugucugacaccugccuugucgcagacaacagccacaucgcuggcccgugcuuugugucaugaaaauuggaaaugugacuuugagguguagccgugucuuucagcccaggggucaaagucuuuacguuagagaccacagggcuuggcaaaggcuugcugacaauguuucuaagugauagcaaaugcagguucauguugguggcccugaggacuugugucaaauuugaacacuucggaaggguucauggggguggcgacauucuuuccuuucuucuccacacugucuccuucuucuaggacuucacguuauccuuguucaucuacguucccauucuuuggaauuguuccgggugucggugagaagcggcaucagagggaaguugcuuucacagccuggggauuggauuuucaccaccguggcuuagaacaggcaggaaggaugcugaaaagagggucuuuggaaauggacagcaguggacaaggaguggccuugaggagacuuccuggcuuccuacagcaacaccaugugagcaggagcaugcaugcacagacacacaugcacacacaugcauucccacacaaacguacacaugcauacacacaugcauucacacacaugcacacacguacacauucauauggacguucacacauccacacacaccugcauaugcaugcauacauguauucacacacaugcauucauacacacaugcauucacacgcacauucacacacaugcagauacaugcacacaugcauucauacacaugcagacacaugcacacauguauucauacacacaugcaaacacaugcacacaugcauucauacacacaugcagacacaugcacacaugcaaacacaugcacacaugcauucauacaugcagacacaugcacacaugcauucauacacacaugcagacacaugcacacaugcguucauacacaugcagacacaugcacacaugcauucauacacacaugcagacacaugcacacaugcauucauacacacaugcagacacaugcacacaugcauucauacacacaugcauucauacacaugcagacacaugcacacaugcauucacacacacaugcauucacacacacauacacaugcauucacacacaugcauucauacacaugcagacacaugcacacaugcauucacacaugcacacacccacaaacaugcaugcacagacaugcauccacacaugcauacacagacaugcauccacacaugcauacacaugcauucacacauuccacacgugcacacacaugcauucaugcauacauucacacacaugcacacaccccaugcauucauaugcacacccacacacaugcacacaugcauuuacacaugcacacacaugccuuuacacauauaugcacaugcacacacacaugcauugauagucacauacaugcacacacaugcauucacacauucacacacaugcacauacauacacuuacauucacacaugcacacacauacacuuacauccacacauacaugcacacacacuuacacacaugcacugcacagacagcagcuuguccuugggagacacugaccccaaaucuuaaaugcaagguuugguuuggaauugauuccgacacaggaaucucagcuguaaguggcuaugaggauuguaugucaaugacaaaaccugggcggcaaacauguuuuggaucuuuauuuuuuaaacacgauuuuugucuucugagaguguuuuccaaaauggcaguugggagcaauugggcaguauccauuagcaauucagaaauauacacauauauacauucuuugacccagcagcacugcuuugagggacuuaccuaguagaauauguuagcacgucugucgggcaguguuugucauaaugcaaacuggaaccaauccaacgugcaucggcagaagacggguuaaauaaacaaggaguccauugugccugggagaugcaacagauguugccaaggauaucuacagagacaggccaugauuucaagagcaaauugcagaauauuuagggacaguaucauuaaaaagaaagagacugggcgcgguggcuuaugccuguaaucccagcauuuucggagcccgaggcggguggaucacgaggucaggaguucaagaccagccuggccaagguggugaaaccccgucucuacuaaauauacaaaaguuagcccacgcugguguggacaccuguaaucccagcuacucgggaggcugaggcagagaauugcuugaaccggggaggcggagguugcagugagcugagaucaugccacugcacuccagccugggcaacagagugagacucugucucaaaacaaaacaaaaaaaacaaaacuccgaagccacacagccucauagugaugaauguguuaguuaguguguccagcaugugcgucuucaucuuugccuuugcacuuacagaacuugagcacugguuacauccggagaugaaaagggaccuuucacuuucacuguauaaauguguaccuuaagccauuucacaagaaauggaguuacuucugcaacaaaaagcaaccaguaaagacaaggcaggcaaguuuagguucaggcccagauggcuccacagccuucuggauaguuccagaaaaaccacucagguucuuggucuuucugucugggaguugggaauccaucauggguuuccuggcagggagcgucucacucagguggugugaacacacaugcucaguguagcuguugcugauucggaagacugcagccagcacccauccgcuacacuggaguguaacuggaguguaguugguggaggcuuuucucacuggggagaggggguuaagcuccagucucuaugcaagacaagccucaucuacuuuaggccagcugagaaucugcuugcuuuugugaaauagcuuugugaucaaauauuauuuugaaaauaaaucaucuuacugguuuuacaugcguauaguggucugaagcuggcuggaauuggucuagagaauccaguccuagguaugucuguguggccagguuggcugggcgugaggagggcacugugucguuuacauauaaguggguucuugaaguugcuguggcugagugugugcucugcuguguugcguguccauccacgcaaguggcugcuccaucccgucuuccaucugagcaggcacaggcggcucgcucggagcccauuaaggacaagugcccacugggcacaggaggcacugggccuugagccuggagucuuuguuuccuguuggguauggagaccuaaaaggggcguuccuggagcgacaagagccugacacugccuccucaccuucgggcuccuugucucugccuugaggccccagaggacgccugcugggucucuggauuucucuauauccagcucagaccucccucccuucuuaucccucccuccaaagccuuuccgauccucagcccacagccgugccccucccuucuccggguggggguuucugaaacauuccugccacggggucucacagcuucugugcguguccagugcauuucccgggugggccgcuucuccgacgcccucauucucgcugcagcccagcccuggccugguugcacucugacuugucucucuuggccccuugucuucagggccccccuggacgcccaggccuuccuggggccgauggccugcccgguccuccaggaaccaugcucaugcugcccgugaguacccuuaucagucggagguggggaggcagcuggggcaggugggauccaaaccagacccucugaggcugcgcugucacuggagaggccugugggccccgucucagucuguggucuugccugggugccacgucacugcucccagagugacccuugucuuacacuugcaguuccgguuuggagguggcggcgaugcgggcuccaaaggccccauggucucagcccaggagucccaggcgcaagccauucuccagcaggccagggugaguacugcugggucccaagaggccugaaggggacagagcccagccccaggggccaacaggagugagugagucaggcucagagcccaacuuggagggaagcagcugucuugaucccagaaugccugcuugcuggggucaggagcugugggagcguccaguccucaguguccaguagggaccccgagagcaugucaguguccaguaggggcucugagagcaugucaguguccaguaggggccccgagagcgugucacuguccaguagggaccccgagagcgugucacuguccaguagggaccccgagagcgugucacuguccaguagggaccccgagagcgugucacuguccaguagggaccccgagaucauggggacuguuuggggaguuucucagcaguucuuuguccaugcugaggguccggguucuaacuuuacaaggggcuucugggccccuccaccucugacccaguaggcccaccuuccaccguuggugaccuuugccucugugcuaggcccucugcugggauccagaaguggagccggaaacccacguggcuccuggaaggggcugccugggcuggagcugggcuccucugggagagagcccuugggccccagagccccucacucucagccugggggguccuaaggagcaggguccgcagaggagcacuugccucccuauugugaaguagcucauuaguggccuguguuuucuguagacuuggcuccggauugcugauugcccacgauagguguaaacacugccccguggggcggguggguggguggguaauccuccagcggagugcaagaaagcugcuaaguaaucccuuguuugagaaauauuuaugcagcucccacagcagccagaguagauguuaaugaucagagugcuuagguaauuacaggacaguguaagcacagagucguuaccauggagcaaauugccugaaugauggaaggugguguguagcaaaccccacuaccugccacuggguuuaugggcuugggccugccuggcuggccuuuuaucuuguguauuuuaauugaagcuaaauggaugauaggcuauaagauuuuauaaugcaaaacaaaauauucuaaaauucagauggcaucugccagggaaacagagucacuuggcagcugcagaagcggcucugugggaaagcggugggcccugcacuggugcaggugggggccacaugcagagggggcagguggguuccuacccucccaaaauacuuccccaguggcugggagugcuugaagcgccucccaugugaaauaaaauaugucaugacucagcuugagcucagguguaaaauguacucccuaugcccagaguaagaggcuuauuucugaccuagccaagggugaugggcugggagcaggcccucucugugugggcuagagagacaggaaggagggauggggccuaucccccaagggaggaaacgggggcccacuggcuugcaccucugcaugucccacgucacucccguggaugcugagagccccaucgaagucggggggggggggcccuuggggagucaucagaccuccuuuuccagagucuccugucccuccucuguccagucugcccguucccuccugccacaucucacggcucaggcgccagcaaaccggagcacugcugcuggggcccugucucagcgugucucacuuuccuuugcaguuggcacugaggggaccagcuggcccgaugggucucacagggagaccuggcccugugguaagucauuggcaaaucugagagcugggcgugguguggggauuggcccacucccugugucguuggcggacaguggcagguggcccugggguccuguggacacagagcggcccuugguccagugccuguucccaggaggguggccagggggaccaggggccucucucggugcugcuccagcccccuuguuggugggggguggggaugggugacugugccucgaagucacuugagggaguucagcgggguagagcugacaucagcgauccugggaaacagccuccaacuccauccugaauggaaaggagcuggcaggaaucagaggaggaggccccuccucaccccugcauuggaguuccaggcucccccugcagagaacacgcuaugagcugucaccagaggaguggcuccuuagagggaugggguccugcugcagccaggggccuggggaagucccucgcacaggcugugacugccuuguggagcaggggccuccauugaucuuuacagcccuguuccagaguugaagauaacuaaguguggggcagaacgcaggauuuccagccucacccgccccugcccuguggccucaacuuagcucucaucugggguccucgaugcaugagaaacauacagugugugcccagggagacuugggcugccagugucaggcacaggggcuggguuccggggccucuggggaggaguguggguuugcaggcacacagaggaguucaacaccacaggggcccuccuggcuuugccaccugccacugggucugggcucggucgccuccacacagggccugacucagggcuggccucccacaucugggggaucuggccuugaggggccuguagcaggugcauacgcugcucgaagcuuugggcuguaacggaccacggucagguucaccccggagagagaaacaucuccaggagcuuugugguguuugcgagccccaacaacuagaauuguauuccugauuaggaagagauccaaacaacugcauuucccggcuccuggaaagucaucguucuuccccccgguucuguucgaggcagacaggucgcgcuuugugugcugagcaccguggccgaagcccuguccccucccccugccccuccccugccacccccagcccuuccuguguucucgaguccccaccucgagcagacauuaacacacaccaugucucccuagggucccccugggagcggagguuugaagggcgagccgggagacguggggccucagguaugugggauccuugccuucgcugucuggugggcgccucccguucuccggcggcagcgacggcgagcauggagggaccccaacugcugcauguuuucaaggaaauucgugggaauuguccuugcuuuacgcagugcugaggguggagcacaaugaacucugacaccugcggcagaaaugagcuggcuguauucugucccuggccuucauucugggcagcagauccgugucccguccccgaagugcccacauguuuguggcuuggacagccaggcaugggcagggucgaugagcacagggacaaggcuuugcucuuucuccugagaaaggcggacucgccacugacccuuugucucuuaccccuggcaggguccucgaggugugcaaggcccgccugguccggccgggaagcccggaagacgggugaguggugcgagugugugugguuuagugacagcagcuugggcgcuggaggagcccaaaucuggggugcgggcacccccaacagccagcugggccacaugaagccagguggcuccccuucuugugaugggugcguccauccccaaggcugccucugagccagcugccugggaggggcgcucuguguccugggcgcagacacagcggaccaggccucuucccugggcacauucauuuaguuuaauaaaccuuucuaauucaagaaacuucccaggcccuuugggagcaaauguuaagaagacaaaacuaucagcgggccuuauauauuucgggcagcacugggacuccagaaauggccugauucgggggcaugggcgggccuuccugcgccuuaccugcugucuugccuccuggaauuuucugucuggugcaugguucuccuggauggaacugguuuguuugcacaugacccuggcuucuaaaagaggacacacguuucccgagugcugaccaccacccagacaggcuggggcaggcccugggagcccagauugugcucucaaaaguggaccuuuucaaccagcagaccuuucuggugaacgagagaaauuucggugcaggguuggauuuguuucaguguggaccucuucccaguauguugucuaccuaagcuacccuugacugcuauagucugagucaacaaggcaaaaauggguccuucccuagugguucuggaugcuccugacuuggggagcaagcugugguuaguggguagaaaugacccgauaagccgcaguuuggcagguccgagggucuaugcagggaucugggcaugaaacagaggccugggcuggauaauuccaggaggauuagcagcucuggaaucgacucuugguagacaauugggccauuuauuuggaucugauucugaaaaauguuuuauuuccuuaagguguuuuugugugucuccguaaauccuucccacccaguuucacuagaacugguuuccuagagugagguuaaaaacuggaacaagaggagacucgggaaaugcugucuaacauggccagcugcagaguugcauggugucggggccaugcauaugcguguguuuuaaggcauuaaguaugcccagaagaucugcugcagaagaaaagaugguggugagagaggggcuuggagcugaggggucgauuccaaaguggucugagcagccucuuccauucuuugcuagcauuuccugcaaggaacgcucgcuugugaauuguagaagcaucugggugcuuugcggggcugaguugugcugugaaauccugugaaguuuuccgacaaucuucccuugguuucuaaaaguguuuggaaaucuagaagaggcucccaaugggccccuccauuugcccaacagggcgaugucuuuuuggggagcaacgggagcaccgacugucuccuugggguguguuuggauuucucucuuuuugcuucucggcuguucucgggugccaccuugucugucuccagugcuuugagacccuaagcugccacccuccagaucuucucucugcuuggugguggguugggggcaagggccucauaugaggaggagccccuggaaaauggaagugcaggguggcagcccucuauacucgcuggcuggggugccucguugugcaggguggcagcccucuguucucgcuggcuggggugccucauuggcguggaggucuggcugaguuucauagagacccuguucccuugcagggcucuccuguggugaagguggggccugcacagugggccccggaaggucuagguccccucuucagccccauggccagucaguugggcaccuuguccuugacuguguccauagcuggccaucaggaacagggcaucugcucaccgugcagaugcugccucccgucgcuguguggucugagugagacugggccucacuuggggccugggccucuuccuuagccaaguggacaaaccagauguguccuuucucucuuuccucugaccuccaaaugguggaaaggagcugugcugucugugaugucaguggccugcacucgccugaguccuaaauucacgguccccuagacugacgcagcuccuccagccgggucuccucugccacauuguggcgucuucucgaagcccaggggcaguggcgugaucccccuuugacagucugggaugacgugguccggaaagaccagccccguguguuccauccguuggugugaggcacagaacagccccgcccgggcuccuggaucuggguccucgcagcagcccggccacucgggcugugaccuugggggugggcgcggcucugguggaacgcucaacuugguuuaacggaaaaccauggcccgggggucucagugaaccggggcucuuuugcauugacgguuuugccuccuuuguuccagggucgggcugggagugauggagccagaggaaugccuggacaaacuggccccaagguaggucacccaccacccuccuggugcccuggcaucacugucaucccuggggucauguugaugauguaaccaaaaugcugguuaugugaugacuacgauuaugaugacagguggcuccgucacuggcauuugacgugaagauaggguuggugggugaauuucgccagcaagcgugacaguugcaguucauuuucauaagggagaaauuugcucccuuccagcaguggcgagcagggaugggggugggaucccgacuaugaaaaccauccguggccgugcaggugacgaggcgcauguagggcagaggcggggcauauggcaagugcgggggccagggggucuuguccagucgggacuccuggguguuguggaggugaguagauguugcccguggcuaaaggcagggcuguguguguggcaugaaugaggcugcaccaggcaugcaccagcuguugcugucgccacucaugccugcccgcugcugugcucaguguauccaccccucugccccagcacugcugugagcauugccccggucuuggcucaccccuccuccucgccucuuggaagcauuugucccaggccacggggggcaggggagauacugaccuuccgugaagagugcaccuggggacagcagcugugauuuggagauuggagaccgggcaccaaaaaaaugccagggcucaacuacaccuguucccucuuaacgggcguggaugagcucugaagugcaucccgucagucccaagcuagugagguggccuggggugacaggaggaaacgcagucuuguugacucugucucagaagaccauggucuucuuucaacaacauggcugaaagccuaaaaugucccaucaucgacaucaccccagauggugugcacacccaugagacagggcccuguucccgggcuccagggcaugcagaagaggggccggccagagagccaggaugccugaggguagccagugcuggcccguccaccaauggguacgcguaccuccugagcgcgggcagccccucggcaccauggauacagcugugagcggacacaccgggacccugcucuccuggagccucccuggggugggggagaucagcagcagacacucacacacacgggaaacugcagcggucgcugaaauaccgcaugacuaaggacccgucggggccugggacuuggggaugaaagucaucucccccuuugcagcccauguucauguuugcaggggaagaggcugagauuguagaugcaaagugggggccuauggggagagggcuggccgaugggguucagggugcauagaugcugugugaaacgugguccaaggcggggcggccaucacuugguggacaccaaggcgggguguccacgugugcaggguggcgucugaggcagccuuucuguccuuuuugcagggugaccgggguuucgacggccuggcuggguugccaggcgagaagggccacagggugaguauuuccucugugagacacaggcaugacgaugggcagcagaggugucucucgggaggcccuucuccuuccaggcagccucagauuuccuguggggucaggucuccgccauuccaacagucaguauacaaaccucacgggagucagcaauggcagugagccccaagaugaugucuuuguugauggguggccagcccaaaggaauuggagcucuuaucuacaguuugugacaagugagccagaugggccuacccaccugaggcgcgugaagggggcagggaaggagcccuuccuuuuagagaucuguuuaauggaguccuuuaacauuucaggaaauccaagcagcugccauuucaggggcggccaaggacacuuugcaauauuaaagugguggucccaaggggguggggacaaucucaaguggccauguggagaccaggucacgaaaacaugccaggugucccccuguucccuguuaaugggcguggaugaauuugaaagugugucccgugagucccgagcuagugcggugaccugggggucuuccuggcugcgccguuucuaugugguuguuggagaacacagaugcggcagcuuuggauaaacggcaacagccaagccccucgaaucuugaaucugucucaauagacuguggucuucuuucaauaacaacgugauagaaagccuacaaucuccugcccuguugaggaggugugguggggaaggcucguccuggccgccugcccugcuuucucagcccauuugggggccugacaugagggcucuucacagcuugugggguguuccuucucugaccugcuuucugugaagcagauuucucugauggcuccuuuauauuuuagcacacugaggacauacaggcacaugaguaugugagugcacaccccccaugcacacacacacccacacauacaccacauacaccacacaugugugcgcgcacacacucauacacacaugcacacacacgcauacacacccacacacccccacacucauacacacaugcacacaagcacacacacacacccacauucauacacagaugcacacacaccacacaugcacacauacgcauacacacccacacacacccacacucauacacacaugcacacacccacacccacacacucauacaugcacgcacacacacccacacacacccacacucauacacacaugcacacacacauacacacaccacauacaccacacaugcgcacacacacucauacacacaugcacacaccacacacccccacacaugcauacacccccacacccccacacacauaugcacacauacacccauauucauacacacaugcacacauacgcaugcacacccccacacccccacacucauacacauaugcacacaugcacacacccccccacccccacacucauacacacacaccacacaugcacacacacccacgcacccccacacucauacacacaugcacacacaccacacaugcacacacgcauacacacccacacccccccacucacgcacacccccacacccccacacucacacaugcacacacaccacacaggcacacacacacccaugcacccccacacucauacaugcacacacacgcauacauacccccacacccccacacucaugcacacaugcacacacaugcacacccacacaccccacacucauacacacaugcacacacacccacgcacacacgcacauacacacccacacacccccacacucauacaugcacacacgcauacacgcccacacacccccacacucauacacgcccacacacccccacacucacaugugcagacaccacacaugcacacacauacaugcacacacacauacacccccacacccccacacucauacacacaugcacacaccacaugcacacacacgcauacacacccacacaccccacacugauacacacaugcacacacgcacacacccccacaccccccacacauacacacaugcacacaccacacaugcacacacacccccacacacccccacacauacacacacaccacacaugcauacacacccccacacccccacacucauacacacaugcacacacaccacacaugcacacacaugcauacacacccacacacccccacauucauacacacaugcacacacaccacacaugcacacacgcauacacacccacacacccccacacucauacacccacacacacacgcacauacacacccacacacccccacacucagacacaugcacacacaccacacaugcacacacacacacccacacacccccacacucauacacucaugcacacacacacaccacacaugcacaccccccacacucauacaugcacacacacacccacacacccauacacacaugcacacacaccacacaugcacacacaccccacacauacacgaacaccaccuacacaugcacacacacgcauacacccugacacacccccacaugcauacacacaugcacacaugcauacacacaugcacaccacccacacaugcacacagacgcauacauacccacacacgcauacacacaugcacacacacacguacacacaugcacacacaugcauacacacccgccacacacauacacacauguauaccaccccgauacacacauacacgugcacaccagccacacacgcauacacacgugcacaggcuccacacaugcccacacucacacccacaugcacacacaugcacacgugcacacaccccacacaugcacacaacccacacaugcacacucauacccccacaugcauacacgccacgcacacgcauacacaccuauacacacauaugcaccccccauccccccacaugcacacaggcauacacaugcacacaccccacauacccccacacacuccacccacacacgugcacucgcauacacacaugcacucacacaaacacacaggcgcacccacacauccacccacaccccacugcucuguugauugcucccguaagcaugcccugcagcccuccaugaugccuugagaaggggcuuggcuguugccauuuauccaaagcugcuacauguauguucuccaacaaccacauggaaacagcacagccaugaaggcugucccugacucagcuccagcccuuuugcacgacugaugagcacauauugagcacccacugcgugcgagcucugaggcugcaggcaggcggggcucccugaggguaugagcgugaggcugcuucaccuggagcacuugggcugaggauagcucagaccucggcucaguguccugaggcugcccacauguguggcccugccuugcgcugcugggugcucaguccagcacccuccuaccuucaggccaucguggugagacucaggugagagucugcagccugcauuagcccggcugaggcacacgugaucuucuaaggaaaauucccccauucuggaagggucuuuugagagcuugggaaucuuacugucagaauuagagaaaaacaaagugggaccuuggacaagcccugcaugaccugcucaggagaggcugacguugacccuuucacuuccuagggugacccugguccuuccggcccaccaggaccuccgggagacgauggagaaaggguagguauucugccgucccuccgacugcuccugccugcccuacuccucagugauuugggcaggaaaaccacagaagagaggcccaggugugggauuggccugccgcauguggagggccagcugggagaaggcagauggggauuccagugggcaaagcgauugaucagaugccaagaggcugcggggcauuggagagacccugacugcaacguuuaguuacuccaucgguccugcugauggauggagcucggggccagcucucagcucucacugcaggaugcaggugccccaaaccccacugggaggaaagguggccagagcguuuacugagcucagcgucucugcuuaucucguccagaugaggaguuagcuggaggcauguggguggcagaaagcugagauuuggaggagcagaagaggguggggggauuggaaauaacccucugugggccuggagguaggggagcgaguggcuguggccauggggccagagcacaggagggagcuguucuccagcauggacgcacaggccggggucugguaucugccacgccgucuucauguguggaggcgaagugggaucucugggccacagcacagugggauuggggcaugggaugcacgaggcuguggguuuccaagcucuucccugcaggcaccgcagucacucagacgccuucuuuguaugugagagguguuuagggggaaagcuuuaaggagcucuggagggugagaaagaggagcagcuccaggggcauuucugucucaccagcuuucaggcugacauggacggggcaccugcuccugugugggccucagcacagucugcuguaagaugaggaaggagagagggacccuucuagaugucagugcuucuugauugagaggacguguguguguguguguguguaugcgugcauauguguggcugugugcauguguaugugcagggagugcacguaucugugugcaugcaugcacgcauggcugugugcguguguauguggacaagcauguguguauggcuguguaugcaugugcaugcacaggguguaugugugugcacaagcaugugagcauggcuguguaugcaugugcaugcacagggucuguguguccauguguguguaggcauguguaggcaggcugugugugagcauacaugcuugcaugugugaggcgggcgggaaggugcaguggugcuuuggcgagggacaguguuugcaaacagcccguggguugaagcagugagccagggaggcauucccuucugcagccaggaggaagccucuugcuguacuuuccaggcuguuuaggaccccggcagggacaccugguuccccagaggguggcccaggggaucuugugacucuccccugaugcccuguccugccccagaggcugucauucaagaaggucaccaaauccuuucaauuagaugcucuuucugcccagccuuuccucuggagagcuguggcaugugagcuccugagccggcaucucagagccugcaggcuucaccugcagugucugcacaccuagcagcuugcugggagcgaggacauuccaggccuuuccggcugguaccagagcugguaaaccuggcguaugugaagcagccccaagccagagaacccuugugcaccacugaggggaagcugguguccaggcuaacagcucauuucucuaaccuugccuuuuuucuccucugcagggugacgacggagaaguugggcccagggggcugccuggggagcccguaagucugugagcugagugggacggugggggcucaguguggagaaaggcuuuguccaaggcuccugcuggagcaggaucugggaucagccaggagcuuagaagagagagagcucgaccugagaacagacggaccugggcaucucccagggaagccaaagagaggaggcacaggcgaggcuggcuggcaacuccaggaggaagucugagccugccuacaggagcaagccuggcccucaaggguuguuguggggguccaggggcagcgugguggggucugggggcauuguggggagucgggggcaguaugugggguccaugggcauuguggagggucugagggcaucguggugggguccggggucagugugggguguccgagggcaugggggugggggguacaggggcaucauugggaggguccagggucagcauggguggguacaagggcauuguggggggucugagagcauuguagggggucuaggggcaacauggcaggguucaguggcaccauaggggguccgagggcauuguggggggucaagggagaagcaugggaggucugaggucauuauagggggucagggggcggcaugggggguucaagggcauugugggggaucugagugcauugugaggggucccggggcagcacaguggcauccaggggcauuguggggggggucacacaccugaaucagcccgagcuugggcccguuucaauggccacccuuccagaggcagauuccuccagcagacucugccccagcccugggcaugggaaagcucuucccuaagcagacauauauuuaggcccagagcaaauuuccugauggauaggacauuaauuacuauucauuuacuguugcuuuaaagcaucucuuuucucguagccaagucagcccggcugcgugcgucagguggugcuaauugaugagaaauauagcaggcacugcauagaggaggcaggggucggugccugcagacucauuugggacuaaauuauaccccagaugucugauuagccucuaaggagaauucaugaacuccacucucuccuuaacacauguccaaguaauaccuucugggcuguuagcuuccaagaaauguugcuauaacuagguauuaaaauaacgaaggaaacauuuaagaggcaguaagugggggaaggaguucucuucuacagaaucugaaaagguucugucaaaauuaagggcacuugaaguccacguaccuggggugaagccucuguaauucuccguggguggggggugugagugcccuguggcaggcaguucucccggaaucucacuccaccugcgguaaaggggagguucugcacgagccucgccgaccggagagggcgugccagcucuugcccagaguagcguccuggaaaagaucuguaccccacgccuccuucugcacauucagucuugggguucccaccagggacuaguuucaccuggugcucuccugcccgcacccucugacccugugauaucauaaaaacaaucguaugucgcugcggaggggaauucaggagcgagccgguaaugaggauagggcacaagggcuccgugcaguggaauguuauagcguggugauucucugggggagcgucugcucaccugccccagcaagugucagaggagccggucagcuugaaagccccccuuucccugagggugcccugugguguccucucugaguucucaccaauuccagacaccugccccugguucccaacaccagggugggguggagggaggcagcgcagcaggcugggagggagucugggccucacuccugggaggccaggaggccugagucaccagcugggguucuggguggagucagggccaagugggcauaggggacagagaggagggcugggauuucugcccgaguuuaaauccuauuuucccuuuccucuuacaggggccacguggucugcuugggccgaaggggcccccagguccucccggaccucccguaagucccauuaccgcccugcuugucugcccccaucucggccuuugagaccccgccucccagccgguggacgcuugggcacuggggcagcaaguccgugcuggccccucuggcgccugccugcugccagugugaggcgugagcgggacacugauguucagacgcuguagacacggccccagcagguguggccuugcagguggaggcccgaggcugccggccucacgccuccgcuucacccuggcugcacuuccuccuggcagacagcaugugcuauuucaguuauaagcagaaacccaggaugucacguuucuucccugcuagaaagaacuuccagcagcuucugugaacauucuggaaggaggcugaagcccuugauuccaguggggcugugucccggugggcagcucccccagggccaggccugcccccuucagccuucccagccccgugaccugguuuucuagaaccugaggccugccccguggaaugcuagggccuggcaguucaguuaaccuuuagcugaggguuacuggggcugaucaguggaccucugggaagggauuuggagucagguccuucccuuccccagagagcaucccguccucugauucgucgugggaugggcgucugagcugaguugagugggauuuuccucuugagcacugugaguucuuucgcauucaguuacauguuuuucuucuuaaaaucguacacagggugucacggguauggacggccagccggggccaaaaggaaaugugguaagucccuggggucccguggccuggcuucaggggcacuuucccugggcacacuccuugccuggcuagggagguccaucgcuguccacaucagcugggaacaugaagggcagguugcagacccucugcuguggugcccacccuccaguggugaguggcaccuggagacuuuagcaugauggggugacuugggaguuuucugcccaauaaaucauuucuggucaguuccucucacguguuccuuccuggucggaugucugggcauauuugcauaaacgaguuagugcucacuccaucagagucaaccuccacagccucagaggcgcugaguccuggggcugcucucuguggugggacccggccgccuuucccuucccgcuggcauuaggcaguggggagcaguuugaaaggaugggaggccagugagggggcacacgacacccaggaaggggauacaguucccagagcccccuucagugccuuugcucuugucuccuguaggguccccagggagagccuggccccccaggacagcaggguaauccaggcgcccagguaagugagccugagagaggcagcucgcagggauccggccgugggaggcacacgucuccaguccggagcccugggaggaagcggggagcucuguccccuccaaguagcagccccuccccuuaucuggagggagacuaggaccuggguuggugccuggaugagggagacaucaaugagaagauggacagauggcaggggaggguucugagucaaucagcgcccucaccuucccuuucuggcucuuucucccucuuagggucuuccaggcccccagggugcaauugguccuccaggagaaaagguaggugggccugggcuguguugcaggccacugcccgccugcagguggauucccuggccccacccugggaggaccccugguauccaccagcucucaauguauaucuuggugcucccaagagacgccaaagcucagagugccaagaacugggccagaagcaugaggaggauuuuggauccgugucucauugauucauacguuuauucauucauucauucucuaguauguauagggguugcuggauuuagcaaggaacaaaaauacaggacaugcaguuaaauuugaacuauuguguaucugaaauucaaauuuaaccgggcaucuuguuuuguuguuguuuauuuugguuuagucuaguuuugcuaaauuuggcaacuugacuguaucuccagagccuacuguguccuaggcccuggaacgagagcuggaagugcuugcccuucuagagcuugucgcuuaaccaggcacaagauaguucagguagcuccaagugccuugguugcgaucagcaaaaacaccuccaaggggcugguucugagugcaugagaauccccggggggccugagaaacacagagggcugggcugcugccaggccugggaccuuccaggagcugcuguuuaugggauacugaggcugugggccuugcacugcaggaugcccugcccugcccugggguguugaugugaacagaccagggaggacaggguggugggagcacuugaagaaggcacagcacuguaagagcagaggaggccagaugaugcccccccgggccccaguaugcagcagguggauguggagaagaaugggggcacuugguggacugauuccguuccuacagcagaaccugaaggugcugagaacaguggagccgccuccuccugggcgcuaccguggcugcacgccucacagccagggacccagugccucugaccacacuucucagcaaaugcugugugggcagaaauguugaaaaguaaccuugguggccgacggagaggucaggugagccuagggagggcaucuccucauggagucucugguuuguucuagggucccuuggggaaaccaggccuuccaggaaugcccggugcugacggacccccggugaguagcccugcccaccucaucccuccauacucuccccaccuccacccugcggauagggcugcaggcccaggcucuuugggguuguuguuggacggcauugacucauucuggcucuguugaugaagacccguuuggucuccaguuggacugcucggucauucuuggguucuggacacccuuaacaucauggauuuuaaucaacgaguggcgauugcgcgaguaggaauauuagcuauuuauuagguugugcugauuaauuaccggaagucaggccugcgugcugagccgugaggagggcugggccgggcuccaggccaucgcuugcguccccaggguuggaagcgaagaggcaggguacgugguguguauuuuuaguguucacacacugagaagggagguggugagcaaacgcguuugcagugugugcgcgcacagcuguggagccaaauuagauucugccuggaaauagcgaguuggugacaaauccaaucugugucuaagcuguguggaggggggaggugugaggaaguagaacacacucagaaugcgugcgugcgugcacacgugcguguacaugagugugagcugauuugcacccacacccucuguaagugccugcugugguuuugguuuugauuauuccguuaaugcugagucuguuucacaaacgagauuagcagaauuaauuauugaagaugcaguaugcuuuaugguuuuaauaacacuguuaaaaacuaaacaaggaaguuaaauauguugaugauuaucggugacugcucaccacacagcaucccucaggccgagucaguuggcccagugacucccacaucacaaacugcccuuucuuggucagaagaagcagaguggagccuucucauccccacgcgcgcagcuguggggccccguggucaccuggccacaugggaguuugcauacugagugguucaucuuuuccaauguguuguguccuuuaauuuacauuuauauuucauugcccuuucuaaugaucagaacagcacaucuuguuauagaaaauuaggaaaauaaauaaaauuacaguaaaauuauagccaccuuugaucucaucuccugauuuagccauugacagcggguggacguguguccuuccaggcuaguuuucuguucccgugcugcuggcugugguguccauggaguaugggccgcaaucuguggggacaguggcugggcccagagcccugcggggaggaaggggaccugggugugaagcaggccacacgaggaaggggggccugggugugaagugggcuguaccccucuuuccuucugcggggaggaagggggccugggugugaagguggcugcaccccucuuuccuucugcggggaggaagggggccugggugugaagggggcugcaccccaccuuccugccaagaucauucucucggcccucagcugaccuaacuuguucucccuggaauuccccuccccauguugaaaccuccaaagaauuggggucccuaaagagccugcaguuuccuuuuauauucuuugggggaaggaaaggccuuuaaggugucccuuccccagcccgaauuuaaagcuuaaaaugugagcguagguggaccccauucacaugaaggugcuucgagcaaaaggaagcaaaggguaggcccaaagacagccccagccaucucccacgaaaaucuggaggaaagaaaagauguuuaaaaauucuccuuugcaaaggcagcacauugaggguaaacccuacagagagaguuuucuuuuuuucuuguuuugguuuugguuucaaagaaaggaagauugccuuaaaauccaucaagagguaugaggcacuucagagcagacucagugccuagaaauauguuguugaauaaauccugauagcacacgcuggggaaauggcuaagugaauuauggcucaguggaauauauuccugguaucacacgcuggggaaaugguuaagugaauuauggcucaguggaauauuacagagccaguaagaauugaauuuagacaaauacuccgugacaugagaaaaaugcucacaauguaauauuaaauuaaaaauagaucuaccaugccaagggcgcaugcauaucugcagagacgacagaugauucuaucauacaauuagccacagccacuccgaguggugaggugaugaaggauuuuaauuccucuuccaguugccuaauugucuaugaugaacauacguuacuuuuuuaaucagaaaauaucaaauacaaauaauguaagcuuuauuauuuucccauuacagaagcacugcucauuauagaauauugggaaacacacacaaguagaaagaaaggggaaagcggcccugcccggcuuugcaggaaaaucagucgugguuaucuuguuacguuuccuuucugccuuuuccuguucaaacauuuuuuaguaagggagcuuugugcuuccccccacugcuuuacucucauucucuaucuguaacugaaaauauaccuaaaggaauuuggccuggaugggaauggaggccgccgugaugccggccgcuaacucugcuuggugcucccugggugggcgcaguucugagccccuugcaaacgcucugugcgucuccgcagcggcgcugugugcagaugugcuguuaucuccagccuggaacugaggaaaugaccacguggagaggccugggggcuuccucgagcagccggggcugggucugcccgguccagagccgggcucucggccccccugcagauccacccacuagguccuucacagaaaggugucuguggcugauagaaaguguaauaaagggccacaaagaaccccuccuggccacccuggaccaggacacccucuaguuggcucuguucagguccagcccggccacucugaggugcuggcgccaugagccuuguuuccggaaggcggcgugguggccaagcacguccccucccagcuggagcagcgggugaggucccgcaggugccuggacuuccucaaagccucccucaaggggaacuuugcgcccucccacucacuugcugcuaggauaggcugucugcuaggauaggcugucugcaaaggcaucaaacccaauuggacagcuaauaaaaacuuaaaagucacacacgaaccauuuaauugaggcaacgagacuugggucuucuuaaugcuacugugucuagaaagagucucagaucaacguuaggccacucaagguagaagagcaucuugccacccucucguguuauaccugaggaagcgggaggcccagagagggcaagugaccugcccaagcucacacagcagguugaguguguccaggaguagaacccacccugccagccuucucaucacccugcccagccucuuuccuggaauccucguugguggaacugcauuucugcacagugaacauugaugaucuuucugcuuuuauccuggaaguuuggcucaccgauccugagcucacaggcauuaaaccgagugacccgccuggguuggaaagucagagaaaccugcauuccuaggaauggaauuaguacaggcccaggcaggcaggagacacagguccuuccuagagccucggcuggguaccugucacauggggcauagguccucaccuucgcucagcuccccuccauccccgaggccagguggagacccgagggugugggucucaaacgaggcagcuguuugaagacucacggaugugcugggaccccucagucaaguaacacgccuuagcccuccaccccgcaccaaccuugcuuugcuuuugguuccccaacaaucagagauuccaagguuugcagacagcucagcaauugcuaguccgggaagcagggaugccaggaaccuggucccagcucauuauugugcagauucaucuugucaggugaccuggggaagaggcccuuguuggcccuguccccacucgugggucacuggucuguggaccugcacuggagggcgggcuggcucuggccgggucaggagccaccgugcaggucaccugugcacuuggggguugcugcauacuccccgcaagucucuggccuuggccgggguugggccagggucaggcuuauuguucccauuuugcagauggagcagccgagguucagggccuggcggcucggggaggccgggcugugcuuggcugccuggccagcugccuucgacuucuggugcucucaguuuuccuggggaggaagggaaaugggcuccaugaucauggaugcuacgcagggaggggaagcgagggaggcugcuuucuggaguggcacugacuaaucaaugcuucuucuuuugugacagggacacccuggcaaagaaggcccuccaggagagaaaggaggucaggugggugcucgccacgcccuccuacccuucagcauccagguggggcggguccaggugcucugggcucagccucugcucagggacauccagcuuggaaaggaaggagccggggacacucagcccuuccucaggugucuccgccaagggacccagccugggggggacacaggccuuuuccccaagaagcggggcaccccucucugggucagugccccucaccccacccuccaguugcugcccaugaccggaucgggugcccaugaccagauggggugugggcagcagggcagugucuccguguucagcccuggucuugacucugcacaagcuggguggccuuugaguuuuggggagaugcuauuaugaauggggacagaccuaccaggucacgccggugccagggauggagucuuucuauggaugacuguguccgacacugugagcggcuugugguuccuccugcggggccugcugggcugcgagggucccaugcagcacguccaccagcgccuucucuccacugcgauucaugacaaagcugcugggcugcaagcaccucugugggaagagccuccagacgggaggaguagccaguggggacugcucuugcuguccuggugugcgccaaccuucguucaccccaagacugcuuuucuuguguguugaaaccgcacaccgagcucauggucgucgggagccuggggcugagggcagaggcccaccugcuccaggguuccagaggccccaguugucacaggcucuggaaucgggccugauuaacauuuaucucuugaagcagggccugugcaggcaagauggggucuggggccuggucccagcuccccuugccaagggugugguaggccaggacugacccuccagggcagcagagcuagcgccaguccucacagggaguucaauuuccagugccaggccugcugggcaguggcacuucuccaacgugcugccucugagacccagagcggucugagauucgccacuucugccccguucccucucuugaaggucgcagcagccacuggggugaacccuccccucggcccuuggcuuccguucaccaugggagacccaguucccgcugccuccaguggggaguuuaccagcccuccucccugggcacagccucuuaucaucagagguggaggcagcaccuggggccaccagagcucgcacagugcccggaacuggugcugacaggugguuggcacuuggagcccacagcacaggcccacuguucugagagcuggcuuuucaacuggaacgagaggcauucacuuacucccugggacuuccugaguuccucuaugugccaggcauccuguuagcgaugggauacagcagggagcaaggcagaccgggcccgggccucagagcugcagccuugcagaggaggccaccaagcccauccugccugggagcuccagccgcugccgugacaccauguggaaagggggcugggagggaggcggugggagccguucaucaugcuggagucuugggcugggggcaugggggcuggaugcccacccccaugagcucuaguugagcaucggcgaggcccuuggcugcuggaggaugucucuucccugucuagcagccuugucccuucucccagccggaagcucuccugauuuauuccaaggaccuuaggcugggaaugcauuucuuuagggacaacacuccuugcagagcuccaacgcugaccuuucaccgucucacuguucccccagccuaucccuuauuucccugacugccgggguggggccagcguuugcuucaccucugugucccgcucagcaugagacacagccacaccuccacugucagugcaggcugugaacaccugugcgagucucccacggggggccucucuggaggcucugagcugggauguucgcccugcucucagcaggagggguaugccgaacucuggaguuuccugauguuccccaggcaccuccacacuggcauggggcuaacggucuuuuucuguuugguuuuaggguccaccuggcccccaggguccgauuggcuacccagguccucgaggagucaaggugagagagacucacgccacuccaggucguccuggaggucaggguugggacugugggccuuggcguggcugguuuuagggaauucucugugguuuaaugucccugcuauucagucuggaguagcccaguccucccagucacuuguguggacgcuaggucucaggacagcgggccugagcaggugagggugugaccagcuagagucaggagggcugauauggagcacaggacagucugcagucuggugacgacgccaggggcgcgcuggcggccaucugucaggacgggacacguccuuuugcuucuugccucuuuaauuguugccauuugucaggcuucugucacucuccucgcagacagcagaucccggcugaagccaagagccuggccucuuuccuggggaagcucggaaacauuucuucccagccauuugcacauuccgagugagaaacagagucugucuccaccgauagcaucugggugggccagcgcugucgcaaggcggaguucaugggagcuguccauuuauucacaaucauucguguuucugccaugacgggcucugacaaccucguuacauggggcgcacagcuccagagcaauaucccagacacagguccccucugucacagcccagcuaacuguguuugcucugagcuggguaaugcaaucucgaguugugcugcucucuggacacggcacguucuguguagacagacauaccccuaggcgcacgcggaccagcucuccucuuccucugagaauggggacuugcgguaucuuaaaggcucaugaugauucuuuccuucaagaugcuuuuaacuggaugugaaggaauauguguguauauauagcaacuagucaagcuugagggauuuguagaaaugacucaccagcuccccugccccucaccucccuggucugaagggcuuuaugcuuuucaaacauuguugcacaucagaaguguguggccgcccuggggcauggaggccaacuggaaacugucgucugcuccgaaucaacccuccugacucuggcuggucaccccucaccugcucugagagcccaagacaucaguuuucagugacaugccccagauuacacuaaaaucgaggcugcugucagaaaucaaaccagguuccaaaucaagugccccacccuugucccccggaggccccgacuuccauuucccaggaaugaggaccuuccaaguucacgagguauugaagagagaccucccaacgguugggagccuuaggcgagucagguuuuucccuaaagccagcuucuaccagcaaaaugccuagcgaauuuuauaagggugauaauuuaguagaaaugcugauuaugugaguucuauagcauguuuauuuuacaaauuccugucgcauagcagaagccucugccaacucccauacauggcuaauugcauaacgcugcuucugugagcuaaaaagguguuugcuuuaaaauguuuauggagaaugcucuuaucuugccuaucugauuaaaauucauucaugacaugagcaauccaguuagacuuggaagcagaggguggaaggaaaaccgagguuuaaaauuauuuucaucggggaaaaaguuucucauacuccugugcauuuggaaaugugaguggugucggcgccucacgaguuuggcccggguggcagugaugguggcagggcgugggauugcgugggccgagcugccgccauuugaggugaauaguccuuggugagagggggcccguuauuuuccaccaaagcccuaccuucuucccaggaaaagguucuuaguccaguggggcugcuauaaccaaaagacccuaaaauggguggcuuguaaacaacagggaauuauuucucacaguccuggaggcugggaauuccaagaucacagcaccagcagaugcagugucugcggaaggcugcugucuaguuccuugauggucccgucucacuguguccacacauagcagaagaggggggacgagcacccuggggccucugguaaaggcauaauccuaaucacaggggcuccacccugugacccagucagucaccuccccacagccccaccuccuaguuccauugccucagguauugggguucaccauaugaguuuuugguggacacagacauucaggccacagcaggcucguguuccuuugaguucacugaccuuuagcccaccuccaggcuucccucugccuugcacgucugaaggggcaccuguuuaagcuugacugucagcagagucaaauccaccccucguuuagcccccagcugcuaggggguugccaggaggccccaaauaugaguucacauccaggccuugggcgaaagccugucccucucugggcugugcgcacaucuggucccagccgugcugcagcuccugagugcuccuucccggggcggcuggccggccgagucacggaugccccaauccagcccuucccagccagggccacuuccugcaugacuggggagugcccucuaaugggaggugcugcucaccccaccacggacacagcagccccaaugucaacagccccguggccaagaagcccugggaagugcugguucugucuaguuggucccauuccuccuacggggauccugaaacgguagaacuguaggaccgggaggggucucaggaggcugcggcugguucugucuaguuggucccauuccuccgauggggauccucaaacgguagaacuguaggaccgagaggggucucaggaggcugcgguccuaccugccugcucucagcagggcaugggcagggagggagcagcagcgucccccagccugcccagccagagggaggagagcuggugccaaugcccccgggugcugugccagggaguuuagugcuccugggaaauaaugccagccacacaaacccagucccccaggacucagggcagggaggggcagcuggacaucaccuugcauucaggaucagacgcugcugagcaggcucaacccugauuguauucucagccacaccugcgauuuuccugugcguuucagaggaaauaagcagaauccaaaguugcucuucuauuuugcaaguauggugaggacucaaaacugcccuaagaaaagaaaguagcucaucuccuaaaaagcccuucuuggugggguucuggggcuguugucucugaggcgaugccacgccguggugagacggcaggugguuuucuggggcccccagcucugugucagccagcguggcccuaccuguucucuuuucaaaacucugggggcuuccagccaggauugcuuuggaagaaggcaucugcuaggaaaaaaacaccaccaagugcuuagaaaccacucgccucucagcagcuggcccagcugagucacuucucaccuuccugggcugcccgggcccacaggugcugccaagcgcgugcugugcucagugggggcaguggccugcagcaggcuguucugagccuccucgcggcuuggcuggucguucccacucagcccuggaauacgcaagcuguguuuguccggcgcuuccucuccaucuugagguccaugucccaucucaggcugggguagagacuagcguaggagaggcuuguuuggagucggccucccugcuugggccagugcuguuucugagcugugcccuguccccccaaggcgcuccaugcuggcccacauuagugugccaagugccaggccagacgaaccagagcugcuccgagcccaccuugcccucccggcugccuccgcccugugcugggcguagagggaggugucccaggccucuccacuagugguggcggccaggugugaagcagacaugacuucagcaauggugccugcagguguaguggcagaacucuugcuugucuccggugcuccaaauccuccagugauuaugguucagggcaaccacgccgcugcccugucugcguggcuggaagugccuugcagcuggcacuggaguggaaggcguuucugcaguuacauccgcagcuccuuggcagagccagggcacgcagcccaaggccagccaccucugcagaaaggagcuccuccgugucuccaucccuucccagagccccucccucuccaggaccuggggaaaggccagaacugccaaguaugugggaaguucugaccaccagagggcagccggcaggcccugcguccuccagugcucuguggccccggcuucagccucagccuggaaucccggugccgggggcaguguggcuucucucucucucucaagucccacgggcagguggccugagguagcccgagguagucucucuagcuaaaagucacccugcugggagggcugaagucaaagacauuaacagcaaggguguggcugcguaauuccaccccacagauuuaccuccacugccccaggcgcuuggcacagugagagugucagagaaauaguccugggccccgucccagaaacuccuguucagcagggaggugggaugguguguccugaacucaugacaacugcaauaaauauguuaucaucauucauuaguaauaucacaguaucaucucuucauguuaacacggaguugaaauacauggcacugggcuucuguuuauugacaccugcugugugcugggugcuaggugcuguucugagagcuuagcaggcauuucccucccaacagugguaacgagguaaggguugucguccucuccacuucccaaaugaggaaacugaggcacgcaggagucuggggcauugucagaggccauggagggggagcugggaccuaaucaagucugccuuagaccucaccuccugcuuccuccccaaaccucugaaagguggggguguuucuagaagaugaugcuauaaugggaagcaggagggguguguuggcugccgggugugggcccuuggaagggcggguccagagcuugggcuggaaggugggggauggguuugggucuuugcaugaagaacaggagucaguggagucagcccaggaauuguggacacgcugggccuccugaggccacagggggacauaugggaggaaguguguugagggcagggcgcuggccucaucugucagcuucagcgagcucagccugucuugacacgccugcgacagcucuagaaaggcugagacuuguaaccauucacuccuuuuucuuuucccacccgcacagggggccgauggcauccguggucugaagggcacaaagggcgagaagguaagucucuccuugcagccacggggcccccugcuuaguccggagccgaauuccagccagcggggcccucccacaaugcuucuuccaugaaaccagcugagguggaugucgccucugaguacugagggggauggaugccacucuguggaaagugucucuguuugcagacggaagaagaguaaguugaggauaggcccucggguccccaggggcacaucuccuagcagagcugaguggguccaggguuugugucucugcacaaggagaaggccuuggccccagagacaacacacggccccccacgugccugcaggggccaguggacaccugucacccuccccacucccaggugggccgccuugcauggccgcuggcacgaggguccacuuaguuguuagauguucaucccugggcagcccaagcugcagaaacucacagugugcagcagagccaggcagggagggagagaggccgugccauuggccaugguccgugggggcaggucaggccuaagcagaucacuguggugaagacaaagcuaaacuacacccccaugcaugccugccagagucagaagcuugggugcagccugcagcggcgacagccugagccacauggagcugcguggccggccaccuuucucuucucacugugguggaaggaagcucagagccaaauccaaggcccaguuaugacacagauuuaggccucaggggcggccucaccgugccacccuccccaccguggccucacgcucuguuguggguucgcccugccaugccguguagccaugcaauacuugcuuuccguaaggcauguugguccccuuugcugggcagacucugggcucuccccuggccacggcggccugcggggcuggagugcgggugcuggcgugaugguccacgugccgagacuccuuauuugcuaccugucgaagaugucgcuuggauccuuucuugugaaaucugccggccuuaaagccauucccgaggggacgcauugaguggccacaacuggaucagaaaugauguggcagcaggaacgcucuuguuccacggaguuuguugagcgugcuggucccugguuucuguucuuagugucugcccuugugggaggaccggccaggaggccugagccugugccaucucggcuccuucccaagggcauccgcacagcggaauccuaaguccucauccgggaaagcugagcaguuuggccucuccaagagcacugcuuucuacguggagcccgucggggcuucggaacacgagggccuuacgaacacaggguccccaucccagaauuccaucccguugguccccgggaggcucccucaccugaggaccuuucauccuuuccaagguggcuucacagaguccagcuuugccgcuugaucuugucacguuugucccuagccagagacagggcugccugagaugauacugauugggcugugcaggggaugccuucuugccaggagagcucccgcacuguucccgagggccacgcaggcagcccgacauggucuggggaaggaguggggcagugccaagggaccgucuuuguggacuucugcauuauuuguggccgcugcucagcuuccagcacuaugugaacacugugaacaagugccuugaggcccugggagccccgggagcuggcgcuggcuggaaagggcuggauucucacugcacagaaagcugccucccuugcgugugcccccagccgggccuugaauguuuacgaccggcugaguccccagauccuguccuuucacucuuuuuggaucaagauguagccccugaauaaugacaggaaaagcccagccaaggguccccucucugggagccacccgugcccucugcugaaggaucugagggcuuuugcccugcgguuuccgggauggggaacgucuagaccagggacucaaacggacagcagggggcacugacgcgcggcagccucacuugggucccagguucaccaguaacccaggggugcgcgggccgcugacuucccccgccacccccggcaacaccccuacccuucagaaagcacugccuguuacugcagugccggcaagagcaggcguuagggauucuuugcaggggcauuuucauccagcuccccguccucaauugucacccccuuuacccgucacuucagugcuucagugcugaugggacgccacagagugcacugagaaaugauaccgggagcucaggggccugggcuugcugaggccucgccaugcagaacauucagauucaaacugggccugcccaagaagcagggacgcagcucucuccagcuucagaacguuacagcugggaacgcagagcucaugggaaagccauucucgagggaugggccccaagcccaccccguccgggccaugugcugccccccaagcgugggggaccuggugcugagugugguuguuuggagcggggaagggaccgccagggaggcggguccucuugccuagacuagggcacucucuugucccauauucagggugaagacggcuuuccuggguuuaaaggagacaugggcaucaagggugaucgggugagcaucucagguuugggauuugggcuggggaaagcugggugggcuuggccgugugggaggggguggggauguuugccgccacagggcagcuucucagaauggagguaaacucuugguagagauuccuggugggaaggggacaguggcguggagcccagggcccgacucucuccagcuccucuucaccuccucuuccucaguuugccccuuggggacugggaauaaccuguggucgccagcuccuccgcccagugucccacacagggggucaguggggcuggguucacuucugacugcaccuguggacugcagaguuacucaccugacucaagagggauaagcggugccugggaagagaaaagagagcagcuacggaaaugacccagccuaccgaaggagcgcagcugcugcccaggccacacggccggcgcccacagggcagcacgcgacgugggucuaggaucccugugagccuggggagcguccugguccccagacaguucuucagggucccugggacucccacacaguccuguggucugugauuuuggcucaggagaccuggcuuauuuuuaaaugaauaauuuagcucggcuccagagaaagccggugggugcugggagggacuggggcuugccggcaaccacagaaagugacgggcugcacguuccuguaauuaaagagaaggugacgcaaagggcacgaaggaaggguagggagcucuuagagcagccaggguggccaaaagacucuuggagguuuccccaguaaccucucagcgagcagaagcccagcagaaggaaccgaagacgccucggccuccggugggcacagccguggugacagcugugcacgcaccgggacggacaucugucggcugcagcagggcugucacccagcugccgcagucaucccccugcagcaccggcucgcagguggcuuuccagaacaggaaagccccacacacuuggcacuucgucccaaccuggcaggcaaaaggcagaggcaaucugcaccucugugggaaggaagggggaggaaggaggggaucucuugcgcaauguugucccaguuaaguugcugcuaaaggcacccauucuagaacuucuuuccuaguagaaggcuccugaauccccacaucccagcggcuucucgguuugauggugaaaguccuuuucuccuccuuucugaugccucuguucacacauguggcguccacgugacgagggugcagcuucagaagagaugacacacguucccgugccagggcuccgagaguggagcucucguugccaugggacgagggugggaugcaggggugggacccauccugagcccagggaacaggaccccauaugcggaccucuucagagagcacagccuggcacuuugcaccuucucggugcucuguaaaugugugccggguuauuuuguugaacgagaggaacaccucuuagggacagagaguuccugacccgaugacagauuagagccucagaauuaggaaguuauucauuuuucucuaucugagcaauacacauuucuguugugggcuugcaccacugcuuuacagcugcucuuagagacagaugaucagaggaggauccauccauugcuggacaaagagugccgggaagggcauuuagagacucugccguagcgcuaccauugccugggcaggcuccagagcccucuccccuuucugagccccgagcucccaaucuguaacuugaggaaguuggacgaggcggaauuuaagcccgucuguuccugggacgccuccugaggcccucccgugugcucguuaugcccagguaacugccccauccggggcugggguccacuuccauaccuccugggguuucagaagcagcagcagcucccagucacucugcucuauuuggagaaacagcaauucagagcuacuauuguuaaccaaaguuauuuuagcuaagaggcacucaauuuagagaagguaauugggaaguaggagccugcagccuugagaaaauaaauagcaggcaaccucggugcagagaccagcuuccgcagagcccgggagcccgggaauucgcgguacaaugcgcucgcuuugucaguggcuccgggagcagcuccguggucugagugaggccgagcugguggagcagcucugaccacagggugccugugaccuguccccuugcuccuugcucucagaauggugguggagaauagugugugugcgggggguggucuucucaccuccucuuuucuggcuugcagggggagaucggcccacccggucccaggggagaagauggcccugaaggcccaaagggucgcggaggucccaauggugaccccgguccucugggacccccuggggagaagguuugugaugugggacguucagccacuuucuugggagggaucugacaggcccuuccccauggccucgggcucccguuggcuguggcugcccuaggcauggggugggggugauuccugagcgggcuccugucuccacccuggguucucucugcuguuccuaugaagcuguugguugaaugaugacccuuuccuugucccggguucgcccuuucccagcccuccaccaucgccuuggaaggcuccuuccucccgguggcuacaaagccugcguucugagccccaacauuccaggaccccguccuugucacauucccgccuccacagcuggguaauaacgguguccccaccauggccugaagguguggcagccuggcaggaaggaaggccgggguccuuggagcaggcucugggcaugcagccaucaauaggccugcaguuuccagcugugggaggcuccugggccagccacacacccuggcuccacccuguuuccacccugggcucaggcaggaauggugcaugcagugguccagacuuccugcccuauccugcuacguggacccauacaaaagggcucagaggugccccaggaugaacacgcugaguugaggcauuugccucuaaucgcuuugcuccacaguggcaagaccucuccuccaggggccuucgcuucuuccucggugcagggaccaucggguacccccuggauuucaugggugcuggcagucacccuccaccuagggcaggcagggcuucugcauaaugacgugugcccccgccucuggaaaccacacccuccuccaggccccugccagaacgcauguccuuucucucugcuccggggaaacggauggagcaauaccgugcuggccauuaaugcaacucuuucuucccccagggaaaacucggagucccaggguuaccaggguauccaggaagacaaggaccaaagguaacuucuggccguguuaggugucccgggacaggcggagggauguucugcccggucuccccacccugcauccggccguguuaggugucccggcacagguggaaggauguucugccgauaacuucuggccauguuacguguccuggugcaggcguggggguuguaccgccaggccuccucaccuugcauccagcuauguuaggugucccgggacagguggagggaugcuccaccggccgucuccacccugcacagguucauccacuccccauccuugggggcgugugugacacuguggcucucagccuccaccguguucacugccuucugcauuaauuugccgaguugaaaggaggcucuugggcaaugagucuucugccccagucggcacagacaccugggguccuucugggauccuccuggaguccccugcagucuucugcaccuguugcuuggcugguggcccuuuuccccuggguuguccauacccagaauccgugggauggucgccucucaacucuaccucaccggcgauuugaaggcuauuugcucauaauggaguauaaaagaaaaaggaaaccuuucuuaugugaaaucauguucagguuuaagugaaacagcuccuugaggcuuuggaaaucauugaaaauguuauuuuuuuucaaaucucacauuuuauuauucaugguucuuccuuaaagaauaaccagcugccugcacuggagacauaauuaacagccgaagcggggucccgucuuucucagaucugccucugcccgaggcaucuccuuuuagccucagcaccuuuucggucucacuggagcagucuuguuaacaggaggacgggcguggugggcugaggcugcccuccagguauuuccauucucauuaaggaaaugcuccuguccguccuuccuguggaaugcgaagcccccugcuccguguguguggaugcacaccccauaugcaggagagguagcuugcugugaaacaggaauuucauuuaggaucuaacaguggcucguugaacgugggugugauguagcugcugaccgcagcaucgucacugaauguggucaaaggggcugaugggcacuuuuccucucuuaauauacaucccucuggggauggaaagaagagaaguuugggaaagauggguggucuaaaucaaguccaggcaacuuuuuggaaaggaaugguacauguguccugggcagagacuagaaguagccaucagcacagugacccgguuucugaacugagcucugugucaccugcacugagguuuccuggguccugcccccugccuagauuggcaggcgggcgugugaguggcuuggcugaacucaguccccugugagaaauacaagguuuggacaugugugagcucuucauggauacaagugugcauucaggacaggauuuuaagccagacaaauagagaccugccaaagacaguggccagcgccaacccugugggcagcugagcgaccucacugcggugcugcuuccuguguggguguuuggauauucaccaggucagagucccuaaauccaucucuggucugugugcaccuugcaaacuucuagaauuaaagagcugguaggugcuacagucagugcauaaauuugcauucauucccaacucugcaagcugcugugcuuuauuuaaagggauugugggacgccaacacaacgugcacgaggcacagaaaauacaaugucacagugcaauguucaugucucaccucaguucagcucagcagugugugucccuuucucccaaacaccagccacccuccuauggauaugggcgcgugggggaugguggcaggggagggagcaugaugaaacuccauuuggcuuucuagagcugaagccugugaaaugcuuaggaaauauuuauugaguagagaggauggauaaagagauagguggcugggugaguggagggguguggauagguaggcagauggaugaauggguagguauguggguguguaggcagauggauagacagauagauggguuggugggaagagagguggaugaauggaugggugggcaggugggguagauacauagauggauggaugagugggcagguaaauagacaaguggaugaauggagggguggguuuauagguaggcaaaucgaugaauggguagguggguagguagacacauggauagacauaggugggcugcuuggcagagagguggaugaauggaugggugggcagguaaguagacaggucgaugaauggagggguggguuuauagguaggcaaaucgauggaugaauggaugggugggcagguaaguagacagguggaugaauggagggguagguggauagguagacaggcaaauggaugaaugguuagguggguagguaggcagguagauguauacauagguaggccaguggguggauaggugggugaauggaugggugggcagguggguagacaguugggugaauggagggguggguggauagguaggcagauggaaugaauggguagguggguggguggguagguggauagacagauagauggauagagagauagauggauagacagauagauggauagacagauagauggauagacagauagauggauagacagauaggugggccaguggguaaacagguguaugaauggguaggugggcagauggguaaacaaguggauggaugggugggcagaugaguagacagguggaugguggauggguggguagacagguggaugaauggaggcaugggaggauagguagacaggcagauggaugagugggaggauagguagacaggcagauagaugaauggguggguggguggguagacagguagacggaugaauggguagguggguagacaggcggaugaguggguggguggguagacagguagauggaugaguagguggauaggugagaagguagguagacagguaggugggugguugggugggugggcagguggagucuggggcagaggcugugcacuggcaugcagguggucccccaggcggcccaugcagcaugacucauuccuggcccagcucugaugccuccuccuuaaacucucuuucagggcucuauuggauucccuggauuuccuggcgccaauggagagaagggcggcaggguaaggauagccuggccccugggcaggcagcuuguucggcugccucggugccuagcaaguugguucuccagccgacggccuguuuauuucucacucucuugcuucugaaacugcucuccugaauggcuggccuuaagcucuugaacuucagcaccacguguuggugacacucuccagacgcugggcugggcagguaugugauaggaaggggcagaggcaggaaggaagugugcugagaaaauggagcuuucuaauuagcaccacaauccagaaggcucuuucaggucauucugaaaaucagauucuucuccucuacccaagugggcuuuuccuccaagcuaauuuuaaaaggaagggaaaaaggagauuguuuuuucccuucaaaaauguccugcuacuuaaccgucguccaaauuuaaagucauuuaaauuaacauuaacuuggacgggauuagcaagcugccauugucauaaacacccaccagcuugcagugugguuugaguccccuuuguccucacccucagcgaaggaacagggggccgggcugagggagcuguguucucccugcaccuucuggagcccccgcuggcccaggccucccugcaggagcgguccuggaugcuuguuagugaaaucacagugccugagcauugccacuugggaaaacaggagagagaugguccucaggccuuggacucugagcuggccuuguccacggggcauauggcggggacagagaaaggccagucugugguguacaugcaggacagcaucugcagagcaggccugggggacaugcuccccgaaagauggcagagcucacaccugccuuguagccccagccaugauccugcagcccugcccagcccauccuccuaugccccauccugcugucccagggcagacagagcuacaggguugcagcucccucuugggccugucccuccuggccaaaaccuuaugagcaaacaaauguguucugccagauucacaaaauaggaaaaagaagucuguucugaguguaaguuggcagcacagacccaaggagacuauuaucuccaucuccaccccucucugucucuguccuuuuacccauccauccauccacccacccauccauccauccauccacccacccaccaacccauccacccauccauccaugcauccauccacccacccacccacccacccagccacccagccauccagccacccacccauccauccauccacccacucacccauccauccagccacccacccacccauccacccauccacccacccacccacccacccauccauucauccauccauccacccacccauccauucauccguccacccacccacccacccauccauccauccauccaucuauccauccacccacccauccauccauccauccauccauccauccauccauccauccaucuucuauuaucugucuaucucugucaguaucuauccaacccauccaccucuccaucugucucuauccagcugucauucuucuucuggagaagcccugaguagugccuuugggaauacacugucuucugaaauacucuuagguaccacugugagaaacauggggaaugugagguaccccggugggcugcuccugugcugggggaccuuucacacugcacugcagugagagugucugggagaggauauggccuucugcagcuggucaugggcugugacugcaagcccuuuccauggaggacugugugggaccagggaccucguggagcaacuggagcccuugcucacucccaugcuccugacuggggcucugccccucaugcgucucagccuccccaccggcgagccgaggagcuuagauggaugcuccagauguccagggcaucagcacugugggucacgggacacaacacaaaccugacucaagcccagaccugccaggcaccacaugccccagucacacauaggagcuacucacagccuuucugcagccucugggugucuggcccugcccaaggacauuucguucacugcugcaccuggcugguggcacaacccacaacacagaccucaggccaaaagggcgaggccgugugcuuccccuugagccaugguaguggugguucaugugugugagauggagcccuggccuccuucaucuuugccaucacagcucuucagagccucccguucaggacacugagcacagccuuugcccgcaugagccuucaguggcaucgucacugcagaaugaagccugcagcacugccuggcuuucuggacaggguugaugcuuuguaccaaguucggggaaugacggagagugugggugcccucugaucuaguagguugggcuucccgaauguccacaggaagcugagggcugggcuguccuugcaaagggacccuuccucuuuuguugacugcagaagccucacuuagguuacccagaagccucugggcgcuggcuugccuucugcgccucggugaacagaugcugccucccagguuucgcccuuggccgcccuucuuuugccuugggcuuuggacuugguagucuugggugcaguccauucacuuaaacagcacaugcaucgcgaguccuuucucagugcuggguguucugccaggcucugaggacucugguggucaaagcagacaucccucuggcauccagaguggaacaccaccugguaagcagcacucagaggagugguggcugugaugaugaaggacaagggugagucagggaaaggucauaggcaccagggucugacccagaagguccagggaggccuccuggagcagugacauuuuugcugagcccugcaggagggacagaaguggauaggugagguauggaaagcaggcagagcuguggggucaggaggugaggagccgggggccggcacagggccgagcccggcaagggagacgugggagugggcugugggcugcagagccugccggggcagccagcugcuuugggggaagcucuuuauccugaggcacugggaccuacggaagguuuuagccagggggaauggcacugaagauuguuugaaacagcucuggucccaguguggggcaggaaugggaaggggaccauuccaaggguugaagggaaagccagugggaugucugugcucauccagagaggucuuuuauuuauuuauuuauuuauuuagagacagagucucgcucugucacccaggcuggaaugcaguggugcgaucucagcucacugcaaccuccaccucccaggcucaagcaauucuccugccucagccuccuaaguaguugagauuacagaucgccuggcuaauuuuuguauuuuuaguagagacaagauuucgucauguugaccgggccaguuucgaacuccugaccucaagugaucugcccgccucagccucccaaagugcugggauuacaggcgugaaccaccaugcccggcccagagaggucuuuuagaagaucuuagauauuccggccagauggaugcuucuaggugcuaggaugccaggccugaguguccgcaugcaugcgugcaugugugugugugcguguguguacauaugugugugugcaugugugcgugcaugugugugcauguguguguaugcauguguaugugugugugcgcacacgugugugugcgcgcguuugugcacacgugugugugcgcgcgugugugcacgcgcgugugugugcgcauguguaugugugucugccuuccacaugagggcugccugcugucugccugcugucugucugccugguccuaccuucugcagagcuagcguugguucuguggaccuugacuaugggccagacguggaaauggcaggaacauaagcugcuaugucaagccagcugaagccaaaggaagaggagugggugugagcaaagugucgcuuugccccucgggccucgggccaaggagggaucccaggagccccuucccgggaagggggaaagacccgcucuucagaugcaccugcccgaaaguggaaggccucuccuagcuguguuugacuuccccaguagaagguccccucucaagcugcguuuggcuucccagcauggccauugcugggacuguccacuccuuccuaagggcaagaagacaggugcccacaagcaauuugcaagggagaaggaaggcuaaggaggcuggggggggcauucuguuccacagcuccagucacagggacucgagauucuuuggcuugaguuaguuuauaaagaaaacagaugagcaagaugccugcugggagccccagauggcguugcggucgagccgguauuuugcuaacugccagggccccagcgccugugccucgggcacagucaguuuggguugcagucauuuuuguugcaggauuaaaccugugguccaggucauagugggacuguuuuaggguggaggguuuucauucuaggggaggaugggaaugaguaaaucuggcagcccgggcucauucgcaccuaaaugccaggagucaucagguuggccgugggcauccucgccuguagaacgccuaucacuggaagaaagcagauguuucguuaauuuucauaugcaaauauuuauuugaagccagaggauaucaccauaguaauugaagaacuggaaccggagcgcauuguuaaaaagcuacauaauuaacucaucaucauaaaugguuuuaauaaaugcauuucaaaaugggagacucuaggaagcaguuuugacucuggcagcaaaugaaugaaagaugaugagcggaaacuuaucugauggccuccagccauacagauccaccuugggcggagcaucagaaaccagucaaguucagccaggcacgguggcucacgcuuguaaucccagcacuuugggaggcugaggcgggugaaucacgaggucaagagaucgagaccauccuugccaacauggugaaacccugucucuacuaaaauuagcugggcgugguggcacacaccuguagucugucccagcaacucaggaggcugaggcaggagaaucgcuugaaccugggaggcggagguugcagucagccaagaucacaccauugcauucauuccagccuggcggcagagcaagacucugucuaaaaaaaaaaaaaaagaaacaaaaaagaaaccagucaaguucaggaagcugaguugggacacggugggggauguaggggccccugcguguucagcccguggcuuccguguaauguagcuuaacuacauuuuccagcucugacaucuuugcacugcauuuguuuucugugguuuggaaaaugcaaaacaacaacagaaaaaagaguauaaauucuauuagaggagaagccgaugacucuuggauauaugauuuauauauuaaauuccaaguuugcgcgucugcagagccuguugaaaauuuaauggcuaauauucuuaacuguagcaaaaguaaauuauguaugaaagggguugacuuucuucucuuuucuugcaauaaugauuucccucccugcugaggacagagagagaaagagagaugaggaggaggggaaggagggaggaaggaggaggagggauguagcggugcucugaggaaagaaaccagauaauaguauaaacauccaucagacugcaggaggaaaauuggauuucagcaggacuugugcaggagugcaaagcugugugugucgggugugcggugagcuucucgcccugauaaaucuccuauuaaaacacggaaaagguggguggcggggaggcccagguuccuccuauccugcucugaauucacagucucucaauaacccgggagacagcugccaccugagcagggccgggcauuuagagagugacugaccagccccuucucugauucuaggggaccccuggaaagccaggaccgcgggggcagcgaggcccaacgguaaccacccuuucagcuugugggcauguuugggaaacgggagcaugguuuagggagcacgugccaggggcugggggaaggcagugucugugugucgggacuugagcugaccuuccuucucucccaucuguccaggguccgaggggugaaagaggcccccggggcaucacugggaagccuggccccaagguauguuuuuggccuccugggcggugggcggcgugaacccaaguugcaaggcuacagagacguggagcgucugagggugucugugaccuuuuuuauuaaaaaaaaaaaaaaaggcaggacauuuucuuagguguguuuaagaagcuuguccccuccagcagccucuggaugccucagaucagauguaauuaaguggcugagaacgauggucaugagaaguggccccagcagagcagggacagggccucgccccaacaccugggaccccaaagacggcagcagggggccaggcccaccgcagacucacccgcccuggucgggaggccccauuuccucucuugaaagggguuugagagcugcagaggccucuaccagaaccuacagaaagugcuuucuggcaggggaaggcccaggccggccucaugcacauucuucccaccgaggggcauugaagccacuccuuggguggagaaucuggacacagacccagcaggcaggcuacuccuaccuguccaggaugccacuccagagcggguuccugcugggaugagucuuccaagggcugaggggccgagcuggcccgucccucggcugaccggaaugcacccacaggccacccugaacuccuccaggacaagcucuggggcacuucucgugugccccgugaccugaccugaggcucaccuaugagaacucagagcagcagcugucacauggggguggcccuagagcgggucccugcguucugccuuugcaugacuuuuccaggugcucgaggcuggggcacagccuuugucccacucaggagacuguucuggaaauguccagccuuguagacacugggcugucagcugcaugcagaggcacggggacaggcaggcuuugauagccacagaucagcgccaaugccuucugccccuuacugagggucagggccaccuucaggggugcacacaggcaauauuugacucagacguuuugaugacguugugggccagagucuuuucauccaaauaauaacaaucauaagcuuuuccccccucuccuucccucucaagggcaacuccggaggugacggcccagcuggcccuccuggugaacggguaagcagcuggagccuucgggggugucuccaagggcagagccugccucgaaugcccccugcacuuuguccuggggugggcuggggccagggaggcacgccucagacccugcugaaggguaggguuuuccuaagaucccaagggugggucacgcccugggagugaacucuuccguaggucaggggccucgaccgcagcccuggucuugggguuugggaguggccgagaugacaggaaauggguccugggccccauccugcccccgagggugaggcagggugagggaggggcuggaauaauggaggaaaggccaugggggugggaagaaaugacaccugcguucagagagccaccggcacaggcaggucagcggcaggagcugcucgggagagaccucuuguccucaaacuggccuuucucuguucccagggacccaauggaccccaaggacccacaggauuuccuggaccaaagggccccccuguaaguaauggcuuccuugcugggccagcacugccuguccccuccaaaacccaccuguccccuccaaaacccgccuguuuucucugaggucugcucggagcuccucacaguggccgguggguggagggaggcccgaggugaaauucuggcuggucagaugagggggagacccccccaccgccaaggcggcuguggggcagucuguggcugugucccacugccgggcccgcuggcacuggagagggcugcacgcugggguccucucuccuugagacugaagugauuuucucugaguucuguguuagugcccuggggccgccaucacaaaugaccaggaacuggcuuagaacuggguguggcucuucugucacagcccugggggccagaaguuggagagcaaaguguggucagucagagcuggcaccuucuggaagcucuaggggagaugggguaccaggccucucccgggggcugguagcugcugccaguccuuggcacccaguggccugugcacacucacccuggccacugcccccaucuucacguggacuuccgucugugucucucugucuucuaaucucuuucuuuuuuuguuuuuugagacagagucucgcucugucgcccaggcuggagugcauuggcucgaucucggcucacugcaaacucugccuccuggguucaagccauucuccugccucagccucccgaguagcugggauuacaggcaugcgccaccacacccagcuaauuuuuguauuuuuaguagagaugggguuucaccguguuggccaggauggucucgaacuccugaccucaggugauccaccugccucggccucccaaagugcugggauuacagccaccgugcccggagcccccacgcccggccaucucuuucauuuuauaaggacaccagucacugggcugggcccacacccaucuagguuggcuucauccuaauucaguuacacuggcaaaaaccccauuuccaagugaggucacaggcacagguucugggggucagagcuuccacauguccuuuuuggggacacacgucgccuuauggcaggugugauguaucuccuccaguauggacaaccaucuagcagugggauuaugacccagcaggcauggcggggcuggugggaggagguuggacuuugcaacuggacagacuuggguccuggcaccggcugugucaccugcuggcuggaccucaggauaccaacuggccucuuaugccucgguuucucccuugguagaugagggugacaacagcacgucccauggggcaguugugaggauuuuguacgaggacaggcaggagccaaggacagcuuuagauuuguugucacuguccccgugccugccaggugauugcuuuucucagaggaugugcaggggcaggagccauggaaauaacggucacuccacguggcauuaauucucaaaggugguugcuucucagacacgaaugaaccuccuuuccuuugguuuuuucuucagggcccuccaggcaaggauggacucccaggacacccuggacagagaggcgagacugugaguaucgagggugcugggggacguggcuggcuggcucucugaccacccugcacgugggcacagcccucgcugcccagcgccaucuaggacccuccuggccugggagagacagguuggccucagaaaggcucccaagggccgggccggcuuccgcugacucagagccaggcugugaggcagggccagggcagagcagucaugcaggccggcagcgccuuauggcaucugugggcagaaggcagguguuggcuuugggcugguuuuggaaacuuuggugagaggccacauuuaaagacacacacagauuauccugggccgacugaagccucaugcauccagccuuauuuucccucuagaauaaugcugagugcuaccccgcuugagggauacgucuuuuaauugagaaagugcugggaaagggucuacauguuacucagcgucauucagucauucgaugcugcaauacuucaagagggcggcugugggccaugcaccaaccccacccacguucacccgggcccuuccagcuccaauccagggggucuggaggaugccugcaaugucccuuuuuacacuaaagaaaacaagcgccagucagguggaaguggccucuaacuagucacuccgcugggcacauggucuuuguagucagagacuccccuuugaccuugcccuucacuuuagaaaugcauaucacaggcuacuucauccagaccagaaaggacuccaguguuuucaguugggagaaaaagcccucaucagaaaugggaucauuuuccuggccccaucagcccuucgaaauuuggcccagcucccuaaagguguguuucaggaaagggugcaggcacgccuguaaccuggcccacaccuacaagcuuggggcuccaggcucugaauaucuggggacgugcagugucgggugacuuccucgucaccacgcuguguuccuucuccgagugcccaccuacucuguccagcuuaaaggaugaauugcacagaugcaaacauuucccacagaggagagugaggggcaugccaggaucacugcaagggucccugcagccagguuucuagggaucaaggucucuacaggacucucccagcaaaagcagguccccucguggaaugggucucugagugcccuguugaauauauucuccaugccugcuuugaaaaaauccccuuugucucucuuugguucaucgugaugaaaccucuuuuaauuauaccuucacugguguucugcacggcgcaugcugccugauaaauggagauugcuuugcucuuuuguuuauagagaaaaauuaaaacauuucuucugagcuuugcauauuuuucucuaaugccuuuucaaggagacaagauagaagguuuuacauauuaugugcuuuucucccucugacuuauucuggacggaggcuggugaaagaauuaagcugcuugucucugcucagaaaguugcacauguacuuccggcugccuucugccaccccggccaccucucuagacacauggcgcuggagugaugccugugucucugagagccacuugggacauagcaucuccuccaugggcuaguccagacaagccuuccagaaagagcuucucugcaguguugauuuccuucuuuuuuaaaaauaugaaacaccaacggucauuauuucuccuaaaugugagccagaaacuuauuucucagcaaagggcuaaggucauauucuguccucaacagccaggguggccgagggcccuggggaggccuuuuuuguuucguguuaacuuugacauuagcaaaacuuaaccaaggcuccgaucucccuucaggcucuugagcucuucuccccggguccacugagcagggcaugcccuugacacccauccaccguuccuuacuucugaccccauaagugcaaugaacauuagaaacgaucauucuagcccacagcugagcugggcuuaaagaggcgagcccuccuagaguuugcaaagaagcuaagucugggcugggcacaguggcucacgccugcaaucccaacacuuugggaggccgagaugggcggaucaccugaggucgggaguuugagaccagcccggccaacauggugaaaccccgucucuacuaaaaauacaaaaauuagccaggcaugguggcaggcaccuguaaucccagcuacucaggaggcugaggcaggagaaucgcuugaauccgggagguggaggcugccgugagccgagaucgugccauugcacuccagccugggcaacaggagugaaacucugucucaaacaaaaaaaaaaaaaaaaaaaaaaaagaagcuagucugcuguggguucauguggccccguggcuuggugugagguuuugccucugacugcuggacagugagucagugagcccaggccugaggccgcucacccuccagcccuagcuuggccucagggccagccaccuucuccuccagcgucuagaguuugccucgaggccuccggguagaaggugugcaugucuccaccagugucauguggcaccugcagauggcuucucgcuggcaccugucaugcucugcagacgugccuggaaaagaagcuuauguugccuuaaggucaucuuucuccuuugagggagaguacagaagucguggcgacacccacagccaagccaggaucguuaucuacgcgugagcaugcagagcgggcgugagauauucccgcugaaucaagcuaaaaauaacgcauccaagcugccgaguuaugaaagcagcuggcccucgcucuugccuguuuuaaauacaugcugaggagcacgcgggcagagucacccgucgugcaucagaggcguucacgccaaagcaggucagucgucacagagccacugcugagaaacagccagagguagucgcggguccagaaagggcaccaagccaacucagaaaaggagcguuuggugacaugauaaaggcgaaucgcgucggccuaaagaugcagaggcaggagagcagccagugagaugagcuuguguggcuucguuacccucgugaaauuagugcaaacgcacgguggcucacgccuguaauccccgcacuuugggaggcugaggcagguggaucacgaggucaggaguucgaggccagccugaccaacauggugaaauccugucucuacuaaaaauacaaaaauuugccaggugugauggugugugccuguaaucccagcuacccaggagggugaggcaggagaaucacuugaaccugggaggcagagguugcagugacccaagaucgagccacugcacuccagccugggcgacagagcgagacucuccaucugaaaaaaaaaaaaaugaaacaagagacaugggccucuuacacaaagucuggaacaucuacucuggggggaagggagguggggggcaagcguccugcugagaacagugcagggcaggguggcgcaggccacugcagcaccgucagugcagugacucucucuucacaggguuuccaaggcaagaccggcccuccaggcccccccggcguggucggcccucagguaagcuccagccuucccagauuccaugggucacucggugucacuugcccacagggaagagggucccagcccgggcaucuguucccuccacgauuccggaggugcagguacugcugagagguuaucuuagguccugaauguuggucagcgugaggcucgccccacgcaggagcaagcacagauguguuugcccucaacacaaacccaacacgcagggcaaggaaggcugcccaaggcucacaggguggcuggggccagaccugggccagcucaggagcugggcucaucccugcuguggguguccaaggcagccgaguccuccugccacuggucccugugggugucacgggccugcgauucuaaccgcagaccaguggcagaucagugucaggggcagcuuagagccaggauugauggcuuagagcugcagaacggggaggggucaccuuguguccuagaaagcgcacaccucauguagcggugaguaagacguagaccugcugcagccacagaacugaagggcaugugggcucugccccugguguggcuuuucucccauccuuggccuguccuguggcugaaucagccucccucagggcacaucccaggaaggcaggcuuggccgugccuccugaaggcgccaggugggggaagagggccacgcggggcccagcagaugccaggcagugagcagcguaccaacacccacccucuagauuuuugccgggaagagaaggcuugcaaaggcacuuggagguuuggugugcccgcagcagaccuuugcguccaugaccagggcuguccuuagauuuaggaagagauucucacucccuugcaagucacucgaaacgucuguggcugacacugauuuuccccacagggucccacgggagaaacgggcccaaugggugagcguggccacccugggcccccuggaccccccggugaacaggggcuuccgggccuugcuggaaaagaagggacgaaggugaguuucuggagccuucugugucagcucaggcguuuccucaggaaucauuuugggacuuuguguuuuucuugcccuuuucugaugaauggguaauucgucaaacagacgcuucucaugccgguucacuccccagaccgcacguuuugcucacuuuuccuugauucacuccaggagucgcgcugaccugcucagggaugggcuugaagggggagcgcaggggucaccaccauccuccacccucugcucucuccccagcugccagcccugcucccagaaauggauaaaaagcucugggacuucauguguccauaacacguuuagcagaaagugguccuuuuaaaaaccccucaccccagccaggugcaguggcucacgccuguaaucccagcacuuuuggaggcugaggcagguggaucaccugaggucaggaaguugagaccagccuggccaacaugacgaaaccccaucuguacuaaaaauacagaaauuagcugggugugguggugcgcaccuguaaucccaccuacuugggaggcugaggcaggagaaucgcuugaacccgggaggcggagguugcagugugccaagaucgugccagugcacuccagccugguuaacacaaaugaaacucuguuuuuaaaaacaaaaaacaaaaaacacagugaaaccccguuucuacuaaaaauacaaaaaaauuagcugggugugguggcgggcgccuguagucccagcuacucgggaggcugaggcagcagaauggugugaacucggggggcggagcuugcagugagccgagaucgcgccacugcacuccagccugggcgacagagcgagacuccaucucaaaaaaaagaaaaaaaaacagcccucaccccaagagccugagaaauuauaaaagugaaaagcaaacguguuuuuaucccaccucuuggugccagcuccaacugcccccuuuucauaucuccuccccugggcgccccagguucacuggccauaacuugcuguguuagcacaaaaauagcccuucccuuucagcucuucaauaaggaaugcaacaaaggcaagcucuccagccuguaggaccacagaagaguaaaccugaaaaauaauaaagugaagcaaaugaagaaauacugaaaaaaaucacacacccgggugugcauguagauauaggaauaaauacacauguguacaugcacacguguguguauucuagacacaaagagagcucuccgagcuuggaaaggcggccacgggcauuugaccugcucguuugaaaacagcacugugcuccauguuggaccccagagaacauuuuggaagauaucaaagcuuuacuguaccucagggaaagucgaggcuaaggggugacuuuuuuucagaaaaugugguuucgggcuugaagaaguuccuuaagugauaaguccauuuaggacgaugcuuuuaaugcuauuucgaccauggauuucuuugucugagcacggucuuacaaggagccccaaaucuauggaaaagauagacgugcccucagcucccacauggcccaucguagcccuuaagggccuugggaggaaggaccccggaacuccguggagcagggguagagucagauuugcacgcagagcccgccagaugagcguggcuuccagguggaggcucaggcugugcucccacgugugggcugcugaguccagucacgacucugaaaaguggccaggagaagcccaauccaacccaaguccaggagugucugaugagaaggccccgacccuuggccuugcuccggggcuggugagaggucugugucgcuggcuccaggagagaaggccccaacccuuggccucgcucugggacuggugagaggucugcguugcuggcuccaagagagaaggccccagcccuuggcuucgcucuggggcuggugagaggucugcgucacuggcuccaggaaagcucaucucugacucuguuuucagggugacccaggcccugcaggccucccugggaaagauggcccuccaggauuacgugguuucccuggggaccgagggcuuccugguccaguggugagugagaggccaggcggggaaugaaaugggacaggugcagcccuggaggccucuccccacgugcccuugaccaaccuuuucauggcuuugcagggagcucuuggacugaaaggcaaugaagggcccccuggcccaccaggcccugcggugagucaaagccuuugucccauccucuuucuugaauccuacucuccaggucagaaggggcaguccccgagagcccagagcaugcagcugccccagacccccgaggagccuggggaggauguggaggggggaaaauggccuucagggagaugcggacggcgcaucccaagcuggcagccaggaugacgaagggucccaggggcacaccgaggaaaggagagugcugggcagccuggagggcgggaggagccacucuguguugccuguggagcaugcucccuggaggagcaaggagaaagccuacacaccuaucgugggucugggcugggccagcaggggaagaaacagacacgggucugcagggacucugaagaugcacgcuaaagccaggcugcccacggcgggggcccacugggcaggauggcccucacgauuaggccagguacccacccauccauaugccagcccccaggcaaggcauccccuagaaaacgcaccccauggaggagcacagcagagaggggagugggugccccaugggcaugggggcccuggaggggagggguugcccugcaggcaugugggcccuggaggagagggggugccccgugggcucuagagggaagggggugccucacagacaugugggcccuggaggagagagggugccccgugggcagacccucaaggggagggggugccaggcuucuagaagagggagcccauugaaggcaagcacaccacagggcacacugucagacaccagggggaggagcaccugggagcuuggaguuacaggaagacacagagccccgaacgcuagaccagguagucugugcuugcaaagggccauagggagccacugugggcucuagagugagcagguaaguggagugaucagcuggugcuuuacaaagucacgaccacgcagucugagagccuuugaagcagacuguuuucuugcuccaccucagggaucuccaggggagagagguccagcuggagccgcugggcccaucggaauuccagggagaccugggccccagggacccccagggccggcaggagagaaaggggcuccuguaaguacugccuuggauugggggagcccuucccucagagaugcuggggucguuccgugucuggccuugucccucccccugugauguccccagggguauuuccuugggauuggggaugggguggggucugcggcccucuaggacagagcgugugucccaugggaaccuggugaccugccugaggagcacaggaggaguccuggugccggccacauucuuuccgccaucagcugagccagaggagcccugugggaugauguugggccggucucagccuguccacgcgugcaugcugguguuccccacaugcguggacagaggaaggggccgaagacagucagugcgcuguggacuuggucuccguccagccucagugccaccuguguggucgggccacagcugcccacugugugaacuguucccugcugcuggcccagacccauggcugggcucuuccuaggaaaggauguuuggaaccggggaguccuguuucuugguuggggggcagguguagagagcagauguccagcaaagaaggggcaggggauggguggauaacggaaagacaaggcgccucccucuguguccaggaaagcccaccugcugguaagccccgaauuuugcaggcuuugugaagccucgggaguggggaggagcaugucuugaggccacccagaucuuggucuccaagaaggagaugagcgagcgcccuuuuugccuagaugcuuccugcuagccugcuuucgugaauaacccacaaaaugccacuuaccguccagaagugguccacccugacccguauuuggcuucugccacacaauuuugcaguguccccuaccucugcauucaaucagcucuggagaccaauuuaaucucaacuucuccuucccaguacagagggucagaaugagcuugaguucuccaggggaauuggcagauaaucggugcagaccaucucaaauugaguuaggucugagugcugauuguuagaaagcuguuuucuuucucuuuuuuugagauggagucuugcugugucacccaggcuggagugcaguggcgcaaucucggcucacugugaccuccaccuccuggguucaagcaauucuccugccucagccuccccaguagcugggauuacagaugugugcuaccacacccggcuacuuuuguacuuuuaguagagaugggguuucgccauguuggccaggcuggucucgaacuccugaccucaagugaucuacccgccucagccucccaaggugcugggauuacaggcgugagccacugcgcccagccagaaacugugauuuucuuguacguuucacucucaguggcucauggguggcaggaacagccuacauucccugggcaggaacuucccuggaaaccacauuggaaacaucugggccauugagaaucuguucaauacauuauuggcaauuuuggugucuucuaaucauuuccagugaggcacccaggacauggauccagcuggauucugugccagaaaacugaagccaacugggcagucaguguauagagugcacacaaagucagcuggaaauggcuugguucacaguuucaagagaguaaauauuugagcagaaaccuugcaagaguugcucuauccaggcagaagcucgucauccucccagaauagcuccagagggaaggaaaggccaagcaaagguuggacgucucugagaacucccgaccugaccaggaauguaggacaggaagcuuccacaaaagccccacacguggucuuugcauucucuggcuuaaguaggguagacauuucuaugaauaggagcucaguuugaggagcaggacaugaauuguggagggaggaaugguaagacgaaauagugauggaugacuaaaucccggcuacauuuagaccagaacauugaauguacauucucuauuccauguuucccuucccaaugugcacacccuccuucuguguaucugucggaagauagggaucccugucugcagugagaaaauauaggcugcucacagagugaugcgauggcuggucaaacugagcaaagcaagaacuuaagaaggaucauuugagauuaccaagcaggcaguuaggaggaaaaugaaucaaaguuacaaggacaggaaaaauagugugugcguaugccugcaagcauguccuguguguguaccugugcgugcauacucauguaugcaugcacauacaugucagugugcuucuuuauauguccuuguguguacauguuggugcauauucacacgugugcacauguuggugcauauucacacgugugcacaugcgaguaugcuuguuuugugcacaugcaugugcaugcaugcauaccuguguacauaggcguguucacaugugugcauguaugcacaugugugugcguacaugucuucaugugugagcaugcauguccuugugugugugugcagggagagugucugcagagaauguaaagaaucagaaagcuggugaaagcuggagcucaggcuauccuggugacugggcuuggcucccggucacuagcuuagacaauccacauacaggcucaagaauuuggccggcuggauuuggauccugucucuacugcucacuaacugugccucaguuuccccaucuguaaaagagcagccuuuccuaggaugaguguggauuaauugaagcgaugcaccagaaguucaugguccaggggcgggcucagagucggcccucaguggcccuggcugaaauccauuaggacuguggggacggucacccucaccaacucccacuuccugccagcggaucccucucuuggguaaugagcugguggggggauguucccagguuggagccacguuugaccugagaucuucuguauucucuagggcgagaaaggcccacaaggcccagcuggccgagacggucuccaggggccuguggggcucccggguccagcuggcccugugggucccccuggagaagacggagauaagguaaggcaaauccagagugacccauggcugggccuggcugggcagacgggugugggggaggguggugaauuuaaaggacaggaugcuggcagguagagcggcucagccagcggagugaugccacacccaccccgcaguccuggcauuaggggaugauuucacagcagcccacugguaaaugguaauacacgccguccccggcacgcucgagggacuuagaaaccacacccuccugugucauuuugagguugccugcaacauuugcugugaguagccacagcagagaaaaaugcuccccgguccccccgaauaauuucaaauuccgaaacugcggagcccgguuuaaugagguuuugcucaguaucuauuuuuaaaugucuccgcuugaauuauccaggcucccguucauuaagaaugugcuuuauaauuccaaaacgauggcugcaggagcuugcauuuuauccuucauuuaacgcagacagugaaauuucgcugugcuguaacuuucuauugaugaccccucucuggggacauuucugacuuugucaccucugcauggauaaugccuuacaucuccgggcgggagacagccuugcaccgacaggaacaacagagaggauuuuaauaacuucuucggcaacauaguaauugaguugccuguuguuagguugucaugguaguggcccaauuugaaaaacagaguaaauauuuucaauaugacuuuucccacaucuucaagucuacuaaaagccugucgagcaucagaucgagaccucgucccuuuuagcccuuguauuaaaaaggaaaucaagcuaauauauggaaacauuuauucguaggaaaguuuuagggccaccuggaaaggacacuguucuuaaucuccaagaaaaauucauuacggggaacagaaaagguccaaacgguugucaagcuuucuaaccgaaucccccacaccuuccccuagggagagaucggggagccggggcagaaaggaagcaagggggacaaaggagaacagguaaguauuggcacgggggcgcgcggcagcccccaggucccggggggccucgucgcaggcuguaggccgugugccaugcacguucucuuccaacguugcugaugacuagcgggacaugcugugaaaaucucccgugcauguguguucccacaacgugugugugugcacacgcgugcauaucugggagugagucucucuguguuagaaugaacaggaagcauccaccgguuuugcgaaauuaaauaaauggaguguuucuguccuagagggcuuggguucugcagacacacccauugcccucugaggugagggaaccagaaugcuccggcagagacagcaccauugaccaaaugccuguucauuuuuccccuuuugguuuuuucaucuguucagaaauccuaguggguucuugcaaaaaccccaugacucugcuaccagcucccucccgaugagugacaugucuucuuauccuguacagccaggccuuucccccaguauguugauuccuaggcaagcaggauccgugcuccugggaggccugccacagaggcuguguccuucuuccagccguggguugggcuaccagggccaagggcacuguacccuccuugcuugccuccuucccauggucccaugcgggaggucucuugaggauggcacagcaggggacauggugcugggcgcaagggcuccagaggagcuugugauccuggacccucacuguugaagggggccucacgugccccuguugugggugcaugaugggagcugagaugacacacgguggucucgagagacauugggggcagcucuuugccauccagaaaugggcucaggguggaaccaagauccucaucugcuucccagagccugcagcaggcuugcaucguggugcaaggaacgacacauuuggagacugaacugacgacguuggaugcaucaguccccgggcucaggaugcgguccaccccucccucagccuuauccacgauccaagaagcuaccuaugucucugucuuguuccccgcaggguccuccugggccuacagguccucaaggccccaucggacagccaggccccucugugaguauccauggucaaugaccuucgaaaagccccacgcccccccagagcugcuggcauugccagcauccucacccauggccgguuauuucccugcagggagcugacggcgagccggggccucggggccagcagggccuuuucgggcagaaaggugaugaaggucccagaggcuuuccuggacccccugggccaguggggcugcagguaacugugggguucucaccacaccgggcuccuccgcuucugacgcccccugugucuucauugugcucucuccucuugucuuuuuaagaauggaaaacuaaagccaggcugcagggggccuccugggccuccucauuccaacuggaagugcuguagcuucccagaauuccagacaugcccgcauuuaccacacuucagcaguggcauuuauuucugugcucauuguggaaacugaugauucgugagaaacauaguaacagugacuucuaaaugcaccuccuagagaugacaacgauaaacauuugggcauguuucauggccaugccuuuuaaauguguguauucucaugcacagaggcgcauauguaauuguauuugguguuugacaaugaaucaugucauaagucagagagaaaguuuguucccagcuuuccccauuuuccauccuccauucccguuuuauguuacgaguguguugaaugccauuacacaugacuuucuauuuauuuggaaaacaugauuuuuagucacugcacaguaagccagcaucugguggugacauaauuuacccaggcguccccugcuggcuccuuaggcuuuauuguuuuauggguuccugccauaaucaccuuugucguaaaucuuugcaaucuucucugcuuauuuccucgggccgauucugagacugggaaccccgggacguccucguggguagcuaugcacagagaagcaccuucccggggcuucgggggcucaguggugcuguguggguggaggucgugaaagcuguguguguguuugacauacacaugacagaacagcgcuuaacugggaaguuuccuguucucaggguuugccaggaccuccaggcgagaagggugagacaggagacgugggccagaugguaagugugccugagacuccaaggccuugccguacuagcggcucauguuuuggggaaacauuugcguuuccucugggcucaguggucucucccuuuuccuagggccccccgggucccccuggcccccgaggacccuccggagcuccaggugcugauggcccacaaggucccccagguggaauaggaaacccuggugcagugggagagaaggugaggcucgugccugcucugguggcagauuugcgguuguuugaggagugugugugugugucugugugugugugucuguguguauguguaugugcgcaugcacacgcuugugggggugcauacacguguguguaccucucuguguguacacagagaugagaaguacucauuucugugggcauggcugguuuauuccuaugaagggcauuuugaaauguaggcagaugcuugugaaauggaacugggaacucugacuguccauuugugacagccuuuugcagaauuuccagacgaugccccaccagcaaagccccugccuccuccaagacucagcucugguggagaucaucuauuccuuaaauaacugguguuucuaagcuugcaguuuccauuucagccgaauuauuuucucaaauggguccucuccauuugaucugauugguuuuggagcccagacuccaugagcgucauggacccagucgugugugugugugugccugugugugugagcuccugugugcacaucggugcaugugugugugccugcaugcugggugggacagcauuugccugacugcaaaagcaccucucccaguuccccuggacaagagggaagacagaguguacauccaugcacuugagcccccugugcaccguuuccagagcuuucuuucugacaucaaucaggccauuaaauuggaagacgccuuccaccgcugcucauuuuuuaugauacagaaauuaaagaggaauaugcccugcugagaccacagggugauggugugcggcuucugcucagagaggcgguguuuuccuugguguccccgcuguagggcgcauguuucuguucaccugcugccacugugcaugcccucuucccugcgucccucuggccugugucccugaggacugcgugccuguccuccugccucggcccuggccaucccccaccuggagugccauccuagccacuuaccagcuucucauaguugcccuccacaacccuuggagcagcgcuccgggaaagccuucacagacaguguugcuugcagucuggacacucugcccuguauccaucacgugccugccacauuccucacgcaccuccaauucugggaguguguggggacagcacuccccagaaaccccuggguccugggugcccaggggcaggcagacagcaggcaggauuuggcaaaugcuugaaaccguagcacugcguucaucgcggugcucaccgcugccauaaccacaugcacugucucccuagggcgagccuggcgaagcaggugagccuggccuuccgggagaaggcggccccccggugagugagcgggcgcugcgggaggggugggauauggccgagcggguguguggacggggugcuggguuggaggcucuggcucugccuuagcuuuuccauccacgaaaugggaguuguaaccccucuugugcccauuucauggaaugaccgugaacaaggugugugaugugggagucagcauguacacgcagaccuagcaauagcuaccugugcccaguggccugcaguaacucuacccucuguaguguuugcuccuggccccuucgcggggcagcugcugucaccucguccccccggaccuugagggccagacuaggaauauccaggccuucucaggccagaugaauguucacuaugaggccagcccaaagguggcuuucaggcccaggaccagcuggguggacucgggucuucugguucuagcugcucccuccccaugagauccguggagucugugggcaccccuuguggucuucacugacugaugucugguccaggagucagucccucccacccagagcugaaucucaggcuuugagggccccagaaagugaaggcuccucaggucccccucagggugcacacaggagcugauucugcccagggcuuggggagcgaccuggcagccagcccccugcagggcucagcagauacuuggaaaggcuggucugaauggggugagaaaaccggggaggcccaccuugcucugggcggcgacgugguuggcucugaggacuugacacuggccucuuuccuccagggacccaaaggagaaaggggagagaagggcgagucaggcccuucaggugcugccggacccccuggacccaaaggcccucccggagaugauggucccaaaggcagcccugugaguauuccagacacaccucaggggcccugcagcaggggcggggcucugcacugggaucauucugacucacuggcggugcacucugcucugagaacagcuucaagaccauuccauguguuggguaaauuuucuagacacuagagguuuucauaccagcuacugaaccaaaauaguggagaugagacagggcguggacuggaggagaaagcccugagugauucuucucugugggccaggcggccggcugagaugcacgagugacagccaggcuuugggaaguugcccccgcccuuggccggcccugauuuugcaucaggaggggcuucggagaggcacauuccggaagucugaagguccagguucuaguugcagccuggagcucccaggaauagaccugugggcggaacgccugccccuugcuuggcucuggaaagcaagagaccagcugaccccugccaugcccacuggccaggcuugcuggcucugggacaugcugcacguggaagggucucugggccauaaagugcacuggguugucggaacugcuggaaagucuuaggagcuggacgguggcagguggccaucuugagguggugacaugauuggccguguguggucucagucagguugcugauggccuuggcugcuuccuucuuucuuccuuucagggcccaguggguuuuccuggagauccuggcccccccggagagccuggccccgcgguaggugcucaagagggcaaagccaccggaucccccacagugcuggccugccucugccagccccauuuccccucuuucuggugguucuuugugaugaacucccacuggggcaggcaaugucccaaaaggcacucguguuccggugaucagagcaagaaaacgccuuugaccccacugaccaugcucugugcuggcaccagaauggauuuggguuuugggaaggggcuggagaugcauugggaacuggugcaugaacucagggugccauccgggguucagcaaggagcucgcuuuugccuccauagggucaagauggucccccuggugacaaaggagaugauggugaacccgggcagacggugaguccacaaucugggcuggcuuccugguggaggugucaguguauucuugggaccuugcagcuugcuugacucauuucugggaaaaacuccaaccuaguugauauugauuccuuuaugauaucgauucccuuaugauauugauucccuuaugauguugauucccuuaugauauugauucuggacagugacagagcucaugaacucccucugagaugcacgugcugucucagcagcagguuugcaggcagccccagggcuuccacgacccaccaugggcucgcccgggaacgucagaucuuacccacagcucugccuagcagggccagugccucuccucaccaggcccuuccugccuuaccuugaccgagaucacacuggacguugcaucugacgcuuggcguugaguguuuuaaacaccgcuucaagcccagaacgucuuucugggacggaucgacccccaugggcccugggcaggacugggccuggaggaggccccugaggccuugcagaugcccuugccccaccuugcacccagccuggccaagcgcgggggacugcggaccugagggcaaaggccaugucacugaguugagaggagcguccacucagagaagggguuagggaucuagccucgggcuggauuucccugacagacacccccaguccaccacuucccggccuguguccugggacgauucuuguccccccuucugugaaaggggaugccagugccucgucccugcccagguugugguggggaccgaaccgucauuguguaucaagagucagcacugugaguggggaaguucucuuccaaaaugcagaaaacccgcaggaugggaguugggguuccuuacgcugucacagcccgggugcgacacugucuuaggacccucugugcuagccccaaaagaagagagaggcggccgcagggcuggccgaggaguaaauagacugaaaucgccauguguuuugccucaauugagucuaacgggccccaauuccucacacucuguucuuucucccaauaccagggaucccccggcccuacuggugaaccagguccaucggggccuccaggaaaaaggguaaauaauccugcaggcacauccuugcugucaaaucccugcaugaaacacccccgccccuccccgucaccuuugcuugggcccugggugcucuaagcugcacugaugaggaagggcucggguguggcauguucuccacuuagccucggccacaucaucaccuaaucacaggcuugccaggucgacgcagcugcuccuuuuaggacaggccgccugcugacacggucagugauauccauggugggagaaagacacccgcaaagcugcaaagguccuuuuccccuggcucagguuuuacugaaaagccagaacaaaugagaaggcaucuuuugcagauugaaugguccagccacuugcugguggggcaguaaacagcugccuggugcacccaggacggaggccacacacaacucgcggcgugcacugcgccuccccacguggccugagaggccuuuaccugggacuggaguccauaggacucaugcugaggacccgugucacugcggguggcccgggagcagccuccaugacccugcaccccugcccugcagcccggcacacccugagcaccugcacccgagcucgucccucugccccugcaggccacacacacacacacccugagcgccugcacccgagcucgucccuccaccccugcaggccacacucaccaccugcuguucucuugcuucuuucagggucccccaggccccgcaggccccgaaggcagacagggagagaaaggggccaagguaacguguuuuggagccaggcugugaccgcguagaccucccccaggggagcccagaggguggggaguggacaagcgugugggcagagauguccauggaggcugagaguggcugccccaggggcaccuggcucauggccuaccuggggaggagaccugguucucucucaaggaggcagccaagugguggccacaagacuggggccgucugccuugcccaccugagggaggaggcggguggugggugcgggauucagggagcccaaggcugaguaguuaugucccccggagcccugcgaccucaugccuggucuuugagucggccagaccugagccgccuaccucugaaguggaccguguccgauggugaccgugucugcugcggggcccgugcagaagaugggacgccgucacccaugcaguuggcuuggggccuggcccagagcacacgggaggcuauucugucagugaggugauggcggcccggccuggcacugucugccucccuccuggaggcgccuguuguuaaggagacgggagguugugcgguuccaucccugcucgggcaguggcgcugugacacccggucuguggucggcgcagucagcggagacgggaucccugcuggccugggagaugaucgggauggagacuugaccagggcagcuuccacaggcaaugaaauguggagaauuagggcaaccccggauauggggucaccugggacuccuccagaggugcccaggguuuccgagcagugguccugggccagggugccuggagccuagagcuccggaccucauucugcccuccgccguccugcagggagaagccggcuuggaaggcccuccugggaagacuggccccaucggcccccagggggccccugggaagcccggaccggauggccuucgagggaucccuggcccuguggugaguaggcugugaggggcagagggguugccgaguggagggacgggggaccagcaacucaugcagagcgucucuguguuucagggagaacaaggucucccaggauccccaggcccggacgguccccccggccccauggugagucacauuccucauggugagcauagcgggugggaugacuucgccacccaaagccccaaggaugaggacucugaucccccugccuccucccacagggucccccaggacuucccggccucaaaggagauucuggucccaaaggugaaaagguaagaggggccucccugccccagcaacugugacucggggccuucaaauuuguggccgugggucucaaacucaacaagcucuugauccgucaccuaaaugugucaagcaccugcugcaggcuggugguggggaaccugaggggugacaaaggaaaauagacacgcuguguuugaggcuuggccccugccucugggggguccugagcagcucgggagaucccggaggccccugcgguauugacggagaaccuuccagcuaggcacagaggccccggcugauggguguccaggaucccagguugcugcucucccugggcugagcggccccagauccuuuccgcaggaggugugaggacauuucugcagugggagcaaagcccuuuuauuuuucuaacugcugggaauuguuuuccacuugcauugauuuauuuacaaacauaaaagguacucaggagugagaugguuguauaugaagcagaaggcagugagggcccucucauuuccacucugacguccgccaccacugcccccagccccaaggcaaaugagagcuggggcugccuugcgaggcuugcccuggguuccuagaagacaaacauagacagcgagugucauggauucuucuuuuuuuagaaaaacaacccaugauuguaauaucuauaauacucugcaucuuucuuuccgugucaguccacaaacuuuguuuuaguuccguauaggagcaggcguucggauuugccauaggaaauuggagagcguauacgaagagaaagacagagauaaacauuaccacucaggaaaaccccuuuaucacuuuggucugucucagugucuguggcucccugucuguuuuuagacgugacuguggccagcgaagggccaccucggaccugccguuucgucaccuggccccucuguugagccuguuccccuuccaggggaggcugaccaugauguaaagcuuccugugccauggcugugcugcgugcuaacuggcccaccguggccgagcaugaggcguggcucccucaaaugccccuuccugucuucauuuucccacagggucauccaggccugaucgggcucaucgguccuccgggugaacagggugagaagggcgaccguggucucccuggcccccagggcuccuccgguccuaagggagaacaggugcgugagauggcacuucuugcaugugggcugucgagaggcauuuuagaucccuggggcaggcacccaggggacaggaggcccaucagagcccggaaggacguccacacgucgguugaguccggucauccugcuuggcagaugggaacacugacgggcugggcuugcccaggugcacagugagcugggcagagccgucucccagcuccaugcccugacuggcaggcggggcuuccuccucaugaccguggugucccccagagcuggagggacucggaagucaggucauucugccugguucccagcccugugggagagccugucacccaccgcuugcccaggaggucacuggugacaaccagccguguuugccagagcugcgggcagaguggcuguucuggcuccugcuuccaccuuguccccagcugcccccaaacuguagcucauuggaguuugcagccucugcaaaccauagccaaggaaacgccaugcagagagcuucacucugucccacaacucugagugacuuggaaguggccuggggagggugacgugugccauggaggcaggagaggggaugaggugaccuguagugccucuguccuucccccaugagggccacggguccuuauuccugugugggaaucuuuccgucccgagcaaggugugacggacacacacacgcacaguaugcugugcccacccacgcccaugccucauaggaugcgggggacagggcaggagcaggcagagccccuggaggcugggaguaagguggcacccucacuaugggcccggggaagguugcaggacauggcugaaggguggagcucauugcaaacccuaccucacuggccaguguccuccaugccauugacuguuuuccucugccgguauccccaggccacagcagggucgucggaggagugccgcccagggugugguggcccggcaaccacgagaauuagagaggcauccaggguccccacggccagcggggaaagcaccccuguguccacccuguuugcucaccugcccucaccccaaaccauggucuuggcggcauugcugaugaaggugucggguuggugugcaggcuuggguaguugugggguccuuacaaugagccacagcccaaguuccugcagggacaaggugaagggagggaagcgcucccuccccagugaaauacggccaucagcccuccgcuacccucgcccccagcuucugcccggagagagcucugaguggaauccagggcuguagggagagaggcugcagguggcuccagcugcccguggcaaagcuggucaaagcuguucugugccagcagcucagucugggagggagucaguggggagaaggggucugagcggagguuccacgcuccaaggaugcagaaagcacauuuacaggcaggacaggacagucagcauggaugggacucccugcccaaccccuccgggcuuaguucuagaggggagacuaacaccaugagcaggaaacagcaagaggggcccaagccagggccacaaugucagggcagugguuucuguauuuccaaaugaacgugaaaagaggugcucagccugaaguccucgguggccugggggaugagagugaguuccuggcagcccagccgggggagcagugccgagggcuggcagccuugggguggaugcucaggucgauggcuccccugacaugcacagcccaggaucagaaagcagccacaggaggcugcugaggggccaaagggcauaccguggggaagggacaggggagccgagggguguggcuggguagcaggguugcagccccgcagcuccuccucgucugaaggugauaaccugcauuuucugguccuuuucaggguaucacugguccuucuggcccgauugggccuccugggcccccuggccugccgguguguaucugggaggggcuuggucauuccugggagggcagggaggguggggauaagccuuggggccucaguguggagcuagagaauuguggaaaagucacacgagaagcuggaauuggggccuccaggguggauuugcccauuaacucaacauugggguuccaggagacagaagaaaggaaguggcguugcccggccaugguuuuugguggggaagacagggacaggaaacgguggccauuucagggaacgaggccacuugucuguaggcaucuggggagggugcggaagguaguaguuggcucuccagcccucccaauucccaggagcccggccagccuggcccagacaagagcaguuagcugcccuccucuggcaccgcugccugggucucacauugcugggagacccagcauucccagggcauccccacagccgcugggcugcagguacacauggcccccgggggccccuggcacgcugagggcuggccccugcugugugcuaucagggcuggggggugcauuccaucagccccuucugagccaggacaugcucuuuuccgcugcgccccccccgcggcugucugagcugggguuuccuagccagggugggugguaggcuggccgggggcagguaggaccacccugugucuccacgaggggugagcaccagccaggccccgacccuccucccacucuagccgggcaaauacaagcauagacucuugagggggaugcgggugggagaggggcgaggggcgagaccaggcugggcaggacauggagcacgguggggcuggagcugagacccggcuugcugacguucugcccuccucucucugcaggguccgccugguccaaaaggugcuaagggcuccucgguaaguaacaugcugcccagccaggccaaugccuggaagguaggggagggcgacggguccccuggcacgggaacaaacuacccagacaaccguccuagcucaggcccugcugcucacgauccucccaucuuucuacacugacccauggcggacugaggcaggugggcugcucgccgccugcccuaggaagggcuccaucccucucuguucucaucucaaggauccaggaggguacaggggucucugccauucucuucucugcuguggcugauagggccaccucccccacauaggucuccagggaccauucuagagcugaagguggauucaaaguccccucauaccucugugaccaaggguugauucuuuucuuucuccccaggguccaacuggcccgaagggugaggcaggccacccaggacccccaggccccccgguaaguagcccuugaagcccagaaagcgggacgggggcucuggcuagcuccgagggaauugagaaagcaacugugugugugugaccccuccugagacucaugaagcccauguggcaugcccgggccuugucccucgcacgcagccggggaaaugagccacacaggucuaucacaggaagcuuacaggccaauuggcccugagaagaacagcuggccaggagagagaggauacacgugugugcugugugugcaugcaugguauaugaaugugugaacguguaguauaugcguguaugugacugggcacgugugugugcaugucuguauguguacgugcauccuguauaugugcaugcauguguaauguguguguacaugguuuguaugugcaugugugugugcaugauguguguauggguaugcaugcauauauguggggcacauaugugugugcauguguaguguguguauauuguauacgugcaugcauggccgugugugugugcauauguauauguguacaugcaugucugggauauaugugcauguguguguguguguugggaugggggagcacuagacaaggcccuggaggugaaaggugaagcccaguuugaaccagggcauggcgagugcacuauuggacaccccccuuugguuguggagucucuccaacucccaucgucaucuuagcuguggccuucuggaagugaauggcucuuugcaucaggaggcauucauguggccccacuguguucagccccagcuagggcugcagaggccagacuggggagaccuggucccuuuccucaaggcuuggccuuuuguguggcugagggcaggauggcagaugcaagcccaaggcugcaaacuguuaaguuucagcucuagagagaaaggagaggugcuccaugcuggcaagcaccuggcaguggggauggguguggaauguuccagagacuggaggaagggauggaaacaguucuaaggcggacagauguccauguagcccagguugccaggccccagggaaccccugcagauguggccccagcugucccugcucugcucauauccugggacccuucccauccuccaucacccaccgcugcuccuguucugucccccagggccccccgggagaggucauccagccccugccaauccaggcauccaggacgcggcggaacaucgacgccagccagcugcuggacgacgggaauggcgagaacuacguggacuacgcggacggcauggaagagaucuucggcucucucaacucucugaagcuggagauugagcagaugaaacggccccugggcacgcagcagaaccccgcccgcaccugcaaggaccugcagcucugccaccccgacuucccagauggugagggccugggggggcagggguggccccccaaagcgggcauggaccugcaggacacauggaguguggcaaggacaguucagccaggcacagcggaagggacaggacgggcagccgcagccuccccaucuguggggccggggugcgcaagagccuccccucuugaacuuuauggaggcaucucagggugaggccgggugcagaggccaaggcuuugaggucagacucuccagguucucaucuggucuuaggcauuuucuggcggggugaccugcuugaaccucguguuccugaccugucaaaugggaacagaaacaucucccaggaagaggacagaguugcgugaggcagugccugagaggcuggcacagugccaguggaaguaagggucaguguuaggaccggcagcagacgcugugcuugggcaaacggccuucaaacuccgcgauacuguaaaaacacauccuucuccucaccaucauagccucaggcaccaauugaaggauaaauucccauuagcuuuucuucccccugggaaguuugaauguucccccugcaagauucgagggauguucaugguuccaguagacucugauccuacaugcaugaauuuccagaguuccuuccagaacccucucugcauuucuguccacccagagaguaggccggaccccaacccuccuggccaccagaacacguacccaguugcuucaugcaccagcuguguucuuggugaaugaguuuguccacaucucuuuaugggcccagcaggagaagcaaaaugcaauaaaguaaaccccagaaaggcccguguuggcggcauuccuggggcgugcauuuuaacugcuggacugaaaugucacagcggcuuccggaaccauccagggagcaauccuucugacucugccugccucccuccccgucucugaaauccaggugaauacugggucgauccuaaccaaggaugcuccagggauuccuucaagguuuacugcaacuucacagccggggggucgacaugcgucuucccugacaagaaguccgaaggggugaguagcugugucccuccauggccccagcggggcaggcgucacagacagggccaugccgagggcuucaagcauuucuuguauaugcagcuuuaagacugaaagccagaaaugaauccguuucaucagugaaacuguucuuucagaaguagaccugaaauuguuuuaagaaauuuuuuaguaauaaaauagguuugugcagcccggggucaggaaggguuggagggcuuuccaccuggcauccugccgucccagggcugggacuucacucacugguugauaaaagcuuuucuccggugacucaguggucccacugaccugagacccccauuaaaacccuuuaaaggaauugggagcagguacaauaacgugagccugagacaucuuccggaagcugcccuuugccucaauucuuauuauccagccuguuucuguggguuggcccuggucccuccugagugcuuuguuuugaagucuguuuagugaagaauucgggguggggagcugggcucuguugagauuuuguggcaugucacuuaaauacccaccucuguggccuuucggaggccucagcgcuguagcaggaguuugugugcauguggauggugugugggcacauguggaugaguguguggaugggugugugaaugguguguguguguguguagaugcugugugguuuuguaguugggguguauguggaugguguguguguagauggcauguggaugaugugugggugcauguggcugguggauggguguguguaugggugguggaugggugcguguggcugguaugugggggugugugggugguguguggguguguacaugguguucggguguguguggcugguguguggguguguagaugguguuuggguacuuguggcuggugcagguguguggguguguggcugguguguggauguguauaugguguguggguguguguggcugguguaugugggugcauguggcuggcaugugcaugcauguagacgggcguguguugcuaucccucaagcaugcaccugaggcagguccagccuuggcccaggcgaggacugagucucccuguugcuccuggaaggugaccaagccugcagcucucgugccccugcaucagcuugaacggccucuccuucaugagcucgcaguugucgcguggccccaggcaaaggccgcccauuucuggggccgcagcgguuugcugugcagguccagaccugugcgccccugcagccucugcuuccuaacaaccucagugccccagaagcaguuuccugccaggggaagagcagcuacguucuccccagggaccgccauccccuuaccccucaaucacgcccugaccgugcugagcucaguagccacuuuggguuaggagcccacuggcugcaguggaggcugcacauggcuggagaucuguggggcuccaagugcagggguccccucccccaccugaaguuuuaacuccuugagaaccugccuuccuagugacaaacccuguucagagagaauccaaacacgggggccuuccaucucggcucucguuucccucagucuggccagaggccccgcguggaauucccuuagaaaagagguuucucggcccuccuucgcggccugccucugcaaauggguggccuugccgcuguggaaaucacgggccagacuccuccaaacucagagguuuccugggaagccgcggcugguguucacggcacagcagcguggggcugcugagcgaccccaggcucccccaguguugaccagccaggcguccacaggcugcagccucgggccugggcuacagcugcuuggccaagggcaaguggagacgcuuuccgagguggcccccuuggacccggaggaggcucacagcagaggcugggggagcccgcgcuugcccacaucccgggacucuuccaggaagaagcugccuucacgccgccugggcuuggcauugacaguggcagauuuggaaacgagagagggugggagagcucuggguggcgugagaggcagaugggacaccccuuuccuccaggggauccccuuuucuggccuucuuggcacaaggccagcucaagaagaaggcuggggggaucagccagggaucagucuucuguguccucauggcgcacaacgugagccccagucaguccaggcuggggacaggccggcccugggggcccuuccacuccacgccugcagcaagugcacccucaggcagccggggcuccccuuguccuguuuuugggacccagcgugcaggucuccccucagaggaauggcugcucacccacccauccauccguggcgucacugaggccugcccugcugggcccagccugugugucugcagccucggccucuguggaaagcaggccucaggugggagcccucccaggaagcgggcacaaguagugccccauggcagcgugagcuggcugcacaugauccaggcaggcagccgaggagcagcccucacccgcacacgucucaguccccaggaagguucuaccacacacacacacacacacgcagaugcacacuacacaccacacgcacagauacaggccacacaccacacauaccacacagauacacgauacacauaccacacaccacagagauacgcaccacacacacaauacacaccacauauaccacaccacacaucacacagauacacaccauacaccacacacauaccacacacacgauaaacaccacacauaccacacacacacccauaaugcgccauacacaccacacauaccacauaccacacauagauacgcaccacacaucagacacacagauaccacacaccacgcacaugauacauaccacacaucacagauacacaccauacacagacauuacacacagauaccacacacacacaccacacaucacacagauacacccauaacacacuacacacacaccacacaucacacacagaccacacauuauaccacacacacagcauacacagauacacaccacucaucacacacacagaugcguaccacacaccauacccuucacacagacauaccccccacaccaugcacgcgcacacacacacgcacacagucuggugccgcagcagccaggcaaggcugugaggaugggaugaggaugccccaccccucgccugcaguaaaugcuggcuuuuauuaccauucccuugguccaucauucauucauucauucguucauucccucccucagugagcguuuccagcagugacugagcaccaggcgcuggccuggggccuaacaugcaaaacgagaggcagagcgcacccuuccugggcagcagcaggggcuggagggcuggggccaggcuccucacauggccuccagucucuccgagggcuggggccaggcuccucacacggccuccagucuccccgagggcuggggccaggcucauccucacgcggccuccggucuccccgagggcccaggucaggcuccucacgcagccuccggucucccugagggcuggggccaggcucauccucacgcggccuccggucuccccgagggcccaggccgggcuccucacgcagccuccagucuccccgagggcuggggccaggcuccuccucacgcagccuccggucuccccgagggcccaggccgggcuccucacguggccucccuaagggccggggccaggcucauccucacgcggccuccagucuccccgagggccccggccaggcucauccucacauggccuucagucuccccaagggcuggggcccggcuccucacguggccucuagucucccucaaggcccaggccaggcucauccccccaaggaccugggccgggcucauucuccugugaccuccagucuccccacaagggccggggcccucaggcugcacugaaggcgcucgguggguccucccugcagcccccccggcgugaggaugcaggcgcgggggccgggaaagccuggggccuugcucuggaggccggagaaguaacccuuuuguucuguuucucucccuccccaccuccccgcugcauguuuaggccagaaucacuucuuggcccaaagaaaacccgggcuccugguucagugaauucaagcgugggaaacugguaagguggccucuggcgucuuugcgguugucacuuuaaacccgcccaucucguaucuuacagaguaaaauggcccgcuggcccaaagagcagccuuccaccugguauagucaguacaagcgggggucccugguaaguggccaccucggcccggccaccucggcacugccugcuugcggcacggcuggcucgcggcucugcauggcacccaucgcugccaugugugccacaccgcucuugccaaaccgcuccacaucacgugacagcaagacucagcuagguguggaguccucuccccagcccccgccacccugacaagaguguguuucugccuggaguaggcagaugguuuuccguuucuguguagggcgcgcagagcugggugugggccccagccugagcugauccucugcccacagacggugcagccccaggcaccugagcacugaggucagacgcuccagaagcaggagcgcuuucacugugucugauggcagggcagaggacacagaucccagaccacuuaagccauucagagcuccuucuaggaccugcaccacggauccccucuccccagcugcucagggcugagggcugucucucugcccaccgggcugcagauucccaguuacacugcacaccacuguacgagucacguuuucacuuuuggggaucgagucuuacagaauccaucccugaaaggaaacgacauuggccucccaggaaagaaccacauaggagguucuucuggccgguguagugcccaagagccaguuuggacacauugaugugaggacagcggcugcuucugccgcguggagugccccuaggaaccccaccggaguuugauuugggcccucuccuggaaugaagagcagaguucugucuuuucucccagcaaguuaaaggaccaagguuccagaacacaagacggguuccgggugucauuuauggcccagauucuccuuucccucccuucuugggauccaguggccccacucccaggugguccucaaaggagggccuugcucucagaaggcagcccguggguucugcggcuuguagccugaccacuugccauggguugcugcacccuggcaccagccccagccucccuggguggacacagagcacuggcccugagccgccuuugcccugucugcaccucugaagccccucgucucauaaccugaaggcauucacagcugauuauucaucucucgugcccucauuguuguugguuugaaaucauauaccagcuccuuugcagacacuccgagggucugugcucaccguggcuguguuucuggaggcuucccguuuugugguuugccguggacuugcaguccucuccuccuuuccucuccugcuuuuccuuuuccccgccuccucugugcuguguuccaaaaagagcugcuggcauacagaaggaccugaaacacccggggacagggagggcccgggaccagggcugcuuggcccggagggacagagcguaggggaugcugaugugugggaucaggcaaggaaggggcccugggggugaagcugcugggggccgagguggcaggguccauucugcagucuugcggguaguuaccgccugcgcuuggcacugcccucuccccgcaaugacagcucucagccuccaaaaagagccucucacagcauccuccaaaaugggaaaagcagaaagagccuauuuuccucgcuuggaggaaauggcugugaaaccucauuugcagccuucagcccgaguagcccauuuccaccucucguccuguuccacagagaguuaaugaagguuggggugaagggacgacccagggaacacaucagcuuacuuuaggaucuuuccacggccuuauuucuagcucugugaauaucauacguggacaagagguagaugggggccucucaaagauacccagauuuuucagccaggugcaggggcucaugcuuauaaucccagcacuuugggaggcucaggcgggcagauugcuugagcccaggaguuugagaccagccugggcaacauaccaagacuccaucucuauuaaaaaacaaaaugcaaaaaugggcugggcagguuggcucacaccuguaaucccagcacuuugggaggcugaggcggauggaucaccugaggucaggaguuuaagaccagccuggccaacguggcaaaaccccaucucuacuaaaaauacaaaaauuagcugggcauaguggugugcaccuguaauuccagcuacucgggaggcugaggcaggagaaucucuugaacccaggaggcagagguugcagugagcugagaucgcgccacugcacuccauccugggggacagggugagacuccgucuccaaaaaaaaagaaagaaaaaaccagaaaugggaauuuuaucugggcagggcuacccacacugcaccauacugagagaauacugcagagaaucccucccaccaggagagcagggccucacugugggacccugggguuccaaugcagggcagcgugccccaugccccgggccccccugcugccccaugggcacugggggcuucagguccuucuguguccggugcugcccaccgccgcucccuguggugcacacucuuccucgagucagucacguucccucccagaaggagcgccggacggcccagccugucgguugguauucacuuuuccuccucaagguuugcccguaagguucucguggcugcgucugaaagcguggaguucgccgauagcccugggacugcagcguguucccucgccccugggaaggcccaggccccaggccagcugcucacuuugggcuuuuucuaguggcaucuguugaaaaaguggguccugcaguguguucacccucuucccacucccggugcccaaacacucuuggcaauacugaagucaguucccuuccucuguucaauggggcucuuucggagcaggccagaggcaggguccaaaacacaccaccacgaggcagcgguugcauaggagugggcagagcaggucucaggugcuggcuuuagccugcuucauucccugaugcugcaaacaggacaggcugcccugcccagccaggccuucccugcagagaggguccuucaagguccugccuaggccaggagagaugugugcuucauuucggggagcuaagaugcaucgauguccccuggaagugucagguuuuucagaaaccuugaguuggcaacagagaugcaaaagugagaugcaucauggcucaggaugcccugcacgggccuugcaccugguggagcugagcagcccaguccuggauacccagcuagugaugcuggagaggccaccuaagaagcugcacauuguccucugaugccuucccuggauuugugcagagacugggagggcuuucagggaggaucagugucaucagagucccgggcugaccuuuggcacaggcagggcaggcagauggagccacuccugucucaggaagccugcucacugcccugaggagacgcuucugggaaggggaggaguggucuuucuugaguggccaugccagacaucauccgggaccccugugccuccaggaggauccccggucaccccagccaucugcacagcccugacccucccucaggcucgccuccccugagcaccucacuacagcuggcccgcucacuccccgaggccucgugccccguggcuccagcugcucacagucucccuggccagggccuuguacauccugggcacccagcagauggucguuuguucacauaaucuugugagcaccuuccuuugcugguguuggagcaugaugauagggacagggggccagagcuggaguggagggacaucgggagggcugggauacagaucagggucccuaagccagcccuagaggcuggagguggggaggagccuucccuaggagcaguggucuaggcugugacccaaaggacagcagugggggcaccuccugccagguggggagugucccaggccgagggaggagccgugcaguggcucaggggcagaaggaggacaccugcuguccagggcucagggagaaguguggugcagcugggagggggcucuaagaccuccuccucucacccccagggaaccuaaugccccucucuggcccugcaccccucuacucaggggaaaccagggcucgccugcugcuccaggugccccgacccagcgaucgggugcagagcucugcguuucaggaaugagaggcaggucuucaugcaagccauauuuuugagaaugguucucuguucacucaacacauacaaaccuggcagacccagaucaccaucugggauggaggcacccagguggcagaaggggagaagaacuguggguggacgugcagggagagcagcugcagcuggcacugcagugggugcuggcccaggagacacuggcugccguucaccaugcagcaaagcuuuaucaagcgcacacugggcagccauggggcggguaccacggccaguaacgagcaagaaggaugccauccugcccucucugaacuuauagucugcuagggaagacagacacugugacaaacuaagguuggggagggcagccacagaguaggugcaggagcaucuauucuggguaggcuuccuggaggaggcagcacaggugccgagcccugaaggauaagcauaagccaagagaaguggguggauuauuuaaggcccugaaggacaugaggcaugguucccuuuguuccugggaacacgcaagagagcccaugugcgcuggccucggccgggucuguggguacagugcguuuccagguaguucccccgagaagaccacagugugagugaagcccagggcagugcggacguggggcuuuguugcuguguguguccccacccugcugagccccaacaccccuguccccccagcucuccuauguggacgccgagggcaacccugugggugugguacagaugaccuuccugcggcugcugagcgccucugcccaccagaacgucaccuaccacugcuaccagucaguggccuggcaggacgcagccacgggcagcuacgacaaggcccuccgcuuccugggcuccaacgacgaggagauguccuaugacaacaaccccuacauccgcgcccugguggacggcugugcugugaguaucccgcgccgcgcccagcaccccugcucacgccuccguggggcucgcuccucacucagcacggguuuaccuguccccaagaugccugccagagggcagugagggccccggaccagacucucgccccaggcagccccacaguugcagggagacuaggaaucccaggccuaugcagcuggagcuccgggaacuugggagaguucuguggguuaggaugggaaaucugagaccuggccggaaaagccaggggcgugggucccucgccccauccagggcuguggcguggagugaggaauggaggacccguugugguuccaguuuggagcugggagccucccucuccuuggacagggcucuucugggaguggccagaacuaagcugggccuguucccgagagcacggccgucuggaaacacugcagacaguugccagcucuccggacagcccggcccaugggcccucuccauguggggagagcuguucuggucccagacaagggaauggaggccggagcggcgggaggcuugcugagaccucacgggcagucagggcugguauuggcgcucauacccaugggccuucccacaugcacgccuuuccccucccuacucagugagcugggcucaccuccgcuaagguccccuugagacugccagggccaucgcacaggucugggaugugcccgcguguccuggagguguuuagggugcagcugugccccaagagcccaggccugcgggagccucagacaugucccccucguguggccuuuuagaggcuggaggugggaaucgcugagaauuccagccugugggucuuccugucacugacauuggagccuguucucuccaccacuuauucuugagagaccugcggaaagcagcccuuagcgccucgcuccuuuaguguuuguagaaaggcacgccugaggccggguaaacgggaagcgguuuacuccgcucccagcucugcaggcuguccaggaaucguuguguggugccagcaucugcguccagugauggccccaggcugcuuccagucuugggaaggugaaggggccaguguguggaaugcacaggagagaggaagcgagggggugccaggcccuuuuuaacaaucagcucucaugggaacuaguagagugagaacucacucauuaccccgagggcagcaccaagccccgugacccagacgccucccaccaggcccaccuccaacacugggaccacauuucaaccugagauuuggaagggaugaagguccaagccauggcaccggcccaggccagcuccugaggggaacggggccggcguuagggccggcccugcagggugcccucuucugagcaacacggauggguccucagugugaggccugggcaggcaggaaagccagaggguggugccgacugagagugcaaggccugucuguagcccugggagcagaguggaccuggguuccaaucccgccucccccugcccagcaucgcugcggagcaccuggcccucacccauaggacgcucagcuccuuuucucugcugcccaagggcugcacugaggguuaaagcugugucucccagggccaucccgcggccaggccgugcucagcgggggccgcccucaccaggagugcucaccucuccucccggcugcuacugccuucugcgauugguuggggucaguacuucggaucugacuguggaauaugcagaacucaucccuguguaagguugauggauccagaucccuggaaagaggcauuuaaaaaugccagggaccuuacccguccuccccaaaugaguauaacauagcaccugccucacagggcuuucuggggagcaugucaaaccaugccuuuagagcucggaaucgugucugacccacugcaagcccuggaugagcagccaguuccugugaauauuuuuagauaacauggaccacaaauguaaggcaguaaacauggaggugaagagaaaucaggaacccuguaaaggcgaggcaggaccuggagggacagccuccugaguuuggcuuugagcuuccuggcuuccauggcaaaaagggaaacuagcuggcccaguggguauugucugguaaagggagaggaacagcuuuccagagaggggaauguucccuggaagacaaugcuagaaagauggaucccacgaaggacccuuggagguuaaagggcaggccagaccccugcucccuaaucuggcuaagagaggcuucugcugcuuuuaagaccuuccuggaagauccaacuucuuccaucccaguuccucuugaagcuccugccccuacucauuccaucagcaaagcccacuucugcgaggucccagaagucuucggcaaugcuuucugacucagaaccugacuuccuggcuccaccugcauccugggauagggucaagcugggaucauuuaaauuccacaagcagagagggcucuugcucagcccagugucucccggugaugagggugugcuguuggcaucuggggaaguguggccauugguuugcaagacauuccacuuugccagucucgggugugccaaacgccuccagaaacacuccccacguccgaaugcgaaccaccaauacaaguguucccuucuuucuacauacgcaaaaccugaggcccagagaguuacggcgacucgcccaaggucuccaggugugacagagcugaggcuccuaauucccacugcagcauucuucucaccauagccccuuccuggcauagcugcaccuugaauaccucaguugacagugaucucacuaccuccugagacagcccaggccauggcugcagagucucaggaugaggaagcucuuccgagaacugggcucaagucuacuuguacuauccgcccaucgccuccugggucuggucccgucagccaugcagagggaaccggguucaagagcaguuucccagcccaagccuucugacaucaaggcccgacggcucucugaugguggacagcaggcuguuuggcauucucggccuccacccacuagaugccaguaggagcccccuaccgagugacggcaacccagaaugucuccagacacaucucccaggggcaaaaucucccccauggagaagcacccuucuacacacagaacuaaggugugaagggagcgcagaggguucaccugcugcaagggcaaagaggaccugcuccuuccugucucccauggaacccaaagaagcuggcacuucuggggugagaucaggacccucaaagccgagaaccaagugcagcugccguccagaccgcgccaccuucucaggcagucagcagcgugggucugguuagccgcccagugcugcaagugccaccccaaaaggagacccuggcucacucucucgcccccuuccccauggcaggcguuccugaguuccacaacuguccuuggaagugucucugcgugcagaggagggauugggaucacggggauacccagacugcacucugggcagggagaggagaagcagcccccuccccagggcuguucuacuucuggaaagcaaagauucugacuuugaaaagauggagagagaauggcccaaaacugccuaaccccagauggcaggggcaggcucugcggccaagcuggacaggugguuuggguggaaaggugggcaguggcagcagcguggagcuggggugcggggcggccauggggguggcaugcagggacgcuggcccggacucucaggugcccugcugaccccagucccugacaagcccaaccacaauuugaaaagucacaaccgucucauuuaauuacggaggcugcugcaggaggcccugaugccccgaacucgggccagcggcaaaagcccugccucagcccccggaggucugcaugauucauauuguaauaacggccgaagaaauuggaauuccaacgcgggcaucguuuggcuggggcgccugauugacggggccgcugagcgggcccaguggagaggcacaaaucaccugcaagagggcccaggcaccccgccgcauaaauccugguguuugugcagcuuucggcgccucuggggggccguucuggccuguaaugguuauuuauaccccuggaauaacgggguaacagagcggcucgcagcggccuacuuuaaauacgccccucucuaagcacucugauaauuggagcagaggggucccauaaaucccaugaaaucacccgacagcucagcaaaugcugcccgucccucuggggagagacuggugccaucgcugagaagggcugugaccgacgccacugcugagaugaacugcuugcccagccucccagggguggaugagaaaggccgggcagcgcccugcuggcuugcugaccugucgccgagcucacuuggcuccccaggacagcgccaccuugcaguggcccagugaagccaggcccaaccaucucacugcacucccugggugggacugggccagggagcagaggccggaggagaggcaggcaggguggucucuggcuccucgccgguggggagggugaggagguugguacccucaggguucaccccuggaggguguggauggccaccucucauugaauauccuguguccagccccgcugcccaccuauccuucccagccaccgcagagcugcaacuggccccugcccuccguuccacaggagagcuguggccacccccaggcgggcuugugggacagcagcaucccagcuguguucugcagggcugagcuggccacagggugccgucugccccacacucggcauucuguggaacuguguguuuugcugucaaguccgggggugccccauggcgagguccuuuaggacagcguuucucaaaggccagucaugaccacgccuaucagaauugucugagacacccauuuuuuaaaaugcagauuccgagucccaccccagccagacggagucagccucucugggcaggggucagagcuguaggggguuaacaagcucccugagaacucgcguucucucugaaguuccaaucccaacuugaaaaucaugccaggcugagccagcugcaguaacagaaagguguuccuaucaaggcaggguugugagaagggcagggucaggggagaaguggacauuaggaggugaaguuugggacucucauggauaauagcaggaacgcaugcagggaggugagcuucauuccuucucacagcgccucugugaugugagcaugcccauuuuccagcugaggaaacugagucacagaaagcguaucgguuauccauugcuuguaaucaacuagccccccaaauuuagcagcuuaaaaccacagauguucguuacgucaccccauguccgagggucagaagccugggagaggugcagcuggcuggcucuagcucagggucugucuuagguccauucgcugccacgacaaaucucgccagcugcguggcucauaagcaacagaaauuugucgcccacaguucuggaggcuggaagucugugagcagguugcuggcaaggcaggcucuggugagcuccccucugggcugcagauagcagcuucucacuacacccucacaggguggagucucucgggugccucuuuuauaggggcacuaauaccacucaugggguuccacccucaggaccuccucaacucccaucgaacggccccaccuccuaauaccaucuuugggaacgggaacauuaagaucauagucagggagaauaaggcccuucaaggccacgcccuccccauaggucagggagcagaauaccgggagagcuggagcugcugucugcuauccgaaucuccggccugggagucugcgcugggcccucugcagggcugcauccuggggucacugccucccauccgggagggaacccuggcuggccccuacuuguuuaucugaucauuucuuuuggggauggggcaguggaaggagauccuucccaggcccagauccagcugcgacuguaaauccagucugggucugagguagcaaaagccaucugcccaggaugcguuugcaggcuccugguuugcgggaaaggugcggccuccagggcccuugucuugggggaaguugacgggacagcagggccagcucagccucaguuauaaagaacacugggaguuauauuuggguggcuuuggggagggaccaaagaaucucacaccugcgcugccuguguucugggagggaggcggccucuccuaggcuuccaucccacaucccagcgcccaggguugugcuguuuugagcaagggaugggugcugacucauccugcaggccagguucauugcacuaccccugcccucugugccucaguuuaccuaagacuccucuagaccagaugguguggaagguccccaccccuucccauacuuguggaggugaagacccagcccaccgagugccuaaggcaguguguggcagguggucguaggggggucuuacuuggcucaaggcucugccggugccgccucggacuccuuccuuuucgaaccuggagcccccguuugauuuuccagugugcccugcuuguucuguagcuggcccuggguccuggggaggcugccuggaagugaauaccuggggcaucacaaggagucuggacugggcacggugggaaggcugaucagcuucaauccugugugugccucagccaccccugaagccuugggaggguccugucgccucgcugaugcccacaccaccccaccuccgaccugugcagggggacucuugggacauccaccgggguuaaaugcaugcucugaucagccauauuuccuccaacacuugcccgggcaagcgcagcccuggguaggagacaggacaccagccuggguuuuggagccagacagauuguggggggugauugguaaaccccaagacccccaacuguucuuaaccaccggccaucugucucccucuuccccagaccaagaaaggcuaccagaagacgguucuggagaucgacacccccaaaguggagcaggugcccaucguggacaucauguucaaugacuucggugaagcgucacagaaauuuggauuugaaguggggccggcuugcuucaugggcuaggagccgccgagcccgggcucccgagagcaaccucgugaccucagcaugccauucguucgugagugucccgugcacguccugacccuggacagugaaggcuucucccuccccucccaccugacuucaucuacgccucggcaccacggggugugggaccccagcccggagagaacagagggaaggagccgcgcccccaccuggagcugaaucacaugaccuagcugcaccccagcgccugggcccgccccacgcucuguccacacccacgcgccccgggagcggggccaugccuccagccccccagcucgcccgacccauccuguucgugaauaggucucagggguugggggagggacugccagauuuggacacuauauuuuuuucuaaauucaacuugaagauguguauuuccccugaccuucaaaaaauguuccaagguaagccucguaaaggucaucccaccaucaccaaagccuccguuuuuaacaaccuccaacacgauccauuuagaggccaaaugucauucugcaggugccuucccgauggauuaaaggugcuuauguuuuugugaguuuuaaguaaauauuuguauuguauuguuauaaauguuaagugugccuggcuuucaaucaugcacggaaacccagucucagucccacggacagaaugggcgaggcauggauucuggguugcaguaccguucugauuagaaauaggaagucuccccacccccgcccuggccaagaacgugcaauaaauuggaaguuugccccggggcagcaagaauuuaugcugccauugaaaagcagguaccagugccccuuuucagacaguuuuugauucgcucuagacuuuuuuuuuuuuuaauagggaaaaaauuugauaauuuucuuuuuucuacaugcacuuaagacuaaaacacagguuuggauuaauuuuauuugcuuccuuuuuccgcuuuucuucccgcagagccugaugggagaauguccagggcagggaaaccacauuuuuuguaggugauaacucaaugaaaauuggugcuuauuuuuuacacuucucucuuguggcucucuuguggugcuaucuaucuguuuuaaggucuccuugaaggcgcacuggggacccuggccaugccucguucucccugcuuucuuuauccuguuauugccuccacagucuguugccaaggacucuaagaucaaugcacgucacuuuccuuuccacugggcaggauagccaagcacacucccuccugcgcucucccgccccggugcguccacucccgagggcuguuaugaggacuggguugugccuacuugauuugaaaacacacacaagcaauaaaaagccucuuccugcauugucuguggugugaccauagcagauuauauuugguuccugaauguuuguggugcuaauuucuguguuuguuccaagccguucagucaugccaugcgcugccucgguagauggaguaauguacaaugaacuccaugagucucuccagggcugccugcagcacgucuuuuccaaguagccuauuuggauucccaucucaaauguccuggaugcgagcgucagcggcuccagagcucggggcgggugagguccccuuuggggaacccuuuccuggccaucgaggucggggggcugccgucugugggcaggaggacccgaggggcagccaggaaaggcgaucucuucacugugaaaaguugcccgggugcagcgccuuuuccuucuaccaugggaaaugcaggcugggcccuuggggugagccugcggggcucuggugcuguccccgacccccaccaccaccagaaugcaguuccagcuuaggaagccacaaacaagccacccaggaggaacaaaacaccgccagcguggauuuuccaaauuucccuggaaaguaagucucgcucuugccaaagaaaagucuggcuuggagagucucuggagcccaggaugccagcaugugccaaugacugucaccuucaucucuucaaaagaaaagccauagccgaggacugucccgcgacccccguggacugcgucuaggucaugugauucuguuuucauuucucaucccauccaauuuguccuuuucuccugucauuuucuuccucuguggucccuucaaaguuguuauaauuuguacugaacuucaaaaugugucccguucuccccagaccacucuagccacaguauauugcaauaaaauuacuucuuauauuugcagaaauucuuuugguguaauuuuauuuuuuccucucaauauauauaauuggacaaacgcuggcaaaaagaaaaaaaugguaagcaaaaaacccaagauaaaguuucgaggacaucaggccuuuugaaauacaaugucaaaugacacauuguacgguuucaaaaaauccgcuagacaugucauaaguuuuaacuguaaugcccaggaaaggauaucuuaaaauauucuaaacuuguguaacaaaggaauaauuaacuguaauaguuuuucaauaaaucgaguuggguguuuccaccguaaacagau

SEQ ID NO: 13110 - RNA, 7237 nt, Homo sapiens
aggccccagggaaccccugcagauguggccccagcugucccugcucugcucauauccugggacccuucccauccuccaucacccaccgcugcuccuguucugucccccagggccccccgggagaggucauccagccccugccaauccaggcauccaggacgcggcggaacaucgacgccagccagcugcuggacgacgggaauggcgagaacuacguggacuacgcggacggcauggaagagaucuucggcucucucaacucucugaagcuggagauugagcagaugaaacggccccugggcacgcagcagaaccccgcccgcaccugcaaggaccugcagcucugccaccccgacuucccagauggugagggccugggggggcagggguggccccccaaagcgggcauggaccugcaggacacauggaguguggcaaggacaguucagccaggcacagcggaagggacaggacgggcagccgcagccuccccaucuguggggccggggugcgcaagagccuccccucuugaacuuuauggaggcaucucagggugaggccgggugcagaggccaaggcuuugaggucagacucuccagguucucaucuggucuuaggcauuuucuggcggggugaccugcuugaaccucguguuccugaccugucaaaugggaacagaaacaucucccaggaagaggacagaguugcgugaggcagugccugagaggcuggcacagugccaguggaaguaagggucaguguuaggaccggcagcagacgcugugcuugggcaaacggccuucaaacuccgcgauacuguaaaaacacauccuucuccucaccaucauagccucaggcaccaauugaaggauaaauucccauuagcuuuucuucccccugggaaguuugaauguucccccugcaagauucgagggauguucaugguuccaguagacucugauccuacaugcaugaauuuccagaguuccuuccagaacccucucugcauuucuguccacccagagaguaggccggaccccaacccuccuggccaccagaacacguacccaguugcuucaugcaccagcuguguucuuggugaaugaguuuguccacaucucuuuaugggcccagcaggagaagcaaaaugcaauaaaguaaaccccagaaaggcccguguuggcggcauuccuggggcgugcauuuuaacugcuggacugaaaugucacagcggcuuccggaaccauccagggagcaauccuucugacucugccugccucccuccccgucucugaaauccaggugaauacugggucgauccuaaccaaggaugcuccagggauuccuucaagguuuacugcaacuucacagccggggggucgacaugcgucuucccugacaagaaguccgaaggggugaguagcugugucccuccauggccccagcggggcaggcgucacagacagggccaugccgagggcuucaagcauuucuuguauaugcagcuuuaagacugaaagccagaaaugaauccguuucaucagugaaacuguucuuucagaaguagaccugaaauuguuuuaagaaauuuuuuaguaauaaaauagguuugugcagcccggggucaggaaggguuggagggcuuuccaccuggcauccugccgucccagggcugggacuucacucacugguugauaaaagcuuuucuccggugacucaguggucccacugaccugagacccccauuaaaacccuuuaaaggaauugggagcagguacaauaacgugagccugagacaucuuccggaagcugcccuuugccucaauucuuauuauccagccuguuucuguggguuggcccuggucccuccugagugcuuuguuuugaagucuguuuagugaagaauucgggguggggagcugggcucuguugagauuuuguggcaugucacuuaaauacccaccucuguggccuuucggaggccucagcgcuguagcaggaguuugugugcauguggauggugugugggcacauguggaugaguguguggaugggugugugaaugguguguguguguguguagaugcugugugguuuuguaguugggguguauguggaugguguguguguagauggcauguggaugaugugugggugcauguggcugguggauggguguguguaugggugguggaugggugcguguggcugguaugugggggugugugggugguguguggguguguacaugguguucggguguguguggcugguguguggguguguagaugguguuuggguacuuguggcuggugcagguguguggguguguggcugguguguggauguguauaugguguguggguguguguggcugguguaugugggugcauguggcuggcaugugcaugcauguagacgggcguguguugcuaucccucaagcaugcaccugaggcagguccagccuuggcccaggcgaggacugagucucccuguugcuccuggaaggugaccaagccugcagcucucgugccccugcaucagcuugaacggccucuccuucaugagcucgcaguugucgcguggccccaggcaaaggccgcccauuucuggggccgcagcgguuugcugugcagguccagaccugugcgccccugcagccucugcuuccuaacaaccucagugccccagaagcaguuuccugccaggggaagagcagcuacguucuccccagggaccgccauccccuuaccccucaaucacgcccugaccgugcugagcucaguagccacuuuggguuaggagcccacuggcugcaguggaggcugcacauggcuggagaucuguggggcuccaagugcagggguccccucccccaccugaaguuuuaacuccuugagaaccugccuuccuagugacaaacccuguucagagagaauccaaacacgggggccuuccaucucggcucucguuucccucagucuggccagaggccccgcguggaauucccuuagaaaagagguuucucggcccuccuucgcggccugccucugcaaauggguggccuugccgcuguggaaaucacgggccagacuccuccaaacucagagguuuccugggaagccgcggcugguguucacggcacagcagcguggggcugcugagcgaccccaggcucccccaguguugaccagccaggcguccacaggcugcagccucgggccugggcuacagcugcuuggccaagggcaaguggagacgcuuuccgagguggcccccuuggacccggaggaggcucacagcagaggcugggggagcccgcgcuugcccacaucccgggacucuuccaggaagaagcugccuucacgccgccugggcuuggcauugacaguggcagauuuggaaacgagagagggugggagagcucuggguggcgugagaggcagaugggacaccccuuuccuccaggggauccccuuuucuggccuucuuggcacaaggccagcucaagaagaaggcuggggggaucagccagggaucagucuucuguguccucauggcgcacaacgugagccccagucaguccaggcuggggacaggccggcccugggggcccuuccacuccacgccugcagcaagugcacccucaggcagccggggcuccccuuguccuguuuuugggacccagcgugcaggucuccccucagaggaauggcugcucacccacccauccauccguggcgucacugaggccugcccugcugggcccagccugugugucugcagccucggccucuguggaaagcaggccucaggugggagcccucccaggaagcgggcacaaguagugccccauggcagcgugagcuggcugcacaugauccaggcaggcagccgaggagcagcccucacccgcacacgucucaguccccaggaagguucuaccacacacacacacacacacgcagaugcacacuacacaccacacgcacagauacaggccacacaccacacauaccacacagauacacgauacacauaccacacaccacagagauacgcaccacacacacaauacacaccacauauaccacaccacacaucacacagauacacaccauacaccacacacauaccacacacacgauaaacaccacacauaccacacacacacccauaaugcgccauacacaccacacauaccacauaccacacauagauacgcaccacacaucagacacacagauaccacacaccacgcacaugauacauaccacacaucacagauacacaccauacacagacauuacacacagauaccacacacacacaccacacaucacacagauacacccauaacacacuacacacacaccacacaucacacacagaccacacauuauaccacacacacagcauacacagauacacaccacucaucacacacacagaugcguaccacacaccauacccuucacacagacauaccccccacaccaugcacgcgcacacacacacgcacacagucuggugccgcagcagccaggcaaggcugugaggaugggaugaggaugccccaccccucgccugcaguaaaugcuggcuuuuauuaccauucccuugguccaucauucauucauucauucguucauucccucccucagugagcguuuccagcagugacugagcaccaggcgcuggccuggggccuaacaugcaaaacgagaggcagagcgcacccuuccugggcagcagcaggggcuggagggcuggggccaggcuccucacauggccuccagucucuccgagggcuggggccaggcuccucacacggccuccagucuccccgagggcuggggccaggcucauccucacgcggccuccggucuccccgagggcccaggucaggcuccucacgcagccuccggucucccugagggcuggggccaggcucauccucacgcggccuccggucuccccgagggcccaggccgggcuccucacgcagccuccagucuccccgagggcuggggccaggcuccuccucacgcagccuccggucuccccgagggcccaggccgggcuccucacguggccucccuaagggccggggccaggcucauccucacgcggccuccagucuccccgagggccccggccaggcucauccucacauggccuucagucuccccaagggcuggggcccggcuccucacguggccucuagucucccucaaggcccaggccaggcucauccccccaaggaccugggccgggcucauucuccugugaccuccagucuccccacaagggccggggcccucaggcugcacugaaggcgcucgguggguccucccugcagcccccccggcgugaggaugcaggcgcgggggccgggaaagccuggggccuugcucuggaggccggagaaguaacccuuuuguucuguuucucucccuccccaccuccccgcugcauguuuaggccagaaucacuucuuggcccaaagaaaacccgggcuccugguucagugaauucaagcgugggaaacugguaagguggccucuggcgucuuugcgguugucacuuuaaacccgcccaucucguaucuuacagaguaaaauggcccgcuggcccaaagagcagccuuccaccugguauagucaguacaagcgggggucccugguaaguggccaccucggcccggccaccucggcacugccugcuugcggcacggcuggcucgcggcucugcauggcacccaucgcugccaugugugccacaccgcucuugccaaaccgcuccacaucacgugacagcaagacucagcuagguguggaguccucuccccagcccccgccacccugacaagaguguguuucugccuggaguaggcagaugguuuuccguuucuguguagggcgcgcagagcugggugugggccccagccugagcugauccucugcccacagacggugcagccccaggcaccugagcacugaggucagacgcuccagaagcaggagcgcuuucacugugucugauggcagggcagaggacacagaucccagaccacuuaagccauucagagcuccuucuaggaccugcaccacggauccccucuccccagcugcucagggcugagggcugucucucugcccaccgggcugcagauucccaguuacacugcacaccacuguacgagucacguuuucacuuuuggggaucgagucuuacagaauccaucccugaaaggaaacgacauuggccucccaggaaagaaccacauaggagguucuucuggccgguguagugcccaagagccaguuuggacacauugaugugaggacagcggcugcuucugccgcguggagugccccuaggaaccccaccggaguuugauuugggcccucuccuggaaugaagagcagaguucugucuuuucucccagcaaguuaaaggaccaagguuccagaacacaagacggguuccgggugucauuuauggcccagauucuccuuucccucccuucuugggauccaguggccccacucccaggugguccucaaaggagggccuugcucucagaaggcagcccguggguucugcggcuuguagccugaccacuugccauggguugcugcacccuggcaccagccccagccucccuggguggacacagagcacuggcccugagccgccuuugcccugucugcaccucugaagccccucgucucauaaccugaaggcauucacagcugauuauucaucucucgugcccucauuguuguugguuugaaaucauauaccagcuccuuugcagacacuccgagggucugugcucaccguggcuguguuucuggaggcuucccguuuugugguuugccguggacuugcaguccucuccuccuuuccucuccugcuuuuccuuuuccccgccuccucugugcuguguuccaaaaagagcugcuggcauacagaaggaccugaaacacccggggacagggagggcccgggaccagggcugcuuggcccggagggacagagcguaggggaugcugaugugugggaucaggcaaggaaggggcccugggggugaagcugcugggggccgagguggcaggguccauucugcagucuugcggguaguuaccgccugcgcuuggcacugcccucuccccgcaaugacagcucucagccuccaaaaagagccucucacagcauccuccaaaaug

SEQ ID NO: 13111 - RNA, 7237 nt, Homo sapiens
cauuuuggaggaugcugugagaggcucuuuuuggaggcugagagcugucauugcggggagagggcagugccaagcgcaggcgguaacuacccgcaagacugcagaauggacccugccaccucggcccccagcagcuucacccccagggccccuuccuugccugaucccacacaucagcauccccuacgcucugucccuccgggccaagcagcccuggucccgggcccucccuguccccggguguuucagguccuucuguaugccagcagcucuuuuuggaacacagcacagaggaggcggggaaaaggaaaagcaggagaggaaaggaggagaggacugcaaguccacggcaaaccacaaaacgggaagccuccagaaacacagccacggugagcacagacccucggagugucugcaaaggagcugguauaugauuucaaaccaacaacaaugagggcacgagagaugaauaaucagcugugaaugccuucagguuaugagacgaggggcuucagaggugcagacagggcaaaggcggcucagggccagugcucuguguccacccagggaggcuggggcuggugccagggugcagcaacccauggcaaguggucaggcuacaagccgcagaacccacgggcugccuucugagagcaaggcccuccuuugaggaccaccugggaguggggccacuggaucccaagaagggagggaaaggagaaucugggccauaaaugacacccggaacccgucuuguguucuggaaccuugguccuuuaacuugcugggagaaaagacagaacucugcucuucauuccaggagagggcccaaaucaaacuccggugggguuccuaggggcacuccacgcggcagaagcagccgcuguccucacaucaauguguccaaacuggcucuugggcacuacaccggccagaagaaccuccuaugugguucuuuccugggaggccaaugucguuuccuuucagggauggauucuguaagacucgauccccaaaagugaaaacgugacucguacaguggugugcaguguaacugggaaucugcagcccggugggcagagagacagcccucagcccugagcagcuggggagaggggauccguggugcagguccuagaaggagcucugaauggcuuaaguggucugggaucuguguccucugcccugccaucagacacagugaaagcgcuccugcuucuggagcgucugaccucagugcucaggugccuggggcugcaccgucugugggcagaggaucagcucaggcuggggcccacacccagcucugcgcgcccuacacagaaacggaaaaccaucugccuacuccaggcagaaacacacucuugucaggguggcgggggcuggggagaggacuccacaccuagcugagucuugcugucacgugauguggagcgguuuggcaagagcgguguggcacacauggcagcgaugggugccaugcagagccgcgagccagccgugccgcaagcaggcagugccgagguggccgggccgagguggccacuuaccagggacccccgcuuguacugacuauaccagguggaaggcugcucuuugggccagcgggccauuuuacucuguaagauacgagaugggcggguuuaaagugacaaccgcaaagacgccagaggccaccuuaccaguuucccacgcuugaauucacugaaccaggagcccggguuuucuuugggccaagaagugauucuggccuaaacaugcagcggggagguggggagggagagaaacagaacaaaaggguuacuucuccggccuccagagcaaggccccaggcuuucccggcccccgcgccugcauccucacgccgggggggcugcagggaggacccaccgagcgccuucagugcagccugagggccccggcccuuguggggagacuggaggucacaggagaaugagcccggcccagguccuuggggggaugagccuggccugggccuugagggagacuagaggccacgugaggagccgggccccagcccuuggggagacugaaggccaugugaggaugagccuggccggggcccucggggagacuggaggccgcgugaggaugagccuggccccggcccuuagggaggccacgugaggagcccggccugggcccucggggagaccggaggcugcgugaggaggagccuggccccagcccucggggagacuggaggcugcgugaggagcccggccugggcccucggggagaccggaggccgcgugaggaugagccuggccccagcccucagggagaccggaggcugcgugaggagccugaccugggcccucggggagaccggaggccgcgugaggaugagccuggccccagcccucggggagacuggaggccgugugaggagccuggccccagcccucggagagacuggaggccaugugaggagccuggccccagcccuccagccccugcugcugcccaggaagggugcgcucugccucucguuuugcauguuaggccccaggccagcgccuggugcucagucacugcuggaaacgcucacugagggagggaaugaacgaaugaaugaaugaaugauggaccaagggaaugguaauaaaagccagcauuuacugcaggcgagggguggggcauccucaucccauccucacagccuugccuggcugcugcggcaccagacugugugcgugugugugugcgcgugcauggugugggggguaugucugugugaaggguauggugugugguacgcaucugugugugugaugagugguguguaucuguguaugcugugugugugguauaauguguggucugugugugaugugugguguguguguaguguguuauggguguaucugugugauguguggugugugugugugguaucuguguguaaugucuguguaugguguguaucugugaugugugguauguaucaugugcguggugugugguaucugugugucugauguguggugcguaucuaugugugguaugugguaugugugguguguauggcgcauuaugggugugugugugguaugugugguguuuaucgugugugugguaugugugugguguaugguguguaucugugugauguguggugugguauaugugguguguauuguguguguggugcguaucucuguggugugugguauguguaucguguaucugugugguaugugugguguguggccuguaucugugcgugugguguguagugugcaucugcgugugugugugugugugugguagaaccuuccuggggacugagacgugugcgggugagggcugcuccucggcugccugccuggaucaugugcagccagcucacgcugccauggggcacuacuugugcccgcuuccugggagggcucccaccugaggccugcuuuccacagaggccgaggcugcagacacacaggcugggcccagcagggcaggccucagugacgccacggauggaugggugggugagcagccauuccucugaggggagaccugcacgcugggucccaaaaacaggacaaggggagccccggcugccugagggugcacuugcugcaggcguggaguggaagggcccccagggccggccuguccccagccuggacugacuggggcucacguugugcgccaugaggacacagaagacugaucccuggcugauccccccagccuucuucuugagcuggccuugugccaagaaggccagaaaaggggauccccuggaggaaaggggugucccaucugccucucacgccacccagagcucucccacccucucucguuuccaaaucugccacugucaaugccaagcccaggcggcgugaaggcagcuucuuccuggaagagucccgggaugugggcaagcgcgggcucccccagccucugcugugagccuccuccggguccaagggggccaccucggaaagcgucuccacuugcccuuggccaagcagcuguagcccaggcccgaggcugcagccuguggacgccuggcuggucaacacugggggagccuggggucgcucagcagccccacgcugcugugccgugaacaccagccgcggcuucccaggaaaccucugaguuuggaggagucuggcccgugauuuccacagcggcaaggccacccauuugcagaggcaggccgcgaaggagggccgagaaaccucuuuucuaagggaauuccacgcggggccucuggccagacugagggaaacgagagccgagauggaaggcccccguguuuggauucucucugaacaggguuugucacuaggaaggcagguucucaaggaguuaaaacuucaggugggggaggggaccccugcacuuggagccccacagaucuccagccaugugcagccuccacugcagccagugggcuccuaacccaaaguggcuacugagcucagcacggucagggcgugauugagggguaaggggauggcggucccuggggagaacguagcugcucuuccccuggcaggaaacugcuucuggggcacugagguuguuaggaagcagaggcugcaggggcgcacaggucuggaccugcacagcaaaccgcugcggccccagaaaugggcggccuuugccuggggccacgcgacaacugcgagcucaugaaggagaggccguucaagcugaugcaggggcacgagagcugcaggcuuggucaccuuccaggagcaacagggagacucaguccucgccugggccaaggcuggaccugccucaggugcaugcuugagggauagcaacacacgcccgucuacaugcaugcacaugccagccacaugcacccacauacaccagccacacacacccacacaccauauacacauccacacaccagccacacacccacacaccugcaccagccacaaguacccaaacaccaucuacacacccacacaccagccacacacacccgaacaccauguacacacccacacaccacccacacacccccacauaccagccacacgcacccauccaccacccauacacacacccauccaccagccacaugcacccacacaucauccacaugccaucuacacacacaccauccacauacaccccaacuacaaaaccacacagcaucuacacacacacacacaccauucacacacccauccacacacucauccacaugugcccacacaccauccacaugcacacaaacuccugcuacagcgcugaggccuccgaaaggccacagagguggguauuuaagugacaugccacaaaaucucaacagagcccagcuccccaccccgaauucuucacuaaacagacuucaaaacaaagcacucaggagggaccagggccaacccacagaaacaggcuggauaauaagaauugaggcaaagggcagcuuccggaagaugucucaggcucacguuauuguaccugcucccaauuccuuuaaaggguuuuaaugggggucucaggucagugggaccacugagucaccggagaaaagcuuuuaucaaccagugagugaagucccagcccugggacggcaggaugccagguggaaagcccuccaacccuuccugaccccgggcugcacaaaccuauuuuauuacuaaaaaauuucuuaaaacaauuucaggucuacuucugaaagaacaguuucacugaugaaacggauucauuucuggcuuucagucuuaaagcugcauauacaagaaaugcuugaagcccucggcauggcccugucugugacgccugccccgcuggggccauggagggacacagcuacucaccccuucggacuucuugucagggaagacgcaugucgaccccccggcugugaaguugcaguaaaccuugaaggaaucccuggagcauccuugguuaggaucgacccaguauucaccuggauuucagagacggggagggaggcaggcagagucagaaggauugcucccuggaugguuccggaagccgcugugacauuucaguccagcaguuaaaaugcacgccccaggaaugccgccaacacgggccuuucugggguuuacuuuauugcauuuugcuucuccugcugggcccauaaagagauguggacaaacucauucaccaagaacacagcuggugcaugaagcaacuggguacguguucugguggccaggaggguugggguccggccuacucucuggguggacagaaaugcagagaggguucuggaaggaacucuggaaauucaugcauguaggaucagagucuacuggaaccaugaacaucccucgaaucuugcagggggaacauucaaacuucccagggggaagaaaagcuaaugggaauuuauccuucaauuggugccugaggcuaugauggugaggagaaggauguguuuuuacaguaucgcggaguuugaaggccguuugcccaagcacagcgucugcugccgguccuaacacugacccuuacuuccacuggcacugugccagccucucaggcacugccucacgcaacucuguccucuuccugggagauguuucuguucccauuugacaggucaggaacacgagguucaagcaggucaccccgccagaaaaugccuaagaccagaugagaaccuggagagucugaccucaaagccuuggccucugcacccggccucacccugagaugccuccauaaaguucaagaggggaggcucuugcgcaccccggccccacagauggggaggcugcggcugcccguccugucccuuccgcugugccuggcugaacuguccuugccacacuccauguguccugcagguccaugcccgcuuuggggggccaccccugcccccccaggcccucaccaucugggaagucgggguggcagagcugcagguccuugcaggugcgggcgggguucugcugcgugcccaggggccguuucaucugcucaaucuccagcuucagagaguugagagagccgaagaucucuuccaugccguccgcguaguccacguaguucucgccauucccgucguccagcagcuggcuggcgucgauguuccgccgcguccuggaugccuggauuggcaggggcuggaugaccucucccggggggcccugggggacagaacaggagcagcggugggugauggaggaugggaagggucccaggauaugagcagagcagggacagcuggggccacaucugcagggguucccuggggccu

SEQ ID NO: 13112 - RNA, 10379 nt, Homo sapiens
cggccgggccgcgcgccucccccggaacucggccgugccauucccaugaugcccagccacgggcacggcuuccggagugcggccgccgccgccaccguccgguaggucgcggggagggggcggcuugggggggucgccccgccccccgccccgccccuccccucccgcgcuucccacggcgcggcccgggcgcggggcggcggcagcggcggcgcgcggggaggcggggaggcggggggcccggccggacgccccugcgcccccuccccgcgccccggccgagggcggagcgcgcuggcccugcagccuccggcccgcccccggcccgccgccucccccgggacgugggacgcgggcgcaggcgggguccgcgcggcgggcggcgggggacgggcggaggugagcgggugcagggccggggccggggggcucgggggcugggaagcuggggggucggggacaggagggccagccaggccggggccggcgcgccgugcaggccgcggcgggcgggcggcgggggcuccccgaggcaggcggacggggaucggcgccggggcugcuccguuccccgggcggggauccugucucuggccuccgugcgacucucggcccgcgcgccccgcgcuccuggagccccaggugaggcgcaggugagggcccgcgguggggagcuuuggcccggcccggggcggccgcugcccuccgagaauggccgcggcccggccggccuggagacugcgguucacgcccugcgccaggcggagcuuccgggaggguggccgcucucccgggccccaagcucgcuaguccucggaucccagaaacauaacuccgggggugcagaccugcuuggaggcccggccucuucccugggaggcguucacucccgccgggccgaggaccaggucgccgaucccagcggcuagggugagcgcgcccucggggaggggagcucccuugggggacccugcccagcccgcaggccgugaguagcccaagcuugggagucaggggaggucgggccggggcagccgggaggggcucaccuugccuucaguucccaagcacaggaaauggcggugcagcuuugcugggggacgcuuguagugagguuguaaaauugcagcuucuggaaggcugggagcugaauucuagcccacgcccacuucuggguggcuggagcggguccuccugcugccccgcccgcuccugcaccggggcuccucucccuggccugcagacccuggccucccuacccuggggggaaaccccaccugggagguaagaccgcuggcugagcugcuuuucggccaaccgagaaauguagaguauuugggggcguuucucacaggugggcagacuguuaggauggcgagggcccagugugggugcuuugguucucuccagaagguugaugucuggaccgagaagguacccgaguguucuccaccgcuuccuaaaaucugacaccguguggccuuggggugcaggugcuggguguccccacagccacccucaagaccguauccugaggcagcaauuugacaaagccugcaccucuggcuugggcccacaccuaucucuaaggacugauuagggggcuuuucuuguuuuuuuuuuuuuuuuuuuuuuagagccagagucucgcuuugucgcccaggcuggagugcaauggcugaucucggcucacuguaaucuccgccucccugguucaagcgauucucgugccucagccccuggaguagcuggaacuacagacgugggcucccacgcccagcuaauuuauguguuuuuaguagagaugggguuucgccauguuggccaggcuggucucgaacuccuggccucaagugauccaccugccuccaccucccagagugcugggauuacaggugugagccacuauccccgacccagggggcuuuucaagaaugauucaucucgcauaauguuuuaaagccacaagcuguccuggggagacgaccccccucgauuuuuuuuuuucuuucugagauggagucucguucugucuccuaggcuggagugcaguggcgcgaucucggcucacugcaaccucugccuccuggguucaagcaauucuccugucucagccuccccaguagcugggauuacgggcacacgccaccacgcccagcuaauuuuuguauuuuuagcagaggagggguuucaccauauuggccaggcuggucucaaacuccugaccucaggugauccaccugccucagccucccaaagugcugggauuacaggcgucagccacugcaccuggccagauuuuuuaauaccauucuugaacuaggugauuugacaacuuagaaaacuguucacuggguguccaggccuucucugcaaccagucagaagcuguaaauguggcuaguggagaacagacuauuuccccaggaaaacuccccuccccgaccuugucaucuaguguaaagacacugacuugggccgguuuucuuaagguaguauuuaagguaguauucuuaagguaguauugcuguuuaaggagucaauagucuuaauuuagacgcuccucagcccaaggcuaaugcaaauguuuugucauuuaugucauuuugcagaggcaauuugaauaacaccuacaguaaggcaggcguggguuugcuagccagugaaagagcuccucucgcauuguuggucccccagugcucugugucaguggggaaucucuccagaaggugacuuuaugggggaugucaugggcugcaguggguggccagaauuugagaacuagcagauaacgucacauacgugccccauccccaucacuucagccagcaucagaucugcuguccaggauagcuauacauuacuugugguuaaauguauuugucuuaauacauuaaguuaaauauauuuguacuugugguuaaaugucuuagaguaaguuccuucaaaaguuaauuuugagcccuuaaguuaaugauauuucuuuccaaaaaaaaaaaauuuaucaacuguagcuucagccuguaauuagaugccucugauucucuuugauucugguagucaaaagucuauugaaaaagcagagagagaaugccucgguguguaaguggagugaugaggaccugaucucugggccgugugggaacacuggcugccauuucaucacagucaaccuggacucacagaauuucaaguaauuucaaguaauucuuguauuuuaguuucccuuguagggcacaaauuggugcuagcaaaugacuuacuucugaaucugucucacccccugguuaauugcugguuaccccuuuugggcucaccuguguguagguggccaggcucaccuuuuguuucuuuuucuuucuuucuuuuuuuuuuuuuuuuuuuugagauggagucucauucugucgcccagacuggagugcaguggcaugaucucagcucacugcaaacucuaccuccuggguucgagcaauucuccugccucagccucccaaguagcugggauuacaggcaugcgccaccaugcccggcuaauuuuuguguuuuuuuaguagagauggaguuucacuauauuggucaggcugaucuugagcuccugaccucaggugauccacccgccucggccuuccaaagugcuggauuacaggcgugagccaccacaccuggccacagccucacguuuuugugaaaagaugguggcauguaaauacccaauuaugugcuugucaggaaggaagcgccugguuaaccggagaaagcuccugguaaagaagaauccauaacagaggcaaaacauacuggccaguuuucgcccacugcugagguccugagggcagccacagccucugagccaaggggaguucaguguccauaagccuuggaggcuugcuugcacaagaaccgcuuugcacugcaauuuugggguaggcagguggguaucagagcaauguguuaagaaugaauagcugcgcaguaucccugguauuguucuaagugacugccauccaccugagcuuccucccugcaguggcaauccccaggccauucgugagcaggucuucaaagugucccaagcucagcccagcacuugugcugaggcagccaccuuuggucugaaaucuggcagcgcaggaugagaagggggacaucacuguguucagggugacuucugugcuaguuagcuaagaauaacaaugcagucccaugcgaccaccuggcaaauuuacauuugacauuuaacauagagaggguuuaguaaaagcagcccuucaagauguuuggggaaauaauuucugaguggcucacaucauacaacuuuccguuccaggagcuugucgguugggucaagaaugaaccuacgcaugacggcgugcugauccuggguuucuagucauccuuuuuaagcugcaaagaagcauuugcagacguugucucauggguaccgcuugccaacuuuggagguaaauaaaaccucuccccucuuacagagaagguggaagcccggagugagaagggaagagcggggaggugaugaccgugcgugccccgggcggcaccguggagggugguuggaaacauuuucuuacugaaucuucccagcagccccgggcuggagcagguaaauuguuccuuucccagcugaggaauccgaggccccaggagcaugaguaagucgugcaaggacacccagcuagcuggacguugggcuccacccaacucucuccacucugugagcccgacaugcuguuccucuggggccucgcuugguguuggcagcuaucgcuguuuguagcugcaucaugcccaugugcuuucuuuccgcccaggaugugaagccgguagagaaauaaagcaucgccccucugcgcgccccuccccgucugcuagaauguuucucaugaacgcuucuccagugguugcucuccaguccaaaugggaggccuuuggcccgccagggagcuguagguuccccaggugcuucucggaggcugacgagggcguggagagcgcgucggugagcgcccgggugcagaugcuuaucagcacucugcagcgcgacggggcugcucggggcaccagcgaugagcgcgccgcacagaggggccacagggcagagggaugccacgacgccaggccggcugccaagcccaccgugcacaaggagccacccgcguuggcugucuguggucucguugcugacuuugaccccaugggggaggaggaaacuacagacuuuggcccguuggugcuagauucagacagugaugauuccguggacagggacauugaggaggccauccaggaguaccugaaggcaaagaguggagccgcacagcccggggccggcggggcccagccaggugcagcccagccuuccagggccgcaggcggaggcaguagauguaagccggaaccggcucacggcagugccccgacugcccugugucccccaaaacuuguaccuggaucaggugguggccccggcagccaggugggauccagcaaggaccagggcuccgccuccccggucagugugagcagcgaugacuccuucgagcagagcaucagggcggaaauagaacaguuucugaaugagaagagacagcaugagacccaaaaaugugaugggucaguggagaagaaaccagacacaaaugaaaauuccgccaagucacucuugaaaucccaccaagagccgccuacaaagguggugcaucggcagggccugcugggcguccagaaggaguuugccuuccgcaaaccuccccgguuagcgaagaugaacguccagcccagaagccucagguccaaggucacaaccacgcaggagaacgagggcagcacgaagccggcaacccccugccgcccuucagaagcagcacagaauaaaggugggaucaaaaggagcgccagcgcugcaaggaggggaaagcgagucaugagugcggcacaggcguccgaggcguccgacuccagcagcgacgauggcauugaggaggccauccagcuguaccagcugcagaaaacacgcaaggaggccgacggggaccugccccagaggguccaacuccgagaggagagagcgccugacccucccgcacacagcacaagcagugccacaaaaagugccuugcccgagacccacaggaaaacacccagcaagaagaagcuaguggccaccaagaccauggacccugguccagggggccuggacacugaccaugcccccaagcuccugaaggaaaccaaagcuccaccuccagcgagcccugcuuccaggagugaguuuguggaacgguccucgugccgggcggacacaucugcugagcugaugugugcagaagcaauccuggacaucuccaagacgauccugccggccccuguagagggcagugacgggucccuguccgcaagcccacucuucuacuccccgaacgugccuucccgcucugacggcgacaguagcuccguggacagcgaugacagcaucgagcaggaaauccggacauuuuuggcccuaaaggcgcagucagggaguuugcuggccagaggugagagcugcccgcaggcugcccaggguccacuuuugccgccuggccucaacagccagaccggcggccacaagaccccucucucuaaaacaccagacccacugcugggcugcaaaaggaagcguagaggugguggccaugugaggccauccacgcccaagaaaaugcaggagguggugaaagacgguagccaggaugccgaccacagccaggggagagcugagcccggccaugagaggcgagaccugcccauccagggcaaagccagugaggcccugggaggggagggcaccgccaggggcccuggcgacacucgcaugucacagggccaggguaagacagacgaggcaaggcgccuagacgagaaagagagcucugaagacaaaagcagcucccuggacagugacgaggaccuggacacagccaucaaggacuuguuaagguccaagcgaaagcucaagaagaggugcagggagcccagggcugcgugcaggaagaaggucagguucagcacagcccagacgcacuucuuggagcagcugggcgggcuccggagagacuggaaagacaggggcccgccagugcugaagagcugccucuccaaguccaagagagacaguggcgaggguccugggaagaaaccccccagugucuuuggcagcacggcagagaggaugaggcaggagggugccgcgagccaggacgcggcccuggccuuccgggugaggagacccgccuccgccucugccuccgaagggaauccauuccccagggagucccagggcccagcucccagccccggcucccugucugaugacagcaguucaguggacagcaacgacagcaucgaacuggagauuaggaaguuuuuggcggaaaaggccaaggagucagugagcaguucagaaguucaggcagagggccccaccgcucuugggacagggggcccagccaggccagaggugcugugcaggaaggagccugccccaccgccuggcgugugcacacgcagccagagggccaggggggucccacaucuggccgaagggcuucgaggcacagagagcgcaggagcacagggcacagcuggucuguucagccagggcgggaaggggcucccugcugcuccugcccgaggggauccggugccgcccaggagcaccagcggcggugucuccgccaaggggcucucagugagcaggagaaauguuuacguucacaaagaccagagcccacgaggggcugagccugcugccaaaagugcuuuuggucagcugcccagcugugccacagcgggcaccgaggcaggaggcgccagaggaaccuuucacaugggcugcgggagcccgagcuuccugacccccagcccgggagcggagagggacgcuggagcccaggccgaccgcacaccgcccuggagcgacuucgcccaccagagucggcugcccagcccgugggugcugcgcuccgaaggcagagaugcaguguggagggggggcgucgggagcgagagagacaagggguccgagggccccgcccggggccugcccagccugccccuugcgggcuucucgccgcugcuguccacccagcucuuccacuuuggaaagggugucuccugggggggcaggcaggcuggccucuucagcccccaccuggggcugccucugcagggccccuccuucucggccuucagggaggcccaggccggacccagcccugucuuuggaagcccacacuugcuggcaaagaaggacggcggccccuggccaaccaggaaggcacaggcagggcugaguuugcaugacaggaggagcucgggcucggaggaaagcauuuuagaccugagguaucgacgaagggucaacagggaugaccaggagcaggacgccuugggcagugacgccagugacuucagcgacaccuccacggaggacaguggcggcagcucaguagugaaggucuaagcccucgagcuguggguucgcguccuggguugcgugcauucguggaaagcggcguagccgugcgugugugugaugguuccguggcugcaaggaagggaaacagucuauuauacauagcccuguauauauguacaccaacaugaaacuuuuauuuaacagacguguccugguaaauaugauuuuuguagcuuuuuguaaauuauuuaaagugauguaaaagauauuuuuggaaaauacuguuguucaauuuuguaggguguuccuaacugcaguuuucuguguucugcauacaagucuuagcuuaggaaacauuugguucuuaccaucacagccagguucacagaggcucugaugcuuuuugguugauugcuggugagaauggccggcgguggcugcagugguagccugaggaaggccaagcugcccucccugggaaucacucagaugccccaagauguccguugggaagcucccaggacagcacuuuuuauacagaggacaccgccucggccccacguccuuagaggccagagcacaucugaaaacugcaaucacagccguccgcuggaaaaacguuucgaagcacaguggccagcgagcgagcacguggcuacucccuguugcaugucaaauccacacagaugucagcggcagcugcucggcagcccagcccugggccuggguggguucauguccaaucuuguucgaucacuagaugauucuaacaucgaaauaaaccucuuuuuauauggcguuacuguucuuuuuaaaucaugguucuuaaagauaacacacgugcacuuaaaauguccuuuucucuggccgggcgcggugacucacaccuguaaucccagaacuuugggaggcugaggcgggcggaucaccugaggucaggaguucgagaccagccuggccaacauggcaaaaccucgucucuacuaaaacuacaaaaauuagccaggcaugguggcggaugccuguaaucccagcuacucaggagacugaggaaggagaaucacuugaacccaagaggcggagguggcagugagcugagaucgugccauugcacuccagccugggugacaagagugaaacuccaucucaaaaaacaaaacaaaacaaauuucuuuucuugcacacaccaauaagcacugcuuugaacuuugguccccagacacccagggcagagaugacgugcaaaacccaguccuggggauaagcguucuccauaccugcccuccagaaacaggagccccgucagaggugugcccgaacaccaacgucagcccuuuggguggcuuucugugggcgccucccaggacagaaugcacagggcccucuccugcacuguggcgugguuaaagguggcggccucagguccuugguguuggugcccugugaugcugcccugguauucugugccuucugcucugaggccaccgcaguguccguggcuacuacagagacagaagcagugcugggcacugaugggccgugacauuuacauuguaauuguccagcaaacuuugaugagucacuggagcuucccaggucagccucguggcuuagcugccaugcgggguuucuuuggagcugaaucuuguugguauucgaacaugcgaguggcuugucuacacacugugcaccccuggguuuuagcaagaauucacucuuguauccagaugcaggcaugugccaccugccauccacagaugcaacgucugcugggucagaagccgugaugagggucccugugguugcuguuccuguccagccccgucuuuugugugugauaucuucguuguggcauauugcuucacuuaagugcuuccaggagaaacaguuccauguaauccaugcuc

SEQ ID NO: 13113 - RNA, 4792 nt, Homo sapiens
gcucaggaugugacaacguuuuuaaugcaaagucaaccauuagcaucuuucccauguacuuauuagaugugaaauggcaggacuucacggccccguuugcauauuuuccuacuccgcagacgaauaauauuuucagggaaggcagcgcagucugugccgucacaaucgggcgacugugggugaugagggaugaugauuuuccaggaggcccuggggucagaggacuccuagagggaguuuccagccccucaaucgcagauggauggccuguugauguuguaacugggguggaaguugagccggucacaggaggugaugcaguuaucggggccagucacgaugcuuuucuccagguaaacauugagaguauuguuccggaacauuccacccgcugcaaguuguugggaaaauuuauucgaauuuggauaaaauacuuucuauaagagauaaaggaacacggauuaaugacguauaauacucuugagcaauccguugaauauuuuugaaagaaaaauaagaauucauaagaaaaugcagagaagccagaguggguaggauggccuggcucaccccagaccauccuaauccaugcccgaugccuggcacuugcuguuaacacugcccccggcacuguucuaaggauagaagaaugagcuguggggccaccugugugccaucucuaccucaggauguggcugugagcaucgccuugggggucaguccuggagucacccccaggucugcuuuugcucacugugcuacucugggaaagcugccagcccucucugaacuucaguuuucucuucuauggaauagaaaugauauccaugucaguggguuucaaccuuaacuggggcugggugcgguggcucacgccuguaaucccagcacucugggaggcugaggcagguggaucgccucaggucaggaguucgagaccagccuggccaacauagugaaaugccgucucuacuaaaaauacaaaaauauuagccaggugugguggcgggcgcauguaaucccagcuacucgggaggcugaggcaggagaauugcuugaaccggggaggcggagcuugcagugagccgagauugugccauugcaguccugccugggcaacaagagcaaaacuccauugagaaggggugugcugaggccacucgugugggcgggcacccagugguaggaguuauucuagcaagacagcaucauuaggugacugugacauuccugaagcgaguggucuggaccuccgccaaauauuuuaccccauacgggugaccuguccuuagaggauccugugccacgcacaucaccugauguuucaucuccuuggcaagaaacaagugcaaagagaaaacuuuucuuuguuuuugagaaguuuuagaucuauagaaaaauugaacagaaaguacggagaguucccaaauuaccucccucagcaaacacaguucccccuguccuuagcaugucgcacuuguguagcacacuuuuuacgguggagccaguguugauacuuuauuaguaacuaaagucuacauucuaugggugggacaaauguaucaucacagggauccgcccaugcaguaucauggagaggaauucccuucagugcauuuuuuuuuuuuuuuuuuugagauggaguuuuugcucuagucacccacgccggcgugcaauggcgccaucucagcucacugcaaccuucgccucuggguucaagcaauucuccugccucagccucccaagcagcugggauuacaggcgcccaccacuaugcccggcuacuuuuuguauuuuuaguagagacgggguuucgccauguuggccaggcuggucucaaacuccugaccucaggugauccacccgccucggccucccaaagugcugggauuacaggcgugagccaccacgcccagccuuucagugcacuuuuuaaugcaaagcauuuaucuucuauucccacaugggagguaaacagcuucuccggcauccacccuuggucacgaaacuggaaaagagacuccagacggagcagguggauaagaaggaggagaaccuccuuggaaacuugucaguaguaccucaugccuccuaccccacugccugcucccaucagugaccugaaggcuccuaccauuuacaauaggaacauuuuuucauggccuuuuauaaaaccuaaaacaucuggacccauguuagugagugugcuggguuuuuuuuucuuuuuuuuuugguuuuuguuuguuugcuuguuuguuuugguaacagggucuggcucucacccaggguggaaugcaauggcaugaucaaggcugacugcagccucaaccuccugggcucaagcaauccuccacccucagccuccugaauagcugggacuacaggugcaugccaccacacccagcuaauuauuuuauuuuauuuuuacagggaugggggucucauuacguugcccaggcuggucuugaucucugagccucaagugauccucucaccucagccucccaaagugcugggauuacaggcgugagccaccgcauccagcugugucuggucuuuuucauagaaauaccugauccccagggaaaacucagggucgucugauuacgggagagugauucucaaaugcuccagcauuuuuagauaaguaaucuucucacaagggcucagucacucacgccacacaacuaaauaagcacucaccagaccuuuucagugaugaaugcuuugacaacgaaaauacguccacaacauucucaccccagaauggcuggcccagugucccaggugugcaggagacaccgcacuagucccucuguccauucaccuggaccuucaugggguuugguguggggagguucuaggagggccauccuggagccuaaggucaagcucaaaaaggguuuggcuuccccaauggcccacagacuccugugcccaccaauacaacuugcccacccacaagcugugccgucagccaguacugccucuucagguuacacguuaacaucucauaaaguacaauuccaaaaaaaaaguagcccuucauuuauuugccucagaacugagcaccguaaguugcaggagaugguugcgugugugugugugagacugcugugcgugugguuggguguaugggggcagggugaugucagcaagucuauauccuccucuuuuaaaacacuccacucccaaauucauucacucauuuaguuccauccuacccucucccaaagcgauuuugggaaccucccuccuccccauuugugaugcuggaacuuuggccuccucccugggugcaccccuccccgucucauuguugaccuguugagaaccccagguuuuuagccucuucuugaggccacccacccccugccccccaugcccggucuugcaucccacuuacaggcaucucgugcacggugggggcucugcucccguaagccugguuacugguccuguacacggagacagccuucuggguccugguagaugagaaacacucuauuuucauucauuuacucuaauucugcacaagccacagccuuguauuugguugacggcacuccccuggaaaugcccccauggaaagagcaauaugcccgggcuggugauguggccucgaaggcagccucugggaguaccuggcugaugaccguucugaauggcccggccuccccggcccccucugcuugccacugucccugcucuuccaaggcaggccaaagcccuaaagagcaggcagccagcaagugcugauccccagcccuggcagggccucggcacaugcugcaauuucuggguaaccuagcuugucaggagcggaggcuuggccuccagacccugccacccagagggucccucugccucugagcccccacccucacugaggcuaugcuucuacugguaccacugccccuaccugucaguaggacaggcuacugagaggcugcaggcccacgacauagcuuuacuuuauacuccuagaucuuggccaaguuguuccuucuacaucccagucaucucaaugcgagaaugaggauacuaacagacccugcccuagaggacuguugagggaccaaaugugugaugagcacggcaagauguuugcaccugccuacaggaauugaguuucuuacuacuucuuagccugcaaugcccuguggcagcucagagcuggcugagucuacagcaagacaguggaggugcugcugugcucacgccccgcagcggaguuucaggguagagaggagaggagacucacccgacacaaaucaguggagcugagaccacaacugggcuuucuccccccacggcccugccccccacugcccuuauccccacuuccuuguaugaggcucuagggagcacggucgccgcucacuggcgggcgaugacagcgcgggccccggaugaccacucgaucuucuugauuucuguagcuaggaccuugggggucuugcggggucucucacacacggggcuaucgagcaguggacgccaggaccaggcgggccccagcuuccucaccuguagccccggaaccaccccggguuguugaaccugcccggcagguccgcgcucacgcgguaguagucgcugguccucuccggcggggccguggccuugggcgccacaggcuccgcgcacgcucuggggcauuccucagccauugugccuggaggagaagcgggacucggcggcguccuguugccaagcgacggccaggucacgugacuggggagcgagcggaggggccuuaaaggcgccgcgcgugggccggguuccucug

SEQ ID NO: 13114 - RNA, 4792 nt, Homo sapiens
cagaggaacccggcccacgcgcggcgccuuuaaggccccuccgcucgcuccccagucacgugaccuggccgucgcuuggcaacaggacgccgccgagucccgcuucuccuccaggcacaauggcugaggaaugccccagagcgugcgcggagccuguggcgcccaaggccacggccccgccggagaggaccagcgacuacuaccgcgugagcgcggaccugccgggcagguucaacaacccggggugguuccggggcuacaggugaggaagcuggggcccgccugguccuggcguccacugcucgauagccccgugugugagagaccccgcaagacccccaagguccuagcuacagaaaucaagaagaucgaguggucauccggggcccgcgcugucaucgcccgccagugagcggcgaccgugcucccuagagccucauacaaggaaguggggauaagggcaguggggggcagggccguggggggagaaagcccaguuguggucucagcuccacugauuugugucgggugagucuccucuccucucuacccugaaacuccgcugcggggcgugagcacagcagcaccuccacugucuugcuguagacucagccagcucugagcugccacagggcauugcaggcuaagaaguaguaagaaacucaauuccuguaggcaggugcaaacaucuugccgugcucaucacacauuuggucccucaacaguccucuagggcagggucuguuaguauccucauucucgcauugagaugacugggauguagaaggaacaacuuggccaagaucuaggaguauaaaguaaagcuaugucgugggccugcagccucucaguagccuguccuacugacagguaggggcagugguaccaguagaagcauagccucagugagggugggggcucagaggcagagggacccucuggguggcagggucuggaggccaagccuccgcuccugacaagcuagguuacccagaaauugcagcaugugccgaggcccugccagggcuggggaucagcacuugcuggcugccugcucuuuagggcuuuggccugccuuggaagagcagggacaguggcaagcagagggggccggggaggccgggccauucagaacggucaucagccagguacucccagaggcugccuucgaggccacaucaccagcccgggcauauugcucuuuccaugggggcauuuccaggggagugccgucaaccaaauacaaggcuguggcuugugcagaauuagaguaaaugaaugaaaauagaguguuucucaucuaccaggacccagaaggcugucuccguguacaggaccaguaaccaggcuuacgggagcagagcccccaccgugcacgagaugccuguaagugggaugcaagaccgggcauggggggcaggggguggguggccucaagaagaggcuaaaaaccugggguucucaacaggucaacaaugagacggggaggggugcacccagggaggaggccaaaguuccagcaucacaaauggggaggagggagguucccaaaaucgcuuugggagaggguaggauggaacuaaaugagugaaugaauuugggaguggaguguuuuaaaagaggaggauauagacuugcugacaucacccugcccccauacacccaaccacacgcacagcagucucacacacacacacgcaaccaucuccugcaacuuacggugcucaguucugaggcaaauaaaugaagggcuacuuuuuuuuuggaauuguacuuuaugagauguuaacguguaaccugaagaggcaguacuggcugacggcacagcuugugggugggcaaguuguauuggugggcacaggagucugugggccauuggggaagccaaacccuuuuugagcuugaccuuaggcuccaggauggcccuccuagaaccuccccacaccaaaccccaugaagguccaggugaauggacagagggacuagugcggugucuccugcacaccugggacacugggccagccauucuggggugagaauguuguggacguauuuucguugucaaagcauucaucacugaaaaggucuggugagugcuuauuuaguuguguggcgugagugacugagcccuugugagaagauuacuuaucuaaaaaugcuggagcauuugagaaucacucucccguaaucagacgacccugaguuuucccuggggaucagguauuucuaugaaaaagaccagacacagcuggaugcgguggcucacgccuguaaucccagcacuuugggaggcugaggugagaggaucacuugaggcucagagaucaagaccagccugggcaacguaaugagacccccaucccuguaaaaauaaaauaaaauaauuagcugggugugguggcaugcaccuguagucccagcuauucaggaggcugaggguggaggauugcuugagcccaggagguugaggcugcagucagccuugaucaugccauugcauuccacccugggugagagccagacccuguuaccaaaacaaacaagcaaacaaacaaaaaccaaaaaaaaaagaaaaaaaaacccagcacacucacuaacauggguccagauguuuuagguuuuauaaaaggccaugaaaaaauguuccuauuguaaaugguaggagccuucaggucacugaugggagcaggcagugggguaggaggcaugagguacuacugacaaguuuccaaggagguucuccuccuucuuauccaccugcuccgucuggagucucuuuuccaguuucgugaccaaggguggaugccggagaagcuguuuaccucccaugugggaauagaagauaaaugcuuugcauuaaaaagugcacugaaaggcugggcgugguggcucacgccuguaaucccagcacuuugggaggccgaggcggguggaucaccugaggucaggaguuugagaccagccuggccaacauggcgaaaccccgucucuacuaaaaauacaaaaaguagccgggcauaguggugggcgccuguaaucccagcugcuugggaggcugaggcaggagaauugcuugaacccagaggcgaagguugcagugagcugagauggcgccauugcacgccggcgugggugacuagagcaaaaacuccaucucaaaaaaaaaaaaaaaaaaaugcacugaagggaauuccucuccaugauacugcaugggcggaucccugugaugauacauuugucccacccauagaauguagacuuuaguuacuaauaaaguaucaacacuggcuccaccguaaaaagugugcuacacaagugcgacaugcuaaggacagggggaacuguguuugcugagggagguaauuugggaacucuccguacuuucuguucaauuuuucuauagaucuaaaacuucucaaaaacaaagaaaaguuuucucuuugcacuuguuucuugccaaggagaugaaacaucaggugaugugcguggcacaggauccucuaaggacaggucacccguaugggguaaaauauuuggcggagguccagaccacucgcuucaggaaugucacagucaccuaaugaugcugucuugcuagaauaacuccuaccacugggugcccgcccacacgaguggccucagcacaccccuucucaauggaguuuugcucuuguugcccaggcaggacugcaauggcacaaucucggcucacugcaagcuccgccuccccgguucaagcaauucuccugccucagccucccgaguagcugggauuacaugcgcccgccaccacaccuggcuaauauuuuuguauuuuuaguagagacggcauuucacuauguuggccaggcuggucucgaacuccugaccugaggcgauccaccugccucagccucccagagugcugggauuacaggcgugagccaccgcacccagccccaguuaagguugaaacccacugacauggauaucauuucuauuccauagaagagaaaacugaaguucagagagggcuggcagcuuucccagaguagcacagugagcaaaagcagaccugggggugacuccaggacugacccccaaggcgaugcucacagccacauccugagguagagauggcacacagguggccccacagcucauucuucuauccuuagaacagugccgggggcaguguuaacagcaagugccaggcaucgggcauggauuaggauggucuggggugagccaggccauccuacccacucuggcuucucugcauuuucuuaugaauucuuauuuuucuuucaaaaauauucaacggauugcucaagaguauuauacgucauuaauccguguuccuuuaucucuuauagaaaguauuuuauccaaauucgaauaaauuuucccaacaacuugcagcggguggaauguuccggaacaauacucucaauguuuaccuggagaaaagcaucgugacuggccccgauaacugcaucaccuccugugaccggcucaacuuccaccccaguuacaacaucaacaggccauccaucugcgauugaggggcuggaaacucccucuaggaguccucugaccccagggccuccuggaaaaucaucaucccucaucacccacagucgcccgauugugacggcacagacugcgcugccuucccugaaaauauuauucgucugcggaguaggaaaauaugcaaacggggccgugaaguccugccauuucacaucuaauaaguacaugggaaagaugcuaaugguugacuuugcauuaaaaacguugucacauccugagc

SEQ ID NO: 13115 - RNA, 4619 nt, Homo sapiens
gcugaguaaguaacaacgacugaggaugccgcugacccagggcuggggaaggggacucccagcucagacaggcuuggcugugguuugcuuugggaggagagugaacaucacagggaauggcucaugucagccccaggagggugggcuggccccugguccccgggcuccuucuggcccugcaggcgauagagagccucaaccugcugccgcuucuccuuggcccgggugauggccgucuggaagagccugcaguagaggugcacagccagcggagagucgucauugccggguacaggguaggugaugaggcagggguugcaguugguguccacgaugcccacuguggggauguucaucuuggcugcgucucucacggccacguguggcucaaagauguuguugagcgugugcaggaagaugaugagguccggcaggcggaccguggggccaaagaggaggcgcgcguuggucagcaugccgccccugaaguagcgagugugggcguacucgccacagucacgggccauguucucaaucagguacgagaacugccgguugcggcuuauaaacaagaugaugcccuugcgguaggccaugugggcggugaaguucaaggccagcuggaggugcguggcugucuguuccaggucgaugaugucgugguccaggcggcucccaaagauguacggcuccauaaaccugccagagaccccaccaaggcaagggggaugagaguucacggggccaucuccacuggcuccuugcaggaacacagacgcccaccagggacucccgggcuccucugugggggcacuaugggcugggaagcacaauuugcaacgcuccccgugugcauggacagcagugcagacccauccaggccaccccucugcaugccucgucucguggcuuaaccccuccuacccucuaccucuucccgaaggaauccuaauagaacugaccccauauggauguguggacauccaacaugacgccaaaaggacauucugccccgugcagcucacagggcagccgccuccgucacuguccucuucccgaggcuuugcggaugaggccccucugggguuggacuuagcggggugcucugggccaaaagcauuaagggaucagggcaggaguggccaagccugggcggggaacccugauccaaagcacuggaccacugcuggccugggcugagaaaagcggggcaugggagacacccccgccucucggugcgugacaggcgagucauccacauuugcgguucccagguccucaccuccagucuacucccacuggguucugucccuuccucucaagcaacccugcccaucaaggcacuggcgaccuccaucuugccaaggucacagccuugaauucacuucucagcagcaucaacagagaaccacaucuccccuacccccggcugucccucuucacugacuccaaacacuggagcacccagggcuccaccuuggaccuccuuuuccgaugcucuggaaacaccugccagcccccgaugcugauggcucccugggcccaggcccaucccuccugguaaccgugugaccucuccacuggggcagcaaaggguucauaccugguaggaaccaagcuugugaugucccccaggucuccccugguuuucaccaucucaguaaccaguaccaggcuccacccgaagagcagguguuugaucccuucggccccagccaccucccaccccagcccaaggcccacuggcucugcccugcugccucauguccaccugcugcuccagcucuuccgcuacugcgauuuaagccccgccaccuucacccugaacgcccacaccaaccuccucccuggccucccaccugccccucccauccccuccccccacagcagucaaaaugaccaugugagaauacaggaccagucauuccuccuccccgcagcccagaaggcccagcccgauccggggggaccaaccuuacagguucugcccucagccuuuccauuucugaacccguggaguccugcaacccccagcaggccugcccuaucaagggcugugagcgccacaccaaggcacacaagagcguccgccaagcugaggaauaaacuccugcuucucuguggggcucuguauucccauguggaggaggauggggcuguaaucaccuaaaacugacauaggccaguucaaaaguggcccuagaaccagagcaggucccagguuccuccugggaaccgccccgggcucagaugggggugucaccuaccugugccgacagccagcuuugugucccagauggacucgggcaucgaagaggcuucucacggaaaacaguuccuugacauugaagaagucagagugcuugaggggcucauucaaaaucuugucguugaaaucuacggcagggaggaggagcgacgcugcgucucccaccgguggcagcagagacaggcagagcgcaguucccgcccaccccugcucccaagugccuucugugacaccgagguggggagccgggagcccagcagccccaggaaagaccuggaagcacagggaccuuuucaggaaacagagggcuggagccagguucugaucccgaccuugcuccuggguaagccuggucgaaccuggucaaccccgucccuuggucuuacuuggaagacagaggagaaaaagagaggggcccagcggguugcucaggucuuucuggcaccuccccgccuuguggucucagguggccagccagaaaguccccaucaggaguccagcaaggugggcagacuccaagcccagugcccccaggucacuugggcccgccugggcgagcucggggcuccgggccucggugguccagugacaccccccuagggagcgaagccugugcuaaccacuggcccgcccgcucccucucacccuauccauggugaggcgguggccucagcccgcugugcuacgucaggcaggaccgagcggcggcgagcacgggagugggaggagcccagcggagcgcgcaguuucgaccgcgugcagcgcccaggccccucuaggguucgcaucccccgcggcugccggccucuccucguucccacccaacucggcugggcgcccaguguuaccggugcuguccuccgacucgcggaucauaagggccgucgcgcuuccaagcguccugcggcucggccgagcaggccggggggucgccuucccgagaaagcccaaccagcgcgacggggcccgggcaccuggggggaaguagauagagguccuggcgccgagucccgaaugcaccacgcccgcuccccaccgcauccccaacgggccccuccgcgucccuaacggguccccuccgcguccccgcgcccuccccgaguccccuccgcgcucgccccggguccccuccacguccccgccgcuccaucggguccccgcgccccuccgcauccuccucgcaugcuccuccccagggucccgcaagcgcgcgcucacccgcgccgaguauucggggcagcgcggccgaggaugucgccauggcugggacgcggggcagagcgaggucucccuccaggccaggccgagcggccuccccuuccgucgccauccgcgcggggccgcagugccgccuacaggcccggaggagccacagcgcuguccccaggcggcugggaccucccugcgggggcggggcacgcgaggggucagggcccgggguccugggcuugagagucucgggcggggaguggagccacgguccucgcccugcagcucgccccgcccugcuaaugggaccggccagcccgggaggccccugacccuuggggaagcccgcugggcgauggggacccucgccucccgccaagugagcugugaaccacguccugcgcaaccucucgcucuccaaaacuguuuguaauauuuaaacgauauuuggcuuaggagaauuucauaaaguuagccagaucucgggucucaauuuagacucggggugcuggggggcauagcaucccuggaguacauuggacagcaaaaguccaaucguugccugccgaguggaccugcagugcuuaaaccccgucacccggcuggcggggucccaggcccugggguuucuuucgcccgggaguccacgcccugaugcugggguggcccgguccccccgcggguggcugggggccuggggcugccucacacgacggucccagcagggaaucucucgccgucccgaccuucccggcccuuggggagucgcccggcagguuccggacccacccgcagaggaacccggcccacgcgcggcgccuuuaaggccccuccgcucgcuccccagucacgugaccuggccgucgcuuggcaacaggacgccgccgagucccgcuucuccuccaggcacaauggcugaggaaugccccagagcgugcgcggagccuguggcgcccaaggccacggccccgccggagaggaccagcgacuacuaccgcgugagcgcggaccugccgggcagguucaacaacccggggugguuccggggcuacaggugaggaagcuggggcccgccugguccuggcguccacugcucgauagccccgugugugagagaccccgcaagacccccaagguccua

SEQ ID NO: 13116 - RNA, 1067 nt, Homo sapiens
auuguuaucuuuucuuuucuuuuuuuuuuuuuuuuaagaaacugauguuuauuuuccgccaaucauuuuuccguguugcuuaagagccuaugcaagaacagcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagguagcgcggaaag

SEQ ID NO: 13117 - RNA, 1054 nt, Homo sapiens
cuuuucuuuuuuuuuuuuuuuuaagaaacugauguuuauuuuccgccaaucauuuuuccguguugcuuaagagccuaugcaagaacagcuuaagaccagucagugguugcuccuacccauucaguggccugagcagugggagcugcagaccagucuuccauggcaggcugagcacuccugucuucaguagggaacuacugaauaggcacagagggcaccuguacaccuucagaccagucugcaaccucaggcuuaguagcagugaacucaggagcuggagcaguccauucacccugaaauuccuccuuggucacugccuuuucaguagcagccugcucuucuuuuucaaucucuucaggaucucuguagaaguagagaucaggcaugaccucccauagguguucacgagaaauggugccacgcaugcgcagaacuucccgagccagcguccaccacaucaaacccacugagcgagcucccugguuguugcauggaauggcaauguccacauagcgcagaggagaaucuguguuacacagagcaaugguagguagguuaacauaagaugccuccgugagaggcugguggucagcccuggggucaguaaccacaagaagccuuggcucccagaagucugccuggaucugguuagugaagguuccaggagugaagugaccagcaauuggaguggcuucaguggcagcagcaaacuucagcacagcccucuggccaguauuccuggaggauauaacacugacaucagcaggguuuucaauagcaauaauagcacgagcugccagcagaagcuucucccagguccucuucagauuuaugauauagaugccaucacuuuuccuuuuauagauguacuguuccaucuggaagucaagauuggugccaccuaaguggguuccugcuacaaggaacuuaaggacauccuccuccuucauuugcaggacaucaagcgcuccagacauugugaaaguuucccuuuaaguuacgacgggaauccagaacgacgcuguauggaccccucuguagguagcgcggaaag

SEQ ID NO: 13118 - RNA, 51921 nt, Homo sapiens
cccaggaguucugagggcugucucagcacauuucccaguuuaauggugccaaaaggaacaucugcuguaugaaagguaaacuuuuguguuuccuucagugugcugagaagaguggcuggcuuuuccugugcauaaaauaacuggauaacccugcaaggguccuuacuuaaacacggaaugugagagucucuaucucauuuuaauuaagacagguaaugaaagaacaaaacuguaaugaccaggguauaguagaaacaggauuuuaauauaauauucaagucuagcauuugcuauuuacaacaaauaaauauugccccuccccaaucaguaaacaaacauuuuuuuuuucuuuuugcuuuuuauacaaauauucaaucaccccacccccaccccaaauccuccuuccucacuaacccccgucuugcauggucucguaaagcccaggacgcaguggugaauggcacuugcaguggcaugagauucaacaucgaugggacucagcugggacuguccucacucaccgggugcagagucugguccaugaagaggguuucucucucugcucccaggggagggcugggguaagcggugggugagacucccucacucucaguuggcccugaugauggaaucuuuggugcagccugagaaaggcuagaguggugggaggggccgggaccccugcgaaggucacaggccagugccugugggcaugagagaacugcaguggucacagugggugcucuggggugcccaugggcacagguggcagugacccacaccugggaaggugucagggaaguguacagagguggcgcccgggggcaggcagggcaccaugccaugcccguuggcacugcuccuuggcaaaagucagcuaguccucugguuccagagagcagaaggcaccuaaggcagcgagugguccacgggaggccaggucagccugaccaauggcaggcgucaaucccagcagcgggagagguucaggaugaaacuggagucugggguacccugggcuggcaggugggaggaaggcgcccagcuggccugggccacucugguccauaagugcuuggcuaccagccagccagacccugggaggaugcccucagaagaugcccuuggcaaucuugaguccuuucugcuucaugcgagggaggguggagcuggcuccgugcuugaccuucacucccuuggugaagguccgcuucuugaggacaaagucauaguuggcgguagaguucauggcauagaagacguuggcguuuucagggaucuucagcucugguggggaggggcagaggggugaucagggaugcuccugggggcccugcaggauaccccuaccgcuugagagcccauacaaggacugucuugagccacagaccucagauccccuccaauacagcuccagaacuccaaggaccccucucaaugacuccugccugaggacagacucugcugagguccucacaaaaccugaugacucuuguuuaaacagggacugacuccagaaccccccggcuuggccugagcuggcagagggucaccccguccugcccauacugcagugcuggcugcccaccuggaacaggcuuucuagaauccaggucaccucccagaauccugcccuacucaggacaagggauccaaggaccaggaaaggacaggccugccccagggcucuggcgcccguuccagggaggccuguacuccuugaacccuggcacccggcaagcacuuccuuuuggcuccauuucccaccaucuccucuggcccacagccugcuauaaaccagagcugggcucgauuugugcuccugccgacaucguguggcuuuucgucaucuuuaaccucucuaggccucagucuuccuuuucuguaagaugggggucccgccuacccugcccaccuaaccgaaauggugcaagaagcugccagaggauuuagacuguaacuucuagggaucacaggagucauugcuuacugucugggcuaauggugggaggugguguucagcucacuggaaagaaaacagcgaugauaguauuuauaguuaacuuuuauggugcacauagaugcuuuauauauacaugcauauauauacacacacauauacaugcauauauauacacacacauauacaugcauauauauacacauauauacauacauauacacauauauacauacauauagauuuuuacauauaugaugaacacacuggcuacuuucauuuccauuugggggaugagaagacaagcacagagggcuuaaggagcuugcccagcgucuccaggcccaggauaccccacucugagccugcacugguucuugacacuuucccaguuucuagaauacugaguuggccuccuaguagccuguucugcuuuuagaaucacacacucauggauuuuaacacuugacacuuugguccacagcugucaccauucuuuguagagcacauguuuucuugucuuagccagaaagagucccuuccagugggccacguggcuaaccugucccagugaaaaaugccuuuucucuuugcuccucacugaugugagcuuugaacugccuguucacgccuagggaagggcacacacuggggagguccagugguugcuggggacagcaagcagacaaugggggcagccagggcugcccuguccacagugucuacccacacucugcuggugaauuuucuggggccaaaggcuuccaaccuggggcuggggagugguguggaccugcccccucugccaucgcccucuggucuucugacuuacuccggucaucugagagaaucugcagcagcucauaguccuccggcuccuccuccuccagguuguguuuguccauggccuugcggauuacagccggagccuuaucuuggcuggucaccugcaucgcggcgggggauggaccaucagggaaaagacccuggagcggcucccccagagugcaguggccaaggacccucuggaguccccucagcaccaagcacaggcacucacagccucuggccaggugcuggguccggagagggccuugucacauucuccuacuccccaagugaggccuccguccuucuguuccccaugugaggccuccauggaaugaggaggggucugucccagcagugccuacccugcuucuccuguaagagacuguucccuccucccacacuuccuugagaagcacuugccccuccaggauaacagcaucacugagccuggggaacagacagucccuaguccaagcccuggagguaagaaaggaggggccggccaggaugcucaguguggucagcauaggccaggccccugcuaccuugacccugagggccagagcacaggcggaacucggacauagggccacaggugacugcuuaaugacaaccaugcuagcuccuggcaaugaggggucaggagcgugugugaauaauggggcaccugacccagggcugggguacagaggguggggguuacaaaugguucaucugucgcaggacaccuggaggaugaagaaagagcccccaggcaaacccauucugugagcaauucccaucugcugucuccaaauccugucuagacucugacccugcuggccccuuccagggcucccagccugguugccacagcggccuccuaaccaacaccccugcggcucugguaccagcccacaccagacagagaagccagccaucauugcuccugucuuccuccccgagaaagucgagguccuggcagggcucagggccuauguggccaggcccuggauacuucccugaccucaccuccccuacagcaccgccccuucagcuccugggggcuuugcacggcugcuccuuuccucccccucugcccucaggccagccuugucccugaucacuaccuucuucauuucuguaccuggcugacaucuguccuuccccgccaacuacaagguagaccccgggagggcagggauggugcacuguguucagggugcauuugccgccaguggagggaggcacccaggccacccccgccggcuuaccaggaugcucuuguacauguugccauuguccacguccaggcugacgcggaugauacagcagucgcccaccugcugguuguagagcggcagcgcggagcuggaguugcagagcccugagacagagcgcuugugggugcguguggcagccacgggcgugguggaggcugaggaggacgaggugcugcuggaggcugagcugaugccggaggucuccggggaugacugugaggcugauucccagaacugagggagacgguaagaucagcagaucccacugcccugugggggcaccccaggccagcugccagauggggaaccuucuagaagcuguguucaggauccagggcuuccuggccccaugcauggauuuggaguggggagaugggaaaggauauuggggagaagggcaggcagucaccuucuuuuccuggccaucaggagacuccgggacgaagcugauguugaucuccuccacgucggagcuagaggagccggccgagugcacgcugagcgcgucagcgauguccccgcugcugagguaggggccacaccugagcuggucacaggacuuggagugggagcugccacugguacugagcucagugcugggggccuggcggcugggugaagaguuggcuuaguuaagggggcuccccaaggacacaucccaaccccacagccccugcacccugcgcccaaggacugugcaaagugcugggacaguugccaguacuccauucaccacagccaucugggagagcauuuaguaucaccccauuucacagaggaggaaacugaggcccaaaaaggugaggggacucaucccagucucagggccagucagcagcaggguaggauuccagggccagccucccugacucccugagcccaggcucagcccugaagcuucugagccccaaggcagcugccccuaccacccuuggccaggcccuuacucgcuccagcgcuugacaauggcuguguucuucuugguccugaggguguugcuggcugacucggaugggggcuccagcucgcacgacagguuguagcuaugagcagaggggcaguggugugacaaccaggggccaugcuccggccuucccccagcaccugcccagaagcuggagucggggugccccggccauccucaggcaacaggggcugaggcugaccaugggucauagcugcuggcccucuggagcuggcccccuaggacagccugcccccacuguccccauuugcugccccggccucaccucucagucucgcugagccgcuccacggcccggaaccaggccccaaauugcucaucuggcgcgaugcuguaguuguugcaggccgacugcagcagcuugaucugggcgaucaccucgaacuccuggggccagagggaagcacagggcggugacaaggccccccgggcagcacaggggccagucucugggucuuuguucuuggggucccuuccuccccucuacucccauccaggccuuccuguucucaaaguugggcucagccacuccccaggaggugguccuggauuauaaccuccuacccucacccuccagugggaggggacccccuucucucuguguccaaaugucccaugucccaugaaucuaaggagaggguaggaguugaaauguccuacccuggugggucuguuuuccaccccuccccaagucagggcugccugcagcugcuuaccuuccuccucuucucaaaguugaugagucugcccuggaagguggacacccaauggccgucagaaagugaccccuugaccauuacagucuccccaccucaugcugcacuaucaagagugcccaccagggggcagggcacgcacaccccuggauugaagccggugcugggcaccagggcaaggggacaugcgggcagaggcuuggggacuucuuguccagcacucucggaggacaauggacugaggccuugggugagaaggcccugcucagccaccacgugccgccugaccgcugagggccuggcuucccucugugcucagggucacugccugagggaugggcugugucccacucagccaaacccugcugcagcucuguguuugggcagcccuggggugucaccagcagggcacugagcuguuuacucauugcugggacagguguggcagcccagcccccagggcucagggaaggucucuccucccgggcccuacuccagccccgcccggcacacucacauacagauaguccuucauggcaguguccagcaucaccaggucggugaggaacgugcccagguagggaacggugcccuggaugaugcccugugacauugggguaggaggaugagcaaggccccuccccugaaggcuuucucagcccccagccccaacuggucucacuuggaacagcugggggaccucugggggccuccuggggcccacugucucccuggaccccagacucccucuagccaucucccuggcuggcaucugggaaaugccagguucccaagucguguggccccuggcccuccccagccccacacccgccugagccggcucugccaggccuguccuuucguggcugcagcuggucuucccagauaccagcugauccagguguggcucugcuaggguccagaggaggcuaccucuaauggggcccauaggcaccguggcuagagaggaaagggcccuccucccuacccccaggccagcccccugccccuccgcggccuugggcacucucaccgucuccuucggccguuucugggcucucuugggguucaucuccaggguggcaaacuuggaggugcccuccugccaggguagaggacagggucagcaaggcccuauccccucagcccucaggcacccugaccuggggugcugccaguguggucggguuccagggcugacccuguaucaauacucacuagugugggguccugggccgguggccuggccuuccugagccugccucccccucuggaaagugcggaugagaacuccgccugcugcauggugcgguggcucacgccuguaaucccagcauuuuggaaggccaaggcagguggaucacuugaggucaggaguuuaagaccagccuggccaacacagugaaaccccaucucuacuaaaaaauacaaaaauuaccuggguugguggugcacaccuauaaucccagcuacuugggaagcugaggcaggagaaucccuugaacccaggagguggggauugcagugagccgagaucacgccauugcacuccagccugggagacagagcgagacuccuucucuaaacaaauaaaaaaacuccaccugccucgcagggccucagagacucugcgcuacaguccuguuauggcugcacacuccuuucucccuugaaccuuccauaaggucagcaccccagggcuggcauuccuccauuuucuagaugaggaaacuauggcccugagaugggcagugacuugcccugggccccccagggacucagaacaggcucuucuguccuagccagaggcucugccccaucugccuuuacccguuuggucacugaucaggguaccguccucugggcuucucgugcaugccagggcccccaguggagcugugccacggagggagagggacaggugucccaggagcccccugcgaugcuccccuguagggaacucuguguguguccacgcaggaggggggcccuagaugccauuucacugaccggguaugccaggggcaccaggcagugacacuugacucccucugaggccucgugaauccauuagucacugaaaguucuccucagucaucugggguauccgccacagcuaauggggugccaugggaagaauucuacaggguucucuggucagugucucuucucggggcaggguagggaagccacauggggccuccaaaucugccucccaggucuggccaccuggccccuggcauccccugcagcuccugucccugggguaggcaggcugcccucuccuuggguguguagagcagacagagguagcgucaggagccuggccucccggggacagacugggccggugugggggcaggagccgcauccccuucccacccagcaggagggaccggcgaggaagccagaggccugcugguccugaugcccaucuacuccuccuggaaccuccacugcuacccuuacuguguccaauuaacuggggcccugucccucaaacacccaggggccaaacagaucccucuucccccuucacgcacacgggaaaggaacuuucccagcaagaagcgaaugccaccgcccgccgccccagcccccgccccagcccccgccccagcccccgccccagccccagcccccgccccagcccccgccccagcccccgccccagcccccgccccagccugccgccacuccaccuugaugagcagcucccggcucaaugaguaguuguucucaucugagaagaucucugacagcuucugaaagauccggaaacugucccugucagaagggcaaagaaggaaagagaaagcugggaaugguagggaggggugugagugcaaauccguuuuauuuuagagcugaaagaccccagacugccugaacgcagcacacaggguaccccagagcacuaacgcucugcaggucuggggagggggccuucauguuggugcaacaggaccccauucccguuuccacugagcagcuauuuccaaagggguuuuuuucuuuuuuuggagacaguuucagucacccaggcuggagugcaguggccagaugucgacucauugcaaccucuaccuccuggguccaagaaauucuccugccucagccucccaaguagcugggauuacaggcguuagccauugcgccuggcacaaagguuuugauuucaauuggaugaggguucuguggcuacaacacgaauaccugaaaaucucugauguggcucaacccaccaucugacagcuuaggaagccgagcucugaggcagagcugcugccaacucaggucagugaagggucccugcccucaggguuuguggccucccaugggcucacuaagggggugaugccagcccugugggaggucccuggugcaccaggagcuccuacagaggcaugcccaccuggaaacgucuucccacgucuucuucagacgguggauggaguugcucugcagggcagagaggauggcauacagugacgagaaguucuugaggauccggcacuccuggggcgggaagagcaggaggcaugagguggggcuggagcucccagcuugccuggccucagucccccuuggccaagccuccccuccuaaugagacagacacccagggaguccccagagggcacgccugcgacccgggggugacaggaggauuuuagcucaacccaaggaaagaguguaaggaagacgugagcauccaggcagugggcugggagagucaaggccagcaugccccugggaaggguagacuggggccuguacagggccuuggacugcagaccacaaccugagaacagaugaagccaaagugggggcccaggccccuccucuggcauacccuggccaccucgauccagugcuccaccacccuggcccugucuggggcuuucgugcuucgguucccgaggcagguggugaugacacaguuggccacacuguugaacugggugacaguggcgcggauggugggcgccaggugcuccuugcccuucuugucccgcugggaccagauggagcccaggcagugguagggcaccaccuucuugaacaguuccuggggaggaggcuaaaugucaccugguccugccccagcagucugggcuggugcuggggaagcugaggaugcagcuugagccuuguggggaucucuggguuuuaucccguguccaugcagggugcccagcacacaagugacccgggacagaacgcuggugggaagaagaggagcaccgccucgcgcagccucaccaagccccagcuccaacaggcggcucacgccugcccaccccccauccccccgccucagucugcuccccauccagacgcacaucugcugugggcgcuacaacuaagggcuuuguccagugucugccauaggcuccaggacacaccaagugccuaaugagugcugaggcuggugagccuccugaacagaugggggugacccauggaugcaccuuggugagcacccuccgcucccacaggccaggccugcugagcuuccugucuguuccaucuagaaucugcacagucacucuggaggauaggggugaccucaucucuacuguccagagguaaacugaggacuugggguuaaggaacgaccugguuacuugguguguagcagcagagcugggauuugaccagaacaucagcucuggaucagcaaaugguaggucugggacagcagaugcugccagaaggcaggcccaccccugcccugccaagcugagcugcucaccgcauccaucaguguaaacugcucugccaccagaucuggagggaacaccaagaggugaggcuucuccucacucagcccguucucugcaaccacaggugaaggccaggaaggcuguaaugauggaacuggugcuggagcuggcuccagcucuagaguuugugagggagcuggauccuguucuggagcuggcucuaguuccagagcuggcgcuggagccgauucuagucccacagcuggcucuggagccugcuggagcuccggagcuggugcuggagcuacuucuagcucugaaccuggagcugguguuggagcuggcucuggcuccggggcuggagccggcacugggcugggugcucgagcugguguuagagcuagcucgagcucuggaguugguuuuagagcuggcacuggugacagagcugcaagaggagaaaaguucaacaacaugccagccuuuccugugccuuuccaaagacacagaacagccccggcuuccagagaagccucucuccccgaacccacaaaacguguaccaggccacucuccugccuguggucccugccuguguggucugaggcucaucugggccccugacccagcaccagacccuggagccuccucuucguguggcccagcaccgaccccuccucauucacccucuggcacccaccccaguccuccucacccucaggcucugccucaauggguuccgagugcuccagcugggccaggagaaggugggcacggcgcuccaggucugagccuggcauguugagcugcacguaggccaccagcugcuugaggcagggaaaguccggagguugacagaaauccuccgaguacugguccagccaggugcccaggauggaggagauggcacuggggacagguggguggcagcagagucagaggccugggcuccccugagccaggcugggcuccugagccggccccuguccaucugaaggccaccugccccggcccaagcccccuuggcuguccagcuaaaagaaccaaggaggccccuggucaguggcgaacaccucuccccuccuccaaggaagccccgcccacagcucugcaugucucccagcacccccuccucgcuggaauguaaacuccaugagggaucgguccuccugccgggcaucugcaggucccuggcggcuccucaacuuguagcucagugcuggugagcugccuuacucucucagagcugugugugggucucaucuucccacuaauccuguucucccagaggguggggugcagccugcccacugagcacucacuauugaggggugaggcaaugugagagcagaggcucaccccaccucuugccaggggccccuagaucagggcccacugagccaaggccagcugggaugaggcuauggugggaugaguucccgccgggggcugccccgagccccagccaccccaggaccccuccacagcucucggucgucuuucuuccugcaggcgaagcccccagaccccagcccucuagcaggaaccacaagaggugugggagccaggguucugcccagccagccccggcuccggccccagccccauguacucucccacuguucgguggggacagggucccuuccucuuggcucaaagcucacucacuuuuuaaguugguccugggguccaccauccucgucggaauaggggaggaugcagccguaucuagaggaggccgugagggcgucacaucuaccguaccugcuuaugacgucuaguguuacugucugacucuccgacuagaacggaggcccaggagggcagggauuuuuuuuuuugcuuuuuuucaucaaauuauauuaaaugccuagaaaagggccagcacacaguaggugcuucauauauauuuguucaaugaauaagucccaaccagcuccuucccagcuaucugagcgccccuugggucccuccaacagcccccagauagaauccggaaucuccuugacaagugggaaaacugcuucgcccaaggccacauacaagagaggcuuggggcagagagcuuccccaugggggacaggaaaaucauaaaaacgagcaccacagccccgcagcccauucccuacagggccaggcguugagggagcacuuuccacgccucaucccgcccaggcauggugacaaccccaugagguccucuuagcacuccaguuucucuuucauaugagcaaagcgaggcucagagaggugaaucagcauugccaagacccgcagccaggugggggugggggcgagggccccugugcacccugugcaguggagggcucaugcucaccuuuugaacagcagguccaggaccuguugggugguggugaaggcucuauagguacacaggaagauggugacguaggagaggucgcugcccuggaaggcuggcaccaggugcuccaccagcuucuccagcgugccagccuucacgguccgcaccuugcaagucucauaaagguucagggccgacucauucucauacuggggugggacagaggagggacagacagucaguggcagcacacgaaucuccuggagcucagauggaaccccgagcccucagcagcuuguggcaagaggcaggacugaguaucucuagcagaaaaagguuaucagcuuuaaaaguagaauuucaggccaggugugguggcucacaucagucaucccggcacuuugggaggccaaggugggagcaucacuugaagccaagaguuugagaccagccugggcaacaaagugaaaucccccagcucuacaaaaaaauuguuuacaaaacuuaaaaauuagccagggccaggcauaguagcuuacgccugucaucccagcauuuugggaggcugaggugggcaaauugcuugagcccaggaguuugagaccagccugggcaacauggcaaaaccccaucucuacaaaaaauacaaaauuagccaggugugguggucccagcuaccuggggaacugaggugagaagaucgcuugagcccaggaggucaaggcugcugugagcuaugaucauaccucugcauggcagccugggugacagagugagacccugucucuaaaagagugaaaaaauuuuuaaaguagaauuugaggugcgggaaugauuuaaauacugacaccuucagguccguuguuagcugaguaaugguagcugcccugugggaagagcgucaucugagagcucuaacaaaauauccccauucuagagaugaggaaacagaggcuuauccaggggcugggagggacuggcccguuaggacgcacagcaucuuccccguggcacuguuuuguuuuguuuugagacagucacccaggcuagagugcaguggugugaucucggcucacugcaaccucagccuccugggcugaagcaauucucaugucucagccucccaaguaguugggauuacaggcacacaccaccaugcuuggcuaauuuuuguauuuuuaguagagaugggguuucaccaugugggccaggcuggucucaaacuccugaccuuaggcaauccuccugccuuggccucccaaaaugcugggauuacaggcaugagccacugcgccuggcuccugcagcacuguugaaguguccucagaggacucacaguggccccacagucaugaggagcugaacuggggcaguggcuccagccucccuucuggaauauuaugcagcugagucaggccccggcucucaaccuggaggaaccccagggauguguucugggagauggcaacuugcagagaccuaacagccugaagcccuuuuguccuugggugaagacagccccacuacuccagauggugugcacaucugggagaaggcauggaggauggugaggcugauggcugcacacccggggaagggaggucaaacaugaaaacccgauuaagccugggcuggacagugggggucgggaagggagugaaggccguuuccuuugggaucagaacugggggcccucaagugaaaaaguccugggagggauccccagcugcgucucccaguggagaccccgagcgcacucaccccgagccagcgcugccccuuguugccuccguggugcagcugcaccuugcgcagggagauggaguagaugacuccguugaucagcuccucaccgaucuccugcguggagcucugugaagacaacgcccggcagccgggcgcggggacgucaagggccugccuggccaccgugcaggggaugcaccuguguaaccuguuucccagauagggcacagacuggcggcugcacagaccuacagccugggguggaaugagaucacagcucgagagccacugucccggcacuccacuuccccaacccggccagccacgaccugggacgugauuaugaugaguccaccaggcuuccaauccccuaguaacuggcuucugcuccugcccaggacagacccacccucaagccauccccuuccacacaggggacuguuauucagccauugcacagauggguaaauggaggcugagagaggaacaacugguccaaggucaugcugccucggguaaguggugaggcagggaccccagggcucugacacggcugacugcauccaggcggcuaugccccaagagaaggucccccuaccuccccagggccagaggcccaugggcauccucacacucaccccuccucuacccagccuggggggcccuggcugaccuagcaggaacgcacagcuccucugggcccagcccuggugcguuggcagcccaggucugggcagguguggggcaccccagacagccacaucccagccacuuccuuccccucugcucauucaugcccucgugccugcuugggcaaugggaguucccaguucccugaccaucaucacgugaggggacgggugugagaggugacggugcugguauccaggcagaugcugggguuccacagagcccuaaaccacaggccuagacuggaacaggaagggggcaucuggccccaggcaguaaggaaaggccguugucuuaggagacagacuucccccaccuggcaggcuggccuaggucacuuagccacaauuacccccggccucacagcccccuaugccaccugcucuguccagggacggaaugagcuugcagcggguagaggagccgggggguuaaggacaucaaccucagagguuaggaaggagcuaagagguacuggccuggcccagggucauuaaccgcccagucagugccccagcccagguaggcguggagcucagagaaggccuggcagacagugcugacucaggcccuucccucaaccccagcaggagccagguagacuguccagcaugcuguggacgggacccuggccuccugccuccugcgcacccucagaggcccaggagccauccuggaaguccacuuccuccgaccugaggucgccucccacgcugggcuuuguacaacaggaaagcugcgggcauugugccgggcuccugaccgccaccgccucuggacagagagccagccccauuucuuggaaguuagcagggaacccacaggcacacucacacccacaccccacaaacagccccgccaggggaggucuggcccuuccacugacaggaaaagagacauacgcucaccccccuuuuccugacucacacaucucuccccugccuagaaaguuguuccuuugaaaagaaaagcauuagagguuacagcgaccagggcccccaaccacccgggccuccucaggggucccagacugccuccugugaaggccguuggcucagcugggagucucucucucucccagggauuuuagccacaucuggaccagcugggaggcagacaguauccugaguguccaagucaccggcaguggcucugagaucucgugcaggacaagcccgccacaggggacuaaacauuaacccugggggagcccagcacagcacccagguccuggcugagcaccaucagugccugcuggacagagguguccccaggcaggccaauccccaggaggggcugaagccagguggccucggcugucccugagcaggucuagagagcggcuccuccgugagcuggcaggccagcagcuggcccagcccugcuuggugucaugugaucccugcacccuucccccacccccggggggcccucuucugccagccgggugguggggaaggaugcaggcccaacacugagagccaugcaugcuugggguaagggaguugccacccugucacacagucggggagacgcucuagcccgcguggagcuggccugucuucucuggucgcuucccgucacagcagcagcaggcauggaaccagaccauagagcuacguggaguacaggggcuguuuaaaccaucugcucagaugguggaggugcaggcuccagagagagcugcccuggggucugggaacaaaguggcagaguaaggccucuaucccuugcccccucacaggacagagaaagaaagcagccaacagcccuggcagcugccccagaacccucugcagcaagaaaggcaggguuccagcacccacaggccacccuaggucacucuguuagcagacagcccaucugggcagcgccugggccccagggcacucuggccgggcugggagcucagagcgggaggagcaggaacggccuagugaacagcugaugcagagaaaacgcuuuccccugagggcaggugcccaggcagccgcuaugagcugacugcuaggaggagaaaagaacaccacgugcuuggcuguguccucaagggacacuccugucccaccccuagcaggcaugcugaugucccugggcucugggacccagucggcagcugugccuguaaacacacugucuggccuucuaacauuugggucagugcagugaggguggcaugggguccccggugagcaggggcccccacaccccaaugucuccagggacacagcccagagcccugaagaugaggaugggaaacagggccugguggugucuggugagugugucaccugaucagccuucucagagugacaggccagcaggaugccgugucccuggcugacagaaggaggaagccacaggccaaacccagacucccucuggguagaauagugagggucuugaggaacccuacggggccugccccagcccugccaucuccccgcucaggccaacggcaccuccucccagcaucagccuucuggugcagcuccggacucagacgccuuuccuuggaaaccguagcuaguggcccccugccccauggauggcuccaggaacucaccggccccucccaaggagaccuggcugagggcugaagcggagugaggagagggcucuagccugcaccucggccugcuccgccccugguccuccccgggccuguguguggaaaggcucacggcagagccuccgugugcgugagauuguccugggggaccucccaagccccucugagcugcugcucaggucccagucaccagaggucaccccggggugcuugccaccccccugccagcaccucacaguucuggcccaccagacagcagcucccugucucucgcuggcucugcccagccccuggcccucggccuuggugugucaucuggggagggcagcacuaccugucacaggcaacagugggggucaagagagaaugcacacagcucggugaccggcacugggaccugauggcgugguaccggacaacaccugacaucauaucccccuggggccggcgacggaugcugggcuguaaaaaccugagggaaacuugucugaggccugccuaaggcucagggaccuagccgagggacacuguaaagagaggcugagucacccugaaacccagugggugggagcagcuuucugacuucagcuuuccgcuccaauacagaagccaaacguaaaacgcaucacagaaggcugcucgcucucuacagagcccaggcuccugcgacagugcggggcccacgcugcugugcccuucuccguccuacagagguggggacccaugcccgaggacaggagccgguggggcgugugcuggcugagccagaggugagagcccaggacuucucaagucaugagcucggaccaugagccccaucaagggagguggaacgcaagggccucguguccguguccgugacccuccugcccucgggccugcccuccagcuccagguggguggacccaacccugauccccagcgcacagacaaagcaucaagaugacaggaggccagcccggggugugggugggccacacuccugauccugggcauggcagcccacagaggcggccucagaccgggacgacacgcggugccugcccaccaggaugcucccuggccucagaaaguggaggcugggaaccaaccagugcugagccccgcaaaggccggcccaucucuccagaaacccucccugccggccugugcccugcuacucacugaugggaaaaucgugccucaagcaggaggagggagaaccagaccuccaggucagccgcaagccuugggcauccagggucccuguccacgcccagccccugacagucaggugaacacagggccaggcccgggaggggcguggcugguggcagcugaggaggaaggugggcuggucccaagggggugcagggcagccccaacuuuaaccagcuacagugcccagcacaugcgggcacuuccugggugcaaggcccuuuggacacccaucacguuuaauccuccuaacgcccugccugauggacaaggaaacagccugagaggaacucgcccaggucaggagccaggacguggcagccagaacagggauuugaacccuggccuguugggacccacccaggccuggcgcugccucugccauggucucaggcuuggagcagaguccagccccuuguggcacagauguggaggaggggccagagacaggaaggauuuccucaggucacacagcaaauucgcaggggaggguggcagggccagcuuucuagcaccugcaucuccgagagguuuguggacgugcccugggcaaaaggccuacaagacaccaggccagggaagugccaugcugaaggugccaggugacgcacccgaggagcccagggcacuuggaagggucaggccgcuccccuggcaccuaaucagaaaaccucauuguggcagcugcuaccuguccacugugccaagugcugugcaggcugcuccucaggucucuugucuaacucgaggguccucaccagaacccuaacaggagagcuggcaucauguccauuuuacagaugaggaaacugaggcucaggagcacgucuacaucugcuagggggcugagcuggcaucccagcauagcucucuucucuccagagcccaggcucccugccccucgguugagauggacaaaagucuccaggaaugacuacaggggaggcugccaaagcaugcaagcuuccccauggaggaaaacgccaaaacccuccaacgcagguguccugccccgcccgccaagccacuguugggcugccaucccacugccucccccgcccgugggcagccaaggugugcggaacugggagaauugggucugcucaaagcucagcuuguccugcaugaggcugcaugcaucagugucugccccuuaacaaucaaauggggaacacugcucugcuguugcuguauaucugggaacacagugauucugggccugcaaggcuggaaguccaacccugggacuggguggccacagcaugguggcaccacgccaugggagccaucugggcggccaaccagcagcucuugggaaccaguccuugacugccugggugcagcuuccugaaaccgcuccacuggcucguucagagccugccugcagagggccagugauaaaucuccccacucuuuucucauuggcaacgcagacagguccuggaaaugcccaauuuccagguuaagaaucagaccccagcucuggcaacgagcagcuugauaucucccagggccauuccugagccucccgggaaacaggccagcaugccugagcaucccccgccuggagaaggaacaaagacccaggaccagccagccuggucccccucuucugggggacccucccgaguagagcaagaggggaaccugaggguccugggggcugccccuucagagucacccaggaagcucuccuggaagaccacagucuguacacaugcaugcagggacacacacccacacagggacaggcccuuugccuuggggucuucagugucaaagugcucaugagcccuggggauuaaaccgaagaccugcacacagugugaucaagagaucaaacagugggaagacgcgggaggcugaagggagaugcucccugugaauacagagaagcccucuucacuccagcccaccugcaacugcccucaggccuugggucagaauccuggcccugccacugaccagcuuggucacucugugcaaucuaauucaccucuguugccucagugacuuuaucugucaagugagcucuuaacagucuugaccccaaaaggagaugaugcaaauuacuuagccaaggaccuccccaaaaccugcuggcucuuauuagcuguuaucuuaaaccugugggguccaguucugggcuugcuuccuccagguagcucuccccagcguccuguggcccaaagcacuuuugccuuccucugagccauaagcuucccuacugcucaccugaccucagggcuucugggcugccugggcuuccucugacuccugguggcuccugcacacaguaggugccacagagaacacagcccaugcuuaaauccuggcugcggcccuugcuggcugcacggguguuuaggucagagacuucccuucucugacccccuagcuuccuagaaggugguguuggcaccuacucuguaggguuggucuaaggcagaugaagugaggggguggcccacaaccugcacuuuuugucuggccaaagcaacagccuguccagagaugggggcacggaccaggucaccuccagaaagcaagaacugugcaggccaagcugggucauugguggcuuggcuuagaaucgggaagauaagcggaagcccagaugugaggagaucuggcagcccagagggaagcaccggguggaagcuagguagggaaacagggaugcgggggaaggcagaaacugucuggugguuuccagagaggacagggaccaagugcgcagcgucagcucuggcaggccacauagacaccaggaaaccagccccaggacgggggguguuggcaggagggacagggacuuccccgcccccucccuugggcccuugguaaauggucauuguguucaguuuccggcaguggccuccucuccugccaggauccugguuuuccugacccagccagaagcuuccccuuugauuucuaaauagcagucgaggucuggaucucagugcugaggcugggcaaggagcgccagggccagagagagggaagacaagacccccaggcagggguggggcucagcucugccucucccucaguuccucagggacggagagagggaaccugcacggccacugugagcgcuccgccggacccucccagcacacaaagcccgagcugcugccagagguaaugaaagccagaugagcgcugggcuggugucagccucccacccccacccucccaggggucccucuccagccgccaaugaggaccagagcccuggauagaugaggguugagggaacacgucugguccggccaucugccaagcucaggaggaaagggucucucaggcgugugguguucccccaccaagagcucugcccaacacugggcggagaaacaagucgcauccaggcccugucuagguaccgggacaccaagaggcacgagacucaggcuaacaaucgccagcaaucacaacgcgccacagucuaaagccaugaagcgacuggagacgcagcaaggcaacacgaugccgcacggggacucaggagguucacugugaaggcugcagcccagccaaagcucugaugggcccugagcccccgauccaggaauggccucugugcaggcccugugcccaggcagagcagggcgaggggggcaucucuggauuccacucccucugcuguguagucagcagcagucaggugggaggcagauggcaccacccagagacccagggcacacgagaaacaagcccccgcccucaccuagucacccuccccuccauccaucacagguacaccacucccuucucugaauccuacccaguccuuaccgauucaggguguuggcacucuuuccaguuaagcagaaacaagucuugcccgcccugggccugggccacccuccuccccucaccaccaggacaucuggucccacguguuggaggccugcugcuccaccccaucccccgaccccccccccaccccgcucugagcagccccgaugucccuggucaccagauccacaucugccccaaguagggucugucuggaaggccccuauggucucaucaccucugaggauucuaggauuuggccuucccgaccacuuguuccacaccugcaucguaaaggcuaacgacgcgcugcgggcccugggugggaacugagugaaauaaggcacaggccaccgauguaaacagggacagugccgcagaaaaagguccaccugggcugcagcggccuuggugacagcaggcccuggaacgguauugaggggcgcaaaaccccagccguggucccuacuguuggacggggcgcggcggcagcccccacugcccacccugcuggcugauuucugcagaaggccccgacccccaccuauggaggagagaggagggaggcggcccgcugggaucgcccggccccguccggggcucgccccgaccugcccagcucugccgcggguggggaggcuccgacgcaccccccgcccgaccgccccagcucacccaccuccgggcgcggcaggucggggucuagcugcgugaagcugugcagcaccaccgggcagcugucggggacgcccaccuccaggcgcacggcgucccacacgcugcggcuccgccgggagcccggaaacagcggcucggcgccgccagcaggcccggccgccucggcccacaugcgcugcaccauggaaggcucgcagcgcgggcgcggggccggcccggcgcgcggcgggggcggcggcgcggcccgcgcggcugggcuuugccaccgcugugagcccgcggcccggcccugcugaugucaggcuggggggcggggccggaggggaagaggguggggccggggaggggcggaaccggagaguccgagggacgcgugcgugcgcgcgcccgcggccccgcccucgccgaggucagacccggggcgggaccgggagccuggaggggcggggucugaacaaagagggcggggccggggaggucgaggggugcgcguuggcugggucucccggaggaccggcugucacgugugucguggggccuuggguaccccgguuaggcaccguuugcgugucacgcugcugcagugcguguguugcguagggcugaaauguguacgugcugaucauguguggggaagccgcccuggagucagcuaccccgaauuccagcaaagccucuccccaacucuguggccuuccacaaguugcuuaaccccucugagccucacuguuucuucaucuggaaaaucuggguagugaaaaugacuuccucaaacaguugcggggaggaugacauuacguaauggacaugaagcacucagcacugagcaccugcaccugacuacaggcucaggcggaguuuggagaggcugaccauguguucagugacccugucagugcaauuggaaauccugaguguggggcugugugugcagugggggaaagggucagagaguggggcccuaccuuuuuggggcaaagccccacacuauccccuuacagacacccucagaggaggggaagccagggaggugggggagagcggaaggcaccaagguuggggcugagaggcaucugacaaggaggaaggcaucaagagugacaacgcugggcagagcacauggcugcguggccugucagcuggggcugcuuguggcuuggacaucccuggucucaggguggaaguggggcugcuggggcugaaggggaagcagggacagggacauccucaacuacucuuucuggaagccagugaggaaggaagacagccuggggcuuaacagcagggccaggagaauggaugaaugaaugggacccuuccucaugccucacucaucacugggccugcccuggccucagccuucagucuucauggaggccagcaauugcugccagcagcccuggccaugccaaccuccccaggucugguccguacuauugggccucaguuucuccaucuguaaacugagagggcgggaccagacagcacauuccacgagcacaucuugcccccuucccaagugccaauccucagacacccacgaaacacuuccacugugacuggagugaggcggcaguucauccguucagaacaagacccccaugugcacacgacuagaagggccuacuucacaaaaauuauggugguaaguugcagcuggguggaagcucuacugguuuucauuuuacuucucugaauuucuaauuucuaaaaucaguauuuuaauaaucagcucuaugugauaaaugcuguuuuugagacagucucacugucacccaggcuggagugcaguggugugaucucggcucacuaaggccuccgccucuuggggucaagugauuuuccugccucagccucucgaggagcugggauuauaggcaccugccaccaugcccagcuaguucuguauuuuucguagagacaggguuucaccauguuggccaggcugaucuugaacuccugaccucaagugaaccgcucgccucggccucccaaagagcugggauuacaggcaggagcacuacgcccagccuguuuuuguuuuuuuuuuaagaagcaagauggguagauuugauuugggauggagaucccuagaggcuguuuaggaagccuccaagccguuuggccagggaggguaaugugggugaggcguauuucgaggcaggagguccccacagggccacaaagaggugaccgagacacugcccucggcccuaagcuccuccucccaucccuuucuucuggggccaagcucccaaugccuccggaaacugaaaguccagaagcugccugccacugacuuuaucuccucugcucucuuuaucuccuucgcugagugaugggccugggaacaagcgcccacccguuuuauagcccagaaggacaagugacucaugaggacauagaggaaucaccacuauucuggccuugaagguccugggugcuggggcgagggguggccccaaggaggcuggaguggugaagaguaaagaauucaucacacuaaaccccccaacgcggcuggccuggcucccucccaucugacuauaucaucuacaggagccagggcgggggagggcguuacuuagccagucccucuggccggugucuguuuuuacaaaguuccucuuccugccuuguuccccuaccuuugggacucaccucccaacuucugggaagccugaucacugcucuggcuguacaugagacacacacacacagacagacacaaagauacacagagaugcacacacagagacacacacauagagacagagacacagacacacacacacacacagagacacaaagauacacagagaugcacacacagagacacacacagagagacagagacacagacacacacacacacacacagacacacaaagauacacagagaugcacacagagacacacacauagagacagagacacagacacacacacacacacagagacacaaagauacacagagaugcacacacagagacacacacauagagacagagacacagacacacacacacacacagagacacaaagauacacagagaugcacacacagagacacacagagagacagagacacagacacacacacacacagacacaaagauacacagagaugcacacacagacacacacauagagacagagacacagacacacacacacagagacacauacauagagacagagacacagacacacacacagacccacagagacacauagagacagagacacaggcacacacacacacacauagagacagacacagagacacagacgcacagagacagacacaggcacacacauuuagagacggagacacacacacagagacauuggaacagagacacacacgcagagauagagacacacagacagagacauaccuacucagagacauagagacagacacagaggcugggugugguggcucaugccuguaacccagagcuuagggaggcagaggcaggauuucuugagcccagaaauuggagaccagccugggcaacauagcaagaccccauucuccacaaaaagggaaaaaacaaguuugagauagacacagacacacacacacagauauagagacauagacacagauacacacacauagagacagaaacacagauacacaugccccccuaaugaaggcacagauaaaguucccugcacaggauguguugcccaaugcccucagaucgggcgggccugacucugccucacacuguuagcaacugggguuggcauucaugggacgccuccugcaugcaagacccucuccugaggccuccuguaagcuguggggacacccuaaccaagggcaaggccauccugggacagcgugugucaccaguggaggaacgcagcaccacucacaguguucuccucaaaacccaaaccuaaaucaaggcaggccucugcauauaacugccauuugugggauuacaggggacagagaaacauguucaacacaccacaagggugcaauccacaaauccaggcugugggaaccucuaugggacaaacaacccaguuucuucaacaaauacauuucagaggaaaaagaaaggggaaacuagacuaaaagaagggucagagacgucuaacaaaugcaauguguggauuuuggaucaugaugucagcaagacaacuguuuaaaaaaaacaacuauaagacauguggauugucugaacacugcuacauauuggaugacauuagacaucuuuuuaggugugagaaugguguugccgucacuaguagaguuacaucuugggcuaucuguggauggcaucacaugccugggauucauguaaacaucuccaggggcgggcagggaguggggcagugagaggugaacaagaguggcccugcaccgauggucgugaaagcugggggucuuuaugccauuuucucuauuuuugugucuauuuggaauuauccauaauaaaaguuauaagaagaaaaauggccagacgcaguggcucacgccuguaauuccagcacuuugggagguugagcuggguggaucacuugaggucaggaguucaagaccagccuggccaacgugguaaaaccucaucucuacuaaaaauacaaaaaaauuagccuggcauggugacgcgugccuguaaucccagcuacuugggaggcugaggcaggagaaucgcuugaaccugggagguggagguugcagugagccgagauugcaccaccgcacuccagccugggcgacaaagcaagacuccgucucaaaaaaagaagaaaaaggacacagcuugagacucacccucugaugccucugaggcucccagcaguccuccagagagggcuacaaacuucugaccccgggcagugacuccugccaggcucaccguuuccuguauuacucucugugggcacaggggucacugauggcaucuucacuacaaaagggguugggggcucugcuguggggacugaggccgugggcagcuagaacccgaguccggaugcccacauggggcuaucagagauggcugggggcaguccaggugaacuuggguggguuugacacucaaggccaaugacaacccugugcuuggcgguuggagccucugcugggaggaacuaaggacucucgagaucacuaagcacugcccggaagugggggguucuuaugaaucggcauugaucccuuccucccuccugccccagcucacgcccccccacacccccaccuagccuucccagguucccaaccuccccccgggacgugcaccugccuuuccuugggggcuacaaccacaagccccuggagagcacggcugcacagaccuuucggaagucgggacgcugcucgcagaggaacuuuaaaaggcaggcugugaacugacagcuggcagccagaucccacccacacauguguuuuguuuggcuugcgaaguguuuuuaaaauuuuaagccaacaguaaaaggucaggcgacuucacauaaaaacccacauuucccucuucuccuguaacucugggugaccugaccacaccgggucuguguucccaagugccgccggaagcugacugcagcugcccccuguagccagggcauguguggggacugcucugacaacugucccccacucccgcagugcccagugcccgacacccuggggagucacugccaccccggaggggccaccaauucaacaugugacaacccgaaguggagggaagcagaggaggaagagacggagggggacacacagauggaaacugagcccaagaaccaagagugagccugaggaccacagcgagggacagcgggagagggaggcagcaggcagacggaggcgaggagcgauuccuugggcaucuuaagucacucucuggccccugagcagcugucucguuuagggaaaagguguguucaggcugaaucucuguggucccucuucucccugcucccauacccagacaccgcggccaguggggucuugaucccgcaaagccccccacugcccucaggcagaagaccacuggcuugguguggccccagcuccccacuccagguucccucucagcagaacugcugcagcuccuucuucaugccgccccuucugucuggcuggugcgucccuccuuccacccauuccuuggccaguacauccuuggccgguaccugagaggcagaucauaaaagcugccccuguggaccuucaagucgggacccaggccugccuuaacgcagggccccagacagugggcuuugggccuggggugcaguucugggggcugccggacacacagcaguucagagcgggaacugggcacagggcagugacugggugacuguggccuuuggccaucaccuuuuccaaccugggcuuggccaaggccgggaggaauggcagccagguacccugacucaggucaggcccugguggaaaaccugucaccuccuguugggcagguggaggucacugaccccuuucugucucuugugaucuauauuuagagccuggggaggacaugaaaagggugaggccuggacacgcuccuuggucauuucccaacacugacgucaccauuccuagccugccuagguccugggguggcccucugugggcgggugagcacacaccuuggcaggaggugacgcagcuggaccacgcgugggaacucccggcacagcgggcgggccuggcucagccccaccuccccugccacuggguuccuggcaaccucugguggcuucuuccuccuccuucugccgccaggaugcagggguccccacaggcgagaggcugaacucagagcuggccaggugagaagcgaagcaccgaaccacugaaaucuccaggagaccacacuggguggcagaugugacagcaacccucugaccucacggggcgcugccgucccagcacaaccagaacaaggugugccgaugccgggagcagugcaaacggcccuggacggggaugcagagggcuccggaucagccuggggcucgcuguggggcccugcugucaucccuuggaaauggguacacccccggcauauugagggggaggcacgcagaggaacaaacgugauaaaugcauccaugggcugcaaaucgggggccgcucggacagcugucccccacuccugcagugcucgcugccuggcacugugaggagucacugccacccccgaggggccaccaauucaacaugugacaggccgaaguggagggaagcagaggagagaggaagacauagagggaaacugaacccaagacccaaaagugagccggaggaccacagcgggagagggaggcagcaggcagacggaagcgaggagacagggcgcagaggggcugcggggggugcugggcacaccuggcugaggaagggaccaaaggcccagagggucccauagucucagccuaguaccuguccccaagcccaggggcccugaucacaaggcagcaacgucuaucccacagcugugauagguggggcacaucacaccccgaggggccccggcauccaugaucuccccuccuggaggguggucagccgccauccuggccccggacuccuuggaaaugcuccacaaagugccagcuggaaaugucacagcacagggggccuugggaugagccagccccaaggggccauucuuuccuguggguuuggggaacucuuuuaagaucuggagugcagauucggguuccagugccugcucugugucuuccuagccuuaguuucaccuccuggggccucaauuucuccaucaguaaaauggggacaguaaccgucauagcaccagcucucaggcuucucaggggagcagacagugaagcagugcacagaaguccuugguaauccaagaagcacccucuggacggagcugccaggacagcccgcagccacccuggacugacccguggggcugggggcagcuggggaggccaagcgugugcacacgggcaccagcagcagagcagacccccagucuccucucucauacccgagaugggagaugaagacuccccugugaguuccaaacuccuccaaccaguucuggcagggaagaaagggaguccugggaaagcaacucccaugccuggggcucggcggugacccacccagccccuccccggcagaggcacugguugcccuggaaacucaccucggugguggccggugcuggcagaggugccagccaaggugucgggcuuuggagagcggcacgacgggcgacggcccuucuccuggcggucaccacagagacacaggcaaagaacacagagcccuuccucccccugggcacggcaggccuggcacaaaccuggccugcuucccgggccaugguggggcgagagccagguggggagugggcccugcgggaggcccucugccagugugcucgucgccugcgugcccuaguggaguggagcacccgagugccugggccuggugucacccgcguggcugucauaccugcugcugugacaggcaggaccaggaauucccgcuuguaccaggccaugggccagccgaggacgaguggagaggcugccccaagcuagccuagcuuucucccuuaauucuccaaguccccacucccauucccccugugucgggggccuggaaaccaccacacagagccagaaaggugacagauacaaguaaccaaaucaaaacaggguucggucagcagagccaccaggcggaugugagucuagccagaggcacugggaggcaggcaggagaccccacucacuuguucuggaaggcuucccugcccccuagaccugagcucuuccaucccuggcacccaggcacgagauuuccuuucuucuuuuuuuuuuuuuuuuuuucccugagauggaaucucgcucugucgcccaggcuggagugcaguggugcgaccucggcucacuauaaccucuaccucccgguucaagugauucuccugccucagccucccagguaucugggauuacaggcacaugccaccaugcucggcuaauuuuuuuuugagacaucgucucacucugucacccaggcuggagugcaguggcauggucucggcucacugcaccucugccucccggguucaagcgauucuccugccucagccuccuggguagcugggacuacaggcgcaugccaccacacccagcuaauuuuuguauuuuuaguagagauggggcuucacuacauuggccaggcuggucucaaacuccugaccucgugauaugccugccucagccucccaaagugcugggauuacaggcaugagccaccacacucagccacuuggcuaauuuuuuuguauuuuuauuagagaugggguuuugccauguuggccaggcugguucgaacuccugaccucaggugauccaccugccuuggccucccaaagugguaagauuacaggugugagccaccgcacccggccacaagauuucauuuuaacugggcgcaggggugggggaugccaaugguuuguuucauuaaguagggugguaaaaaauaauaauauuaccaccacuacucccaccauucagaaaaaacaccaccaaagguaacaagaaagggcugccaucagaaagaagggcaggcuugaaaugaguacauuuggcuuuuagaauaauuuacuagagugacuacuggaguuguaaacaaccaccaccaccaccacaacaauacaacaacuuacuaccuugucccuguuuuucucauuuugcugcaaaccagacauuggaagccaucagacgcauccaacacacccgucugacaaguggaaagacugagccccagagagagcagggacuugcccaagaucucacaggaaaagugucuguccagcugcucugcaaagcuugcagacgcuccuuccauccugaccugggggccagaacacucagagccccaaccccaaagcccagagaugccagggcgaagucagaggccaagagucucagcuacuuccuuaccuuccugggaaccuggccggguggaugcccagucccuggcugcaaguggagggcacagggcagggagcagaacagcagaggcggggaggagagggugugggcaggggcuguggagugcccccacaggcacaucaggcccuggggcccggcuucccgcccagacacugccccagcagcaccucgcucccagcccugcuccucugagcaucucacauccucuuccgguggcuuugugggccuuaggggacccagcugagcagacaguucagggccugggagcucugccacccucaggguggagacucucaggggaugugggugggcaugugggggugggcugggcuggggugggggagcaucagagaaauggagcuagaggguuucaggggggcccugaaaccuaccucccuguacucacccuguggccagaacaagucaccuccacuaaaaucccuccaccauuucugucccacccagaagagaaucccaaguccucaccugcccacagcccccuccuacuaacuccagcugccaguguccucugcugggaaccauguucuucccccuuggucucaggacucggcccccagucagagcagccuucuccaacaccccugucuuaaugcagcaacaccaucccugccccagccacccauucccuguucuuuuucaucuggcacacuuccuccucugugccaggcuccaaggcccuguccccugggaaagucaggcaucaccacuggccucucuugcgcacagugacucaaccuugaccuucgaggaacaguagagccaaccaggcugugaauuggucagcccaggacugaaauucugauccccagggacucuggaacccugggccaaugauuuagcaucucugggccuuaguuugcuccuuauaaaaugggcacaagggcgcuggaggauuccacaagaacucagcaugggcucggcucauggccgugcuuggcggaugugcaaugaucauuuccaguggggauugaggaguucaggugccaaaggguuacaugccugccccggugccaggcacauaacagacauuugaucaauguugguggaugcugccccugugccaggagugccauagccugacuccaucccuggcagcaagguccagauggcaguccggggucugcccagugcucagaguguggcuuguaacuggauccuagcagauagcuuggaaauguuugcugauguagaagcacacacagauggguacugcaaggcaggcccggucccgggagaggggaccagcgaagaggucacugucuggguacacacuauuaacgggagagacgcccugugcagacaggcaggaucugggugaggcaggcggcagggguugguauccgagcagggauccgaggcuguccccagccucggccucucaccccgguguugcugacugccuggccaugugacugugggcauuguguggugugguucggcugccacuccagguuuaacagggagcuuaccacgugguuugaggggguggggagggcuuucccugagccucgguuuccuugucugcaaagugugaccucgcagccuagccccguagaagggcucaguggccgagaagguguuuccuacagugugcgcauguuugguuggguggggggcuuaaagaggcccuggaaagaagcgcucaacuuucuuuuuuucuuuuuuuuuuguuugagacggagucucgcucugucacccaggcuggagugcaguggcgccaucucggcucacugcaaccuccgacucccggguucaagcgagucuccugucucagccucccgaguagcugggauaacaggcaugcggcaccacgcccagcuaauuuuuguauuuuuaguagagaugggguuuuacauguuggccaggauggucucaaacuccugacgucgagauccgcccgccuuggccucccaaaaugcugggauuacaggcgugagccaccgugccuggccagaagcgcucaacuuucauagugggggugggggaccaguagggaaguggcagggaaccaggccacccugcugguguguuugugagcuaaugccuuugcuuggacaagcagcucccggguaccaggcccucugcagggccuugcaucucucacacaagcuuucugugcuauucuugaauagcccacuccagcccagcuucccaagccuguuacccccauaucuccccugcccccaccuccagcacaggucagccuggccucagggccuaauccuggggcuccuccuuucggagccagggugggcagggcuacccggggcagugggcacugagcuugcuggaaaggccaucgagggacugcugacacagucaggcugcaggaggagcagcaccagcugccacgcagaaaugcaggagucccgaggagguggugcuggcaggaggggagcagcagggccaugcaccccuccucccacccacguggucccuggcccugccucugccgccagccugggggagagcagggucuuuguucccugcuggccaggccgccacgugaugcgccacaucacugucacugccuggaacgaagacugccauggacagccgaggcgcuggggccugggggugaggccaguuggaggagcuccaccugcagccuccccaccgcaacucuggcugccuucaggagcugggccuagugagggccauacauggcacaaacauuuccagcuacugugcaugaagcuuacgacgacccugaccccaggcuucucccaggacacacgaccuaccaguggucccacgaugcucugcccagcacgccggguggccugggauaaugcaccuggccacacacacaagcccaggcuagcaaaacccaacccacaggcaccuuucuagguaggggcaggcccuggcugggugugaggcccauuguuuacaaacacugugcagcugucgcuaggagcugugacucagagccagagcagugacuccucgcgaagcuguuuacucggcaccacauccuguccaggaagcagauagcagaggccgaggccuggcuuuugcuccucuuuccugcugcuaacuugacucagggagcugcuggccagacucgguguccagcuggggggacacuccagcuccccucccccuggcuucugggaaccugaggccccgucaagucgcucaacacacauucaggcccagccggcucugcuagguagugaugcuguggucgugcaggagacagauccugccccuggaggcugcaccuaugccuggcauccccucccucuuuggcucugacuaggagacucccagggacgggggcaucacugacaccugucacugugcagcccagaggcaaauucuugccacguucagaagccuggcaggcaggaucaacuccugacaccccuucguacccuagagccuagucuggcgccgccuuuagcacaccucaauggggacaaagcacuuuuccagacagccucugccagaaagaugaggccacagucaucaucucuguuguaaaacugagaaaacugaggcccagagagggcgaacaacuugccugaugucacacagcgugucagugccaaggcaggguguaaguccggcccccaaggcugcuugcuuuccucuacucuguuccaaauuaaggaucacaaguagauuuguuccaggcagcacacagacuugacgcugcugggacccugucccugggguggguggucuguccccuguaggaggccuaggcuggggacucugacuuccauuucugcugaucacugcugccuccaaccuggcgccuaaaccagagucaacaacccucugauaauuucuacuacgcacugccaugccaaugcggguaucauuucaccaucaugauaugugacgcagguuuugcaggugaguuugaggaugaagcucagagauggcacaaagcucauccaaagccacacagcagagcagggcuuccaauccugucugacucucagguuugcgcucccagucacuccuuccugcaaacuccuagcaggaagacucuuuaugacuuuucauaaagagucaaaggugauuuuauccucacggugcccuucuaaguucagggugcaaguaucucaaugaccuccaguucacaggagggccccugugugugguggggaggcagagccgcagaaugacuuguggaaggcuacacaccccaguggggaggaccuuuccccugcuccaggcuagggagacccggggacucccaggagcagcagagccacaggacacaccugccaaggcauguggaaggugggccacccuggaguggggagagaaaggcaaagaggggcugugcuuauuuuggcaguuggggcuuggcaccaccccaggcaggacaguaauucagcaacuggcugauucacccaccgcagggcuccccugcacuggcugccugcccgccggccccuauuaccagcccacugagucacgcagguugccaagaagcugaggauccaagaauccaggcccugccccagccgcucccauuggcuuugagcccagcaggacccagcccugccaagggcaccgcagcuccccuccccaacccugccugcccccagguccagcuccaggaggaacccaacgucuaacuguaaggauccaagcaguggcugggagcuggggccuacagugucaggagucuugggccaaacccucauccugucacuuccuggcuggguggagcugggugagccaggcagguuccuuucccuugcugagccuugguucuagcccaucaacagggaacaucucugccucaaaaagacugcaugcugaaaugaaacacuggaugggaagcacucaagauagggccuggcacaugcuccgugucaaaaaaauggcaccccaagguggcauccucugcagggaagaaccagaguucuuauuuugaauucaaggccagcugauacuucuguaaaaugcaggugaaauguugcagcaaugucaacugccauagaguuucuaaacaauguccauuucucuacugaaggagaugaggaucaguaacagaguuuguagccugcacugucugcagaccacagagagggcccggggcacaacuauauucacacagccagaccacgcgaauuuacugaacaccuacuaggugccgggcacuauucaagugccagcgauagaccagggaaaaacacaacacauaaaaaucaccuuuggccuaggucauaauaaguaaaaugcauuuuugaaaauaagaaugcuccagaaggcaaaaacagaacagggaaggcugauggggcccauggggcaggagcaggugcuacaacugcagacaggccaggagggcugagggggcagcgcggguauggauggaaggagggacauuaaaacauuucaccuuggccgggcgcgguggcucacgccuguaaucccagcacuuugggaggccaaggcaagugaaucacuugagcucaggaguucgagaccagccuggucaauguggugaaacccugcaucuacuaaaaauacaaaaaaacuagcucgggugcgguggcucacgccuguaaucccagcacuuugggaggccgaggcggguggaucaugaggucaggaguucaagaccagccuggcuaacauggugaaacccuguuucuacuaaaaauacaaaaauuagccaggcgugguggcggcgccuguaaccccagcuacucgggaggcugaggcagagaacugcuugaaccugggaggcagagguugcagugaccaagaucgugccacugcacuccagccugggcgacagagcaagacuccaucucaaaaacaaacaaaaaaacuagcugggcaugguggugcgugccuguaaucccagcuacucaggaggcugaggcaggagacuggcuuaaauccaggagguggagguugcagugagcugagauagcaccacugcauacuccagccuaggcgacagagcaagacuucgucucaaaaaacgaaacaaggcugggcgugguggcuuacgccuguaaucccagcacuuugggaggccgaggcgggcggaucacuugagcucaggaguuugagaccagccuggccaacacgguaaaaccccaucucuacuaaaaauacaaaaaauagacgggugugguggugcaccuguagucccagcuacucgggaggcugaagcgggagaaccacuugaacccgggagguaaagguugcagugagcugagaucgugccacugcacuccagccugggcgacagagcaagacuccgucucaaaacaaaacaacacaauucaccuaccacgggguccuuucaugccccccauggcggggaguuuguaagcuccuugagagcagggacucuguuccccaggguccugaugccuagaacagcaucuagcacacagcuggcucuccauaaaugccuagaugaacaagugagcucgaugggccagacucuaaaauauucggagguucuugugggaagaucaccaggagagcuccuuggaagaggugaugaggcuggagaggagccugagggagggcagggggccggagggccagggaagggcggggcgccucugcucaccuggcucccucccauuaaagugcuuuccccccaggaaccaggcugagaagagaggcagaggcaagccaggcgggggaagagcgaggaggaaggcagccaggcuuucugggaagcaagagcccuuuuucuuagaagcagggcccuggaguuucccagaagccagccugcccugggacgguggaggcggugguagguggucagguuggcccugguuuaaccuaggggguuuucccuuccuaaauuccuggcccaggaacaauucuuggggaaugggucucuguucacagguaaguagaaguugcucugcugugggcagagaccccuccccaaggcacagccguggcuggugaggaugggggaugggggcugagcccacagucaggccccuguguccagcaggcccuggucgcccagugcgcucgggccaggggaaccaggacaaacgggcccuugugguugggaggcugccugccgugccagggacacugugugcccggugccgccaccagccugcugccugccugaaggggcugagggccugggaaguggggcuacuguuuccaaagggaaccuccuaagcugcccuggccucuggagagggcacagggccuuggcuggcugccaggagguggcagggcuggugcccgcugcccucuuucucacaguccuuugccugcaagaaguuccccagggcuagagaagcgcaaucccuugggacucuagggcccugggucugagggacacugcugugucccacccuccugccacccacugucccguuaaucccugggcuuggcuccuuccuuggcuucuccccuggaaggcgaggcucaagggccucuccuaucugccucaccugggaugccugacaaaggacagcaagguaccagcugcccuccccugcccagggacccuccaagagcuguucaggucuccaugccagcaucauggugggcagcugggugugccaggcaguggcugagcaguucccagccaccacaacccugugagcuggguccggcugucaacccagugacacaugagaaaacugacacucagcccuccucauggucacggcuccggccugggccuggugcuuuguuuguuuguuuaucugagacagagccuuguucugucacccaggcuggagugaucucggcucgcugcaaccucugccucccagguucaagcaauucuccugccucagccucccgaguagcuggaauuacaggugugcaccaccacgcccggcuaauuuuuguauuuuuaguagagaugggguuucaccguguuagccaggcuggccucaaacuccugaccucaggugauccaccugccucgacuuccaaaaugcugggaguacaggcaugagccaccgcaccuguccaggucuagugcuuuaaaaaggcaaaaugcaaacccccacucccucccacacucacuguggcaacgugcugucccuccccaggcaccagccauguguccccacacgcagccacacauaccccuucauauaugugcucccucagccacugucaagcuugucacaucugagcacaugcaugcugcagacauacagggucacccaaaggcagagagaugcaccugcccccaacacacgugcuagaaugcacaugugccccaccgcaucccacagcacacagccgcugccccugcaggcccagaggcccuggauacacacccugcucccugcauaucugccagacagcaaucuccucagggcugcggagaggggaggaggcagggcuccaugcagggacuccccgaccccagaagcugggaaggaaacaccucauggaguccugaagaacggcaagcggcuauuucgagggggcagggggaccaggcaggcggugccgccagcugagaccuuccacacugggcacuacccaccugcccacuacccccagcugucaccuccccagccacccagggccuggggccagguggacugcuucacccuugaacuccaguccugucaacugggcagcagggccuggaacuuggccucagggaagaagggggucgggggagagugggaugcguggccugggcaacuuacucgccuccucggggccguaguuccccuaccugaaaaaaaccuguggauucaacuuagggccugcaagugucccugcccuccacccacacccuggcuccccaagggcagcgggagcuggugggccaucggccaucucccuucugcgaagcggagcagacauuggcugccaucugcggagggccugcccaugcggugccaggggccucaggaacaucucauacucccccacauccguaggcccacagaggaggcaauggggguacagaggaguuaaggaacccacuugucuggguccccugaggccaagccagggcucccaucccaccucccaggcuucucuccccuugaccucuagacagcccgaacuucccugcggcugcuguuccuggugaacaucgugacagaugacagcacuagucaggugauuaaucagcugaucacuugaucaucgggacagauaagugcugcugcagcuauagcccagcagggguggggugggguggggugggagcgggaaucccuuuggaauggauucaggucaggugguggcagcccccaggacuuaaauaccuucugccacccuccccauggucccacccuccccacggucccacccucccaguuuugaacuuacauuacaggcaaagggcacccccccacacacacaucugggaucaggacaaagucccaagaggggcgggugccagaggugggggaaguuccuggacucagggccucugguuggccaagggugcuuucuucuuucucuccacuggacaagcccaccccucccugccuuccucccucggaacacaaaggucagaugggcacaccugaccucucgggugguguccagcagagagguccugcacccuucccaugggagcccuuucuggacccuaaccuagaaagagggaaggacuggggugcccuccagcaggcagugggucccggccccccuuauccuucccagaaggacugggcagcucaauucaguuaauuaugugcccaccaugcagugcagggaggggaggccaacgugggggaggggguggggaagguccuuagugcagcacccacgcaggguggguggggcugugugccugaaucuucccucccaccaacuggcuuccugcagccuguuccuuggugcugggcugggggcucgccucauccgcccgccuucuuggcguggcauccggcaagaacgugggccggggcugcacgcaccuugggcugugggccggcagcuccccgccacugucugugcugcccucugcccugccccuccuccuguggcacuccagcuggggguggcugggcagaguccccaugggaucacccugagcccagccgacgacccccaagugaacauacgagcccaguacccaacuccggaggugggcacaccccuugcccauuugacagauggggcaagggaggcucagaggggugaaaucaugacccagggucacacagugagcaaaugaccagggucagacuggcauccuggcuccaugagagcaccgggaguuccugcagaguugucaccaacaguccuacccucacugccauccccagagagaacaucugaggcaaccaggucucauagccuucccauccccaaaguccaacccacugggcaguguggccccaccugccuuuucccaccauucuacugccccacccucucccagggucuggggcuccaccucgcuccuuccaggcuggacaccccucauccauguucucaccucggcucccgcagugcccaagucugggugcagggugggugcccacaaacuaaggcagccccuaugggagcccaagggcagggcuuucuuacacccucacagcaacugcggggaccucagggcagacagggaggcucagaggggaccugugcugcuucuaggaugcccagcaauaagcgcugagcuggaauuuggacccagguguccugcuccaaagccaccugccucaccugaggaccaggggccugauggccgagguggaugccgacaugugaggaggaagggcaguggcggccugguccugguccccucacucuccugccccaaggccccaguaggugacauaauucacagggcaauguuuaugcacugaacgguaaacacacaggcagagggguagaugggccaccaauggggaaacugaggccagcgagaagggacacacuaaggucacauagucagucgguaucaaaguuggcccagaaccacaguccccuguuccaagggcuguacccagcccaaccacaaccuggcaugccauccagccccaggccagggagcccacggcugcagggcggcaaagcacacgguaccacacgugguaccccauggccccacacacucuggcuggcaccgagccaucgcugugcuuucugaccuugcguuuucugacauucugccacugucaacucucacucagguauccaggaagcggccucuguugcuaggggacuggcuugaugccggguggcuggcagaguggggagauggggaggggggaguggacuggggugucccucaggaaggauccaggggcagagucuacuggguccugugucaggguggagggccaugagaaguaucugaggaaacucagcaggucaggccccuuccuccccaggcucuaaugaagguccuggacccuggucucugcauuuucucuuucagccucagagucuucuuuuugggccaggggugggugugcgcugguggggguuggaagugagccaucggaaagcccaucggaaagccccagcccggagccuuccugcaggcaaguauuuugggggccagcaguugccaagcaacugcucuggguugccacgggaacacucccuuuuuucuggggcuugucauucuuagggggaugccacaaugcuucccguucccuuuccucuccacuuccucacccuggcuuggcugcccugggaggggacacugggaguccauaagcucacaccccaccccuaugggggggcccacauaccccuggcccuaagacucuuugaggcuccagaaucaagaacccccaaaaugcaaagcccagaguccaaggccuucauuagagcagggagacgaugaaaggggcucauuagcucuguuuaugucuccuugccgccauuaaccaccacuuggggccuagggccucccagccccgcccugcccagcagccgggcccagcccugaccguuggaaggccacuguaauuggaaggaaugugguccuggugccuggcccuucccaggcuugugugcacacggggaggcgccauugccaagcugccacuaccuagcugugggaguuccuuccccuuccagugccucaguuuccccaccuggaagugaggauggcaguggcacuuaucuugcagagugcugagcagauacaagggacacuuuagcacaaggccuacaggcuggcugucaucaccaggcaccucugcagcaggggacagagggaaggacucuguggagaauaguccuguggcuagcgugcaauggugacugaccacgccacugauggcagaguggccacugaauccagguccccaggcucgcagcccaugccuucuccacaagaucugucugccccauaccccugagccuuccacagaagccagggugcuucccacaggccaggcacccagcgccagccagguguacagaggccaguaucugcugugugaaucaaucgcugaaccaacugucaaggaccagcagccucaggggcgggccugguagcucggugagcgaggagguggugggagggccuugugcggguagggaggugacaguaagaaauggccucuugcuggaugcagugucucaagccuuuaauccuagcaguuugggaggccgaggcggggggaaucccuugagcccagguguuugagaccagccugggcaacauggugaaacuguuucuacaaaaaaaauccaaaaauuagcugggaguguuggcgugcaccugccgccccagcuacucuggaggucugagcccaggaggucgaggacgcagugagccgugaucuggccccugcacugcagccugggccacagagcaagacccugucucaauaauaauaauaauaauaauaauaauaauaauaacaacaacaacaacaauaauaauaauaauaauaauaauaauaauaauaaaauaaaggaauggcuuccacucauuccacuccugggccagcggcccgcugugcacuccgcucccuuucgcugaugccaugugagcagcuccauggcggggaccugaccccugcuccucagccccacacugccucgccccuuuguauaucaaaggcgccucugaggggcugugcugacccccaccaggagcagcaggaccaccucaggcaucccagcuccccugaggcagggucuggggcugggguuggggggaaggaccccucaagucucuaucugcacagacagcccacccgugcccagggcugccuuccgagcacccgcagaccugggccugcaguaacaggagagcuaucugcaaaccgcagugucaucagccgcacggccucuggagaggccugagaaaggccggcucagcuugcaggcgaggaaccaaacgaaaggcaaacuccuggccccugcagccucgcagguccccuaucccuccucccugccuuccuuuccgccccgcugacaccacggucugcaaaccaugguccuccucgccaccccugucaccuccuccuccgccccccgccggccuccgacgcaaagucgccacccagucaccccgccucggccccgccugguuugauuuccucccgugugugucacccaugagguggccgugccccuggccuguuuacagcugugcgcaagcuccucgcgacccgaaagcgagaccuuugucugcggcagcuccgcgccgggcugggcggccgcacgggagggcacagcgccaccugcuggugcugccgccagagcgcgccaagcugaggagcaggcgggcuccgcucacgcccccacacccccuggcugggggcuggguuccugcgaugucuuccgacuccccgcugcuccccuaguccccguaggcacgcggguacccggccuuugggagggggaucauucccaauacuccuguuacggguugaacugugucccugaacaaaaagaucucugguacccgugaaugagaucuuauuuggaaauagggucugugcggauagaauccggaugaggucauacuggauuagggugggccuuaauccaaugacugcuauccuuaugauaacagggaaaauuggacagacacgcacaggcggacagacacgaacugaugaaggcacaguuugcagucacacgucuacaaaaccaggaacgaaugccaaggaaacuggcagccaccagagguuggaagaugcaaggaaguauccucuccuagaaccuucagagacagcauggccuugcugaccccuggauuuuggacuucuggccuuuagaacugugagagaauacauuucuguuguguugagccacccagcacuuugugacagcagcccaggaagcugacccgauagacacuggucccagucaucacccucugugccaucaccacaccuccccuccacgaaucaaccacgaccacaggacaccuccuucuggaaucucucugugcccacgcacuccccagaugagcacuuccccuuccccuggcaacuccccggauucuuguuacccccaccccccgccccggcauggccugggcccaggagacagauacgaaaugaaugagugaauauccaccuuugcuacuucgucauauucagauguucguaaaaaucuguauguucgucauauucagauguucguaaaaaucaaguggcagcagugcuggggguuaaggaaauggggagagugauggcagaugugugaggggagacaaggggcacuuccagguacucacagccacccugggagcugggacagccaaccaguguguucucaugcucccagccccugaggcucagagaggggaagccaucugggucaccaagcuccugccucuugccaguucugugaccccaaacuagccauugugccuuucagggccuccccagucuccugaccugcacaauggggaugguucuaacgucuacuuccuggggacaucaccacgcuaaugugagacaauacuacaaaaccuguuagcugccucacagacuuagagauggaaggauuaggaaggaaaagggccuucagagacugcaggguccugcugaccccuggauuuuggaccucuggccuuuacaacugugaggaaagaaacuucucacaggggcgagacacagcccggaauacaagucggacaggcugggcacuggugcugugaucuggggaaagucacucccuucuuggucugguuuccucauuugcaccaugaacggguugaaaaugaagcaaaaaucagauaucggcccccuguggcauaugggagcaucuuccaaugggaacaccuuccaauggcucccaugauguuuguuuguuuguuuguucguuuguuuauugagacagggucuggcuccgucgcccaggcuggagugcaguggcaugaucuuggcucacugcacucaucaccucccagguucaagugauuuuccugccucagccuccggaguagcugggauuauaggcaccugccgagacacccagcuaauuuuuguauuucuuuuuuguagagacgggguuucaccacguuggccaggcugguguugaacuccugaccucaggugauccacccgccucggccucccaaaaugcugagauuacaggugugagccaccgcgcccagccuccguuauguuuagaaucaggccugacugccuccucucagacacugucccaggcagccuccacacuggccccagagaucccugccuccugguacauaaguugcugagugauccccuuccuccgagggugauuggauuuagugacuggcuucucaccaacagaacacagcacaggugaugugaggucacuuccaagauuuacaaaaaacuaugacuucugucuugcuuguuugcucuuguuuuccuccccaccuucaccccucacucuggggaagugaguucugaugccgugagcugccugcccuacagagagacccacauggcagugaaccaagggagggcccccaccaacagucacagaagaacugaugcccucagucaaaacugaauccugccaauaacaugagaauggccugggggcggguccugcccaguccagccauggaugagaccccagucccagccucccuugagaccugggggcagaggcacccagcugagcugcccuggaucuggguccacagaaacugugugaugaucaaugucuguugcuggaagcuguacauuaggguaguguugucacauagcuguccacaggccccugggcugccccucccacccccagcucacuugggccacacuggccuccuuucucacuccucucuggccaaacucauuucugccucccagcccugccugcugagccuucuccaucacacuguccagacucgugcagggcuggcccaugcuuugucuucuggucacagcacagauguccccuuagcgagaccucucagauccccacccagcaggccccagcccuccauggcagccccggcauuauuuucgcugcagcacugcuuuuuccuuucugugccuguuugcuuuugugcccuguccaucgcccccuccagacugccagcucuggagggcaggccccccugggucacuuucagagccacacccaagcccaacgcugcccccccacaacccagggugagugcuugggcacaccugcugaagggaaagaggaagcucuuggagcccccucccgccucugagcagcuaacauuguggagagggaugcuaguaauggggggugugcauuggguagaggccggggucccccagagggacccugccgggcucucccugacuccaguugcuccaaugaguacagugggcacugccucccccugguggccggcacuagcacagcagcagcagccucaggcagaaaacccagaaaacaaaacacacaccuuuguuuggguguugucaagguagcagcucuccugagucccagggggucaaaggagcagaaccugcaggcuccagggguaauucaaggcgccucagaagcuucauuugcuccccucuuucccucugcugguccugggguguccaguucacucgugaggccuccucacuccaaccagggcaacggcucuggccccacuuccaaauaagaacccugaggcuccaacaaggacagucuugucccacaagaguuguccagugcuuggccacgcucugcaccaccccaggcccucagcccuucagcccccccggcuucucuugcucagaagaaccuccaagaagaaggcauuuuccacagaccucgguggguagugggggcauccccaguggagaccuaaggccgacagacacgucuacgagccugugggacccuuggagucacccaggccaaacauuccaauuuauagagcaggaauuugaggcuuccuuuccuacagccccguccacacugaaggggucuuuuccugcuuccaggugaucacagcggugaacacagaaccccacaaucuguccucuccaggcugccccagcccagacagauccugggaaccuuggagaauccccgcccaucaagcuggcguguccuccccuugccccccaccccgugccauggccccaggcauguugcuggguacuggaugccccugcccguggcagaguagcccccgcccucuuucuucuuucccccagucacuuccccagcgucccguccuacucugagccccaggaaguguguggugugugugucugcgugugugugagcauguaugcgcaggccugcgccuguacgugcgcggagaagcccaggcaaaugagcccacaugggagaugggcagggguccccaggaucuuagaggcugucauucccaaagcaaaccccacgggaagggugagccgagcccuuccuggccuaagaggccggaacccucccuucaucucuggacuccgccaacuucgugugccccgggcgagucccugccccucuccuguccucaguuucccuacugucccgggcgggguuggacgcggagcugcguaagcgcacgcucagcguggacgcggcgccgggcucccuccccccggugggugugggcuggggcauacgguccucccuccacccgcgacgcgaggcuggggacggcgcgcacucaccuggcaaucuaccaucauccucagccucgguggcacaucgccggccccagggcgggacccggggcucgcagaggccgcucgccugggcccgcgcgcggcgcaggggugcgcccggcugcggggcucauggcgcggccuccgguccccgccgggcccaggacucugcggcccucggggccgccccggcagccgccagcgccgcucccauugucugcgccgcgccgcgcuccggccgcucgggccucgccgcucgguuccgccccggcuccccgggcucgggcccgggugggcggggacagccgcggccccgccccagcccgcccgcaggugcgaggggcgcgccccgccgcgugagcucggggacgcgcucgggggcgcgcucaggccucccucccgcgggccgacgcggguguuccccccgcggggcagccggg

SEQ ID NO: 13119 - RNA, 1319 nt, Homo sapiens
agccaagauuuuucucucucuuuuuuuuuuuuuuggcugagcacaggguacuuuauugaugguauaugacaagguggggcucccuaggccccuccccucuucaaggggucuacauggaaacugugaggaggggagauucaguguggugggggacugaguguggcagggacuccccagcagugagggucucucucuuccucuugugcucuuacuggggcuggugguccaggggucuuacuccuuggaggccaugugggccaugagguccaccauccuguugcuguagccaaauucauugucauaccaggaaaugagcuugaaaaagugguuguugagggcaaugacagccccagcauugaagguggaagaguggguguugcuguugaagucggaggagaccaccuggugcucaguguagcccaggaugcccuugagggggcccuccgaugccugcuucaccaccuucuuggugucaucauauuuggcagguuuuuccagacggcaggucagguccaccacugacacggcaguggggacacagaaggccaugccagugagcuucccguucagcucagggaugaccuugcccauagccuucgcagugccaguagaggcagggaugauguucuggagagccccguggccaucacgccacaguuucccggaggggccauccacagucuucuggguggcagugauggcguggacuauggucaugaguccuuccacgauaccaaaguugucauggaugaccuuggccaggggugcuaagcaguugguggugcagaaggcacugccgacaaucuugagguuguugucauacuucucaugguucacacccaugacaaacauuggggcaucagcagagggggcagagaugaugacccuuuuggcuccccccugcaaaugaggcccagccuucuacaugguggugaagacgccaguggacuccaugacguacucagcgccagcaucgccccacuugauuuuggagggaucucgcuccuggaagauggugaugggauuuccauugaugacaagcuucccauucucagccuugacggugccauggaauuugcuauggguggagucauauuggaacauguaaaccauguaguucaggucaaugaaggggucauugauggcaacaauauccacuuuaccagaguuaaaagcagcccuggugaccaggcgcccaguacgaccaaaucuguugacuccgaccuucaccuuccccauggugucucagggaugugguuuggcugacgaugcaaaagaagaugcggcugacuguagaacaggaggagcagagagccgag

SEQ ID NO: 13120 - RNA, 1319 nt, Homo sapiens
cucggcucucugcuccuccuguucuacagucagccgcaucuucuuuugcaucgucagccaaaccacaucccugagacaccauggggaaggugaaggucggagucaacagauuuggucguacugggcgccuggucaccagggcugcuuuuaacucugguaaaguggauauuguugccaucaaugaccccuucauugaccugaacuacaugguuuacauguuccaauaugacuccacccauagcaaauuccauggcaccgucaaggcugagaaugggaagcuugucaucaauggaaaucccaucaccaucuuccaggagcgagaucccuccaaaaucaaguggggcgaugcuggcgcugaguacgucauggaguccacuggcgucuucaccaccauguagaaggcugggccucauuugcaggggggagccaaaagggucaucaucucugcccccucugcugaugccccaauguuugucaugggugugaaccaugagaaguaugacaacaaccucaagauugucggcagugccuucugcaccaccaacugcuuagcaccccuggccaaggucauccaugacaacuuugguaucguggaaggacucaugaccauaguccacgccaucacugccacccagaagacuguggauggccccuccgggaaacuguggcgugauggccacggggcucuccagaacaucaucccugccucuacuggcacugcgaaggcuaugggcaaggucaucccugagcugaacgggaagcucacuggcauggccuucuguguccccacugccgugucagugguggaccugaccugccgucuggaaaaaccugccaaauaugaugacaccaagaagguggugaagcaggcaucggagggcccccucaagggcauccugggcuacacugagcaccagguggucuccuccgacuucaacagcaacacccacucuuccaccuucaaugcuggggcugucauugcccucaacaaccacuuuuucaagcucauuuccugguaugacaaugaauuuggcuacagcaacaggaugguggaccucauggcccacauggccuccaaggaguaagaccccuggaccaccagccccaguaagagcacaagaggaagagagagacccucacugcuggggagucccugccacacucagucccccaccacacugaaucuccccuccucacaguuuccauguagaccccuugaagaggggaggggccuagggagccccaccuugucauauaccaucaauaaaguacccugugcucagccaaaaaaaaaaaaaagagagagaaaaaucuuggcu

SEQ ID NO: 13121 - RNA, 1342 nt, Homo sapiens
gauuuuucuuuaaugaaaaggauucguuuuuccaaauucuauuuccaaagccgaggagauugccgggcuggagcgcaucguuggugacgcuugcccgucggacccuggcagcggcuggaggaggcucagcccaucgguccguccggaggggcuugcgggagggguugguuuguuugggauuuagggguugguugaggauuuguuuuguuuagguagggaguauuggggugauaaguuagaacaacugcgaaacgaguuagcgggcgcauucggccggccucuucuuucacccccgacuucaugcggcuugggcugagggcggaccacauucggccccgccgcugcgugccggcuucguuccggccgaaauuugaaaggaggaaaaacgacgcgaucgacugaaggacccugccggccgggacuggucacccgcagagaaggaagaaggacgaggaugcggauggcggcgcugguggcagggaccggcgucucugugcgcgcgggccgggaccgcgauccucgcgcuggggccagccagccgccgccccgagaggucucgcccgcgcugagcccugucccuggggcccccgccccuguugcgcccggagcucagccacagauguccagccacaauucucgguuggccgcagacucguacaagaauugcguuuggacaaucaguggcgaagccccugaguucagggcccuggucuccugcgggguuccccuucgcuccuaaaaagcgccaguccaggacagcucggagcugcgcgucggaccaccuagcaggcgcucagcagcggcugcccauccggcgguaagguggacuagcaagcacgcggauccugacccugugcggggauccccaucgccccuggcguggcuccuucgaucgcggcccggaguccgcagaguggcccgcguugggucucagcgccgccccaggucgagggggaaucuccucugucuggccuggggaaccccgacuccccucucccugcccccagccugggaucuccgggaauccggaaggcaggagccccaggccgggucgcguuuccgagcccgggguccgggcugcuggauucgugggucccccgcccccgcccagccccgcgcacgcaccggcucgggcgcucuccgcuuuccuguggcugagucgcggccggggcgccugcgguggcgguggcggcgguggcccgggcggcggggagugcuggaaugcgccgccgggucaccugcagcgcccguggagccggacugggagccggcgggcugccgaggcgcaaggcugaacccgagcaggcgccucuggcggcucggggccggggcgggcuuuuag

SEQ ID NO: 13122 - RNA, 4138 nt, Homo sapiens
uucuuuauuuuaaacuuaacauuguagcccaagcuuuuaauuuugauguugggaauucuccaaaaccaucauuuaaacauggauagguaauguuccaucacaaggguucagaguauguucuuccugggguccccgaguuagcuguuacagcuuuucccgucuaaucaguaaauaagccuccagugguggaacucguggucaagguucugccuucugaguucauguguuucucccuccucuacaucagaauccaccucauugccuggagaucacgccaccaucuucagaaaagcuggucucagugaugcgguuaagugaccucucuacagaagaugaugacucaggucacuguaaaaugaaccguuaugauaagaagauugauagucuaaugaaugcgguugguugucugaagucugaggugagggagguagggggcugggauagcuacuacccugaggaugugcaggagcacccagguggauuuccugccuggucccucagccugcgucugcaggccuucaggccuccucugcaggguugccccgggcuucaguugccugccccgggagguagcuggggcagcaugggaucccaucccaccaacaagggcccucucuauugagcauguagcuguccuggugcuccacaugggugguccaauuugaauuuuuacaacagcaugugaagccagugguguuacuguccucauuacagagaugaaauaccuaggaaacuagggccuaugccuuccgcuuuauauaagguuuaacaaaaacaggccgggcaugguggcucacgccuguaaucccagcacuuugggaggcggauccccugaggucaggaguucgagaccagccugaccaacacggugaaacccugucucuacuaaaaaacaaaaauuagccaugcgugguggcgugcaccuguagucucagcugcucaggaggcugaggugguagaauugcuugaacccaggagccagagguugcagugagcugagauugugccauugcacuguagccugggcgacagagagagucucugucucaaaaaaaaaaaaaaaaaaaaaaaaaaaaaaaaaaaauauauauauauauauauauauauauauaaauaaaaaaauuaacaaaaacaaagccccaaagaggccaaggaaguuuguccucaguugccgugcucucucuuggggugggaugugacaauggaauuggaaauagaaccuggaaguccaagguccccaacuaggaaauuggcagaguugucauuaaaauccaggccuuagacuuggauugcuaugucagccuaugucuucacugcuaacacgaccugugucuuuaauccuccacccuguacucgagguccagggaaccuccuggagaaccuagggcuggcugccuagaauaggcccuucuuggccaggcgugguggcucaugccuauaauccuagcacuuugggagacugaggagggcagaucacuugaggucaggaguucaagaccagccuggccaacauggugaaaccccaucucuacuaaaaauacaaaaauuugccaggcacacgccuguaaucccggcuacuugggaggcugaggcagaagaaucacuugaacccaggaggcagagguugcagugagcugagaucguaccgcugcacuccagccuggaugacagagugagacccuguuucaaaagaaaaaaaaaaaaagcccuucuuccccuauaacucaaagugcaagagccuuuuugugacaucucuccuccuauggugugccagccaaaccacgguuugcaaccuggcuucguucccaacccacaagucacuggggcucucuguacugaguuuccucaucuacaaaaagaaaaucagcaucucccaggagagucagucuucauggcaguuaacugagauugcacccauaaggcccuggcaugcagccuguguaguucucaauuggaaggcuccuuauuuuuuuguuuuuguuuuuuuuuuuuugagauggagucucacucuuguccgcccaggcuggagugcagugggcacgaucucggcucacugcaaccucuggcuccuggguucaggcgacucucuugcuucagcuuccagaguagcugggaucacaggcaugugccaccacaucuggcuaauuuuuguauuuucaguagagaugggguuucaccauguuggucaggcuggucucgaacuccugaccaaaagugaccuacccaccuuggccucccaaagugcugggauuacaggcgugagccaccacgcccggccggggccuuauuuugguccaaagcauugagccuagcaauguggcauagaggaaggaccucccuucaguggccccugccugggucccccugcucaggucaagaugcaaaaaggugagcgccagauggccaaaagguuccuggaggaacggaaggaagagcuggaggagguggcccacgaacuggcugagacugagcacgagaacacgguguugaggcacaacaucgagcgcaugaaggaggagaaggacuucaccauguaagguggcuccugcucuguccccgcugaucuauuccucccuaccaggcugccuugagcccugggcaauaauggaaagcaacguaggaggugggcacaggcacugugccugugcccuggagccuguucaacagucacacaauuaauuacaguuaauuaccugguugugcuuaugauuuguacuaugagggaaagggaggaccccguggauuguggugugggacuggguagcagggaacuguuucuggaacaagugauauuuaagggguguccugcaggaugguuaagcauucggcaggugggugcuagggaagaaagcacgcuacucagugggaacaucuuaugcgaaggccccaaggugggaaaguguuuguagcugagaaauggaaggcaggccagagugggugggcagaggauaagggggccacauagguuggcagggggcuggcucucagcagccacuuugaggcauuugcauugagggcauuuggaagccauggaaaggauuuauuuuauuuaauuaauuuauuuggccgggcgugguggcucacgccuguaaucccagcccuuugggagccaaggcgggcaaaucacaaggucaggaguucgagaccagccuggccaacauggugaaacccugucucuacuaaaaauacaaaaauuaagccgggcgucgcggcgggcgccuauaauccuagcuacucuggaggcugaggcaggagaacugcuugauccugggaggcaucucaaaauuuuugagauggagucucgcucugucauccaggcuggagugcaguggcgugauccuggcucacugcaauguccgccuccuugacuaaaguaauccuccugccucagccucccaaguaacuggaauuacaggugcccacuaccaugcccggcuaacuuuuguauuuuuaguagagaugggguuuuagcuguuggccaggcugcucucgauaacaccugaucucaagugaucugcccaccucggcuucccaaagugcugggauuacaggcuuuagccacuguauccagccuacagccauggaaguuuuaaaagcagggagguggccugacuagccuuggcugcaguguagagaagagguagaagggcucaaaaucguaucugaagauggugcguaggagggcgugacaguggaggggggcagugcagagaugacaaugguggcuguuugagagaaacagggccacagguagcuaaugucuccugguguggaggcccuggucuggugcccaggcagauguaacuucuggcccugguccuuucugaaggccacccaggccagaagggcugucccugcccccuccccuacuuuucccugaccagaggugagcccccuagggcauugugaggcaagccuuggaucucugggcaugcgggggccugggagggcucacagagccgucuuucuggccccagacuucagaagaaacaccuacaacaggagaaggagugccucauguccaagcugguggaggcggaaauggauggggcugcggcugccaagcaggucauggccuugaaggauaccaucgggaagcugaaaacaguagguggcagguggcaggaccccagccaug

SEQ ID NO: 13123 - RNA, 4138 nt, Homo sapiens
cauggcugggguccugccaccugccaccuacuguuuucagcuucccgaugguauccuucaaggccaugaccugcuuggcagccgcagccccauccauuuccgccuccaccagcuuggacaugaggcacuccuucuccuguuguagguguuucuucugaagucuggggccagaaagacggcucugugagcccucccaggcccccgcaugcccagagauccaaggcuugccucacaaugcccuagggggcucaccucuggucagggaaaaguaggggagggggcagggacagcccuucuggccuggguggccuucagaaaggaccagggccagaaguuacaucugccugggcaccagaccagggccuccacaccaggagacauuagcuaccuguggcccuguuucucucaaacagccaccauugucaucucugcacugccccccuccacugucacgcccuccuacgcaccaucuucagauacgauuuugagcccuucuaccucuucucuacacugcagccaaggcuagucaggccaccucccugcuuuuaaaacuuccauggcuguaggcuggauacaguggcuaaagccuguaaucccagcacuuugggaagccgaggugggcagaucacuugagaucagguguuaucgagagcagccuggccaacagcuaaaaccccaucucuacuaaaaauacaaaaguuagccgggcaugguagugggcaccuguaauuccaguuacuugggaggcugaggcaggaggauuacuuuagucaaggaggcggacauugcagugagccaggaucacgccacugcacuccagccuggaugacagagcgagacuccaucucaaaaauuuugagaugccucccaggaucaagcaguucuccugccucagccuccagaguagcuaggauuauaggcgcccgccgcgacgcccggcuuaauuuuuguauuuuuaguagagacaggguuucaccauguuggccaggcuggucucgaacuccugaccuugugauuugcccgccuuggcucccaaagggcugggauuacaggcgugagccaccacgcccggccaaauaaauuaauuaaauaaaauaaauccuuuccauggcuuccaaaugcccucaaugcaaaugccucaaaguggcugcugagagccagcccccugccaaccuauguggcccccuuauccucugcccacccacucuggccugccuuccauuucucagcuacaaacacuuucccaccuuggggccuucgcauaagauguucccacugaguagcgugcuuucuucccuagcacccaccugccgaaugcuuaaccauccugcaggacaccccuuaaauaucacuuguuccagaaacaguucccugcuacccagucccacaccacaauccacgggguccucccuuucccucauaguacaaaucauaagcacaaccagguaauuaacuguaauuaauugugugacuguugaacaggcuccagggcacaggcacagugccugugcccaccuccuacguugcuuuccauuauugcccagggcucaaggcagccugguagggaggaauagaucagcggggacagagcaggagccaccuuacauggugaaguccuucuccuccuucaugcgcucgauguugugccucaacaccguguucucgugcucagucucagccaguucgugggccaccuccuccagcucuuccuuccguuccuccaggaaccuuuuggccaucuggcgcucaccuuuuugcaucuugaccugagcagggggacccaggcaggggccacugaagggagguccuuccucuaugccacauugcuaggcucaaugcuuuggaccaaaauaaggccccggccgggcgugguggcucacgccuguaaucccagcacuuugggaggccaagguggguaggucacuuuuggucaggaguucgagaccagccugaccaacauggugaaaccccaucucuacugaaaauacaaaaauuagccagaugugguggcacaugccugugaucccagcuacucuggaagcugaagcaagagagucgccugaacccaggagccagagguugcagugagccgagaucgugcccacugcacuccagccugggcggacaagagugagacuccaucucaaaaaaaaaaaaacaaaaacaaaaaaauaaggagccuuccaauugagaacuacacaggcugcaugccagggccuuaugggugcaaucucaguuaacugccaugaagacugacucuccugggagaugcugauuuucuuuuuguagaugaggaaacucaguacagagagccccagugacuuguggguugggaacgaagccagguugcaaaccgugguuuggcuggcacaccauaggaggagagaugucacaaaaaggcucuugcacuuugaguuauaggggaagaagggcuuuuuuuuuuuuucuuuugaaacagggucucacucugucauccaggcuggagugcagcgguacgaucucagcucacugcaaccucugccuccuggguucaagugauucuucugccucagccucccaaguagccgggauuacaggcgugugccuggcaaauuuuuguauuuuuaguagagaugggguuucaccauguuggccaggcuggucuugaacuccugaccucaagugaucugcccuccucagucucccaaagugcuaggauuauaggcaugagccaccacgccuggccaagaagggccuauucuaggcagccagcccuagguucuccaggagguucccuggaccucgaguacaggguggaggauuaaagacacaggucguguuagcagugaagacauaggcugacauagcaauccaagucuaaggccuggauuuuaaugacaacucugccaauuuccuaguuggggaccuuggacuuccagguucuauuuccaauuccauugucacaucccaccccaagagagagcacggcaacugaggacaaacuuccuuggccucuuuggggcuuuguuuuuguuaauuuuuuuauuuauauauauauauauauauauauauauauuuuuuuuuuuuuuuuuuuuuuuuuuuuuuuuuuuugagacagagacucucucugucgcccaggcuacagugcaauggcacaaucucagcucacugcaaccucuggcuccuggguucaagcaauucuaccaccucagccuccugagcagcugagacuacaggugcacgccaccacgcauggcuaauuuuuguuuuuuaguagagacaggguuucaccguguuggucaggcuggucucgaacuccugaccucaggggauccgccucccaaagugcugggauuacaggcgugagccaccaugcccggccuguuuuuguuaaaccuuauauaaagcggaaggcauaggcccuaguuuccuagguauuucaucucuguaaugaggacaguaacaccacuggcuucacaugcuguuguaaaaauucaaauuggaccacccauguggagcaccaggacagcuacaugcucaauagagagggcccuuguuggugggaugggaucccaugcugccccagcuaccucccggggcaggcaacugaagcccggggcaacccugcagaggaggccugaaggccugcagacgcaggcugagggaccaggcaggaaauccaccugggugcuccugcacauccucaggguaguagcuaucccagcccccuaccucccucaccucagacuucagacaaccaaccgcauucauuagacuaucaaucuucuuaucauaacgguucauuuuacagugaccugagucaucaucuucuguagagaggucacuuaaccgcaucacugagaccagcuuuucugaagaugguggcgugaucuccaggcaaugagguggauucugauguagaggagggagaaacacaugaacucagaaggcagaaccuugaccacgaguuccaccacuggaggcuuauuuacugauuagacgggaaaagcuguaacagcuaacucggggaccccaggaagaacauacucugaacccuugugauggaacauuaccuauccauguuuaaaugaugguuuuggagaauucccaacaucaaaauuaaaagcuugggcuacaauguuaaguuuaaaauaaagaa

SEQ ID NO: 13124 - RNA, 19033 nt, Homo sapiens
cuucccgggaaguuucaaguuugaaaguccuggcggagggucugcggcuuccgggaccggaguggcugagagaagggccccaagcggccggagcggcgccauggaggagggggcgccgcggcaggugaacggcgugggaggggcgcgcgggcccggggggugcgagaaagccucugucaucgccccggagccccgaaccgcggccgcuucccccgauccuccccucacccgcgccccuucccugccccugcccuggccccggccccgcgacgcccucgcagagcagaccugaucuccggguucggugguuccuggaccuugcacagucuccaaaucaguccgcggcugacccggagacugaaccccaaccagcccgugagcgaggacggcugaguccgcagugugcgccaccagggugguccccagaguguccuuaagucgguucuccucgguggggcuccaaggccgacgggaauuagccgggauagaaaggcggggcacaggggccuggggggguuagaaugugcgcgcagcggggggcgcagucugugcgcgcuuggcaguggcaggaguccuucccggagcacaggaggcacgaggggagcguagaugagaggggagcggccucccccgccccagggcgggaaccuuuggguacauagcggguucuagaaugcggagggggcuggguuuccugccagagcuggcaguaggugcgcgugggcccggaggaccgaggccaugucuaucugcuccugaggagggagaggugguguccuguuccggagcgagugguugggaggggggcauuugcggacaggaguggguccccgcaaagagcggaaaggaggugguguguguguccauguuggaguuccaacccagggcagacgggaccauggggguguugcggggugcguguagacuccuugagcgcccaagccagucguuuaggccgccuucagggcuggggcucggucugcccccucccacccccuuccucuggaggucccuccgccuguuccagacguagcuuguacacauuuuccgauuuccugcggggcuccgcccugcagcggcagcugggugacucaggaccccgguggccgggcccccagcuccaugggaccuuuguuugcuccggucuuuggcucuggcccuguggccuagggcggucagaggauuuccugagccucgcccuugcccucugacagcugggccagcaggccccgcugaggucuggggugggggggucccugagucugggguugcggccccuuccacugggcucaggagaagauggaacacagagagguaagaugggguuccugcaacagcccguguugcggggcaucauggguuacccggccugaggucaccuuuggcaccgguugguuugaaaugcuggcggcuggaaaggagguguuccuguuccuggcuccaaccugggugaagccgugagagagccuucuacuuccucccgggagcugagcagggagugggcacccggagaccuccccaguuccucucugugccucugcuuugcuaccuguggcauugggacaucaggggaacaagcccuggcucccaggccccuggcugccuucucauguggcuucgugugaaccccuauucggcguagcuuuuguggcuccuggacucuacuuugggucccagauguagagagagcagccugauuacccagggcugccagggacagcuggggcccgagagaugguggccccuccucugugucuugacugugggcaaguuacuucaccucucugggccucaguuuccucacuagaaaauagggguaauaguacaggcgugguggcucacaccuguaaucccagcacuuugggaggccaaggcagguggaucaccugaggucaggauucaagaccagccugacgaacauggagaaaccccgucccuacuaaaaauacaaaauuagccgggcuuaguggcgugugccuguaaucccagcuacucaggaggcuggggcaggagaaucgcuugaacccgggaggcagagguuguggugaaccgagaucgugccauggcacuccagccugggcaacaagagcaaaacugucucaaaaaaaaaaaaaagaaaaagaaaaagaaaaaagaaaauggggguaaugaccaccgcuaccgggugggguggcugggaggagugaugugguaauauaugcaaagcacuuagaauagaaccuggcacccauuuaccgugugaacugucccccccgccacauccuucucuaacgggcggaggacaggagccuggccuagaugaguggccucggaguuuccaucuggcucaggccugagcucuaaggggagagaggcuuccaaaacccugugcgagucaguccugggugccgucccuuccuucgccuccaucugcagugagcaaaggcugcugguggccgcugcaccccauggcuguucuccacccucugcuuuccaccggcucugcagccugggccgagccaguggcccccagaggaugagaaggaggugauccgccgggccauccagaaagagcugaagaucaaggaggggguggagaaccugcggcgcguggccacagaccgccgccacuugggccaugugcagcagcugcugcgguccuccaaccgccgccuggagcagcugcauggcgagcugcgggagcugcacgcccgaauccugcugcccggcccugggccuggcccagcuggugagugaggagcugagacccccucaggacagaaggcucuaggcccaucuggccccuggccuuggcccuggccacuguggcgagaccaccucauuuccugccuauagaucaguaggggaaggaggaaaggccacagugggggucucggcucugggugagggacuccugugcucgauacccccgugcacagagccuguggccucaggaccccggccgugggcagagcagcucagggcucggcaccuagaggcucuccggaggcagcugcauguggagcugaaggugaagcagggggcugagaacaugacccacacgugcgccaguggcacccccaagguaaggccccacagucugauggcaggagcacccuggccccuggucugacagggaaaugcaccucagccauugggcucauaaggagacaccauuccagccugcagccugauggggaaaauacagccccaaaccccagcugggugaggaaggcauggcuguagucucuagugugacagagaaggccuugcccuggucuaaugggauccuagcccagccccagucccaacucccagcaugauguccagaacugggccucaguccuugucugacaagaagacuuggcuguggcccugauaugaugacggaggcaggaccuuagccuugaucuaaugggggaggcuuagcuuagccccugcccugaucugaugggggaggcuuauccccagcccugaucugaugggagaggcuuagcuuagccccugcccucaucuaaugggggaggcuuagcuuagccccugcccugaucugaugggggaagcaucaacccugcucugaugggggaggcaugaccacagcccugaucugaugggggagaguuagccccagcccugaucugaugggggagaguuagccccagcccugaucugaugggagaggcaugaccccagccgugauaugaaagaggaaauuugaccccagcccuuguuggucagauggaaaaggcuccccugacccaccaacuaguccaacaagggaggcuugacuuuaguguuuggccuagagguuucacuuuaacccuguuuugaugggggagacccggcuccaguuccuggucugaugggggaagcuguggcccaggccuggucugaugggccugugcuauggcuccauaggagaggaagcuccuggcagcugcccagcagaugcugcgggacagccagcugaagguggcccugcugcggaugaagaucagcagccuggaggccaguggguccccggagccaggugaggccuugagacacagggagggcggagcagggaagagcagggccugagagccgccguccuucccacagggccugagcugcuggcggaggagcuacagcaucgacugcacguugaggcagcuguggcugagggcgccaagaacguggugaaacugcuuaguagccggagaacacaggaccgcaaggcacuggcugaggucaggccccagcccuggcccucuccuaaggcuggcuuguucccauaccacccucagcaggggugugaagggaggguggccguguaaaagcaggacuucucuguugagacuucaugcggaagguggcuccgggugaccugggcugcugcccccugccauauaccccacgaaccuggcucuacguuguccccucugcaggcccaggcccagcuacaggaguccucucagaaacuggaccuccugcgccuggccuuggagcagcugcuggagcaacugccuccugcccacccuuugcgcagcagagugacccgagaguugcgggcugcggugccuggauacccccagccuucagggacaccugugaagcccaccgcccuaacagguagucagaaguuccucccccuucaaagcucuccuucuuuuuggggggaggccggaagcacaaacaacucugaugaagaguucaagaguuccaguccugccccagcacccacuagcagcgugaccuuggcaaacugacauuccuucuucaaaccucaguuuauccaucuguaaaauguggaugauauagcaccuaccucauaggguugcuguguugcacgugaugugcuaagcacagugccuagcacagucagcacucggacagcguagcuuguauuuacauaaauaaccagaauaaugcuuaaagcacugguguuaggaagcucgcagcccuggaaagcuugauacccagcacugggcagcuuggacuguuagaaaguuuucuaggcugggcgugguggcucacgcugguaauuccagcacuuugggaggcugagguggguggaucaugaggucaggaguuccaagaccagccuggccaagauggugaaacccugucucuacuacaaauacaaaaauuagccgggcgugguggcgggugccuguaauccugguugcucaggaagcugaggcagagaauugauugaaccccggaggcggagguugcagugagccgagaucacgccacugcacuccacccugggcgacggggcaagacgccgucgcaaaaaaaaaaaaaaaaaagguuuucuugggccaggcaugguggcucaugccuguaaucccagcacuuuggaagacugaggugggcggaucaccugaggucaggaguucaagaccagccuggccaacauggugaaauccugucucuacuaaaaauacaaaaaaguagcuggaugugguggcacaugccuguagucccagccacucgggaggcuaaggcaggagaauugcuugaacccaggaggugagguugcagugagcugagauugcgccgcugcacuucagccuagguaacagggcaagacuccaucucaaaaaauaauaauaauaauuuccuuggaaaaaaaauaauaaaauuaaacuaaaauugcugggugcaguggcucacaccuauaauccuggcacuuugagaggcugaggugggaagauugcuugagcucaggaguuuuuuugagacccagucucaaaaaaaaaagaaaaaaagaaaguuuucuuggcugggcacaguggcucaagccuguaauuccagcacuuugggaggcugagguggacgaaucauuugagcccaggauuucuagacgagccugggcaacauagugaaaccucaucuuuagaaacaaaaaaaauuagccgggcgugguggcgcaugccuguaaucccaucuacuggggaggcugaggcaagagaauugcuugaaccugggaggcagagguugcaguaagccaagauugcacuguugcacuccagcgugggugacacagcaaaacucuuucaagaaaaaaaaaaaaagaaagaguuuucuggucuggcucaguggcucauguuuauaauccuagcaguuuaggagggugaggcauguggaucacuugaguccaggaguuugaaaccagccugggcaacaugacaaagcuccaucucuacaaaaaauacaaaaaucgccgggcgcgguggcucacgccuguaaucccagcacuuugggaggccgaggcgggcggaucacgaggucaggagaucgagaccauccuggcuaacacggugaaacccugucuccacuaaaaauacaaaaaauuaaccgggcgugguggcgggcgccuguagucccagcuacucgggaggcugaggcaggagaauggcgggaaccccggggggcggagccuacagugagccgagaucgcaccacugcacuccagccugggccacagcgagacucugucucaaaaaaaaauaaaaaaauaaaaaaauuagccagguaugaugguacguaccuguagucccagcuacuugggaggcugaggugggaggauugcuugagcccagggagguugaggguacaaugagccaugaucgcgccacugcacuccagccugggcaacagagagcccgucucaaaaaaaaaaaauuaggcugggcacggcagcucaugccuguaaucucagcacuuugggaggccgagguggguggaucaccugaggucgggaguucgagagcagccugacaaaaauggagaaaccccgucucuacuaaaaaauacaaaauuagccgggccugguggugcaugccuauaaucccagcuacucaggaggcuaaagcaggagaauugcuugaacccgggagguggagguugcagugagccaagauggcaccauuggaauccagccugggcaacaagagcaaaacucugucucaaaaaaaaaaaaaauuugcaaaaauuagcugggugugguggcgggcgccuguagucccagcuacucgggaggcugaggugggagaauggcaugaaccugggaggcggagcuugcagugagcugagauugugccacugcacuccagccugggugacagagugagacuccaaacagagugagacuccgagcagagugagacucugagcucugucacccaggcuggagugcaguggcgcgaucucggcucacugcaagcuccucuucccggauucaugccauucuccugucucagccucccgaguagcugggacuacaggugcccgccaccacaccuggcuaauuuuuuguuuuuguauuuuuaguagagacaagguuucaccguguuagccaggauggucucgaucgccugaccuugugaucugccggccuaggccucccaaagugcugggacaggugugagccaccgcgcccggccaaaaaaguuaauuuucuuaucuugcacugagaucugucuccuuguagcagcagccaaaucaucaucaacaaauaaucugagagcaugggcuuugaagcuguaucccaccgagauacagugagagcuggaaaggccagugccugucuccacagagcacugcuacagggccgacugaccccauuccauugugagcagagcugagaagaggaaaugcaggcucuggauggagcccucucaccuggccuuggggaaucgaggaauauuuucuuuucuuuuuuuuuugagauggagucucgcacugucgcccagacuggagugcaguggugcgauaucagcucacugcaaccuccgccuccuggguucaagcaauucuccugccucagcuucccgaguagcugggauuacaggccugcaccaccaugccuggcuaauuuuuguauuauuaguagagacagaguuuugccauguuggccaggcuggucucaaacuccugaccucaggugauccaucugccuuggccucccaaagugcugggauuacaggcgugagccaaccaugcccggcccaaggaauguuuucuagaggagguggugucuuggccuugaaggacuuacacgggaguacuuauggccaaguagacaaguugaggaacgcagaagaaacagcuuguuaaaaggccuagaagucaacuacucaaggccaccccauauccuguccccuggcuaaacaccccagauacuugaguuguccuuuuuuuuuuuugagauggaguuuugcucuuauugcccaggcuggagugcagugacacgaucuuauugcccagacuggagugcaguggcgcaaucuuggcucacugcaaccuccgccucccggguucaagcaauucuccugccucagccucuugaauagcugggauuacaggcauguaccaccacaccuggcgaauuuuuauauuuucaguagagaugggauuucuccauguuggucaggcuggucucgaacuuccgaccucaggugauuugcccgccuuggccucccaaagugcugggauuacaggcgugagccaccucgccccaccucuuuuuuuuuuuuuuuuggagacagagucuugcucugucgcccaggccggauugcaguggugugauuucggcucacugcaagcucugccucccggguucacgccauucuucugccucagccucucgaguagcugggacuaacuacaggcgcccgccacugcgcccggcuaauuuuuuguauuuuuaguagagacgagguuucaccauggucuugaucuccugaccucgugaucugcccaccucggccucccaaagugcugggauuacaggugugagccaccacgcccggccuuuuuuuuggggggggugggggacagagucuugcuuugucgcccaggcuggagugcaguggcauaaucuugacucacugcaaccuccgccucccagguucaagcgauucuccugccucagccucccaaguaguugggauuacaggcgcccaccgccaugcccggcuaauauuuguauuuuuaguagagacagaguuucaccauguuggccaggcuggucucgaacucccgaccucaggugauccaccugccucagccuaccaaagugcugggauuacaggugugagccaccacgcccggccucaaguuuuuguuuuguuuguuuuuuuuugagcuggagucuugcucugucgcccaggcuggagugcaauggcacaauauuggcucacugcaaccucugccucccggguucaagugauucuccugccucagccuuccgaguagcugggauuacaggugcccaccaucaugcccggcugguuuuuguauuuuuaguugggaugggguuucgccauguuggucaggcugggcuugaacuccugaccucaggugaucugccugccuuggucucccaaaguguugggauuacaggcaugagccacugcgcccggccgagcuguucuuucuaagcuucucuuucuacccuggaccccugccuuuguuuacaaguucucucuguguguaacccccaggcccagacucucccuaaaugauacucuugggccugcuucguguccucaaaagcugcuagauccccacugcuuucucuacccuuugagggacaacccucuagugacgugacacaugaacuuacuccguugacaaaacacguuucauauccauugggagagguggggcagagcugggacucaccuccacuguucagauggggaaacugaggcccagggagcagguggguccggacaggaagccaggcuuccugcucccugucccaagcucuuauccuugccacagugcucucuaggccccacuucuaggcagcaucucgucaugugcuguggcucugugcagccuggcuaaggucugaggucugagccuaugucccugccgcuccagcauguggaggggagagccaguugcucugcccuggaaagagguggcugccacagagaagugugcauucugggacaacguggcuccucaccugggaguguccaggucggaggccuccuagggugucaucgggguccaaggguacccuuuggggggcucauggugcuugggagcugcaggacagucagcaggcuccagucuaggcacucuaggccgccacacugagugagguuccucagguaacugcccuggccucagguggguacggucuggguucagccaccuccuggagaggguggccuuccuggggucccaggacaccuuggugguagcagugggaagauggcaucugacaacgccccccgcucacucuccccacagggacacugcagguccgccuccugggcugugaacaguugcugacagccgugccugggcgcuccccagcggccgcacuggccagcagccccuccgagggcuggcuucggaccaaggccaagcaccagcguggccgaggcgagcuugccagugaguagggaaggagcuucagggggagcaggagaccccugcuucaggccugcccugagucccggcucuggcccugcaggcgaggugcuggcugugcuaaagguggacaaccguguuguggggcagacgggcugggggcagguggccgaacaguccugggaccagaccuuugucaucccacuggagcgaguaaggcuggccuuuguguggucaggggugaccuugggcugcgggguggaaggcugcccaggucggggcucguucugcaccccacccuucagccuggccuccccaauacaggcccgugagcuggagauugggguacacuggcgggacuggcggcagcuauguggcguggccuuccugagacuugaggacuuccuggacaaugccugucaccaacugucccucagccugguaccgcagggacugcuuuuugcccaggugcucaccaccuccgcccucugacuuggugggacccuggggcgucagggccaggaaggccuucaagaccgaugcacugcguguaggugcagagacugacgaccagagaggagggcuccaggaauaagggcuccuagccgcucucucagggcugcaucuggaggccuggguccuuguccugacugcccugccucaggugugacccuggaaaagugccucuccucccugggccucuguuucuccacuaguaucaaugaggacauugaaucuguuucucugggucuuucuggcucuugcaucuguugacccugggggcuugggcuguaaucccaggggcagaggaggugccauggcagaugagaugggaggcgacugguccacaacccugccccuaccccugcaggugaccuucugcgauccugucauugagaggcggccccggcugcagaggcaggaacgcaucuucucuaaacgcagagguguggagggaaugggggcuaugugugagggagcagggcuggggucccgggacuaagcucccccuuuucucccaggccaggacuuccugagggcuucgcagaugaaccucggcauggcggccugggggcgccucgucaugaaccugcugccccccugcagcuccccgagcacaaucagccccccuaaaggaugcccucggaccccaacaacacugcgagaggccucugacccugccacucccaggugaggagcucccuugcccuagacugcaugcuccucuguggcggcuuccugacuccagauccaggcgguaucugucugucugucugcauugcucagcccgcuaacccucuguccaucucacuuuggguugguguguccauccugccagcucuugcgucugccugugcugggcacugugucuacuuucucccuacaguaauuuccugcccaagaagacccccuugggugaagagaugacacccccacccaagcccccacgccucuaccucccccaggagccaacauccgaggagacuccggugaggggcuggagggacuaguggcuccuagggccggcuggggcuggcagggccacccagcugugggguggcaggccugaagggaaagagagaaggaagcccagcccugcccugagcuccucuauacucacagcgcaccaaacguccccauauggagccuaggacucgacgugggccaucuccaccagccucccccaccagguaccccauccugcgcaccuucauguuugagacguucgucugcuugcuugaacauuuguguauccauucauacauuacucccuggcucccuggcgggugcgcugacuggcucucggggucugauuuacuaaacccacauuauugagcuccagcucuaugccggcuucuaggaguccuuacugcagggcuuuuucgagcccauaggucgggacagcccaggacugggcaugggaggcuuggaguggcucuggguaggggcccagccagugcccuaggggacuucauauacccucucuuccuuugcaggaaacccccucggcuucaggacuuccgcugcuuagcugugcugggccggggacacuuugggaagguagugggcugaagagggugguaugggacgggauugggggccucaucacaugagccgggaggaccugaucugugggggcgguaaaggcucccuggucuggcccaccuggagcacaaccucucucuggccccagguccuccugguccaguucaaggggacagggaaauacuacgccaucaaagcacugaagaagcaggaggugcucagccgggacgagauagagaggugugugggggugccgcagggcacccaggauggcuggccugggcuguggcauccagagggcaguugaagguuccuggggcuuuggagaggugaccccguggggccagccagccugcauucucuuuuggcaccugcaguuguuaacuguguuuccuugggcagguccccucuucucucugucaguuugcucuacuguaaaaugggggcauugguggcugugcacguucagagcuccuugugagccccugacauauagaaaccaucacucuauggccaggcgugguaacucaugcauguaaccccagcacuuugggaggccaaggcaggcggaucacuugaguccaggaguucaagaccaaucugaaucacauggugaaaccccaucuauaaaaaauagccagacaugguggcaugugccuuuagucccagcuacuugggagggugaggugagaggauugcuuaagcccaggagguagagguuauaguuagcagagaucuccagccugggcaacagaaugagaccucaucuaaaaaaacuaauuaaaaaaaaaaaaaggagggggaggcugggcacaguggcucaugccuguaaucccagcacuucaggaggccaaggugggaggauugcuugagcccaggaguucgaggccagccuggacaacauggugaaacccgccucuacaaaaaauacaaaaauuagcugggcgugguggugcacacccagcuacucgugaagcuguggugggaggaucacuugaaccucaguggcggaggcugcagugagccgagaucgcaccacaucacuccagccugggcaagaaagugagacccugucucaaaaaaaaaaaaaaaaaaggcugggcgcacuggcucacacuuguaaucccagcauucuggaaggccgaagcagguggauaacuugaggccaagaguucgagaccagccugggcaacacagcgaaacccugcgucuacuaaaaauacaaaaauuagcugggcgugguggcgcacuccuauaaucccagcuacucgggaggcugaggcacaaaaaucucuugaacccgggaggcagagguugcaaugagcugagaucacaccacagcacuccagcccaggcgacagagcaagacugugucucaaaaaaaaaaaaaaaaugaaaagaaaccaucagucuacuugccuggcacuuuggcugagggcccagugagccagggguguugugcagggcacagggcacagcccagggaaaguuuuccuucccucuaauacucuugcucucuccuguagccuguacugcgagaagcggauccuggaggcugugggcugcacagggcacccuuuccugcucucccuccuugccugcuuccagaccuccagccaugccugcuuugugacugaguuugugccugguggugaccucaugaugcagauccacgaggaugucuuccccgagccccaggcccgguggguuccaucccuccugccugccucuuccagcaaacuuugccugguucccuacacccacucucuacauacugcuuucuccaagugcccaacagcaggggagcaggagucagaggccuugguuuacauccuggcaccaacugacagcauuugugauccuggguaucagcuuaugaagcugugcauuagguuucuuuuuuuuuuuuuuuuuuuuuuuuuugugagacagagucuggcucuuauugcccaggcuggagugcaauggcaugaucucggcucaccacaaccuccgccucccugguucaagccauucuccugccucagccuccugaguagcugggauuacaggcaugcaccaccacuccugucuaauuuuguauuuuuaguagagacgagguuucuccauguuggucagguuggucucuaacuccugaccucaagugauccgcccaccucggccuuccaaagugcugagauuacaggcgugagccaccacaccuggugagucucagaucuuuauuugaaaaauaggcaugauuggccgggcaccuguaaucccagcacuuuggaggcugaggcggguggaucaccugaggucaggaguucgugaccuggccaacaugguaaaaucuugucucuacuaaaaauacaaaaauuagcuaggcaugguggcacacgccuguaauccuagcuacuugagaggcuaaggcaggagaaucgcuugaacccaggaggcggagguuggagugagccgagaucccgccacuucggucuggcgacagagugagacuccaucuaaaaaaaaaaaaaaaaaggccgggcacguugguucaugccuguaauccccacacuuugggaggcugaggcguguggaucaugaggucaagagaucaagaccauccuggccaacauggugaaacccuaucucuauaaaaacuaaaaaaaaaaaaaaaaaaaaaaaauuagcugggcgugguggcgcgugccuguagucucagcuacuugggaggcugaggcaggagaauugcuugaacccaggagguggagguugcagugagccgagaucgcaccgcugcacugcagccugggugacagagugagacuccgucucaaaaaaaaaaaaaauaggcaugaugaauauccacugcagggaccaacacuuggucccuggcaccauuuaagggcccaugaagggugagcuggaaaugcacgcaaccuuggggcgaccuugggacuauuggagcacccccacccucagcaugaugcuugucccagucucacucaucucugacucuggccgggacauccgggauccccccgcuauggccauccuggugccucccugcccugccucccuggugugugucuugggccugaguucucccauaaccaccccugcagcuucuacguggcuuguguuguccuggggcugcaguucuuacacgagaagaagaucauuuacaggugacuuuugucccagggaugcacggggguagggguggggguggggguggaguggguaaggacagaugcugccuccgccugccugggcugcuccaggggccguuacuguucccugggucuaagccccacucagucccuuugaucugcacccuugcccucagggaccugaaguuggauaaccuucugcuggaugcccagggauuccugaagaucgcagacuuuggacucugcaaggaaggugggggccgcccauugggauccauaucuccagccuuguuuacccacccuggccaauaggaugaugggcacauggcaugucccaggaaaucuccucaccugcggaugcccugguuccaccaccccagaccucauuccaggggacagcugggcacacuggcccuuucuuccuaguccuagaggcucguagccccagccugcaccuggcccaagggagagccuguggucagggaugggagaggagacugaguucugccuucuguuuuuuuuuugguuuguuuuuuuuuuugagacggagucuugcugugccgcccaggaugcaaugcaguggugcagucucggcucacugcagccuccaccuacuggguucaagcgauucucuugccucagcagcccaaguagcugggacuacaagcgagcaccaccacaccuggcuaauuuuuguauuuuuuuaguagagacgggguuucacuguguuagcgaggauggucucgaucuccugaccucaugauccacccaccuuggccgcccaaagugcugggauuacaggcgugagccacugcgcccggcuucuuuuuuuuuugagauggagucuugcccuguugcccaggcuggagugcaauggcgcaaucucggcucacugcaaccucugccuccaagguucaagagauucuccugccucagccucccgaguaccugcgauuacaggcacaugccaccacacccagcuuauuuuuuguauuuuuaguagagacgggguuucaccauguuggccaggcuggucucgaacuccugaccucaugaucugcccaccucggccucccaaagugcugggauuacaggugugagccaccgcacccagccgaguucugccuucugugaccuuagccugugagcuuggcucugcaugcagucaaauggcgucauaaccauucccacuuccuuggguacagggcagggcuuggcacaggcucagcucccuggcaucauaaggcuuggcuauugaaguuauugugaauaggccacaccaagcagcuauuggugugccuguugguuugcagggaucggcuucggggaccggacuagcaccuucuguggcaccccggaguuccuggcucccgaggugcugacccaggaggcauacacacgggcuguggacuggugggggcugggugugcugcucuacgagaugcuggugggugaggugagugcuggagccuguuuccugggccucugggugggggugggguggcccgugcauccugcugagcccccaucuccacagugcccguucccaggggacacagaggaagagguguuugacugcaucgucaacauggacgcccccuaccccggcuuucugucggugcaagggcuugaguucauucagaagguaagcacugcggggucuggggcugggcuggauggccgcucaaggcccaugugcccucugccgugggacagcagacccccugccacccauccuuagagcgcucugggccagcgugcuuggggccuguggaugauggcagugccuggggcugaaugcccuaagugagcgccuguccuauugcccagcuccuccagaagugcccggagaagcgccucggggcaggugagcaggaugccgaggagaucaagguccagccauucuucagggugagcggcugggguggcggugguccccugugccuggcaggguagguggcauggagugacuccuggagcugcuguuccugccgucucaggcgccucuccuuugcccucagaccaccaacuggcaagcccugcucgcccgcaccauccagccccccuucgugccuacccuguguggcccugcggaccugcgcuacuuugagggcgaguucacagggcugccgccugcccugaccccaccugcaccccacagccuccucacugcccgccaacaggccgccuuccgggacuucgacuuugugucagagcgauuccuggaacccugagggcaucuccuggcaccucuguccccuucccccacagacuguuagagccucugcucguucacccgugcgcccugccuggagguccaggccuugcuggguacuucugagcccuugggauucaaaguggcagccauggggccacuguugugggcuuugcucagugucacugggcaaagugugucccuucccccuccagcucgcccucuucuaccucccagcgagaccuggcccagaaagggugccgcagcaaggagugauaugguuugucuuuuuaagacuggacuugcuuuauauuaaauuuguaaaagugugcacuggcagcagccugggcggggcugggguggagcccggggucugcuugggccugagccacccacagguccuuuucuuccccuucuuccuuggaaggcagaacugcccaccaaggcagggaucugucugacuugaagcuccguucuggggucugggaggcgugggcaggagugagggccccaggcccucugagcgcucaccccagcuggggacaggccccgugguuuucaggcacaagacgguagcccggccuccagcaacccuaaacagcugggcugcugcccucuuccuccuccucagcccagagggucucccaggacccugagggccauccacagaagaagugggccagguugcgggucaggccucggucgaagggguugcuggggcgcuggcggagauaggcgaugcggugugaggagaugaauucccagguggugguguugcuggccaccagguagaggugcgagacgaggagcaggcuggccaccaacgagaagagggacagcagcaggaagguggcgaacaggagcccgcuggaccgcaaccacugaccccagggcuggaagaaccggaggccugaccugcggugcaggggacaggggccuggugcugggggagggcaggggagcccuucccuccccaugccgggucccugggaguccuggcucuguccaccccugugggagcauucaucccacccucccucuacacccgggcagcagcacccaccaugccagguacaggccccacagaagcaccaccagcugcagcgccagguagaccacaaagagugggugguugcgcucucccacacaguucuccauccaggggcagugguggucguagcggcggacgcaacggcggcacucacggcagugccgagcccucaggggcugcugugggcauggaggagaguggaggcucagu

SEQ ID NO: 13125 - RNA, 19033 nt, Homo sapiens
acugagccuccacucuccuccaugcccacagcagccccugagggcucggcacugccgugagugccgccguugcguccgccgcuacgaccaccacugccccuggauggagaacugugugggagagcgcaaccacccacucuuuguggucuaccuggcgcugcagcugguggugcuucuguggggccuguaccuggcauggugggugcugcugcccggguguagagggagggugggaugaaugcucccacagggguggacagagccaggacucccagggacccggcauggggagggaagggcuccccugcccucccccagcaccaggccccuguccccugcaccgcaggucaggccuccgguucuuccagcccuggggucagugguugcgguccagcgggcuccuguucgccaccuuccugcugcugucccucuucucguugguggccagccugcuccucgucucgcaccucuaccugguggccagcaacaccaccaccugggaauucaucuccucacaccgcaucgccuaucuccgccagcgccccagcaaccccuucgaccgaggccugacccgcaaccuggcccacuucuucuguggauggcccucaggguccugggagacccucugggcugaggaggaggaagagggcagcagcccagcuguuuaggguugcuggaggccgggcuaccgucuugugccugaaaaccacggggccuguccccagcuggggugagcgcucagagggccuggggcccucacuccugcccacgccucccagaccccagaacggagcuucaagucagacagaucccugccuuggugggcaguucugccuuccaaggaagaaggggaagaaaaggaccuguggguggcucaggcccaagcagaccccgggcuccaccccagccccgcccaggcugcugccagugcacacuuuuacaaauuuaauauaaagcaaguccagucuuaaaaagacaaaccauaucacuccuugcugcggcacccuuucugggccaggucucgcugggagguagaagagggcgagcuggagggggaagggacacacuuugcccagugacacugagcaaagcccacaacaguggccccauggcugccacuuugaaucccaagggcucagaaguacccagcaaggccuggaccuccaggcagggcgcacgggugaacgagcagaggcucuaacagucugugggggaaggggacagaggugccaggagaugcccucaggguuccaggaaucgcucugacacaaagucgaagucccggaaggcggccuguuggcgggcagugaggaggcuguggggugcagguggggucagggcaggcggcagcccugugaacucgcccucaaaguagcgcagguccgcagggccacacaggguaggcacgaaggggggcuggauggugcgggcgagcagggcuugccaguugguggucugagggcaaaggagaggcgccugagacggcaggaacagcagcuccaggagucacuccaugccaccuacccugccaggcacaggggaccaccgccaccccagccgcucacccugaagaauggcuggaccuugaucuccucggcauccugcucaccugccccgaggcgcuucuccgggcacuucuggaggagcugggcaauaggacaggcgcucacuuagggcauucagccccaggcacugccaucauccacaggccccaagcacgcuggcccagagcgcucuaaggauggguggcagggggucugcugucccacggcagagggcacaugggccuugagcggccauccagcccagccccagaccccgcagugcuuaccuucugaaugaacucaagcccuugcaccgacagaaagccgggguagggggcguccauguugacgaugcagucaaacaccucuuccucuguguccccugggaacgggcacuguggagaugggggcucagcaggaugcacgggccaccccacccccacccagaggcccaggaaacaggcuccagcacucaccucacccaccagcaucucguagagcagcacacccagcccccaccaguccacagcccguguguaugccuccugggucagcaccucgggagccaggaacuccggggugccacagaaggugcuaguccgguccccgaagccgaucccugcaaaccaacaggcacaccaauagcugcuugguguggccuauucacaauaacuucaauagccaagccuuaugaugccagggagcugagccugugccaagcccugcccuguacccaaggaagugggaaugguuaugacgccauuugacugcaugcagagccaagcucacaggcuaaggucacagaaggcagaacucggcugggugcgguggcucacaccuguaaucccagcacuuugggaggccgaggugggcagaucaugaggucaggaguucgagaccagccuggccaacauggugaaaccccgucucuacuaaaaauacaaaaaauaagcugggugugguggcaugugccuguaaucgcagguacucgggaggcugaggcaggagaaucucuugaaccuuggaggcagagguugcagugagccgagauugcgccauugcacuccagccugggcaacagggcaagacuccaucucaaaaaaaaaagaagccgggcgcaguggcucacgccuguaaucccagcacuuugggcggccaagguggguggaucaugaggucaggagaucgagaccauccucgcuaacacagugaaaccccgucucuacuaaaaaaauacaaaaauuagccaggugugguggugcucgcuuguagucccagcuacuugggcugcugaggcaagagaaucgcuugaacccaguagguggaggcugcagugagccgagacugcaccacugcauugcauccugggcggcacagcaagacuccgucucaaaaaaaaaaacaaaccaaaaaaaaaacagaaggcagaacucagucuccucucccaucccugaccacaggcucucccuugggccaggugcaggcuggggcuacgagccucuaggacuaggaagaaagggccagugugcccagcuguccccuggaaugaggucuggggugguggaaccagggcauccgcaggugaggagauuuccugggacaugccaugugcccaucauccuauuggccaggguggguaaacaaggcuggagauauggaucccaaugggcggcccccaccuuccuugcagaguccaaagucugcgaucuucaggaaucccugggcauccagcagaagguuauccaacuucaggucccugagggcaagggugcagaucaaagggacugaguggggcuuagacccagggaacaguaacggccccuggagcagcccaggcaggcggaggcagcaucuguccuuacccacuccacccccacccccaccccuacccccgugcaucccugggacaaaagucaccuguaaaugaucuucuucucguguaagaacugcagccccaggacaacacaagccacguagaagcugcaggggugguuaugggagaacucaggcccaagacacacaccagggaggcagggcagggaggcaccaggauggccauagcggggggaucccggaugucccggccagagucagagaugagugagacugggacaagcaucaugcugagggugggggugcuccaauagucccaaggucgccccaagguugcgugcauuuccagcucacccuucaugggcccuuaaauggugccagggaccaaguguuggucccugcaguggauauucaucaugccuauuuuuuuuuuuuuugagacggagucucacucugucacccaggcugcagugcagcggugcgaucucggcucacugcaaccuccaccuccuggguucaagcaauucuccugccucagccucccaaguagcugagacuacaggcacgcgccaccacgcccagcuaauuuuuuuuuuuuuuuuuuuuuuuuaguuuuuauagagauaggguuucaccauguuggccaggauggucuugaucucuugaccucaugauccacacgccucagccucccaaaguguggggauuacaggcaugaaccaacgugcccggccuuuuuuuuuuuuuuuuuagauggagucucacucugucgccagaccgaaguggcgggaucucggcucacuccaaccuccgccuccuggguucaagcgauucuccugccuuagccucucaaguagcuaggauuacaggcgugugccaccaugccuagcuaauuuuuguauuuuuaguagagacaagauuuuaccauguuggccaggucacgaacuccugaccucaggugauccacccgccucagccuccaaagugcugggauuacaggugcccggccaaucaugccuauuuuucaaauaaagaucugagacucaccaggugugguggcucacgccuguaaucucagcacuuuggaaggccgaggugggcggaucacuugaggucaggaguuagagaccaaccugaccaacauggagaaaccucgucucuacuaaaaauacaaaauuagacaggagugguggugcaugccuguaaucccagcuacucaggaggcugaggcaggagaauggcuugaaccagggaggcggagguuguggugagccgagaucaugccauugcacuccagccugggcaauaagagccagacucugucucacaaaaaaaaaaaaaaaaaaaaaaaaaagaaaccuaaugcacagcuucauaagcugauacccaggaucacaaaugcugucaguuggugccaggauguaaaccaaggccucugacuccugcuccccugcuguugggcacuuggagaaagcaguauguagagaguggguguagggaaccaggcaaaguuugcuggaagaggcaggcaggagggauggaacccaccgggccuggggcucggggaagacauccucguggaucugcaucaugaggucaccaccaggcacaaacucagucacaaagcaggcauggcuggaggucuggaagcaggcaaggagggagagcaggaaagggugcccugugcagcccacagccuccaggauccgcuucucgcaguacaggcuacaggagagagcaagaguauuagagggaaggaaaacuuucccugggcugugcccugugcccugcacaacaccccuggcucacugggcccucagccaaagugccaggcaaguagacugaugguuucuuuucauuuuuuuuuuuuuuuugagacacagucuugcucugucgccugggcuggagugcuguggugugaucucagcucauugcaaccucugccucccggguucaagagauuuuugugccucagccucccgaguagcugggauuauaggagugcgccaccacgcccagcuaauuuuuguauuuuuaguagacgcaggguuucgcuguguugcccaggcuggucucgaacucuuggccucaaguuauccaccugcuucggccuuccagaaugcugggauuacaagugugagccagugcgcccagccuuuuuuuuuuuuuuuuuugagacagggucucacuuucuugcccaggcuggagugauguggugcgaucucggcucacugcagccuccgccacugagguucaagugauccucccaccacagcuucacgaguagcugggugugcaccaccacgcccagcuaauuuuuguauuuuuuguagaggcggguuucaccauguuguccaggcuggccucgaacuccugggcucaagcaauccucccaccuuggccuccugaagugcugggauuacaggcaugagccacugugcccagccucccccuccuuuuuuuuuuuuuaauuaguuuuuuuagaugaggucucauucuguugcccaggcuggagaucucugcuaacuauaaccucuaccuccugggcuuaagcaauccucucaccucacccucccaaguagcugggacuaaaggcacaugccaccaugucuggcuauuuuuuauagaugggguuucaccaugugauucagauuggucuugaacuccuggacucaagugauccgccugccuuggccucccaaagugcugggguuacaugcaugaguuaccacgccuggccauagagugaugguuucuauaugucaggggcucacaaggagcucugaacgugcacagccaccaaugcccccauuuuacaguagagcaaacugacagagagaagaggggaccugcccaaggaaacacaguuaacaacugcaggugccaaaagagaaugcaggcuggcuggccccacggggucaccucuccaaagccccaggaaccuucaacugcccucuggaugccacagcccaggccagccauccugggugcccugcggcacccccacacaccucucuaucucgucccggcugagcaccuccugcuucuucagugcuuugauggcguaguauuucccuguccccuugaacuggaccaggaggaccuggggccagagagagguugugcuccaggugggccagaccagggagccuuuaccgcccccacagaucagguccucccggcucaugugaugaggcccccaaucccgucccauaccacccucuucagcccacuaccuucccaaaguguccccggcccagcacagcuaagcagcggaaguccugaagccgaggggguuuccugcaaaggaagagaggguauaugaaguccccuagggcacuggcugggccccuacccagagccacuccaagccucccaugcccaguccugggcugucccgaccuaugggcucgaaaaagcccugcaguaaggacuccuagaagccggcauagagcuggagcucaauaauguggguuuaguaaaucagaccccgagagccagucagcgcacccgccagggagccagggaguaauguaugaauggauacacaaauguucaagcaagcagacgaacgucucaaacaugaaggugcgcaggaugggguaccuggugggggaggcugguggagauggcccacgucgaguccuaggcuccauauggggacguuuggugcgcugugaguauagaggagcucagggcagggcugggcuuccuucucucuuucccuucaggccugccaccccacagcuggguggcccugccagccccagccggcccuaggagccacuagucccuccagccccucaccggagucuccucggauguuggcuccugggggagguagaggcgugggggcuugggugggggugucaucucuucacccaagggggucuucuugggcaggaaauuacuguagggagaaaguagacacagugcccagcacaggcagacgcaagagcuggcaggauggacacaccaacccaaagugagauggacagaggguuagcgggcugagcaaugcagacagacagacagauaccgccuggaucuggagucaggaagccgccacagaggagcaugcagucuagggcaagggagcuccucaccugggaguggcagggucagaggccucucgcaguguuguugggguccgagggcauccuuuaggggggcugauugugcucggggagcugcaggggggcagcagguucaugacgaggcgcccccaggccgccaugccgagguucaucugcgaagcccucaggaaguccuggccugggagaaaagggggagcuuagucccgggaccccagcccugcucccucacacauagcccccauucccuccacaccucugcguuuagagaagaugcguuccugccucugcagccggggccgccucucaaugacaggaucgcagaaggucaccugcagggguaggggcaggguuguggaccagucgccucccaucucaucugccauggcaccuccucugccccugggauuacagcccaagcccccagggucaacagaugcaagagccagaaagacccagagaaacagauucaauguccucauugauacuaguggagaaacagaggcccagggaggagaggcacuuuuccagggucacaccugaggcagggcagucaggacaaggacccaggccuccagaugcagcccugagagagcggcuaggagcccuuauuccuggagcccuccucucuggucgucagucucugcaccuacacgcagugcaucggucuugaaggccuuccuggcccugacgccccagggucccaccaagucagagggcggagguggugagcaccugggcaaaaagcagucccugcgguaccaggcugagggacaguuggugacaggcauuguccaggaaguccucaagucucaggaaggccacgccacauagcugccgccagucccgccaguguaccccaaucuccagcucacgggccuguauuggggaggccaggcugaaggguggggugcagaacgagccccgaccugggcagccuuccaccccgcagcccaaggucaccccugaccacacaaaggccagccuuacucgcuccagugggaugacaaaggucuggucccaggacuguucggccaccugcccccagcccgucugccccacaacacgguuguccaccuuuagcacagccagcaccucgccugcagggccagagccgggacucagggcaggccugaagcaggggucuccugcucccccugaagcuccuucccuacucacuggcaagcucgccucggccacgcuggugcuuggccuugguccgaagccagcccucggaggggcugcuggccagugcggccgcuggggagcgcccaggcacggcugucagcaacuguucacagcccaggaggcggaccugcagugucccuguggggagagugagcggggggcguugucagaugccaucuucccacugcuaccaccaagguguccugggaccccaggaaggccacccucuccaggagguggcugaacccagaccguacccaccugaggccagggcaguuaccugaggaaccucacucaguguggcggccuagagugccuagacuggagccugcugacuguccugcagcucccaagcaccaugagccccccaaaggguacccuuggaccccgaugacacccuaggaggccuccgaccuggacacucccaggugaggagccacguugucccagaaugcacacuucucuguggcagccaccucuuuccagggcagagcaacuggcucuccccuccacaugcuggagcggcagggacauaggcucagaccucagaccuuagccaggcugcacagagccacagcacaugacgagaugcugccuagaaguggggccuagagagcacuguggcaaggauaagagcuugggacagggagcaggaagccuggcuuccuguccggacccaccugcucccugggccucaguuuccccaucugaacaguggaggugagucccagcucugccccaccucucccaauggauaugaaacguguuuugucaacggaguaaguucaugugucacgucacuagaggguugucccucaaaggguagagaaagcaguggggaucuagcagcuuuugaggacacgaagcaggcccaagaguaucauuuagggagagucugggccuggggguuacacacagagagaacuuguaaacaaaggcagggguccaggguagaaagagaagcuuagaaagaacagcucggccgggcgcaguggcucaugccuguaaucccaacacuuugggagaccaaggcaggcagaucaccugaggucaggaguucaagcccagccugaccaacauggcgaaaccccaucccaacuaaaaauacaaaaaccagccgggcaugauggugggcaccuguaaucccagcuacucggaaggcugaggcaggagaaucacuugaacccgggaggcagagguugcagugagccaauauugugccauugcacuccagccugggcgacagagcaagacuccagcucaaaaaaaaacaaacaaaacaaaaacuugaggccgggcgugguggcucacaccuguaaucccagcacuuugguaggcugaggcagguggaucaccugaggucgggaguucgagaccagccuggccaacauggugaaacucugucucuacuaaaaauacaaauauuagccgggcauggcggugggcgccuguaaucccaacuacuugggaggcugaggcaggagaaucgcuugaaccugggaggcggagguugcagugagucaagauuaugccacugcacuccagccugggcgacaaagcaagacucugucccccaccccccccaaaaaaaaggccgggcgugguggcucacaccuguaaucccagcacuuugggaggccgaggugggcagaucacgaggucaggagaucaagaccauggugaaaccucgucucuacuaaaaauacaaaaaauuagccgggcgcaguggcgggcgccuguaguuagucccagcuacucgagaggcugaggcagaagaauggcgugaacccgggaggcagagcuugcagugagccgaaaucacaccacugcaauccggccugggcgacagagcaagacucugucuccaaaaaaaaaaaaaaaagagguggggcgagguggcucacgccuguaaucccagcacuuugggaggccaaggcgggcaaaucaccugaggucggaaguucgagaccagccugaccaacauggagaaaucccaucucuacugaaaauauaaaaauucgccagguguggugguacaugccuguaaucccagcuauucaagaggcugaggcaggagaauugcuugaacccgggaggcggagguugcagugagccaagauugcgccacugcacuccagucugggcaauaagaucgugucacugcacuccagccugggcaauaagagcaaaacuccaucucaaaaaaaaaaaaggacaacucaaguaucugggguguuuagccaggggacaggauaugggguggccuugaguaguugacuucuaggccuuuuaacaagcuguuucuucugcguuccucaacuugucuacuuggccauaaguacucccguguaaguccuucaaggccaagacaccaccuccucuagaaaacauuccuugggccgggcaugguuggcucacgccuguaaucccagcacuuugggaggccaaggcagauggaucaccugaggucaggaguuugagaccagccuggccaacauggcaaaacucugucucuacuaauaauacaaaaauuagccaggcaugguggugcaggccuguaaucccagcuacucgggaagcugaggcaggagaauugcuugaacccaggaggcggagguugcagugagcugauaucgcaccacugcacuccagucugggcgacagugcgagacuccaucucaaaaaaaaaagaaaagaaaauauuccucgauuccccaaggccaggugagagggcuccauccagagccugcauuuccucuucucagcucugcucacaauggaauggggucagucggcccuguagcagugcucuguggagacaggcacuggccuuuccagcucucacuguaucucggugggauacagcuucaaagcccaugcucucagauuauuuguugaugaugauuuggcugcugcuacaaggagacagaucucagugcaagauaagaaaauuaacuuuuuuggccgggcgcgguggcucacaccugucccagcacuuugggaggccuaggccggcagaucacaaggucaggcgaucgagaccauccuggcuaacacggugaaaccuugucucuacuaaaaauacaaaaacaaaaaauuagccaggugugguggcgggcaccuguagucccagcuacucgggaggcugagacaggagaauggcaugaauccgggaagaggagcuugcagugagccgagaucgcgccacugcacuccagccugggugacagagcucagagucucacucugcucggagucucacucuguuuggagucucacucugucacccaggcuggagugcaguggcacaaucucagcucacugcaagcuccgccucccagguucaugccauucucccaccucagccucccgaguagcugggacuacaggcgcccgccaccacacccagcuaauuuuugcaaauuuuuuuuuuuuuugagacagaguuuugcucuuguugcccaggcuggauuccaauggugccaucuuggcucacugcaaccuccaccucccggguucaagcaauucuccugcuuuagccuccugaguagcugggauuauaggcaugcaccaccaggcccggcuaauuuuguauuuuuuaguagagacgggguuucuccauuuuugucaggcugcucucgaacucccgaccucaggugauccacccaccucggccucccaaagugcugagauuacaggcaugagcugccgugcccagccuaauuuuuuuuuuuugagacgggcucucuguugcccaggcuggagugcaguggcgcgaucauggcucauuguacccucaaccucccugggcucaagcaauccucccaccucagccucccaaguagcugggacuacagguacguaccaucauaccuggcuaauuuuuuuauuuuuuuauuuuuuuuugagacagagucucgcuguggcccaggcuggagugcaguggugcgaucucggcucacuguaggcuccgccccccgggguucccgccauucuccugccucagccucccgaguagcugggacuacaggcgcccgccaccacgcccgguuaauuuuuuguauuuuuaguggagacaggguuucaccguguuagccaggauggucucgaucuccugaccucgugauccgcccgccucggccucccaaagugcugggauuacaggcgugagccaccgcgcccggcgauuuuuguauuuuuuguagagauggagcuuugucauguugcccaggcugguuucaaacuccuggacucaagugauccacaugccucacccuccuaaacugcuaggauuauaaacaugagccacugagccagaccagaaaacucuuucuuuuuuuuuuuuucuugaaagaguuuugcugugucacccacgcuggagugcaacagugcaaucuuggcuuacugcaaccucugccucccagguucaagcaauucucuugccucagccuccccaguagaugggauuacaggcaugcgccaccacgcccggcuaauuuuuuuuguuucuaaagaugagguuucacuauguugcccaggcucgucuagaaauccugggcucaaaugauucguccaccucagccucccaaagugcuggaauuacaggcuugagccacugugcccagccaagaaaacuuucuuuuuuucuuuuuuuuuugagacugggucucaaaaaaacuccugagcucaagcaaucuucccaccucagccucucaaagugccaggauuauaggugugagccacugcacccagcaauuuuaguuuaauuuuauuauuuuuuuuccaaggaaauuauuauuauuauuuuuugagauggagucuugcccuguuaccuaggcugaagugcagcggcgcaaucucagcucacugcaaccucaccuccuggguucaagcaauucuccugccuuagccucccgaguggcugggacuacaggcaugugccaccacauccagcuacuuuuuuguauuuuuaguagagacaggauuucaccauguuggccaggcuggucuugaacuccugaccucaggugauccgcccaccucagucuuccaaagugcugggauuacaggcaugagccaccaugccuggcccaagaaaaccuuuuuuuuuuuuuuuuuugcgacggcgucuugccccgucgcccaggguggagugcaguggcgugaucucggcucacugcaaccuccgccuccgggguucaaucaauucucugccucagcuuccugagcaaccaggauuacaggcacccgccaccacgcccggcuaauuuuuguauuuguaguagagacaggguuucaccaucuuggccaggcuggucuuggaacuccugaccucaugauccacccaccucagccucccaaagugcuggaauuaccagcgugagccaccacgcccagccuagaaaacuuucuaacaguccaagcugcccagugcuggguaucaagcuuuccagggcugcgagcuuccuaacaccagugcuuuaagcauuauucugguuauuuauguaaauacaagcuacgcuguccgagugcugacugugcuaggcacugugcuuagcacaucacgugcaacacagcaacccuaugagguaggugcuauaucauccacauuuuacagauggauaaacugagguuugaagaaggaaugucaguuugccaaggucacgcugcuagugggugcuggggcaggacuggaacucuugaacucuucaucagaguuguuugugcuuccggccuccccccaaaaagaaggagagcuuugaagggggaggaacuucugacuaccuguuagggcggugggcuucacaggugucccugaaggcuggggguauccaggcaccgcagcccgcaacucucgggucacucugcugcgcaaagggugggcaggaggcaguugcuccagcagcugcuccaaggccaggcgcaggagguccaguuucugagaggacuccuguagcugggccugggccugcagaggggacaacguagagccagguucgugggguauauggcagggggcagcagcccaggucacccggagccaccuuccgcaugaagucucaacagagaaguccugcuuuuacacggccacccucccuucacaccccugcugagggugguaugggaacaagccagccuuaggagagggccagggcuggggccugaccucagccagugccuugcgguccuguguucuccggcuacuaagcaguuucaccacguucuuggcgcccucagccacagcugccucaacgugcagucgaugcuguagcuccuccgccagcagcucaggcccugugggaaggacggcggcucucaggcccugcucuucccugcuccgcccucccugugucucaaggccucaccuggcuccggggacccacuggccuccaggcugcugaucuucauccgcagcagggccaccuucagcuggcugucccgcagcaucugcugggcagcugccaggagcuuccucuccuauggagccauagcacaggcccaucagaccaggccugggccacagcuucccccaucagaccaggaacuggagccgggucucccccaucaaaacaggguuaaagugaaaccucuaggccaaacacuaaagucaagccucccuuguuggacuaguuggugggucaggggagccuuuuccaucugaccaacaagggcuggggucaaauuuccucuuucauaucacggcuggggucaugccucucccaucagaucagggcuggggcuaacucucccccaucagaucagggcuggggcuaacucucccccaucagaucagggcuguggucaugccucccccaucagagcaggguugaugcuucccccaucagaucagggcaggggcuaagcuaagccucccccauuagaugagggcaggggcuaagcuaagccucucccaucagaucagggcuggggauaagccucccccaucagaucagggcaggggcuaagcuaagccucccccauuagaucaaggcuaagguccugccuccgucaucauaucagggccacagccaagucuucuugucagacaaggacugaggcccaguucuggacaucaugcugggaguugggacuggggcugggcuaggaucccauuagaccagggcaaggccuucucugucacacuagagacuacagccaugccuuccucacccagcugggguuuggggcuguauuuuccccaucaggcugcaggcuggaauggugucuccuuaugagcccaauggcugaggugcauuucccugucagaccaggggccagggugcuccugccaucagacuguggggccuuaccuugggggugccacuggcgcacgugugggucauguucucagcccccugcuucaccuucagcuccacaugcagcugccuccggagagccucuaggugccgagcccugagcugcucugcccacggccgggguccugaggccacaggcucugugcacggggguaucgagcacaggagucccucacccagagccgagacccccacuguggccuuuccuccuuccccuacugaucuauaggcaggaaaugagguggucucgccacaguggccagggccaaggccaggggccagaugggccuagagccuucuguccugagggggucucagcuccucacucaccagcugggccaggcccagggccgggcagcaggauucgggcgugcagcucccgcagcucgccaugcagcugcuccaggcggcgguuggaggaccgcagcagcugcugcacauggcccaaguggcggcggucuguggccacgcgccgcagguucuccacccccuccuugaucuucagcucuuucuggauggcccggcggaucaccuccuucucauccucugggggccacuggcucggcccaggcugcagagccgguggaaagcagaggguggagaacagccauggggugcagcggccaccagcagccuuugcucacugcagauggaggcgaaggaagggacggcacccaggacugacucgcacaggguuuuggaagccucucuccccuuagagcucaggccugagccagauggaaacuccgaggccacucaucuaggccaggcuccuguccuccgcccguuagagaaggauguggcgggggggacaguucacacgguaaaugggugccagguucuauucuaagugcuuugcauauauuaccacaucacuccucccagccaccccacccgguagcgguggucauuacccccauuuucuuuuuucuuuuucuuuuucuuuuuuuuuuuuuugagacaguuuugcucuuguugcccaggcuggagugccauggcacgaucucgguucaccacaaccucugccucccggguucaagcgauucuccugccccagccuccugaguagcugggauuacaggcacacgccacuaagcccggcuaauuuuguauuuuuaguagggacgggguuucuccauguucgucaggcuggucuugaauccugaccucaggugauccaccugccuuggccucccaaagugcugggauuacaggugugagccaccacgccuguacuauuaccccuauuuucuagugaggaaacugaggcccagagaggugaaguaacuugcccacagucaagacacagaggaggggccaccaucucucgggccccagcugucccuggcagcccuggguaaucaggcugcucucucuacaucugggacccaaaguagaguccaggagccacaaaagcuacgccgaauagggguucacacgaagccacaugagaaggcagccaggggccugggagccagggcuuguuccccugaugucccaaugccacagguagcaaagcagaggcacagagaggaacuggggaggucuccgggugcccacucccugcucagcucccgggaggaaguagaaggcucucucacggcuucacccagguuggagccaggaacaggaacaccuccuuuccagccgccagcauuucaaaccaaccggugccaaaggugaccucaggccggguaacccaugaugccccgcaacacgggcuguugcaggaaccccaucuuaccucucuguguuccaucuucuccugagcccaguggaaggggccgcaaccccagacucagggacccccccaccccagaccucagcggggccugcuggcccagcugucagagggcaagggcgaggcucaggaaauccucugaccgcccuaggccacagggccagagccaaagaccggagcaaacaaaggucccauggagcugggggcccggccaccgggguccugagucacccagcugccgcugcagggcggagccccgcaggaaaucggaaaauguguacaagcuacgucuggaacaggcggagggaccuccagaggaagggggugggagggggcagaccgagccccagcccugaaggcggccuaaacgacuggcuugggcgcucaaggagucuacacgcaccccgcaacacccccauggucccgucugcccuggguuggaacuccaacauggacacacacaccaccuccuuuccgcucuuugcggggacccacuccuguccgcaaaugccccccucccaaccacucgcuccggaacaggacaccaccucucccuccucaggagcagauagacauggccucgguccuccgggcccacgcgcaccuacugccagcucuggcaggaaacccagcccccuccgcauucuagaacccgcuauguacccaaagguucccgcccuggggcgggggaggccgcuccccucucaucuacgcuccccucgugccuccugugcuccgggaaggacuccugccacugccaagcgcgcacagacugcgccccccgcugcgcgcacauucuaacccccccaggccccugugccccgccuuucuaucccggcuaauucccgucggccuuggagccccaccgaggagaaccgacuuaaggacacucuggggaccacccugguggcgcacacugcggacucagccguccucgcucacgggcugguugggguucagucuccgggucagccgcggacugauuuggagacugugcaagguccaggaaccaccgaacccggagaucaggucugcucugcgagggcgucgcggggccggggccagggcaggggcagggaaggggcgcgggugaggggaggaucgggggaagcggccgcgguucggggcuccggggcgaugacagaggcuuucucgcaccccccgggcccgcgcgccccucccacgccguucaccugccgcggcgcccccuccuccauggcgccgcuccggccgcuuggggcccuucucucagccacuccggucccggaagccgcagacccuccgccaggacuuucaaacuugaaacuucccgggaag

SEQ ID NO: 13126 - RNA, 3295 nt, Homo sapiens
gagugauaugguuugucuuuuuaagacuggacuugcuuuauauuaaauuuguaaaagugugcacuggcagcagccugggcggggcugggguggagcccggggucugcuugggccugagccacccacagguccuuuucuuccccuucuuccuuggaaggcagaacugcccaccaaggcagggaucugucugacuugaagcuccguucuggggucugggaggcgugggcaggagugagggccccaggcccucugagcgcucaccccagcuggggacaggccccgugguuuucaggcacaagacgguagcccggccuccagcaacccuaaacagcugggcugcugcccucuuccuccuccucagcccagagggucucccaggacccugagggccauccacagaagaagugggccagguugcgggucaggccucggucgaagggguugcuggggcgcuggcggagauaggcgaugcggugugaggagaugaauucccagguggugguguugcuggccaccagguagaggugcgagacgaggagcaggcuggccaccaacgagaagagggacagcagcaggaagguggcgaacaggagcccgcuggaccgcaaccacugaccccagggcuggaagaaccggaggccugaccugcggugcaggggacaggggccuggugcugggggagggcaggggagcccuucccuccccaugccgggucccugggaguccuggcucuguccaccccugugggagcauucaucccacccucccucuacacccgggcagcagcacccaccaugccagguacaggccccacagaagcaccaccagcugcagcgccagguagaccacaaagagugggugguugcgcucucccacacaguucuccauccaggggcagugguggucguagcggcggacgcaacggcggcacucacggcagugccgagcccucaggggcugcugugggcauggaggagaguggaggcucagugccagcccugcugugggcccaccacugagggaaggaaucagggccugauucuggaaggccuucuuggaggaggggcgaggcccaggcaguggggcaggaggaggucgaggagucucagcuuuggcccaaccucucccacggguguccgugcaucacucaccagcaccaggcaguaucugcagcgccgaagagggauggcuggaggaaccauggcugucugcuccucuuugagcuccuccuggaaugaggggugggguguaagacaggguccccuugggagacagauggcauuggcgggcagcuccccuaggggccggcuuagcucuggguauggaguuugggacccaucccaugcagaauggaggugugggguauggcggagcacccuggacugagggcggcuguguauguuugcaagucucuuccuucucuggggcccagcaguuuccucacuacuguagauggggcucuagggguggcaagaggagucacugaacugcucccacaagagccugcagcacagagccuggcauggagacuggugcugguuguuaggucccuguuggugagaguaggggccccugguuaccugaggcuggggcugcacauucacguagccaggguccaugagugacacagcgagguagagcagcagggagcccagcaccaggagcaggaaggugaggggcaggagcagcucccccugcuccucccauugccgcagcucuggagaggccggagagcacagugaggcugggccggguagaacaggagugggugggguuggggugcaguuggagguggggaaguguguuccuggcugagcaaaggccuggagauguugguuccaugaguggcuguguguggccagcaguucaucugcacuuuuaucuggagggucagagggaaccauggaagguuauagagccagaucuguuuuggaaaaccucauugcuaaagaaauggaucaggggaagccugggggcagagaaucuggccaggaggaagaagagagucgcuacaaaggccuggcaggaagugagggaggaaggaauggacagggggcugcugggucaagggagccagaccugacuggaugugggagagagggaagagggguccagcgucucuggcucugcaauggugagagacugguuaggucugaaaugccugagagagauacagugggaagggugcagcuggcaggcucagaugcugcagaggggcauacggaaggguccagcaggcuucagcccagggaggugacaggauuuuggggagguagggugcagggcaaggagugagggggcaugagaccaccagacagcagaguguagacaaauccugugucccuugguuguaagggggagcagagaagaaaggguggguuuugagggggguuuucugauacggagaccugagcaaguuuuuaggcuaaagggugaaggugguggaggaggucugucuugggaggaaagccagaaggggccccaguccagaaacugaggcuggaccgccauggaaggagggcuggggucugcugugggggacagugggggaggcugccuguggcaggugaggcgcuggguagggggcuacuaagaggaaugagggaaauggaggugggugggugggugaaucugugggaagaugggagacaggccgcaccccauggaguguucucuggccugaggguuugccuggacuugggcagcuaguggccauggggguguggggggugugggugugggcagaaugccaaucuuugcaucuaguugagccuccuaaucguauggauaggaagauuuggggucaguuccugggaaggaucaugugggucccaggaucaggggacauggggcucaagucgguccuuggaucuggugggcaccggcuggguccugggauggacagggcauuuggcaaugaucaggaagaugcugggauuaauuagggaucaacgggguaucagacagagagcagguggcucuuggaaugauagauggggagagggcuucaggagcugguggagaucgggccaaucccaggaucuccagggauuaggcgggagacccagugugaccagaacgucuggggaaguacgcgggaucggguggguccggggucgcucgggguccggcucaccgguaucgugcaggaagagcaccagcgugauuccccaggucagcacggugugcccgguccgcaccaggaccccagggcugaggagcgcccagggcgccaucgccucggcccggggccccacccggaagaagcgcccagaggggcgggcccuccgaggga

SEQ ID NO: 13127 - RNA, 3295 nt, Homo sapiens
ucccucggagggcccgccccucugggcgcuucuuccggguggggccccgggccgaggcgauggcgcccugggcgcuccucagcccugggguccuggugcggaccgggcacaccgugcugaccuggggaaucacgcuggugcucuuccugcacgauaccggugagccggaccccgagcgaccccggacccacccgaucccgcguacuuccccagacguucuggucacacugggucucccgccuaaucccuggagauccugggauuggcccgaucuccaccagcuccugaagcccucuccccaucuaucauuccaagagccaccugcucucugucugauaccccguugaucccuaauuaaucccagcaucuuccugaucauugccaaaugcccuguccaucccaggacccagccggugcccaccagauccaaggaccgacuugagccccauguccccugauccugggacccacaugauccuucccaggaacugaccccaaaucuuccuauccauacgauuaggaggcucaacuagaugcaaagauuggcauucugcccacacccacaccccccacacccccauggccacuagcugcccaaguccaggcaaacccucaggccagagaacacuccauggggugcggccugucucccaucuucccacagauucacccacccacccaccuccauuucccucauuccucuuaguagcccccuacccagcgccucaccugccacaggcagccucccccacugucccccacagcagaccccagcccuccuuccauggcgguccagccucaguuucuggacuggggccccuucuggcuuuccucccaagacagaccuccuccaccaccuucacccuuuagccuaaaaacuugcucaggucuccguaucagaaaaccccccucaaaacccacccuuucuucucugcucccccuuacaaccaagggacacaggauuugucuacacucugcugucugguggucucaugcccccucacuccuugcccugcacccuaccuccccaaaauccugucaccucccugggcugaagccugcuggacccuuccguaugccccucugcagcaucugagccugccagcugcacccuucccacuguaucucucucaggcauuucagaccuaaccagucucucaccauugcagagccagagacgcuggaccccucuucccucucucccacauccagucaggucuggcucccuugacccagcagcccccuguccauuccuuccucccucacuuccugccaggccuuuguagcgacucucuucuuccuccuggccagauucucugcccccaggcuuccccugauccauuucuuuagcaaugagguuuuccaaaacagaucuggcucuauaaccuuccaugguucccucugacccuccagauaaaagugcagaugaacugcuggccacacacagccacucauggaaccaacaucuccaggccuuugcucagccaggaacacacuuccccaccuccaacugcaccccaaccccacccacuccuguucuacccggcccagccucacugugcucuccggccucuccagagcugcggcaaugggaggagcagggggagcugcuccugccccucaccuuccugcuccuggugcugggcucccugcugcucuaccucgcugugucacucauggacccuggcuacgugaaugugcagccccagccucagguaaccaggggccccuacucucaccaacagggaccuaacaaccagcaccagucuccaugccaggcucugugcugcaggcucuugugggagcaguucagugacuccucuugccaccccuagagccccaucuacaguagugaggaaacugcugggccccagagaaggaagagacuugcaaacauacacagccgcccucaguccagggugcuccgccauaccccacaccuccauucugcaugggaugggucccaaacuccauacccagagcuaagccggccccuaggggagcugcccgccaaugccaucugucucccaaggggacccugucuuacaccccaccccucauuccaggaggagcucaaagaggagcagacagccaugguuccuccagccaucccucuucggcgcugcagauacugccuggugcuggugagugaugcacggacacccgugggagagguugggccaaagcugagacuccucgaccuccuccugccccacugccugggccucgccccuccuccaagaaggccuuccagaaucaggcccugauuccuucccucaguggugggcccacagcagggcuggcacugagccuccacucuccuccaugcccacagcagccccugagggcucggcacugccgugagugccgccguugcguccgccgcuacgaccaccacugccccuggauggagaacugugugggagagcgcaaccacccacucuuuguggucuaccuggcgcugcagcugguggugcuucuguggggccuguaccuggcauggugggugcugcugcccggguguagagggagggugggaugaaugcucccacagggguggacagagccaggacucccagggacccggcauggggagggaagggcuccccugcccucccccagcaccaggccccuguccccugcaccgcaggucaggccuccgguucuuccagcccuggggucagugguugcgguccagcgggcuccuguucgccaccuuccugcugcugucccucuucucguugguggccagccugcuccucgucucgcaccucuaccugguggccagcaacaccaccaccugggaauucaucuccucacaccgcaucgccuaucuccgccagcgccccagcaaccccuucgaccgaggccugacccgcaaccuggcccacuucuucuguggauggcccucaggguccugggagacccucugggcugaggaggaggaagagggcagcagcccagcuguuuaggguugcuggaggccgggcuaccgucuugugccugaaaaccacggggccuguccccagcuggggugagcgcucagagggccuggggcccucacuccugcccacgccucccagaccccagaacggagcuucaagucagacagaucccugccuuggugggcaguucugccuuccaaggaagaaggggaagaaaaggaccuguggguggcucaggcccaagcagaccccgggcuccaccccagccccgcccaggcugcugccagugcacacuuuuacaaauuuaauauaaagcaaguccagucuuaaaaagacaaaccauaucacuc

SEQ ID NO: 13128 - RNA, 23231 nt, Homo sapiens
gcccauugcaaagaacacaugauuuauucaagacaacucgucaucaacagcacugacucaaggaacaaaacagaugaaaaaacuaaagcaaacguucugacccucuggagugagacccgcugaauucauacagcucaaucuguaaguguccaagauccagggggcagguucucaagcaggaagccucaggcacucuggcucuguggggaccucccuugggcaucugcuugagaaucuggggaagggacauuaucagggcagguccuuucugcaggcgguguccugcugggagcucagccuaaccaaggccuggucccugugcucuugaccuucaucucaaggucaaggagagggcacuugacccaacucugccagcgaggcaaaguaauggugauucaaguagugugguuccaggagggaagguagggggcagacaagagugagugcacuaaagaguccugggcagugucugcugggucccaggcaguggcccaagcuuaugaagggguuggagaaggggcugaaccaccagcugacaaguccuggagagaggguggcccaggugagcaggaagcaucaugccucugccucauccuggagguccuggagucagcccaguucucuucccaucuuuacacucaauuccaguacagaacucagagcccgcucagccaggaccugcucgaaaaccaggcaguuccuagaagcauggggagaagaggcugacuuugaucuuggaaaaugaagaggaucuugucuccaacuccuuucucccuuccuauacccaugccucauccccagagcacuugccaaugugcaauacauagccaggagucugaauaaauagucaaagucucccaaauacugugcucugggagaggagacaggcaggugcggaaauccaggcggcaucaaaggaaaagccugguagaagagccaccuggggaagccuuuccuggcccaaagccgggcuuggaagggcagcgagaaguccugcccaccagacucggaaagcuuugggggcaggagggcugcuggggccugacuccugccagccagucuggaggacgaggguccucacuauggcacccggcuuccggacgcaaaccuuguacaaggagggaggugacuuggugagaacugggaguggccagcugccccugcucaggguacaccugcuccagcccugggaacagcucaggcaggggucagagaaggcccugcaccucccucagcccgcagcggguggagggguacacagaggcacagacauggcccuccuggaacuggcaggacccagggccuuuaagcucagcuaccccuggccccagagaggcuuccucgggccccacuugcccuuugugggacucacucaacccaacccuggguugggaccuggaagccgagggaaugacaacucuucugaagcaauggguuccgacccugggcucagaaucaagguccuuuucuuuucggacaggagggccucugggggaaccuccagaaaaaccagcucccccucuuccuucucccucccugggcagaaagcaggggcaggaggcucaaagcuucauccuuacucagcagcauuugguuuccaagauuucuguguagggaacggguucagaacccucuaagugaggcacggaggacucccucccaguugggaggaccuaggagccagggcugggggaugggaacaggaggcaaaggccaagcuugaccuccaggggccuugcugagccagucuccucaucugucucccagguucaggggagcagaggcaagcggggagaggagguggcucaggauaaggcaccccaacagagaagggcagggagaguaauggagagaggaaucaugaagcaagacacagucccacucugggaaggagguggaaggagacaggcagagagguagagacagagaaggaggggcugggagaccuggaggccugagagacccucacucccuaacacacacacacacacacacacacacacacacacacacacacacacacggagaagaugccuggggacuugggcccacauucacaccgaccgacuacagacaucugugggugagacagacggcaggacucagcuuucagugucgccuucccuguggagcagccgaagugccccgcucagaagcgguuucuggcccauuggccaagcaccuccccugaguggagcccaggagaagaccagaagcaggaacugaggcuggggcggcagagccgaggcagggaggggccccugccagccucccagugccagaaacggcccuggcccaggaaggacaacuucccgagcuccagcccuccucaguauccugggcaaagagggcagagugcagggcagguggggagcugggcguggcggcagaaggagcacggcacaguguguccccagugggcauggccugggucucgggccgauccuguggcuuccccucaggcuggguuccuacagguuucuaugugucccgggagccagggcacagggucgggaggcuucucuccggaacaugggccucuugccgccgggcuacuuugagucuuggagcuccuuggcuuucugcaggaucuggcagacaucugugaugggguaguccugggcacaggaaaaggccaacaguugccucugaagccacuucaccccugccacacccacacccucccugcugggacccguugccaugcuggauccugggccucaggggcaggagcacagaacaccaggcaucccacacuccccaacccccagaccccugcaugcagcugacgcuacaccaugcagcaccaacucaacgauccaaacacaaccacucccaggcucuugcggcccuuuccucaggaccagaccgugcugccucagcucucccacuacugccacugaacccgagcucccucguguggagccaguaggacugggccagugucugagcaucagcgcgaagucccaacagcccugugaguggccacugugauucugcacuuuuuccagaucugguccaugaaguuagggaaaagcaacucuaggcugggcuugguggcucacaccuguaaucucagcacuuugggaggcugaggugggcggaucaccugaggucaggaguucgagaccagccugaccaagauggugaaacccugucucuacuaaagguacaaaaauuagccagacgugguggcacacaccuguaaucccagcuacucgggaggcuaaggcaggagaaucacuugaaccugggagguggagguugcagugaaccgagauugcaccacugcacuccagccuggacaacagagcgagacucugucucaaaaaaaaaaaaacaacaacaaagcaacacuaaggccacgugcuggugaagaagcugagacccagagaugcuguaacuuggcuugggucacaugaugagcacagcagagcaaaacuguggaccuaaagcuguaggcccuugagcccauguucuuuuuuucugagacagagucuugcucugucccccaggcuggagugcagugaugcgaucuuggcucacugcaaccuccaccucccaaguuaaagugauucuccuaccucagccucccaagcagcugggaauuacaggugcaugccaccaagcccggcuaauuuuuguauuuuuaguagagacgggguuucgccauguuggccaggcuggucuugaacuccagaccucaggugguccacccaccccagccucccaaagugcugggauuauaggcaugagccaccgcgcccggugagcccauguucuuaaucacuacaccccacccuccuuccccgggccugagcauggccaccagcaagcacggccauguucugggcaccugcuguguccuaggugugaacaccuacguagaguacacgguuugaaggccaagucacuugcucaaggccacccaacauuccaggucaguggcagaaccaggauucaaacccagauccaaaccagaucugcucaggggucuggacuuuaaucccuacuacacuccgcugccccugcccagccugucgcagcagcuggcgugggcaggugccuggcgagugccagccucauggcaguggcugagccugcccccaacucccauuaccugcagcagccgcauauucacagugaaguccccuuccagcaacugcucccggaucagccuaugaaaagcagcagcaaaagcgcugggaccugggaugcucugagugcaggcccugcccacuccucccucccuacccaccucaaguuugguuugucgcccucccaaggacuccagaaucccacuccagccaugaaagagcagcccugcccacccuucggggcggaggguccuccugucuggcuucuccaaggacugcccaggugagcugaugacagcucaugcccgcacucacaugagcauggcgcagcagacgaggaggaggaagucaaagcgguugucaucggcgaagagggagucccagaugcggaugacgucaggcagcaagaacuccugggacagcagcagugucagccagcggaaggcaaagaacugaggcuugauguucugcucuugcuggggagacagcgugggggguggggggcaugacucuguguuggcugccggccauggagcaccacgcagugggucagaagugaauucagaacagcagggcccagcaugccaggugugagcaccagggcuggcaccaggcugccggacagccuugccugguaaaggggcggagccuguuugcugccagccaacauccucagaucuuccuauuuuuuaaagagaagcuggaaacccaaaccuuuauauaauaagcucuccagauuuauaaaugauggcucaaacucuuuucacacacuuugcagaugauagccuuggguuuguggaugugcugagugaccaucacagggcacuuacuaaaagccugggcuaugcuuagaauauuaaauauguccucucacucauuuaauccacagaacaauuccacaggcaauuauucccaguagagacaagccuucuggucagccacagugaauauuaacugaaaaagcaugcuacaaaacagcaaaagcauacuuccuuuuuuuuuuagagaugaggucucgcuauauugccuaggcugaagugcaguggcacaaucauggauggcucacugcagccuugaccucgagggcuccucucucagccucccgaguagcugagacuacaggccugugccaccaugccuggcuaauuuguuuuuaaauuuuuuguagagacaaagcuucacuauguugcucaaccucugggcucaagcgauccucccgccucagucucccaaagugcuaggauuacaacugugagccaucacacucaacccauauuuguuuaaaaagauaucauuauuccuggccagccaggcacaguggcucaugccuguaaucccagcacuuugggagagggagguaggcggaucacuugaggucaggaguucgagaccagccuggccaacacagcgaaaucccaucucuacuaaaaauacaaaaacuagccaggcgugguaacgcacgccuguaaucccagcuacuggggaggcugaggcaugagaauugcuugaaccugggaggcggagguugcagugagcugagauugcaccacugcacuccaaccuggccucugagagagagaguccuucucaaaaaaaaaaaaaaaaaaaaaaaaacagaaaaaaaagggcugggcacgguggcucaugccuguaaucccagcacuuugggaggccgaggcggguggauuacgaggucaggagaucaucaagaccauccuggcuaacacagugaaacuccaucucuacuaaaaauacaaaaaauuagccgggcacaguggcgggugccuguagucccagcugcuugggaggcugaggcaggagaauggcaugaaccugggagguggagcuugcagugagccgagauugugccacugcacuccagucugggcgacagagcgagacuccaucucaaaaaaaaaaaaaaaaugaaguuaacacuuaccucagaagacuacuaacagcuuaaccaauuuaguucauaguaaaugcccugcaguaugccuggcacacaaugggcaccauucucaacuuuccccuucccucccagcugggcuccaccaucagcugccucagcacaugggucagcgucccgggcagcagcagcagcagcuacuucugacccccagacucaagcgagaccucgcccugggcugggauggcacagcaacucucugccuccugucccuuuccacccgucuguuccugggguccucaccaguuucagguagagcuccacauccuuaucuuucaagguggaguaaaccuucuccaucuuguaggugaugccacacugcgagucauccaggcucuugauaaaguugucccggaucucggccaugagguuggugaagcagaaaaaggugucugccucggcgugcucugggagagagcaggaugggggcagaaguggcgcacuccaggcccaccccaccucucaccuaccagacaucugcccugcucugagccccgccgaguugccccauccucauggucuggcucaguccuuccucuguccuugaccccucuccacccccaggcuaaagacaucgccucuuucuucucacaucuggcaauacuguacauucacuuagcaguuuauuacacacucuccugaugacaauuuaaaaaucauuauuuaaaucuuauaauucggcuuccuacauauccaccuucucuaucagaauuaaauuacaaauaucaagagaucaguaaacaaccaacauucuagaagaucacagcugcaaaggaucucagagaugauccaggccaacuccucaucuggcagagggagaacagaggcccgagagggaaagugaggugcacagccugacacgggccagcaacgagggaugugggcaccaagagccuucuuaccuuuccacucacuauuggggucgguggcaaagguguaguagaggggccccacgauuucauucaugccuugcacauaagcgaugccaggguugagcuuggcguagaugaacaggauccgcuccaccaccucccagugggccucacagccauugggcagcaccucauacucauuuagggaugauggcacagaguucuuguguggggagcucaucuggaggagaagaggaggagcccaucaagaaagacaaugcuggggucaguggcucaugccugaaaucccagcacuuugggaggcugaggugggagcugagccccaguggucgaggcugcagugagccgugauuacaccauugcauuccagccugggugauagagcaagacccugucucaggagaaaaaaacaaaaacaaaaaaagagacaacaugggcgggccacaauagcucaugccuguauucccagcacuuuuggaggccaaggcaggaggaucacuugagccuaagaguucaagaccagccugggcaacauagggagaucccgucucuacaaaaaauguaaauguuagccgagugugaaggcacgcaccuguggucccagcgacuugcgaggcuggggcaagaggaucacuugagaccacgaggcugaggcugcagugagcuaugaucacaucacugcacuccaaccugggugacaacaagacacugucucaaaaaaaaaaaaaaaaauggacaaugugaaggaggacaauguguucuugccagaaauguaaauguuuacuuuuaagccuggaccuaucuagcauaugggacauacacuggcacagaggaacaagucaaacgccaccaugaggaaacaaggagacaaaccuagaauaugggacauucugcaauacaacaaaugguccuaaaaccuaacuuauggugcuaaaagucagagcagugagaaguacuaacuaggaaggggcaugcaggaacuuucuggauguggacauguucuguaucuugacugacuggcacuuacacagguacacacacaagaaaaacauucucuaauuguacacguaauugcacguaaguuacauuucaauuuaaaacaaaaacuuuagggccgggcacggugguucauaccuguaaucccagcacuuugggaggucaagacgggcagauuaccugaggucgggaguucaagaccagccugaccaacauggagaaacccugucucuauuaaaaauacaaaaaaauuagccaggcgugguggcguauaccuguaaucccagcuacucaggaggcugaggcaggagaagcaccugaacccaggaggcggagguuguggugagccgagauugcaccauugcacuccagccugggcaacaagagugaaacuccauuucaaaaaacaaacaggcugggugcgguggcucacgccuguaaucccagcacuuugggaggcugaggugggcagaucacgaggucaggagaccaagaccauccuagcuaacacggugaaacccugucucuaccaaaaauacaaaaaauuagccaggcgugguggcgggcaccuguagucccagcuacucgggagacugaggcaggagaauggcaugaacccaggaggcggaguuugcaguaaguggagaucgugccacugcacuccagccugggugacagugcgagacuccgucucaaaaaaaaaaaacaaaaaacaaaaaacaaaaaaaucuuaaauaugucaaaaacaaacaacuggccaagcccaagacuuuucuuucuuuuauuugccccccugagacagagucuugcucugucacccaggcuggagugcaguggugcgaccucagcucacugcaaccuccaccucccagguugaagugauucuccugccuuagccuccugaguagcugggaguacaggcacccaccaccaugcccagcuaauuuuuuguauuuuuaguagagacagaguuucaccauguuggccaguauggucuugaacuccuggccucgugauccgcccgccucagccucccaaagugcugggauuacaggcaugagccaccgcguccaggcuggccaagccuuuucaaaaagucagcuguugaggggaugggguuggggaggggaggccuaguccaaaucaagagaccaaagaaagagaauauccaaagauaccacuggcaccagcugaggacaucucaauuguucauggguuggguaucaggugauauuauggacucaugguuaaucuucccagaugugcuaaugguaaguaggagaaugcccuucuucuuuuuuugagauggagucuugcucugucacccaggcuggagugcaauggagugaucuuggcucacugcaacucugucuccuagguucaaacuauucucccaccucagccucccaaguagcugagauuauaggugcucaccaccacgccuggcauuuuuuuguuguuguuuuguauuuuuaguagagaggggguuccaccauguuggucaggcuggucucaaacuccugacuucaggugauccaccugccuuggccucccaaaguguugggauuacaggugugagccaccgcacuuggcugacaaugcccuuauucucaggagauccuaccgaaguacucgaugguaaaaggucagacaccugcaacuuacucucucuauauauaauacacacacaaauaaagcaaugugaaaaacguuaacaacuguugcauuuagauggaaaguauacagauaguuauccaguguacucuccuuucaacuuuccugaauguuugaaaauuuucauaagaaaagguuggaggccaggcacaguggcucacaccuguaaucccagcacuuugggaaacugagguggguggaucacuuuaggucaggaguucgagaccacccuggccaaaaaucucuacuaaaaauacaaaaauuagccaggugugguggcacgcgccgaugaucccagcuauucaggaggcuaaggcacgagaauugcuugaauccaggaggcagagguugcagagcgccaagauugugccacugcacuccagccuggaagaaacagcgagacugucucaaaaaaaaaaaaaaaaaaaaaaaguuggaagauaaauaaagagaugaugaucccuacugaagacuccuacaaugagcacggguccccaacaccagcugccugccaggaucccuugggaacuuuguaaaucaagugcugggcccggcccuaggccugcucaggcggaagcuccagaggugagugacccauaugcgagaacccaggcagugacaguggaugaagccauccuggaagcauaggguccuggagacauuaaacucucucuccccuaacauacacauacauauguaugcgcacacaugcagggauguucacacacacagacacacaucagccacauuuaccaagagcuuuuuuauuuuuuauuuuugagacggagucucgcucugucgcccaggcuggagugcaguggcgcgauuucggcucacugcaagcucugccucccggguucacgccauucuccugccucagccucccgaguagcugggacuacaggcgccugcgaccacaccuggcuaauuuuuuguauuuuuaguagagacgggguuucaccauauuagccaggauggucucgaucuccugaccucaugauccgcccgccucagccucccaaagugcugggauuacaagcgugagccacgccuggcccuuaacaagagcuuuuuaugcggcagacaaugcuguacagguauuccuccauuuaauccacugaacaaucuaaaauauucucucaacaucauuuucaagaugaggaaacugaggcucagaaaugucgggccacuccuuaaaugucuaacauuagguguuggcaucaggacuugacccugaacuggcugacucccaaaccuaagguccaggacuucagggcaggcugccuccugaggaugcccagggcuuucugcuuuugaagaaucugcacagccaugaccucauuucauccucuuggcagcucaggcagggcagaaaugauuaugcccaguuuauggucuaggaaacaaaggccaggauaugugugacuugcccagagucacacagauggucuuuaacucaaacugcccaaucacgaacccagaggcuuagggaugaaguuucugguggguucucugcuaccaggaccaaaaguuaaaccagguaacagugcucuuuacaccuaguuacuacagugaaaggaaugacaggagccaguccccucccggcccuucagccaggaaaucagcagccaagaguacugcccacaaagccagccuccugguuaucuagucacgcaaucugcacugcacagcaguucugcugggcacccaacucucguaggcaccugcaacccuggaucggccauaucugccccugccugucagagcuucgaucaaagucauuuccagcugggugugguggcucacgccuguuauccuggcacucugggaggcccagguaggaggaucgcuuaagcucaggaguucaaaaccagucugggugucaucgcaagacucugucucuauuuaaaaaaauaaaacaaacaaacaaacaaaaaacaaagucauuccccagggggagaaaaacuucugcagcaguaucugcccuagcuuguuggaggcuacagaaaaggguuuuuccauugauggaagacagugaaaaguuuaggggaacaagccacuauuccagagaccaaaguaggggguguaaauuaaggaauaagauaauauacuuguuugacuacaaggagcuucucagagugacaggaaucuauuaaaaguuggggguccuaucaguuccacccagagucucucagaucuaacccugcugcaucccugcccccaccaccucuugccuagacaacugcaguggccuuccagguagccucucuaccgccacuccuguaucuccacagugccuaaagcauuuccgacacaagcagaugugaauuaugucacugcccugcuuacacugcuguaaaggauucuccccaccccucaugacaaaggccccaaguggccuuaccagcaccaaccucuucacucgcucucugcuucuagccaccccguggccucccugaccuggaacacaccacgcucucucccgcugaggacuucggcauaugcccuccucuccaccuggaauguucucuucuuuucuuuuuuuuuuugacagggucucguuuugucacccaggcuggaaugcagugguauaaucuagacucacugcaaccuccaccucccggguucgagcaauucuacugccuaagccucccggguagcugggauuacaggcaccugccaccaugcccagcuaauuuuuguauuuuuaguagagacaagguuucaccauguuggccaggcuagucuugaacuccugaccucaggugauccacccaccucggccacccaaagugcugggauuacaggcaugagccaccacaccuggccagggccaaauuuuuguauuuucaguacagaugggguuaaauccccggguuagucaggcuggucuugaacugcuggccuuaagugaucugccugucuuggccugccaaagugcugggauuacaggcaugggccauugugccuggccguuuucuuaauuuuuauuuuuuugagacagggucuggcucugucacccacgcuggagggcaguagugugauguaggcucacugcaaccucugccucccaggcucaaaccauccuccuaccucagccuccugaguagcugggacuacaggcacaugccaucaugcccagcuaauuuuuguauuuuuuguaaagacaggguuucaccauguagcccaggcuggucuugaacuccugggcucaagcaauccuccugccucagccucccaaagcgcugggauuacaggcgugaaccacugugcccagcccuaucacauuuucucacauuuguaaugaccuucucagagccauccccacuauaagauuagaagccuggcucauucacucacugugaugcagggcccuucccagcagccauuacacccagaugggacacagugaaccucuguuacccaacuuuuagaaagcaccccaggaucuggcagcaucaggauugcgcugaguaacugucaagcagauggucauggcccgacaccuuguggccaggaguuuaagagaaaaaggaaagaaaauacuguugggggagucccuggggaccccagguuggcacucacauuugugaccccacuccgguuccgggccaccgucugagauuucaguguugucuguuccacucucuuacgaaggguuucaaacucauucuggggguccaggaugaggaggcaaggguagucaguggcccucuggaagaaggaaaugucugggcacaaccuccugucaagagggaacaggaaauaaucuuguuacucaagguggaaguuuucgccaucccaucugccaggagaccccaagacuccccaaaagcauuguuuuuuguuuuuguuuuuguuuuugagauggagucuugcacugucgcccaggcugaagugcaguggagcgaucucugcucacugcaagcuccaacucccggguucacgccauucuccugccucauucucccaaguagcugggacuacaggcgcccaccaccacgcccggcuaauuuuuuauuuuuuuagagauggaguuucaccauguuagccaggauggucuugaucuccugaccucgugauccacccaccucagccucccaaagugcugggauuacaggcaugagccacuguaccuggccagcauuguuuguuuuuaauuacaacguuuugaaucacuagaggucaagaguuugagaccagcccggccaacaugguaaauuuugccucuauuaaaaauacaaaaauuggcugggcacgguggcucacgccuauaaucccagcacuuugggaggcugaggcagacggaucaccugaggucgggaguuugagaccagccugaccaacauggagaaacuccguuucuacuaaaaaaauacaaaauuacccgggcgugguggugcaugccuguaaucccagcuacucaggaggcugaggcagaagaaucgcuugaaccugggaggcggagguugcagugagccgagaucgugccauugcacuccagcuugggcaacaagagcgaaacuccgucucaaaaaaaaaaaaaauuagccaggcgcagugggaggugccuguaaucccaacuacuggggaggcugacacaggaauugcuugagccugggaggaggagauugcagugagccaagaucgcgccacugcgcuccagccugggugacagaaugagacucagucucaaaaaaauaauaauaacaacaacaauuacaacauuuuauuuuaaaaacaguauuuuuuuaaaaagcuguagucauuguauauguauacaugcccacauuuuauguguauuugcaaauagauauauacuuuuuuuuuaaagugucauuauggucauacaaccuaacuccucuuuuaaacuccaaacauauuuccauguaaaaauauuuaucuaggucaggcacaguggcucaccacuguaaucccagcacuucaggaggcuaaggcaggagggaucacuugagcccaggaguucaagaccagccugggcaacaaaaggagaccccaucuguaaaaaaaauuaguuggggccaggugcgguggcuuacgccuguaaucccagcacuuugggaggccaaggcaggcggaucacgagguccagagaucaagaacacccuggcuaacacggugaaaccucgucucuaaugaaaauacaaaaaauuagcuggguguggugucgggcaccuguagucccagcuacuuaggaggcugaggcaggagaauggugugaacccgggaggcggagcuugcagugagccaagaucgugccaccgcacuccagccugggugacagagugagacuccuucccaaaaaaaaaaaaaaaaaaaaaaaaaaaaaaaaaaaaaaaaagauggugaccauccuagcuaacacggugaaaccccaucucuacuaaaaauacaaaaaauuagccaggugugguggcaugugccuguaaucccagcuacucaggaggcugaggcaggagaaaucacuggaacccggagguugcagugagccaagauugcgccagugcacuccagccugggcaacagagcaagacuccaccucaaaaaaaaaaaaaaauuagcugggugugguggcaugugccuacaguccuggcuacucaggagguggggcaggaggaucacuugagccugggaguucaaggcuucagugagcuaagaucaagccacuguacuccaguccagccugggcaacagagcaagacccuaucucaaaaaaaaaaaaauuaucuaacaugcacaaacacagggugguuuguaguagcaaaagagauuugguuccauaaguuucacacuguacaacagaauauuauacagcugaacuggaaagauguccaagacagagugagagggaaaacaaguugggagauggugucuagaaugugaucaaguuuuuaaaauauauguauugcaguacacgcacauuuuucagacuucuuauacuuagcacauugcaaacacgcuucuagaagcaccaaaggaucacuacccauguaaaacagaaccuggccaggcauggugucucaugccuguaaugcuagcacuuugcgaggcugaagcggguggaucacuugaggucaggaguucgugaccagccuggccaacuggugaaaccccgucucuccuaaaaauacaaaaaucagccaggcguuguggcacaugccuguaaucccagcuacuagggaggcugaggcaggagaaucgcuugaacccgggaagcggauguugcagugagccgagauugcaccacugcacuccagccugggugacagagggagccucugucucaaaaaaaaacaaaaacaaaaacaaaaaaaaaacagaaaacaaaaaaacagaaccuauuuccccaggucacggagugguucuugacuugaacacagcaaucagaacaccucguggguaaacacugcaccaacccuagccugagagcacaagaggcagugccuccuuuuuccugcagccuggcugaguugcccugugcgggggucacauggggccaucugaagaugagccugggcugaggagcagcacccaggguggcaagggaaaggaggacccugcuuuauccugccaugcgccuucuuccccggccacagggcacucucaugugcugugccucagcccagcagacucuuccacccagcuugcugccuccuccucuuucauaucucauccugagccuccucccuggaaaggcuuuccucgaucccccaaaggaaaacagggccucccucugauucucuaaaagcaccaguuuuucccuccuucacagcacuacaguauuugcaauuacauaucuguuuccagguuuaguauaugucuccugacuuacacuggaagcucucagaaggcagagacuguuucaguccugcucacuccuaaaccccuucugacaccggcacucggccauuccuugagaaggagcugaauggaggggcaccugucuguacuggugcagacugacuugggcaccugagagcugccccuuggagauucugaagggucacugcgggucagagugccagcuuguucugucuaaccaagugccgggggucccaggcaggcuguuguaaaaggaacaggauaagcucccaggacccuucucugauggagaucugaucauucuaagggccucuguaagugcuaagucccacguaucuguggagacccagcccguucugugcccuuagccugaaccaccuuacuccuacuucacaauagaguaaugaucagaaggugugagucacuugcccaaggucacacagcuaacaacugguaaaugcggaauggaaaccaggcaaauggacuccagaacccaagcccuuggccacuccacccaccuguggacaaggccugccuucuagcuccucaccuagcccaacacgcugccaaacuccccagcccgacagggccgcacagccagcaucuccacauuucuuuaccaaguggaaaagcacaaacacauuguagcucaagauuuuaaaaacuguguauuugacccugucacuccuuuacucaaaaccuuugcauggcugccucaugcucuuagaaucaaguccaagguccagccccuaucucccacccuggccuuggcauuguuccucagaugugccaagcucugcgggcucucuggaccuugccaagggcaguucccugcccaacauggccuuugcugcacucuuccccugaggccucccacuccucagaucucagcugaaucacugcuucucaggugagguuuccccaaacccccucaaauuuuccuucaggagcauuuaccacgaaugccaucugcuaagaucuaaugggcugaaugucugucuugccauccucccuucuagguucuaagauccuuaaggagagggaacacaccagugcucaacccugaacuuagugcuaagccuggcacacaaaaggggcucaauacuuguugaaugaaugucagaugaauccauaaacaccugggguacaaaugaaacuacagcucagauaagaacagccagguacaugcaagcacagaaucucccucgcuagccucguucucagccuaucaucaauagugccuggacccaaccgcugggacaauccaccagcagcuccgcaaacacucacccauaggcccggccugcaaauggaaaagacagagcugcagagagccccagaagucccaugggccagcucccggccccaggcacccugccuaccggacaucuuugucgaucugcagcagcaccucguuguccuugaaguacguguuccaccggcugucaggguugggguugaguggcuguggggagaaaugaagaugcucuguccaaggcccagcuaggccccggggcccgauucuaucccggaaaccugagcaguggccuugcugcaacaaucccacugcacacugaggugugguccugacaccaccugcaagauacucagaggagccaacacagcccuucccucagccuccugaauccguucaaacuccacagccgggagcccagccuggggaccagcucugaggacuucucugcugggcagggacucuguuccuuuucuguccguugcucuagcucaagaacuuugcauauaacaggugcucaguaaauguuugcuugcugaaugaaugaauuugguuucuucggcucucauucaucgaugcucugagucgucaauuccuaucugugagucugggccuggggcccaucgauuucuuucucacgugcugugaagcccagggaggagcucagcauuugaggagaacaaggcuuccuggcagcuuagccucccucccgcccugcucugacuuucuucaaggaacagggaugaggguugaaauagaccauguccucagagcaccugacgcagggcugccccugcaaugcucccuggaccccaacuaucguuugucuuacugagcccagggcccccaagcuuagugacccaacgcagaaaggaggaacugggagguccagaggggacugacaccagacugcaccuacccccuggcaugcaggggcccuugccugcuccaaggccgccaccccuccacauucuguauccugggucuccgcugucaaccucuacucacaugguccucaaaagucacauccucccuggacacacccauguuggccuuggcaaugccaggcuggaugaucauuucccucaggaacugggcauacagcucccugcaggagacaagugagaaggaugauucccaacgguccugcccagggagcccagagcagagcagcagccgcaggaggcagggcggccccagcgguacuggcucugucacaugcaagggcccuccugucacugcccuuacacggggucucaccucugcuuggccaggauggagguccaugaggcucucuccaagggaagguaguucaagagaaucugcacagagggagaagggcaaagcucuggugacccuccugcaccaacgucagucuuuaggcggggaugacaggccucaagaaaaacaucucauaaagucccaagaagacaagaugggcuaaaauccaggaaugccagcaugagcuagggguagccucccccuuccuccccacugccucccuccuccuuuaacccaaaccagcccuucccucugcuuuuccucacacagacucuuccacaugaucaucagacccugugcucuaaagggcuggaaaccaggacacugggcuuccauggccaccugagcugggagcuuugggcaaagcacagccuuuguuuugucccaauaagcaugacuuucacuguacuucacggaccaggaagcagaggucuucauuguuggcauuacaaagugucccauccccaaggggaucccagagaagacaccaagaggaacagaaaacccaggacuucccagaaaagcucccucagacaagcaaggaaaggugcagaacaggaggaagaagccagggguaggggcagcccaugcaggaaaacccagggacucucagcagagcagaagccccaccccaggcacacccaccuuccagcagaggcaccgcaguccgcccucacaggggaugccuguggacacagcaggcaaaggucaugccccaggccagagucccagaacccccagcccuucaccguggagccaacuggcggggaguagagugggcaagaaguacuucuucaagaaucauuuccccaagaaagaugacuagauuggaugguuucuuuuuuuugagauggagucucccucuaacaccuaggcuggagugaaguggcgcaaucucggcucacugcagccuccgccucccgaguuccagcgauucuccagccucagccucccagguagcugggauuacaggcacgcgccacugugcucagcuaauuuuuguauuuuuaguagagacaagguuucaccauguuggcuaggcugggcuugaacuccugaccucaggugauccccccacuucggccucccaaacuguuaggauuacaggcgugagccaccauacccagccuagacuggaugcuaauuuuuuuuuuuuuuuuuuuggagacaaagucuugcucuguugcccaggcuggagugcaauggcgugauuucugcucacugcaaccuccgccuccccgguuuaacuaauucuucugccucagccuugcaaguagcugggauuacagaugugugccaccacuccuggcuaauuuuuguauuuuuaguagagacaggguuucaccauauuggccaggcuggucucgaacuccugaccucaggugauccaccugccucagccucccaaagugcugagauuacaggugugagccaccaugcccggccugaaauguucuuuugaggauaacaccuucucauccuugauauuccuuccucaggagcagccuuuaccaccaccaugucauccuaauucaggucaguucccccuguuauaagcaauaauggcucugugacuauuucauagcaucugucauaaguggaauuauuauauauauauauauauauaugguguauuuucuuaacgucuguaaccccuacuacuggguaagccccagaaggacaaaaaccacaucuauuauucccagugcauagcacagagcacugcacauagaagauauuccauacauauuuguggaauauaaacuaagcuacgaaugcuaaguauuuugugcuuuacagauauuauuucauuuaaucuucauuauuaccccaguaaguagggaagauuaacguaauugucguaagaaggaaacuuaucuguaaaacucuuaacuacuaacacugacugccucuccuuuggggccuauauuucacuccuaaacagaaagacaaaguuauccugcaauaagaucaggaagcucacuaccgcaguugcugcuguaguaucccugguaccaugaacaugagugaauaccuccacuucagaaucuauaugaggaugacagggacaauauaagaaguucuuuuuuuuuuuuuuuuuuuugagauggagcuucacucuugucgcccaggcuggagugcaauggcgcaaucucggcucacugcaauucccagguucaagugauuuuccugccucagccucccgaguagcugggauuacaggcaagugccaccaagcccagcuacuuuuuuauauuuuuaguagagacuagguuucaccauguuggccaggcuguucucgaacuccugaccucaggugauccaccugccuuggccucccaaaauguugggauuacaggcaugagccacggcacccggccagaaguucuugcuggcaaaguuacaagggcaaaaaagugacaagaagcuaugcagaacacguugggauauuuuuuaaaacaggcaaaaagagaguuaucuuugugcucauuggggcaaagucuaacacagcaggaucagcuccuuaaagucagugucccaaggcuacccauuuuaccacuagccaagguuuaguucaggcagcuuagaccccaagccagggagagaacaaggaacaacccugcaguuaaccaaacucaccaacacaggaagcuagcuaaggaaugaggaaagacuguccugggcucaaaaggucccaacucucauucuccaggcuucaguccuguccuguuacucucaggaaucuggcaccuccugcggaaagcuuaggaaagcuuagggcaugcuaaguguggccacugccccucugggaaaccccuccaagcucaaggcagucacugccuguucagcucuacagaaucuggaaaaggccccaagagucuguguguaauuuccuuccaaggccccagcccccagcagcugggccccagagcugaccagguguggccucccccuguauucuagccacagggcugcuguagggaaaccgugaaaauacagaauggcuucuuaccacuaaagcugaguucccgcagcuuuuccaaugcaauugagggcuccuucaggacauccuggaaaucugcaauucuggaaggggagauagggcggcaaaugaagcaugcugauaucggcucagugagacccacagcccucagcucccucacacugccaguuuccaaccugugccucucuccccuuuaggacauaaaaaucacacagcuuagucaagguccucaccaaagacagcuuuggagaacaacaaaacuauauuucacuucuuccucuacaaccagaaacacagaaugccagggaagaaacuugagagauauucuugucuagaaguucccaaaugaggaccauaaaauuagacauauuccaacauucuaauacuuagugagcugacauuuacugggcacuuccugccggccaggccggguccacgcacagccaccaacugaacuccuuggaccucaggaaccaggaguaauuugauaugcagacaauggaccaugcucacaaauauaaccauuacaagaccucugggccugccagaaggcaaggacaaaggguuuaaaaaacacguccugaaggaaaacugaagagugagcaaaauucagccaaugcugcaggaucuggccugggggaggggccagacuggagaaugcaaguucucuagcaauccuaguaagaaaaaggcacgggggacagggugcacuuggagagaguacgggagcagggggaucaaaagggggaaaggcacgggggcggggcaugggggucuggaugaggaagacucaggggaagggggacaccagggguccaggaugagggaggcagaagcagugacaucaggggcaggagaagggccgccccuccgucguuccugcagcccacaggcaaugagguuagaagguggacgcucgagacccucugccgagggggucugccgauuccuggccacacccgcgcuucccccuucugaggggcagaaggggcagccuggccaggaguggcccagccgggucaggccccauggccccuuaccggcucuugugcagacuugacaugguguugacuuccggaccccccagccgccuccgccgccugcgccucugccgccugcgcugccgccgccgccgccgccccccagggacgcggggcucugcgcaaaagccuccggcgggaaacacagccacuagccugcgcguuccaccgccuca

SEQ ID NO: 13129 - RNA, 7781 nt, Homo sapiens
agucucauuggcagaggcgggaccgacggugugugcggaacauggcggagcgcggcaggaagcggccgugcggcccgguaagugcgggcggcgggaccccgugcagggcagcaugguggaggcgugagaaccaguggcgugggggccuucgccggggccgggccgcgccuccugcugccugcuucccgcugaucccaggccggaagcccccgaaggugccgcgugagccucagcaggaugggaacagcgcccguguccucuccggaacccccugcggcucccuggcccccgcuggauuacggaggcgggacccugcucgccuccggaugcugaauccggagcccuuucguggcuucuggagcccuuuucugacuuccagggcgacugugggcagugcuguacccugagccucaguuuucucuucuguuuugugggaacucauucgacaguuucuugagugcuuucugugugccaggcugggucccaggcgcuggggauacagcgggucccugcccuccugccgcuuucuggggcagcaguucgcagagguuccuuggcuuccuugccgccccguguggaggggcuggcuauggugcagcaaacggacccccuccaggugugaccaucagccucacacucauaauccuccuaccacuccuucuccagggugaacacggccaaaggauugaguggcgaaaauggaagcaacagaguaaguaaggguggguaagaguaucuucccauaggccacuccaccagugcucagucaaacccuggagaaagacaccaacuuuguucccucuggguccugcagcacacaaaguggggaggcaggggccgggagcccuggggaggcucccuugcugcccucuggcugcucacccagcagcucuccagaguccaggcugacccaaugagugggaacugucuccuuggccaauuaggauguucuuuuauccagagaaagaggagaaaaaaaaauggaaggaucucaagcugaugaaaaaacuggagcggcagcgggcacaggaggaacaggcaaagcgccuggaagaggaggaggcagcggcagagaaggaggaccgcggugagcuggggucuuggggagggccacagguuguggcccacgguaguuguccugcaggcagagcagagaugucuuaucugaaagggccuuuacagaccaguagguccaaacaucuuguccugauggagaaacugaggcccagagaagggagggagccagcaaacugaguucugaccuccugcuuagguaaauuucaagccuauggaaggcaagccuuaucucucuuuuuuuuuuuuuuugagauggagucuugcucuguugcccaggcuggagugcaacggcgccaucucugcucacugcaaccuccacugcccaaguucaagcaauuuuccucccucggccccccgaguaguugggauuacagaagugugccaccacaccuggcuaauuuucguauuuuuaguagagacgugguugcaccauguuggggaggccggucucgaacuccugaccucaggugaucugcccacuucagccucccaaagugcugggauuacaggcaugagccaccgugcccggcccaagccucauaucucuuaacuuagaccucuagaacuucaugaucuuccugauuuuuugacuuuuuuauugagcauuuucugugugcuuuaauuucauuuuucaauuauuuugauuucauaauaaaaaugaaagaaaacuacaaagaagacaggaacaaucccagcaaacauuguagcaaaagcuuguccaaacaauuauagcuacuuauccauguguagcaaaguacagauacaauguuacaacagugaaaccauguuaucuaugugcuucuugggcuuuuuuguuuguuuuugagacacagucucgcucuguugcccaggcuggagugcaguggcucgaucuccgcucacugcaaucuccacuucccaguucaaucgauucuccugccccagccuccggaguagcugggauuacaggcaugcgccaccaugcccagcuaauuuuuguauuuuuaguagagacgggguuucgccauguuggccaggcuggucuugaacuccugaccucacucaggugauccgcccgccuuggccucccaaagugcugggauuacaggcaugagccaccuuuugugugaccuugggccauguauuugacuucccggggcugaaggccccuggucuguaaauggggauaauggcaguauccucacuagggaucagguuaauggcuaucggguuaaugugcacacacuaaagacuuauuagauaucagcuuucauuuuauccccauuugauagcuggagaacugaggcaguaagugggagagccaggaugugaacuuaggccauugcuacuaaccgcuccacagccucgcccagugguuugcccugcucagaggagccauggagacugcugggagacugaggcccagagaggggagcuggaucuauuuugcucaucucaaaauuccucccacuugggaaauucucaaaccaugggcgcuagggacagaggaagggagagaaagguagggggcccuugccucucacacuggcugggaacaucccuccccugcucagggcggcccuacacacugagcguagcccugccgggcuccauccuggacaaugcucagucgccggagcuucgcaccuacuuggccggucagauugccagagccugugccaucuucuguguggaugagaucgugguguuugaugaggagggccaggaugccaaguaaggggccaucccacagggugccaggguucagggagagggaggggcugccgggaugggccgaggcuucaccauggccccguccacaugccuggcucuucccucgugcccugccugaaauauucccuguguaauccuuaguggguagaguugccaggugggggugaugacuacagaggugggauugggagccagaaggccuaaaccuguaucucagcugucaccccggcuggagugcaugcaguggcauggucauggcucacugcagccucuacuugcugcacucagaugauccucccaccuuagccuccugaguagcugggauuauacgcgugcacuuguagacaggagcucuugaaggggccacagcuggauccugagcccccaucucucucucuccaggacuguggagggggaauucacaggaguugggaagaaggggcaggcgugcguacagcuggcccggauccugcaguaccuggaguguccacaguaagggggucacuccccuaagcaugagggaggggugugucaaaguggagaccagguaggaggcggcuuccccugggaacauccugaggucagcauucuuuccuagguaccugaggaaggcguucuuccccaagcaccaggaucuacaguuugcagguaacgcuguaugggcccgcccccccauuuccccuggaucaugccacagacacugagaccacccaguccuacccugcgcuguccaggugggaaagcaggccugggagagcaagaccugugucugaugccaagacgcaggucuguggcagagccgguacuccgcuccaggguccccacugcacccugugugcccuagcacuucccagacucuucccggcucugccuccacagggcuccugaacccccuggacagcccccaccacaugcgucaggaugaggaauccgaguuccgagagggcaucgugguggaucggcccacccggccaggccacggcuccuuugucaacuguggcaugaaaaagguaggaacagaaagaugggcuaggacacaccuccaggacacacccuggcaauggagggcaagcagauggauguugcggagagcccuggaccugcccgaaaucccucacugaugcaaauuugggccagagaauugugcaaaauggggcucaauagauaaagccaggaaugaauuuacuguugcuuaaaaagcaaaucaacagaagacaguccucaugcuccaaacaaaacccugcagaaacaaguugaaagucacucuggagcugcucccauguggcacagagccaagcugggaugagggcauuaauuugccgccucuuuauccucaagccuccucaaaucagaggcagaaaccuuuacauguauggagucccuuccugucagaaagcacaacccaagcgcaguggcucacgccuguaaccccagcacuuugggaggcugaggcaggcgggucauuugaggucaggaguuugagaccaaccuggccaauauggugaaacccugucucuaauaaaaguacaaaaaugauccaggugugguggcacgcaucuauaaucccagcuacucgggaggcuaaggcaggagauucacuugaacccaggagacagagguugcagugagcugagaucgugccacugcacuccagccugggugagagagccagacuccaucuuaaaaaagaaaaaaaagaaaaaaaaguugcagagcuaccaaaauguagaaaacugaguuucaucuacuucuauccugugccaugagcgccccaaaggugcauguuuggccagugaccuguguuuugcacaaaugaucucuugugagcagguucagccggugccagggguggaggguggcagguugaccuggaccccuuggucccuugccagccccggggcuccccugguggcaucuggaagagccguggccccugcugaucuugagaggaauggcacccauuucuucuggcuucuccccaggaggugaagauugacaagaaccuggagcccgggcuucgggugacugugcgacugaaccagcagcagcacccagguaucuggaagguuccccaaccccuggguuggccugaugagcuccaggguucagccaccugcuuccauucccucaccccaucuuuacagacucuguuaccccuccagacugcaagaccuaccauggcaaagugguaucaucgcaggacccucgcaccaaagcuggucucuacuggggcuacaccguccgacuggcuuccugccucaguaaggacagaccuuacuucucugaauauccauccaucccucugggagguggccgggagccuugccugacccaaauaucagaccaggguuuuuguccugucaacuugcuguguguccuugggcaaguccuuccccuucucugggccuuguucucccuggaugcacugccuggaaugcuguuaaggacuacugagcaaaaguaucauuauugaucaauaauguuucuguaggguugggaauggaggcaaaagggccagagaagucagaggcccacuucauguucuuggugccucuuccuauccagucucugcccuguuccccagccaagcacaggcuuggugucugcccugcucaguccuugacuuuccaggaacagcucuacccaccccugcucgguacacacacaccccugccucaaugcacacacaggcagagcucuacccacccaccccuaccuuaguacacacacgcacacacacacacacacacaccacacagcucuucccacccacccccgccucaguacacacacacauaauacccggagcuauggcuuguggggagcaggaccugcacugagcuggccccacccccaggugcuguguuugcugaggcccccuuccaagauggguaugaccugaccaucgggacgucagagcgcggcucagauguggccucugcccagcuucccaacuucagguguguaccuccuggggcugcggccagggcaggaggaauguggccaggaaccugccuggugggugaagcugcacagaugggccccugcugucugggguggggagggacugaggucugggcgcugugcuggguggggccucgguggccgcucaggugacccccucuuacaugggccaggcaugcucuugugguguucgggggccuccagggucuggaagcuggagcggaugcugaccccaaccuggagguggcugaacccaguguccucuuugaccuguacgucaauaccuguccuggccaggguagccguaccauccgcacggaggugagcccgccugccuccccgacugccagccacuggggccuugggaucuguccgaggggcgggugcuacucuugcccugucacccacccuugcccguggcugccuugucuggaggugguccucucaucccccuuggccucuugccacagcgacgagacaugaguguagcugggagucaaccaugggugcuagugcccguccugugcucccagacugggugacccagggggcccugcccaccccugcuccgggccucugguuccuuagccgugcgcucagugaucucccagggcccugguucugccacuuccuugugugugaccacggugggcacagcagcucuccccuuggggucucacuugcaucugucccacgggggaagccacgugcagcuggagccuucguccuggccucauggaaccuguguacccacuuuuggggucaggcauaggacgcugugcuacgggaacucugcugggaaggcugguacucccaucagucucgccgggccgacagcccugucuacccaucccuaaggccuugcccaagccgagcacucugagccugacagccauaccccccagcaggaacccuggcugccacccuuccaaccccugcacgaggggugaaaacuucuugccccucuucuugcccuccccuggcccugggaggugggcguuguuaccuucgcccccauuuuacagaagaggagccugaggagcaggcugugugguccuccagguggcaagugugcagugugaaccugggccugucauuaaccucaccaggcccuacuaaggacaggggaccccagugggccaggucucgggcagccaggcacugaagacaggcugggagcgggggcacccgcuagccccccaggccccagcccacugccacgcuucucuuccaggaagccauccucaucucccuggccgcccugcagccuggccucauccaggcgggugcccggcacaccugaaaguucuaaggggccgaggacaucagugaagcagcagugaaaccaggggcucugcaggucacuugggacggacgccaccagacuugucuccaaaaaucaccaccuuuaauacuccccggccugcacacacccacagucucacugggcuccacccucacuuacugcccgccgugauggccuugaggcugccugcccgcgccaggauguuuggcacaaagagcagccccgaagcccgcucaaugcucucgaugggcaccaggaagcgcuccagugggauggccucauccacaggugcguugggcaucacguaggugcggagcucaauuugcccaccugcugccuccaggaucagcaccuugaagaagugugugggcacugccacgugguucuugccgaugaccugguacuuuacguaggauuucccaucagccucuguccugugggcagacccaggcacacgugggcagggggccuggaugaacccaaagccaccucuuccaggcagccuucccugaucuguccucuaacuucugucaaccugcaggaccacgcccucacugugagacuucuguagccugccuggcuccuccuugaggcuggaacucucuccagggugguuaacucuuucccucuguuuuccuuaugcccaacacugggucaggcagagugggcgacaauaaacgcugcuaggagaaucgagccuucugaauauucacauucgucu

SEQ ID NO: 13130 - RNA, 4560 nt, Homo sapiens
ccacucuacccuggaccuacagcaagaaaagcaaaggacuguggggauggagaugcuacccuuugcuccccaggcugggaagggcacuugacuggagcuggagcuggcugagaaggagaggggcccaguccuuaccccaaggauggcucugcuaucugcgcgucggcugucggugcugaggcuggcccgcgucugccugugcaggauccuggcauuccuuuugcuccauggacgcugccucccuacaaggaagcgagagcugccgucagcaggcacaugugugacugucgcaguuaccugccacaccgccagcacuuccugagagccugcuugguagcaggcccuuggcugggcucuggggugacaaaagagguuuuuuuuguauaguggugcaaucucgguucacugcaaccuccgccucccgcauucaagugauucuccugccucagccucucgaguagaugggauuucaggugcgcaccaccaagccuggcuaauuuuuuguauuuuuaguagagacagcguuuccccauguuagccaggcugcucucaaacuccuaaccuccagggaucugcccgccucggccucccaaaguauugggauuacaggcaugagccaccgcgccuggcagacaaaagagguucugacagagcaccucccuccagaaccuggucuacugaggaggugccaagucaguagcgacggucugagagcucagagcucugcugcgggggagccaggagaagcacuagacccagacuaguggggucagggaaggcuuucuggaggaggaguugucugaguugacuccuaagaguaggagcuggaaaaagagcauuccaggcaggaggaacagcacauguuuaccuggaggagagaguacauggcaucuggagaaggcuugcgggcucggcauggcgagauccagagccagagaggggaaguggcaagagaugagccacagugggguggcugggucaggcagagaccagccagugcccagacuccaacuuaaacaccaaauccacccaucaucuccgacagucaaccagccucuggugagcaucuacuccauaugcgccagacacugugcagaacugugcaugggaguggcaggguagggaaagcugugaucacuacgacacggguuucggggagccaggagcugggagaguggcccagccaccagagagagccaaaggaucagcaggaguuacccaggaaggaggagggcggggguagacaaagacaccuggacugaucuaggagggauggcuguuuuuccaucauuucuaccacuggguauuuacuauauugacuaaguuccaggcccugugcugggagggcagacauggaagauggucuccgccgucaugggagguaggucaauaacccugcaauuccauacggggugguggugacuaggcaguaaaguaccuacagcuauauaggcacggaggccauccaagccaaccucuaccucacucuacccuccuugucaaggauggggcacccacugaggcugggugguccaaucaccugcccauggcagagccagguccagaacuugggccccuggacucccugucacuaauuauucuagucccuccucuuccagaaagcauacccugaccacccccuacauaaccacccagagcuaauuccuucuuccucugggcugccucuguaauauuucuauuaauaugguggccacaguauaucagaacuuaugugucuucugguuugccuguccucccagacugcagcucucaggaggccagggauguuuucccagccaucccaggcccaagacaggcacuuucuaaagaauggcugaaugaaugaaugaaugaaugaaugagucaaggcauggagagacacugugcugggcucuaagagccccacauccaucccaccugaaucuccaagaggucuuggcccaucagugugugccucaguuucuccaugugaaaaccuggaaucagcucuacucuaagacgaggcagucaggaaccaggcugauuucccuccaacuccuacaggcaagguccaggccaagccaggcagcaacccaggguccggccacuucccugaguucugacccacggcagugauccccaggauucccuacaguccagaaaggucauucaagaguuugcaaaggaaacggcuuccuggugggugugccuaagggauggagaaccaccacaucuagucaaguucuggggggaagucaugaacauuuccugugcccccgcucuguuuuuuuuuuuguuuuuuugagauggaauuuugcucuucuugcccaagcuggagugcaauggcgcgaucuuggcucacugcaaccucugccugcuggguucaagcaauucuccugccucagccucccgaauagcugggauuacgggugcgcagccccaugccuggcuaauuuuuuguauuuuuaguagagacaagguuucacuauguuggccaggcuggucucgaacuccugaccucgugaucugcccgcuucagccucccaacgugcugggauuacaggcgugagccaccacgcccggcccugcacccccugcucuguacccuauggucccuagaacgcagagggcaucagaccccaugccaaagcccugagaccaggaaaacaaggaagcagagaccagccacccagucacucaucccuggcauguccacaacagccuccuccagcacaggucaucuguccuugccucacuucaugagccagaggaagacuugaccuucauggaagcaacaccagugagacugagcaaucagcacugcccagucucucugaacaaacucccacucccacauccccuccacaggaaguaucagcaacagccgaucuccucccgcuucuuacagccugucugucugccagguugucugcuccaaagggcagaauacaguuuggcagggguuaagaguacuacuaacagaagagguggaagagguccuugggaacuucgggcucccccaguucccuuccucuuaccaggugcucucccuccacaccucauucucaaaaggcuuccugagguagggcaggggaagaggagucaguggaaguguggcucacccaggaaccgcccacccuuccagccaagucuccaucaggaggcggcuaccagacaacccccgacccaucccuccuucccaaaaaaggcaacaaucgcaacagcugagaaccggcagaccucgguucaccccgguccagaucaaggggaagaagcagucagcgaaagcagcagaaucaucaugaacuccaugaccccagcuaugccccuucagccugggagcucaguuugcuggguauccagcucaccuagggcugcaccaggccuggaccucacuggaucucgccucgcccucgggcccaccugaaugcacaggacugggacagggucuggguucuuagauuccggaccggucuucccaaauaucccaucccagaaaggccccaagagccuagccggggauccugcccccaagucagggcacugcccccaucggaacgauaggaaggaggggugcaagggaagagaaggggaccaggaacucaggagaagacagcuaaggaaaucuuugaaaaagaaauggcaaggagagagcccagagguggaaccucuaggaacgggagaguguguguggaggggugaggaucuggggggacccaggggaugacaaggggacaugggggagccgaggcggaaacuccugguuucugaagcacaaggaggcacaggggugccugggagggggcucgcgcgccgcggagccggcgagaagguggugccccggagacuccgggcacuggggagcccagagguaggccgaacaccgcgggagguccccagggggccggcccggagacagagccccagaugccccgggcgccccgggccgggcagcuggccgagggcguguguaaguggguuucgagaggugacagcucgcgccccuuuccccaccccguccacucaccugggcucgccgcgcccggccgcccggcaggcagccccaggccccggccgcuccgucccgccgccggccgcagcgcugcuccggcgccuccuuuuguuugucccucacugcaccacucagccuccuccgccccggaagugacgucaccgccgggcgcgaacgcggcggccagggcgucgccaucuuuaugaggagaauucuagcggcgcuuucucccgcucucgccuccgcgcuagcgcccugcugcuucggggcggaaguagcggagccgggcucggcccccuuaaagggacagggacugcugcaaccuacgggguguacuugggaacgaggggugaagcggcccaggugagggugaguagcugugucggagcgccacuuccccaaggucaggugccgaggcugggagggucggcuaacgguuccgagcuugguugugcuagagugcuuaaugaguuugaugcuacuaaguauaacggaguggcugcacagaaugauugagccgcccgcgggaaucaacugcgcgugcugcucgcugauucucgcucggacac

SEQ ID NO: 13131 - RNA, 65470 nt, Homo sapiens
aaggaggcgccggagcagcgcugcggccggcggcgggacggagcggccggggccuggggcugccugccgggcggccgggcgcggcgagcccaggugaguggacgggguggggaaaggggcgcgagcugucaccucucgaaacccacuuacacacgcccucggccagcugcccggcccggggcgcccggggcaucuggggcucugucuccgggccggcccccuggggaccucccgcgguguucggccuaccucugggcuccccagugcccggagucuccggggcaccaccuucucgccggcuccgcggcgcgcgagcccccucccaggcaccccugugccuccuugugcuucagaaaccaggaguuuccgccucggcucccccauguccccuugucauccccuggguccccccagauccucaccccuccacacacacucucccguuccuagagguuccaccucugggcucucuccuugccauuucuuuuucaaagauuuccuuagcugucuucuccugaguuccugguccccuucucuucccuugcaccccuccuuccuaucguuccgaugggggcagugcccugacuugggggcaggauccccggcuaggcucuuggggccuuucugggaugggauauuugggaagaccgguccggaaucuaagaacccagacccugucccaguccugugcauucaggugggcccgagggcgaggcgagauccagugagguccaggccuggugcagcccuaggugagcuggauacccagcaaacugagcucccaggcugaaggggcauagcuggggucauggaguucaugaugauucugcugcuuucgcugacugcuucuuccccuugaucuggaccggggugaaccgaggucugccgguucucagcuguugcgauuguugccuuuuuugggaaggagggaugggucggggguugucugguagccgccuccugauggagacuuggcuggaagggugggcgguuccugggugagccacacuuccacugacuccucuuccccugcccuaccucaggaagccuuuugagaaugagguguggagggagagcaccugguaagaggaagggaacugggggagcccgaaguucccaaggaccucuuccaccucuucuguuaguaguacucuuaaccccugccaaacuguauucugcccuuuggagcagacaaccuggcagacagacaggcuguaagaagcgggaggagaucggcuguugcugauacuuccuguggaggggaugugggagugggaguuuguucagagagacugggcagugcugauugcucagucucacugguguugcuuccaugaaggucaagucuuccucuggcucaugaagugaggcaaggacagaugaccugugcuggaggaggcuguuguggacaugccagggaugagugacuggguggcuggucucugcuuccuuguuuuccuggucucagggcuuuggcauggggucugaugcccucugcguucuagggaccauaggguacagagcagggggugcagggccgggcgugguggcucacgccuguaaucccagcacguugggaggcugaagcgggcagaucacgaggucaggaguucgagaccagccuggccaacauagugaaaccuugucucuacuaaaaauacaaaaaauuagccaggcauggggcugcgcacccguaaucccagcuauucgggaggcugaggcaggagaauugcuugaacccagcaggcagagguugcagugagccaagaucgcgccauugcacuccagcuugggcaagaagagcaaaauuccaucucaaaaaaacaaaaaaaaaaacagagcgggggcacaggaaauguucaugacuuccccccagaacuugacuagauguggugguucuccaucccuuaggcacacccaccaggaagccguuuccuuugcaaacucuugaaugaccuuucuggacuguagggaauccuggggaucacugccgugggucagaacucagggaaguggccggacccuggguugcugccuggcuuggccuggaccuugccuguaggaguuggagggaaaucagccugguuccugacugccucgucuuagaguagagcugauuccagguuuucacauggagaaacugaggcacacacugaugggccaagaccucuuggagauucaggugggauggauguggggcucuuagagcccagcacagugucucuccaugccuugacucauucauucauucauucauucauucagccauucuuuagaaagugccugucuugggccugggauggcugggaaaacaucccuggccuccugagagcugcagucugggaggacaggcaaaccagaagacacauaaguucugauauacuguggccaccauauuaauagaaauauuacagaggcagcccagaggaagaaggaauuagcucugggugguuauguaggggguggucaggguaugcuuucuggaagaggagggacuagaauaauuagugacagggaguccaggggcccaaguucuggaccuggcucugccaugggcaggugauuggaccacccagccucagugggugccccauccuugacaaggaggguagagugagguagagguuggcuuggauggccuccgugccuauauagcuguagguacuuuacugccuagucaccaccaccccguauggaauugcaggguuauugaccuaccucccaugacggcggagaccaucuuccaugucugcccucccagcacagggccuggaacuuagucaauauaguaaauacccagugguagaaaugauggaaaaacagccaucccuccuagaucaguccaggugucuuugucuacccccgcccuccuccuuccuggguaacuccugcugauccuuuggcucucucugguggcugggccacucucccagcuccuggcuccccgaaacccgugucguagugaucacagcuuucccuacccugccacucccaugcacaguucugcacagugucuggcgcauauggaguagaugcucaccagaggcugguugacugucggagaugauggguggauuugguguuuaaguuggagucugggcacuggcuggucucugccugacccagccaccccacuguggcucaucucuugccacuuccccucucuggcucuggaucucgccaugccgagcccgcaagccuucuccagaugccauguacucucuccuccagguaaacaugugcuguuccuccugccuggaaugcucuuuuuccagcuccuacucuuaggagucaacucagacaacuccuccuccagaaagccuucccugaccccacuagucugggucuagugcuucuccuggcucccccgcagcagagcucugagcucucagaccgucgcuacugacuuggcaccuccucaguagaccagguucuggagggaggugcucugucagaaccucuuuugucugccaggcgcgguggcucaugccuguaaucccaauacuuugggaggccgaggcgggcagaucccuggagguuaggaguuugagagcagccuggcuaacauggggaaacgcugucucuacuaaaaauacaaaaaauuagccaggcuugguggugcgcaccugaaaucccaucuacucgagaggcugaggcaggagaaucacuugaaugcgggaggcggagguugcagugaaccgagauugcaccacuauacaaaaaaaaccucuuuugucaccccagagcccagccaagggccugcuaccaagcaggcucucaggaagugcuggcgguguggcagguaacugcgacagucacacaugugccugcugacggcagcucucgcuuccuuguagggaggcagcguccauggagcaaaaggaaugccaggauccugcacaggcagacgcgggccagccucagcaccgacagccgacgcgcagauagcagagccauccuugggguaaggacugggccccucuccuucucagccagcuccagcuccagucaagugcccuucccagccuggggagcaaaggguagcaucuccauccccacaguccuuugcuuuucuugcuguagguccaggguagaguggcagacagcagaauuacucucuuccuccuucucccgcugaguaaugugugcuugccgcacucauugaaugcugaguuguuucauugcaaaccucuguuuuuucuccuucaccccagaucuuaucagucugggucuugcuaaugcagccucaugaccacauuucccaaaaagcguggaccacguuucccaaguguguuccaugagacaccaguuucuucggucacagugguuugauaauuccaggaaacaaagacuucuuguuauccuugcugcaggacuuaucagagucuugaaucagagccgucaucaggauugagcugaucacgauaagggagcuagcgacucguguuuccccacacuuauuugaucguguagacaucuuuggggacugggauuccuuggccugugcuuuggaaaacaguucccagaggcaggagagucccuuuagaacauuuggaggauuaaauauguugacauagagcaggcaguuggcagagugcauguccuagaagguggucccgagucauagcugguguguguauagacggcuguguaauuugccagacauacucaggucggugaucucauuugaccauuugaggaugcuuaggcaguggccauuaucuccaguuuacagauguggaaacugagaaucagagugaggaagcagcuugcccagacucaucuguaaagaaggcaaggacaugcggcuugaauccagacccuggaauccugggccagggucuucuguugucugcccugaggccuuccugccuuuaucucucaccucaguuuuuugugugaaggaaggccugagucucccagccuggauuuuaaaagaaauaguaauuuuuuuuuuuuguaauuaccaacauaguuguauauucauuauaugguuuuauacuguuuggcuauuuuugggggacagggucucacucuguugcccaggcuggagugcaguggcaccaucaugacucacugcagccucgaucuccaaggcuccagcgauccuccugccucagccucccaacuagcugggacugcaggugugcacuacugugcccagcuaauuuuauuuauuuauuuauuauggagauagagccucucuacauugcccaggcuggucucgaacuccuggguucaagagaugcuccugccuuggccuccuaaagugcugggauuaugggugugagccaccaugccagaccuguuuggaucuuuaaugucaucuaggaaaugagucucugcugauucucaucuucagaggugugaaugggaagggguauauucuuccacaucuauuguuaccauuugcuuauuuuuauaaaaaucuggucauguuugaguugcugauucacaguuugcuuuuguuucauauaaugauaucccccggaccucuuuuuuuuuugagauggagucuuugucacccaggcuggagugcaguggcacaaucucagcucacugcaagcucugccucccggguucacuccauucuccugccucagccucccgaguagcugggacuacaggcgcccgccaccacgcccggcuaauuuuuuuuguauuuuuaguagagacgggguuucaccauguuagccaggauggucuugaucuccugaccuugugauccgccgccuuggccucccaaagugcugggauuauaggcaugagccaccgcgcccggcuccccuggaccucuuucccaugcaagagguagauagagcugugugugguccuggcagaaugcacacccuugagccccccuggccccucccccucacaugcugggaguuuugagcuguuugggcauuuacagcagcagagggaggucggaagugccuggugugugauugugucgacucuccuguuuaugggauaaggucagccaacuccuggcucugccccauaggaguuuccuguugguuuugaggaacucuguccccuggagagaggggaggccugagcuguagucuuucaugcugggcagcgcugagcaggaagcagcagguccugcuugucagaucauaauuccuccuuuuugccaaggauggcguggaaugaaccgcaugggccggccugagggguuuuggccuccacccaccaccuggguucaggggacacacaugaaucaagcugagacaaauugagucugagccauuguucuccugagcccagcccuuccuggggauaggaaggaacaggcagacccugacucaguuuacccuugcuguaucuggaggaaguguugguugugguccuuuuggcaugcuccuuucaaguuuuaguucugagagugggcaggugaggagcaggaggagggcccacccugccaccuggguccaaagaugcucucuuuugggguauagcugaccucaggaaggguuugggcaaggagagcauacaggcguggcagccucguuuugcggggcugcgagagcgucuggcaggaucgcgcugggagugaggucugugccagagcuccugacaucucaccuguguuuuucaggcucacuguccugucgcuuucccucccccacgucacuuccuccauucuuccccaggagucucuuuucucucccauacacugcuugggagagagcugcagagcuggccccuccacagauggugcucagcgucucuggcuucuccuuccugcaguagcaccuucauaguccguggucauucucagcaccaugucucagugcugagccacaggcugggaugcugcacgcauuugcccaucuuaccuucgccacagccuugcgugugagguugcuuuaccauuuuacagaccaagccccagagggaugaggucucuggcccaaaguuauacaguguacauguggcaaagcuaggacuugaacccagguugguauggcuuggcagcuggggcucuuucuacuucacccuccauuacccucuuuucucagguucccaggcuuuugggggccuucaaagucaccuggaagcuugucuaaaaugcuguuccccugggcccaccaccacagaccugcagagucugcccuggaagguuggccccaggaaucugaacuuugaagaugcuuccccagcaguugugaggcuggugggcuacaaacaaugcugagaaacacugaccggacgccauucuuucagccuuagucccagucgucuaccgcagaacucaugcccuugguguggaagcagggcugagcuccccacaggacugggacuggacagguuuuuuuuuuuuuguuuaauuaauuaauuaauuauuuugagauggaguguugcucugucacccaggcuggagugcaguggcacaaucuugcucacugcaaccuccaccucccagguucaagcuauucuccugccucagccucccgaguagcugggacuacaggugcccgccaccaugcccagcuaauuuuuguauuuuuaguagagacggggugucaccauauuggccauggcuggucucgaucuccugaccuugugauccacccaccuuguucuccaaaguuccaggacuacagccgugagccacugcgccuggccaauuuuuuuaauuuaauuuuacuuuuuugagauggaauccugcucuguugcccagacuggagugcaauggugccaucuuggcucauugcagccucugccuccuggguucaagugauucuccugucucagccucccaaguagcugggauuacagaugugcaccaccacgccuggcuaauuuuuguauuuuuaguagagacgggguuucaccuuguuggucaggcuggucucgaacuccugaccucaggugauccacccaccucggccucccaaagugcugggauuacaggugugagccaccgcaccuggccagacaguuguuuuuuaguggcuucauuuugugugugugugugugugugugugugugugugugugugugcugggaaggcgaggggcuuaaccuucccuccucaaggacguguggggcugagguuucuagaagggcuuuuacucccagccacaaauguucccugcugucuuccagaugcguuucuguugcgucuugcgucuugcagcaaguuugucuacaucuaaacgucucuugagggcuuaaaaccucaaaauuaaauugcuugcugcaaucuaagccucacgccuagagcaauguuccaguggaguaaaaguggcuguaaaauuccauagcuuucacgugccaccuggacgccgucagagugccacugccaaaccugcgcccucugacgggcagcaugacaaacgcacugaccagcagcgggggcggugggcgggaauccuggcccugaagggacaccucgcaucucccagcugacuccaugagucaggaucccuggggguagcccccuuccaucccagagagucggguaccaggcagcucacccucugucagaccccccaguccucccccuggcucaccuagggcuuggccagugcccacuccccugggaucucagcagaagaugugucugcugccucucuaggguacugguggccacauuucauaaccugucuaagaaggcagcgcugguauucauaacagguuaagaccuguaaaccguguguggccgugacuccaugugcaaauaugagccaacaaacguuggcuggacguggcgguucccaccaguaaucccagcacuuugggaggcugagguggaggauugcuugagcccaggaguuccagaccagccugggcaacauagugaccugucucuacaaaaauaaaaaaaaaauuaguccaggcacaguggcucagcacuuugggaggcugaggcagguggaucaccugaggucaggaguucaagaccagccuggccaacauggugaaaccccguuucuacuaaaaaauacaaaaaucagccggguauggugacaugcaccuguaaucccagcuacuugggaggcugaggcaggagaaucacuugaacccgggaggcgaagguugcagugagccgagauugugccacugcacuuuagccuggugacagagugagaucccgucuaaaaaaaaaaauuagccaggugugguggcaugugcauguaguuccagcuacuuagagguugagacuggaggacugcuugaacccaggaguuccagaccagccugggcaacauaacaaccuaucucuacaaaaaauuuuuaaaaauagccaggugugguggcacaugccuguaguuucagcuacucggaggcugaggcuggaggaucgcuugagccaaggaguucaaaguugcagugagucaugaucgcaccauugugcuccagccucggcgacagcgcaagauccugucucaaaaaaaauaaaacggccugccuucuaggcccuucugcccccagggcccagacccaacacugccuucuggcccuaaacccagggcuaggcucccuuccagagcuuccuuauagcaguacccgugagaccagaggcaucugaguauggccugaugggguucccuguagagcccugguuuccauguacccccuaaggaaaagaguaucuugucucaagaaguaucuucaagggccugggucccagguggguccgggaggccugcuugucuuugaggcagguuggcacaauggaaagucgggcuuggggugcaucuucccagcucuuccuagcuguguggccuugggcagguuaccaaacuucucugggccuccgacaucacacccauaaaaggacugauuuaaacucuaccauaauaauaacagcagugaacguuccagagccuuacuguauggcaggcacuaguccaaaagcuuuauauggacugucuccuucuguccucaucacagcccuccaagcaauagacuugucaacccauuuuacagaugaggaaaccagagcccagcgaggugaagggacuuucucacggucucguggugaggugggugccaccuugcugcuaugcaugaagguugggagauggggcaaggacauacugggcacuuaguugacggucaguaacugggcgcuccugccccagccuggcagggcgagggcagguccugaggcugcaccuccagccccaccugcugccucucucugcuuggcuccggagcugcugggggaagcccaggugggugucccucaccuguugccuuucacccuagaaggcgggccacgcccuugcaaguuggugugaggaugaaccuguuugggagcccagcccaggugagagcaguuuggaacugacccgugcuccccucccccuccagcccuggcgucuccccucuuccucuccccaggaagugaggguguacccuucuacacagggcgagucccaagccaggcaacacccccagccagcagccucugacucaccccagcugggugugggggccuccagggcaguguccgcccuggggaggguggaggcugugugugccagacgaggcugagaccucuccucccacucuggcucugggacaggggaagcacaugacccauggcccguggugggagcagauccacaggcuuggaacccucccgggacagggccuguugagagcggccccuucgcgcucccugggagagcacuggagggccagccuucccaucucugguacaggaggggugccaaccucccgccuccccuccugcuugggaaguuuuccuggcucagccuuguuugugcuuucacaaaaggcucucugugcccuguuuacccgcagcccgacugccugccgcccaggugugggagccacgccaaaucccugugggcccacauggggucuggugcgugcugggggggucucucucugggacagagugggcagcuugucauuucuugacucccugucuucgagaagcauccaggggauguggacuggggcugaaccuaaugacuggcucugagagcagauggccaacucugccacacgggguccugagccugggagggucucugaguggucugcgaguuuucgagguucugcgaguccugggggguccugugggucucugaguggucuggcccugcucagagacauggugcuugaggcuccgcccucacccaggucaguccccacugaauucugggagggucaucugcgauggcaggugggaccguggaacgacagccugagugugcccggugcuguauugacacaugaugccuuacuuuuaauucucacgauaacccauuucacagcuauaacccauuuuaggauguaauauuuccaucuugcaguugaggacacagaggcucugaggccccagugaggcaguagugggguuggcguuugaguugcccaacucuggggucugaacuccucccugcucugcucccaggaggugaggaccgcaagcugcugagcgugaguguuacgaggcagggcagggaggaugaggcugaccuguuucuaauguacggauggcagcuacgcauaaauucuuuuaucauccugagaaaccacacagugaggaaggucuuuugauuuauuuccaagcaguuuuucuacucauaaacauaccagauuuaaauaauggaagaauguauaauauagacagcccucuacagucucaccacgaguagacuuaacuauauauaguucugugcauagcuuucuaaauucuuuucuguacacaguaaugaguuuguuauugauauaauuuuauuuuuugagacagagucucacucugucacccaggcaggaguacagcagcacagauucggcccacugcaaccugcgccucccggguucaagugauucuccugccucagccugcugaguagcugggacuacaguugugugcuaccacgcccagcuaauuuuuuuguauuuuuaguagagacgggguuucgccauguuggccaggcuggucucaaacuccugaccucaaguaauccacccaccucggccucccaaagugcuaggauuacaggcgugagccaccgugcccagccaucauucuuguuuuaaaaaauugccaggcaugguggcucacaccuguaaucccagcacuuugggaggcugaggcaggcagaucacaaggucaguagaucgagaucauccugguuaacacgaugaaaccccgucuguacuaaaaauacaaaaaaauuugccgggcauuguggugggugccuauagucccagcuacuugggaggcugaggcaggagaauggcgugaaccugggaggcagagcuugcagugagcagagaucaugccacugcacuccagccugggcaacagagugagacuccaucucaaaaaaaaaaaaauuauaccaguaacagaccagguacaguggcugacaccuguaaucccagcacuuugggacaccaaggcaggugaaucacuugaggucaggaguuugagaccacccuggccaacauggcaaaaccccaucucuaguaaaaauacaaaaauuagccaggagugguggcacacaccuguagucccagcuacuugggaggcugaggcaggagaaucgcuugaacccaggagguagaguuugcagugagccaagaccacaccacuguacuccagccuuggcaacagagugagacucuaccucaaaaaaaaaaaaaaaaagauaucauauuuccuaauuuuuuucauugugguaaaauacacaugacauaaaauuuaccaccuuaaccauuuguaaguguacacuucaaugguauuaaguacauucauauuguguauccaucacuaccacccaucuccagaacuguuuucaucuugcaaaacugaaacucucugcacccauuaaacgcucacuccccauuuccugcucccccaggcccugguaucccuucuguuuucugucuauucacuuaugugaauaagugaaaucaaaguauuugccuuuuaugacuggcuucuuucgcagauaacacauuuuauauacugcucagcaaaauucuuuuaugcuuaauaucucuuagaugucucuggggucacugcauacacaucuacaaggaagguggcguuauuccugauuuaaaguuguagaagcucgggaggcugagguaggagaaucacuugaacccgggagguggagguugcagugagccaagaccgugccacugcacuccagccugggccacggagcaaagcaagacugucuccaagauaaaauaaaauaaguuguaaaagcagaggcuuaggcuaaacaauuugccuggggucacagaauuauuucuugcuggagcuggauuugaaccuacaugucccaaacuccaaguccuugcucucucugcucccugagauccaccugugccugagggaaggcuggggcucucuggguuacucauuuaacccccaggcacagagaugcccuggcccuggccaggaaccuggucccauuuguccuaggcaccugcuugagcugccuugugggaagggccuguucugcaugaugcccacuucuacaucucccugggggcagggcaggaccagguagggagugcuuacgaguucugcaggguccucaggggcugaggagcagcagcugguaggaggagcugccucugcugcuccgguaaccugguaagaugcaguagcugcugcuccccgcugagccuucgccugugggagguuggggagagcacuggcuaugcaggguaggaaugcaugaguguuucagugaguuuugugugaugaaaugguuuaagaaaaguauaaaaacuagaacagauacauccauaucaagaacucagcuuugucagacuucaguguuuugcaguaauuguuucagauacacacaugcacgcacgcacacacuugaaugugcgcaggcacuuaaguaaaauauuccaagcacaguugaagucccuuccccauuuucuucccucccuagauacaaucauuaucuugguuuggagacuuuccaugcaugcuuuuguaucuucgguauacuuggguauacaccuuguagaaaaccuuauauaacauaugcaucaucuacaacuuguuuuuuggaucaacauugcuuuugagguuuauccacauugauacauguugcuacaguucauuaacuuuaauugauuuaaagcauuuccauuguaugauuagaacaacguauccuuucuccuguugaugaacaugugggucauuucugauuuuuugcuauuacaaacaauucuucagugagcauccuugugugugguuucucacuuauguguggagcagcuuucuaagaugcauaaauaaugaggagaggaguugcuggguuguagaguacgugcauccuaccuucucuaagaguucacaguuuuugccaauugggggagugaagugauaugugaucguuuuaauuuacauuccuugauuacuagcaaggcuaagaauuauuucauacauugguuccauuugcauuuuuccccugugaauugccuaugcguauauuuugccauuuccccucauuggauuguuuuugucuuauuuaugcaggauuucuguauuuauucuggauacuaaucuuuucuuuuuucuuucuuucuuuauuuuuuucuuugagccagagucuugcucugucacccaugcuggagugcagugguacgaugucugcucaccgcaaccuccgcccccugaguucaagggauucuccugccucagccuccugaguagcugggacuacaggcaugugccaccaggcccagcuaauuuuuuuguauuuuuaguagagaugggguuucagcauguuggccaggcuggucucaaacuccugaccucaaaugauccaccugccucagccucccuaaguucugggauuacaggcgugagcaguugugcccggcuguauucuggauauuaaucuuuugguaguuuuaaacuuuggaaauaacucuuccuagucuguggcuucuuuucacuuguuuauuauuaugucuuucgauguaugcuuuaacuuuaaugugaucaauacguuacguuuccuauaaggauuuauacauuuugugguaagauauuccuaucuuaaugacauuaagacagucucugauuuuucuuuucuuuuugagauggaguuucacucuuguugcucagacuggagaucuuggcucacuguagccuccaccucccuggcucaagcaauucuccugccucagccucccgaguagcugggauuacaggugccuccaccacaccuggcuaauuuuuuauauuuuuaguagagacaggauuccgccauguuggccaggcuggucucaaacuccugaggugaucagcccaccucagccuccucaagugcugggauuacagacgugagccacagcacacggccugucuuagcuauucuugauccuuugagaucgugauuuaaaaaaaaauuuuuuuuuugagacaguuuuauucuuguugcccaggcuggggugcaauggcgcaaucucggcucacugcagucuccgccuccuggguucaagugauuguccugccucagccuuccaaguagcugggauuacaggugcccugcagcacgccuggcuaauucuuuguauuuaguagaaaugggguuucaccauguuagucaggcuggucucaaacuccugaccucaggugauccucccaccucggccuuccaaagugcugggauuacaggcguacaccuccgugccuggcaaaauaaucuuuuuucuuaauuaugaguaacaaaugguuauaauaaaaaaauagagggcaggggcaguggcucgcgacauugcacuccagcuuggaugacagagugagacucugucucaaaaaaaaaaaaaaaaagauaaguuuggggugaaaaaggguaauaaacagcagucuaaccucacuucuaagauuguucaguguguguguguguguguguguguguguguguguguguguguguguguaauuuauggcagagggguuauguacuuuuuagauuuaacauacuuugaacauuuccucuuguuaucaaguguuuuguucuaaugcacuuuugggauugcauaguauucccuuaucugaucauugaguauguuuuuuguuuguuuguuuugugagacggagucuugcucugucgcccaggcuggagggcaguggugcgaucuuagcucacugcaaccuccaccaccuggguucaagcaauucuccugccucagccucccaaguaguugauccaguagcuucuuuaaccagggugugcuuauuguccaccuacugcgugccaggccccgccugucucuuuaccagguguccuggagcccucugaugguuuuccuucuuccauuucccaacuuaacucucgaaugcacuuuucauucacucaccaggugucuccugaagucaggguugcucuggcagggcugggccaggccuauuuugcucuccacuuccuguucacauccacccgcaggcucuggcuggccuuggcacacuggauguguugaauguuucaggcccuggccuuuuagcagcccucuaaggcagggccuaucuuuagccccauucaaagaugggguaacuaaggcucagagaggugaagucaccugcccaacaucacaaguagcagagccagucuggcccuggcccggcccuugccuccaagcucauguaggcuugcucuccacugaccugggcucucacacagguaguuugggaagccucauuucugugaucuucaugauaguccugagagcccacagggcauuugucaccuuccgccauguuaccauggggaaccaaggugcugagaggggaaggcguccuggcuccuggauagccccucccucucugccagcuggaggccagaacagucgggacaaggggugucugugaugguggcggcagcucugcagucacagcccagcagucugacgcgggggugggcagcugagggggaaggaggaguccaggcugggcagaggccugggcgcacccaccccuuggcccauuuuuuacacaacauggacacauguuuaacagguuugcugcuccuuucuauacagggaaacugaggcccugggagagaagcuguuccacagcuccgccaggacgcagugccagcugagagggccgagcacagggaggauaagcaagggcacuuuccguaaggcagagauagcccagccacccccaccccacgccucaaaggcucccuucccuuccggggcauuucugaccacacccaggugcaccccaagaagggcucucgguggggucugcuccaucugaauggcccacccuggaggugcugccugucugggcccacuguaaauccagguuugaacgccaccucugucacuuauaggcgguaugaaguugggcagaagacuucugucucugagccgguuuccgugguuauaaaauggacaccuuaaaaaaaaaagccuuaacaaaaggacauucucauauguguuagaacguggugagccuugaggacauuacguuaagugauacagcccaucacaaaaggacaaauaccuuaugauuccacuuacaugaggucccuagagaagucagauugacagagagaggaagugggauggagugcuuggaggcggugggaggaaggggugucguguuuaagggguguggguuucaguuuaacgagaugaagagaguucuguguaugguggugaugguugcacaacagugaaugugcuucaugccacugaacuacaccccugaacauggguaagaugguacauuuucaguuacauguguuuuaugacagucuaaaaaaauugaggggaaaaaauggaccuggaaacaauggggaccuccuggcucagugcaggggagaaucuggccuuggccuugguugucuguuucugaacuggaacugcucucuuguggguaucuagucaucugcaguccugaguuccugggcagguccuugcacugggccccucccuguggggauuccucagggcugggcagggaaaggaagggcccaggcuuccuggcuuuagcugccuucccuaccccagccccaacccacauccaccugaaacugcugcuggccucuccaccacaccgggggcccacgcccugcagcaccccaccccaccuuguccccuuucaggugcucucugggagagacucugaguguaucgaguccuaacaauugacucuuguccucaaagagaaucuggcuucacuaggugcugaggagguggaagaaagauuauaccagccugggcugacugcgccccacucugcacaaagcacuuuaaaagcauuugggggcuggacgcaguggcucaugccuguaaucccagcacuuugggaagcugaggugggcagaucgcuugaggucaggaguuuaagaccagccuaaccaacauggugaaacccugucucuacuaaaauacaaauauuagccgggcaugguggugggcgccuauaauccuagcuacucaggagacugagggaggagaaucguuugaacccaggagguacagguugcagugagcugagaucaugccacugcuccagccugagugacagauugagacuccgucucaaaauaaaaauaaaaauaaaagcauuuaguuccuaagacuugcugggugcaguagcucaugcccguagucccagcuacuuaggaggcugaggugggaggaucacucaaguucaggcguuugaggccaaaugggcaacauagcaagaccccaucucucaaauuuuuauuuuaaauuaguccagugugaggcccagcgcaguggcucacaccuguaauccccgcacugugggaagcugaggugggcagaucaugaggucaggagcucgagaccagccugaccaacaugguaaaacccugucucuacuaaaaauauaaaaauuauccgggcaugguggugcacgccuguaaucccagcuacuccagaggcagaggcaggagaguugauugaacucgggagguggugguugcauugagccgagaucgugccacugcacuccggccugggcgauagagcaagacuccaucucaaaaaaaacagaccgggcacaguggcucaugccuguaaucccagcacuuugggaggccaaggcggguggaucaugaggucaggagauggaaaccauccuggccaacauagugaaaccccgucuugacuaaaauaugaaaaauuagccggccguggugguggcgcgccuguagugccagcugcuugggaggcugagucaggggaauuauucgaaccugggaggcggagauugcagugagcccagaucgugccacugcaccccagccuggcaauagugugagacugccucaaaaaaaaaauuuuuuuuuacccuaguguggugcuacaugccuacaguccagcuacucuggaggccaaagcaggaggauugcuugaggccaggaguuugagaccagccuggacaacauagcaagaccccgucccauuuaauuaaaauaauuccauggccuccucccagcagcccugcgugguaucaugcccaccauguaugugaagaaacugaggcugcaagcagugaagagcuuguccaaggucccacagagaggcuaccagaguccaggcccacaccuugguacuggcuuccccucuucauccucggcaagagccgugugggagggagccugccccuguagggggcaggcagguggcucugaccacccggcuggcuccuguugggguggggcuccuuuccccacacccuugggaacucaacccuggauuuggugccugcacccucuuuccugaucucccccgaagccccaucagagaggggcagugacuuuuccagaaucacacagcagaggacaaggaaacgggugcagcugggggugaccccuccagacagguuacccuuaccagggguaggcccaggcaccagccgggccaggccugugagagacuccaguccaggcccuucucagcucugcagccagccccaggcucugccauuggaaccccagggcccuccuccacuccccagacacacucaaacuggagagaggaaccugaagcagaagucccaccuugaucauuuuuuuuuacccccgcuggaccuagccaagggcugaacagaguccggauguucccagaccaagcacggaguuggggcggguggucagaaucagaccugauugggacgguguuuccugccuugggcaggugguuuugccucugugagccucaguuucccucaccugugugacugagcugggaacacuuccugccucagaaggaggagucugggugguacagacaagccccaggucggcggggcuggggcggcuccucgcagaggaagcagguguuucugugagcgaacacaccccacucccugaacacgagggagguguugcaguaucauugucaccacauccugcccgcucaaacagccgcgcccgcccuggcugucucauuccagacuugggggcaggcaggcugcugcaugcaccgggcuccucuccucccucuucuguuccccagucuuuagguccuggcccuggauggggacuccagguguccacaugucucaguggaggcagcugugugauucagaagcucucccagugccacuuucuuucccagcaguguagguggugcguggacccaccuggucauuagagggcccgggccuuccuguggggcgggugcuugcccuggcccgugaguccuggcaucacuaggaggacugacuucuggccuggagcugccagcccagggcgggcgguggugucugcuggccccuuugugaccugagcgcugguaaugcugaggggcggggaagcugcacucccaguccuguuucucuuggcaccgccugggugagaccuugggcaggcggagggcaagucccacaugguggcgaggaccugagcccggugguagagggacaggccugcuggguuuguucuuacucuacucugccccuuaauagcagggggauguuggcaggugaugucaccuuccugagccuuagcacccccaucucugggauggggcuauagaggccuggccucuugggcaucaaggaugacccuaggagggccugcaggggaggccugccuggugccuggcacacuuccaggcccucagcacuggcuguggccaucaucacccuugcugagugccccauuccaccugccucacaugggguccugcucugccuuccuccuguccuccccauccagcauagccuagaaagauuggggcuggggaguguuuggcauuugcagagaggugcuguucuuuuuuuuuuuuuuuuuugagucggcaccucgcucugucacccaggcuggagugcaguggcgugaucucggcucacugcaagcuccacuucccggguucacgccauucuccugccucagccuuccaagcagcugggacuacaggcgccugccacuaugcccggcuaauuuuuuuguauuuuuaguagagacggaguuucaccuuguuagccaggauggucucgaucuccugaccucgugauccgcccgccuuggccucccaaagugcugggauuacaggcgugagccucugugccuggcccgagaagugcuguucuuaaagaguuccuaccuaggccgggcacgguggcucacgccuguaaucccagaacuuugggaggccaaggcagguggauugguugaggccaggaauucaagaccagcccggccaacauggcaaaacaccgucucuacuaaaaauacaaaaauuagcuggaugugguggcgggcgucuguaaucccagccacuugggagauugaaacaugagaaucacuuaaacccaggaggcagagguugcagugagucaggaucaugccacugcaccccagccugggugacagagugagacugucucaaaaagggaaaaaaaaaaaguuuguuacuauucugguuauuaacauuaucaguaaucaaagaaagguggcccaucaucugggcaccccuguuccucuccuaagagagacagacacauuugacacaggcauuuaaaacuugguuuagauaaaaaucuagguucuggguuacaguguaaaguaaaaauugaauguaaaguaaaagcacaauuuggccaggcauggugacucacaccuauaaucccagcacugugggaggccguggcagguggaucaccucaggucaggaguucgagaccagccuggccaacguggcgaaauuccguuucuacuaaaaauacaaaaauuagcugggcgugguagcgugugccuguaauccagcugcuugggaggcagaggcaggagaaucaugugaacccaggaggcggaggcuguggugagcugagauugugccacugcacuccagccugggugacagagcaauacucugucucuaaauaaauaaauaaauaaaagcacaauuuauucuaauacacagaaagggcugggugcagugccucacuccuguaaugccaacacuuugggaggcuaaggccagaggauugcuugaggccaggaguuugaaaccaacuuggccaacauagugagauccugucucuacaaaaaauuuuaaaaauuagccgggcaugggccagguauggugguucacaccuguaaucccaguacuuugggaggccaaggcgggcggaucacaaggucaggagaacgagaccauccuggcuaacacggugaaaccccgucucuacuaaaaauacaaaaaaaaauuagccggguguggugggcgggugccuguagucccagcuacuuggaaggcugaggcaggagaauggcgugaaucugggaggcggagcuugcagugagccaagaucgcaccacugcacuccagccuaggcaacagagcgagacuccgucucaaaaaaaaaaaaaaaaaaaaaaaaaauuagccaggcaugguggcacacaccuguagccccagcuaccugggggaggcuaagguaggaggauugcuugaccaggagguugaggcugcagugagccaugaucacgccaccgcacucuaguuugggcaacagagcaagauccaaucucuuacaagaaaaauuauaaaauuauaaaauacacagaaaggacuggaagguuauuauucagugaaaaguuaacaguguguaacccugguggggauuguaaagcggauucuucuuuuuuugcugcuacgcuuuuuuacaauuuuccguauguucuccagggaacaucuaguaccuuaucccuccgugacagccauacgucuuucauuguaagagcaaccagccuuggccgugugaccacgaauggccacagagaggcauucucacagagaucuugcugcgugccuccuguguagcacagucuggguuuccuaauguggcuucucagccaguguuucccaagcuuggccaaucauuagagucaccaaaguuauguguuaaaaaucagguucccagccaggcacgguggcucacuccuguaaucccagcacuuugggaggcugagacgggcagaucaggagguaaagggaucgagaccauccuggucaacaucgugaaaccuugucucuacuaaaaaacacaaaaauuaccugggcaugguggugcaggccuguagucccagcuacucgggaggcugaggcaggagaaucacuugaacccuggaggcagagguugcagugagccgaaaugaugccacugcacuccagccuggcgacagagcaagacuccgucucaaaaaaaaaagaaaaaucagauuuccagcuucucgccauaguagucaaacuagacucucucugggagagccugcuguugcugcuguuuuuaauuccuuuauacacacgcaaccagagaugauuuuacauuaaggccucucugugaucacccaguuugugagggaggagagccuuauucuuaauccccucucuugaggccgcuccccuaggagccugucauuaagacccacuaugugaccuuuggucuuccgaguguucccagaaucuuguacacacauaacuauacacacauguggaauuuuguuguugaagcagggucucugucacccaggcuggaguacagcgacggggucauagcucacugcagcuucaaccuccuggacucaagcgauccucccacuucauccucccaaaaugcugggauuacaggcuaggauuacaggcgugagccaccaugccagcccccauguggaauuuuuuuuuuuuuuuuuuuuuuugaguuggaguuucacucuugucgcccaggcuggagugcaauggcacaaucucagcucacugcaaccuccaccucccggguucaagugauucuccugucucagccucccgaauagcugggauuacaggcacccgccacuacgccaggcuaauuuuuguauuuuuaguagagaccgaguuucaccauguuggccaggcuggucuugaacuucugacuucaggugauccacccaccucggccucccaaagugcugggauuacagacgugaaccacguggaauuuuuaaaccuugcucuuuguuuuauggaagugaguucauguugugcccccucugcauguugcuuucuuuccucauauuuugcgggaaucccuccagcccuuugcugcagcuuuacagcagcugguucccagugaacugggaguuuuaaaugugucccucuggucaaucuguucauuaaauagguggacuuuagaaaggaguucccgauugcucuuacuggaaugcaagggauggagcagagaacccugaggcugcacuggggaucugucuaaucucacugugcucagucuuccuguguauuaaauggggagccugccugccucccccagggugguuucccagccaaguggccacaugcuuucugcagaagggcugauaagugggcugccccguggaguaggcaggcuuuggcucccagcuagauuugagguggaauuuuggacaauggaagaauuuucauugucuucuuccccugaccccugguccuaggaaagccaggccacccugugcuaaccccccuccuauggcucccuuuuagguugaaccaugauuccggugacagagcuccgcuacuuugcggacacgcagccagcauaccggauccugaagccguggugggauguguucacagacuacaucucuaucgucaugcugaugauugccgucuucggggggacgcugcaggucacccaagacaagaugaucugccugccuuguaagugggucaccaaggacuccugcaaugauucguuccggggcugggcagccccuggcccggagcccaccuaccccaacuccaccauucugccgaccccugacacgggccccacaggcaucaaguaugaccuggaccggcaccaguacaacuacguggacgcugugugcuaugagaaccgacugcacugguuugccaaguacuuccccuaccuggugcuucugcacacgcucaucuuccuggccugcagcaacuucugguucaaauucccgcgcaccagcucgaagcuggagcacuuugugucuauccugcugaagugcuucgacucgcccuggaccacgagggcccugucggagacagugguggaggagagcgaccccaagccggccuucagcaagaugaauggguccauggacaaaaagucaucgaccgucagugaggacguggaggccaccgugcccaugcugcagcggaccaagucacggaucgagcaggguaucguggaccgcucagagacgggcgugcuggacaagaaggagggggagcaagccaaggcgcuguuugagaaggugaagaaguuccggacccauguggaggagggggacauuguguaccgccucuacaugcggcagaccaucaucaaggugaucaaguucauccucaucaucugcuacaccgucuacuacgugcacaacaucaaguucgacguggacugcaccguggacauugagagccugacgggcuaccgcaccuaccgcugugcccacccccuggccacacucuucaagauccuggcguccuucuacaucagccuagucaucuucuacggccucaucugcauguauacacugugguggaugcuacggcgcucccucaagaaguacucguuugagucgauccgugaggagagcagcuacagcgacauccccgacgucaagaacgacuucgccuucaugcugcaccucauugaccaauacgacccgcucuacuccaagcgcuucgccgucuuccugucggaggugagugagaacaagcugcggcagcugaaccucaacaacgaguggacgcuggacaagcuccggcagcggcucaccaagaacgcgcaggacaagcuggagcugcaccuguucaugcucaguggcaucccugacacuguguuugaccugguggagcuggagguccucaagcuggagcugauccccgacgugaccaucccgcccagcauugcccagcucacgggccucaaggagcuguggcucuaccacacagcggccaagauugaagcgcccgcgcuggccuuccugcgugagaaccugcgggcgcugcacaucaaguucaccgacaucaaggagaucccgcuguggaucuauagccugaagacacuggaggagcugcaccugacgggcaaccugagcgcggagaacaaccgcuacaucgucaucgacgggcugcgggagcucaaacgccucaaggugcugcggcucaagagcaaccuaagcaagcugccacagguggucacagaugugggcgugcaccugcagaagcuguccaucaacaaugagggcaccaagcucaucguccucaacagccucaagaagauggcgaaccugacugagcuggagcugauccgcugugaccuggagcgcaucccccacuccaucuucagccuccacaaccugcaggagauugaccucaaggacaacaaccucaagaccaucgaggagaucaucagcuuccagcaccugcaccgccucaccugccuuaagcugugguacaaccacaucgccuacauccccauccagaucggcaaccucaccaaccuggagcgccucuaccugaaccgcaacaagaucgagaagauccccacccagcucuucuacugccgcaagcugcgcuaccuggaccucagccacaacaaccugaccuuccucccugccgacaucggccuccugcagaaccuccagaaccuagccaucacggccaaccgggugaguggcccggccacagcucugcgugugggcuggcggguggccuggccagggcuugugguggggcacucggcaggcucaguguccugggaccgucgaugccccugaguguggaguccucaccugggguuuacagaaccauccaggauagaagcucuguucaagagacagacuccuugggccccaucccaggccugcugaauccgaaucucugggccccgggccugucuuugcuccaaaauguugcaguucuccugccuggagagacugcauggccaggcaaggucugucccccaaggugaccuugagccggguuccucuucagcagggaugugcuugggcaggagguccaaacccggggguucucucgcaaagccggguggugggagucaagacuuagccuggaguuugugucuuccucagcuuguucccagucggacuuggaggcaaggagccaauccggguccacccaggacagaaacuguguggguggccagugcuggcugaggggaagccuuggauggucucugcagcucccacacaccuuucuccacugcauuugguggugucagaggcagaguugggccuagauggggcuaguuuguuucugccugcccuucugaaaaggaaauugugcaaaucauugucacugggaguuugggaggccacaccuucgacauacuuucaagacuguugguggucugugggugccagucucuuaccuggcuggggaagcccccauccaagggccccuugguggaggcaggcaguguggauggagggcuggguacuccuguggcucuguggucuggccuccgaaauggaaacaaagccacugccauuguggggaacgucccucuuccacccguccuggggaccugcagguuuuccugggccucacauccagguggagauuccuguagugagacaugugguggaggaagccugaggccaggcgcugggagacaagggagagcccagccagccacccuucugcccccgacacagcagcagcugucgugccgggccccugugaacuucacuagggaugccaccagguucaggaggcugaagaagagacucggaguugaccaggcccagugggucaaaccuguaauccgagcacuuagggaagccaagguggggcggucacuugagcucaggaguucgagaccagccugggcaacauagggaaaccccaucucuaccaaaaauacagaaaugauccaggcaugguggcaugugccuguagucccagcuauuugggaggcugaggcaggaucgcuucagccuaggaguucaagacugcagugagcuaugguuguaccacuguacuucagccugggcaauagagugagacccagucucaaaguaaaaugaagagcccuggagccggccauugaaacaugggguuuauuugggggaacuuacuuacagggugguccagcagcagugagccaaauaggaaaaccacuccugcuuauaaaaagcgugcagcucauagagcauuuucacuaagcacccuccccucugcagccuccguguggcaacccgcguuucuuaguucgguuguugcuguugggugcaucugccaugcagcagccccacggugcagucccuguugguuucgugggcaccugcucuguguucgcccugugccaggcaugaugcaccuguccuccuuccaccaaccugcugaguccucccaacagggucugucuauagcauccucaggcacggagggagguggccccuggaaugcccggucugucuauaguauccucaggcacggagggagguggccccuggaaugcccugucuguccuccugggccccaggacaggacacaccuucuccagcaucacucagacuagaugcuucaggcccuccagaugccugcuggcuuggaagccuuccuccccucuuccccagggcucccuuacugcagagcaaccugcaacccacauguaucagggauuuugacaaguccuuaucuccggccaccccauauuaugacuugagcacagugggagaguggaccagggcaggguuuucucuuguaguuucgggacaggcccacugaauaggaaaacuggaguccccuggggagaagccacauuugggaagcacagaacaaacccagcccuucuuuaaucuguggagggggagacccuguggcuuccccauagcacagugcugcccuugauaagcugggacuuccucacagcuccugccauuccugcccugucccgggugcugugcuggggcuguccuccugguugggggaggguucaagccuccagccuggcuccccauccugucccccacccccagcuccucccgccaagcuugccuguuagugucaugccugcuggcugaggucaccccucaggaaaggagcuggcggcaagcacgcugucccagaggaaggagacccucuggacacccuguuuagcacauggcuuaaucacauccuguccccacccccuggaacaccagagccuuaauagggaaaacaguucacuugggccaaccccaggcaggccccucauucugagugggaggccugagccccucuuccuccucacucgggcuugauggcuccuucucagccaccuuggccaguggugaccaggaggggugggcguggccugcccacgcccuugcgugcuguuucuccagauuuauacucuugcuaaugaaagccuugacaagacaguauucauucguucacucguuuacugaugugugcaaauuguuauguuuuguuuguuuguuuuuuugguagagacagggucucacuguguuuucuaggcuggucuuuaaacuccuggccucaaagccucccaccuuggccgcccaaagugcugguauuacaggcaugagccacuucgccuggccuuugugcagauguuuuuugagcacuucuagaauccagcuauggagcaaggcgccggggacauggggaugaagaaggccaaguaacgaggcaguuagcacagugcguaggcgcucugcuggagcaccaggucccugggaacacagaggaacaggccccugaagaacgaggaggaggaagccagguggaggggaaagggacaguccaggagguucugguggggaggagcagugagaugggcugcccaggaaugugggcauccuggagagcagagguggggcuauggggggggguguggauggcagggggguccuguccuacaccucaguuucaauugucucuucauuuguuuaacagccgaucccuugccagcccauaggcucugaugacuaagaccuagcucuuuuguucaagcaaguguuuaccgaauuccuagugauugagugggugaaggaaugagcugacuugcagcgugagguuccucuugcgguagugugugggguggggugagugagaggugggagguggaagagagcuguuaagagaccacgauuagccaucaggugaggccacggggccuggcguggccaaggcagguagggauggagagacauggacggaucugggagacgcuggagggggaauucaaagggacgggaguugaugguggggguggucugagugacuugagcuuuuuuuuguggauuguugagacuggaggaagcacagguuuucagaggccaaggugugucucaugucaggugucuggggcucugggauguccaagggaccaucuugaauccaccugaagcccaaggagucacccuuuccaggcucaugggugaagauggguccuugacuugcucacuguggagagcagagagggagaaggacaggagucugcagaagaggagggcgaggccagagcguggggcacauggggccuggggaguuggcuggauuaggaacuggugacuuuggccagagaguuaaggguggacagggucauggaggcagagugaggagagagacagcggcuuuccugcaguuggucaggaaggccagagagccaaggacaacgcuggggcccuggaagccuccugagagaguuguccuuuucaaagaucaggucgaguugaggccuuucagugccgauggggacccacugaagucucuggggagguaggagagggugcaauugggggauugggaaccaacuucaagccuccagggcacgggccggcgacaauccgacaauccagcagagaaggaucgguccagaggauggguguggcuguggugggagccgagcaacugagaguaccuccccuuuucucucuggggccuggagagggcucccuggcucagagcagggcauguucuggggaggaggccuuucagggagggggcuccagagccaggcuccauauggacccgagcucugccacucgcuguccagagcuuucccacugucccugaccacugcaugugucagcagaggagaucacggggugggaguggggucuuucugggaaggcucuggccccugggugcuccagagcccacuuccugucuacccucugaccuucagccccugcugaccucaaagccaaccccaaaugcauuccugauccuuggucacagugguggcaguguaggauacacagguuaggagccuuuuugaaagcacccccugugccugggcugggcaugguggcucacgccuguaaucccaacacuuugggaggccgaggcgggcagaucaccugaggucaggaguucaagaccagccuggccgacauaaugaaaccccgucucugcaaacaauacaaaaauuagccgggcauggugguaugcggcuguaaucccagcuacucgggaggcuaaggcaggagaaucacuugaaccugggagguggagauuacagugagccaagauugcgccacugcacucucugggugacagagugagacuccgucccccgcccccgccccccaaaaaaaaagaaaaagcacucugccgggccuuggccaugcuuaucucccugcugggaaagccacguugcuccccaggaacuccugggcccuucucuaaacgcggcuggagagagcaggugcccgugagguugagguccgagucugcaaaacgguccucagccacagaguguccaagcucaguuucuaguccaaccugugccuuuuacaaauggggaaacugaggcccagagagggagggacuuccagaguuacccuguaacugagugccauauuuggcagaagggaaauacagcaugggcucugagugggaggaaauaagacguacauccucuccugacccuuucggagaggcugcaaccucagacgaguggcgugucaucucucugggccucagucuccuuggcaggaaaaugggggcggugauagagcaagcucagaagggcugcugugccaucuccccaucauccucacuugggaucaaggcccagggcuccuggcuccugcccuccugcccaucccaucugaaggaggcagccucgggacgggcaggcucaacucauggccuuacuuacacgcaguaagaacucauggccccagcugauuccucgcagcagggcagggaagaagcuggcauacgugaggcucuuccugugugccaggagacagcacgaacccacugcagcccccuguuugcuccuugcuccgcuaacaguguggacgguucaccagagcaugggcuguugaaccggguucaaauccuggcuccaucacuuaccagcugaaccucuggacaagucagcgucuuugggccucaguuaccccaucuguaaaauuggaagaguauugacagaauauuuauagguaguuugcugguuaaauaaauuaauaguaucagugcucacagugagccugccacacauuaagcugcauacgggugucgucuguuaacaguaauugcuccauauccucagggaaugugguccaaggucccccguggaugccuggcacugcagguagugcagaacccuauauguucuguucguugcuauucacagguaccuaugauaaaguuuaauuuauaaauuaagcauaguacacuuaggcuuugaggcuauuauuauuuuuuugagauggagucucacucugucacccaggcuggagugcaguggcgcgaugucggcucugcaagcuccgccucccggguucacgccauucuccugccucagccucccgaguagcugggacuacaggcgcccggcaccaugcccggcuaauuuuuuuguauuuuuaguagagacgggguuucaccguguuagccaggauagucucgaucuccugaccucgugauccgcccgccucagccucccaaagugcugggauuacaggcgugagccaccgcacccggccuaggggguggauuuucucagcaugcuguuuugcuuucauaaauuguuguuaagcugggcagaaccaacagccuggcuccuggugagcccugggauggaggugggagcagcuggccaaugcgauauacuucccagggccaggugcuggaagauaguggggaucgaggcaggcaggucucauccuuagagcccacaucaaggggguaacagauggaaggaugagcacugcgaguggggacaugggggccaugagacccaggagaucagggaaggcuuccuggaggaagugagcaagagcugagaccuggugcacaggcagauguuggccagaguuuggcccagauugugcugaugcugggggccuggggaucagaaaagaugcugagaucuuggggagagagggaagggaagcccagaggccccguccaagcccacacccaccucacucucaccccugcuuuuuucccuccagaucgagacgcucccuccggagcucuuccagugccggaagcugcgggcccugcaccugggcaacaacgugcugcagucacugcccuccagggugggcgagcugaccaaccugacgcagaucgagcugcggggcaaccggcuggagugccugccuguggagcugggcgagugcccacugcucaagcgcagcggcuuggugguggaggaggaccuguucaacacacugccacccgaggugaaggagcggcuguggagggcugacaaggagcaggccugagcgaggccggcccagcacagcaagcagcaggaccgcugcccaguccucaggcccggaggggcaggccuagcuucucccagaacucccggacagccaggacagccucguggcugggcaggagccuggggccgcuugugagucaggccagagcgagaggacaguaucuguggggcuggccccuuuucucccucugagacucacgucccccagggcaagugcuuguggaggagagcaagucucaagagcgcaguauuuggauaaucagggucuccucccuggaggccagcucugccccaggggcugagcugccaccagagguccugggacccucacuuuaguucuugguauuuauuuuucuccaucucccaccuccuucauccagauaacuuauacauucccaagaaaguucagcccagauggaagguguucagggaaaggugggcugccuuuuccccuuguccuuauuuagcgaugccgccgggcauuuaacacccaccuggacuucagcagagugguccggggcgaaccagccaugggacggucacccagcagugccgggcugggcucugcggugcgguccacgggagagcaggccuccagcuggaaaggccaggccuggagcuugccucuucaguauuuguggcaguuuuaguuuuuuguuuuuuuuuuuuuaaucaaaaaacaauuuuuuuaaaaaaaaagcuuugaaaauggaugguuuggguauuaaaaagaaaaaaaaaacuuaaaaaaaaaaagacacuaacggccagugaguuggagucucagggcaggguggcaguuucccuugagcaaagcagccagacguugaacuguguuuccuuucccugggcgcagggugcagggugucuuccggaucuggugugaccuugguccaggaguucuauuuguuccuggggagggagguuuuuuuguuuguuuuuuggguuuuuuuggugucuuguuuucuuucuccuccaugugucuuggcaggcacucauuucuguggcugucggccagagggaauguucuggagcugccaaggagggaggagacucggguuggcuaauccccggaugaacggugcuccauucgcaccuccccuccucgugccugcccugccucuccacgcacaguguuaaggagccaagaggagccacuucgcccagacuuuguuuccccaccgccugcggcauggguguguccagugccaccgcuggccuccgcugcuuccaucagcccugucaccaccugguccuucaugaagagcagacacuuagaggcuggucgggaauggggaggucgccccugggagggcaggcguugguuccaagccgguucccgucccuggcgccuggagugcacacagcccagucggcaccugguggcuggaagccacccugcuuuagaucacucggguccccaccuuagaaggguccccgccuuagaucaaucacguggacacuaaggcacguuuuagagucucuugucuuaaugauuauguccauccgucuguccguccauuuguguuuucugcgucgugucauuggauauaauccucagaaauaaugcacacuagccucugacaaccaugaagcaaaaauccguuacaugugggucugaacuuguagacucggucacaguaucaaauaaaaucuauaacagaaaguggccuuuggaggucuuugugucaugggaggacgcuucccucacuucucugaagccugccgggccguguggaacguugcuugggcaccuacaggagaguuaacucugcucaucuccugccccaugagacucugugccuuuggaggcaguuacuggagcuuguaagcuggacgcagcaccugcuagguaacaggcugugaccugggcuggggaucccauagccagcacaaucucugucauccuacucaccugugguugggcacucaugaggggguuuuuuuguuguuguuguuuuuuugacagggucucauucugucaccuagagugcacugcuggaauauaguggcgugaucacggcucacugcagccuugaccucuccaggcucaggugaucucaccucggccucccaaguagcuaggaccacaggggcaugcuggcuaauuuuuuuuuuuuuuuuuuuuuuuugagacagagucuuacucugucacccaggcuggaaugcaguggcucgaucucggcucacugcaaccuccgccucccagguucaagugauucucuugccucagccucacgaguagcugggacuacaggugccugccaccaugcccagcuaauuuuuguauuuuuaguagagacaggguuucaccauguuggccaggcuggucuugaucuccugaccuucugauccaccuaccucagccucccaaaaugcugggauuacagacaugagcuacugcgcccagccgugcuggcuaauuuuuguauuuuuuguagggacgggguuuugccauguugcccagguuggucucgaaucccugagcucaagagauccacccaccucagccuccuaaagugcugggauuauaggcgugagccaccgugcuuggccccucaugaguuuugauggguggggaugggagaggagggcacuggaaugggaaccaguaguccugggccuuugucccagcuucaugggacaggaugugcaugaagcuaggcagaucccuucuccaguggccucuguauccccauguggacaaugggaauuuccacucugugcucucaaaggucccuugcaauuccaacagugagucccaaguggucuacagagguggggcugagagucaucguggggaagccugccucagcucccagccccuuugggggccuuugggagguagugugguaaagggcagaggcugagacagcugcuuccagaugccaguucugccguguuugauguggggcuucaguguucucauuuguaaaaucaggaagguaauggcacacuugcaggacuguucaaggaacaauggcgauuauguagguagaugggguuuuugguggaggaccuggcugcuaguacccaauaaauggccuuguaucuuccacccagaccaaggauccuuguggugggccaacgugggcgcccugcggcaggagacugggugaggaagaaaggccaucauaucugacuuugaccuuagugaugaggccuggguggcugcuugggcaccuccucuacaacuggacagagucuaucccuccucccuccacggggacucugaccccuccaggugaacucaggccugagccaagauucccucccucuucucccccugccaugggcugacaggcugagcagcuggacugugacugccgggcuggggccuucuuuucuguuuccgugguggaggucccucccccaguuugguacccuucccaccaccccccgaccccacucccgcccccacccuggccuugaggcuguccagcgccuggagcaggagaguucgaucuggagcugguuuacauuuggaaaaaaccaccauguagaaacaccgcccacccacuucccaaaguugagcagaaugaacaguuagugggaggcugggccucuccccucccccucccccacccacccagggcucuccacucugccuaaaaccacugugguggucuucucucugauuguaacagcaauuuuggaagcucaaaaaaauuguuuaaauuauauuccacccagcugggcgcgguggcucacgccuguaaucccagcacuuugggaggccgaggcaggcagaucacaaggucaggagauugagaccauccuggcuaacgcggugaaaccccaucucuacuaaaaaauauaaaaaauuagccaggcgugguggcaggcgccuguaggcccagcuacuggggaggcugaggcaggagaauggcgugaacccgggaggcggagcuugcagugagcugagauugcgccacugcacuccagccugggugacagagcgagacuccaucucaaaaaaaauaaauaaaauaaaaaauaaauaaauaaauaauauuccacucagaacagccccugcuaacauuuggugaacaacuuguucaccaguugguaggcacuuacucagcgccaggccuggugccaagcucuuuaucagcugcgaagcauucaucuuauuuacugcucacaggggauccuacugcuagccccaaauuacagacugggaaaguaaggccugaacaucugggacgcaaacacagucugcuucacugagucucuacuacaagccuucugugggggcucccaggggaauggcuggcccaguccgaggggaccucaguguucuuggcacaugguaggcaucugucuuuguugggcaguugcaucagaaggguuaaggacagcugggaacacauccugccucuagugaaccucgugguucugucaucugccugccccucacccagccuaaccccucugaaccaggagccugagcugcacuuacugcuccccccugccccccggacggccuggaccaagcagcagcucccagagcgguggcccagcaaacacgacuugacucgaggccaaggcucuugagggcugagcaguguccccaugcacacuccugaaacacuuugucccuucgccauucagaaggcaucauuuuggggaaggcagcagccgguuuuucagagccagcgaguggcccugccagcugcugagcagggcaagcugagaagggugguggugugcaaguguuauucucucuuuuuguuuuuguuuuuguuuuuugagauggagucuuacucugucguccaggcuggagugagugccguggcaugaucucggcucacugcaaccuccgccuccuggguucaagcgauucuccugccucagccucccgaguaacugggacuacaggcaccugccaccaugcucggcuaguuuuugguauuuuuauuuauuauuuauuuauuuauuuugagaccgagucucgcucugucgcccaggcucuagugcaguggcccaaucucggcucacugcaagcuccgccucccgcguucacgccauucuccugccucagccucgcgagcagcugggacuacaggugcccgccaccacgcccggcuaauuuuuuguauuuuuaguagagacgggguuucaccguguuagccaggauggucucgauuuccugaccucgugauccgcgcgccucugccuccaaagugcugggauuacaggcccgagccgccgcacccggccugcagguguuguucugaccccagcuccacugugccagcccgacuugagaugccaaguaucuugggccugaggguggguaacaggaagcaucucucucuccucagccccuuccuccuacuaagauaccccaugucuccuacuuucgucugagcugcagauggaugcguuaauucccuuccauaauccucccaggaccgagaggguuucagaucggugcugggaggggcccagauaguucuccccaggaccucuuccaccuuuggaaugcccauuaccuggagaaggggggugccgcacaucccccagaccaacccugcaucccauucuauccagauugaggccuagagagaggcaggcguuccucagagucacagggaauggcggcgccuggacugggacucagcccagcugcuuggccugacccucucacagcauaauuucccggcaccugguaagcagugguggggggugguuuccagaagaaacacagaggaagcagauaaaauccuuggagaugggaaagggcaaauccuggauuaguugugggggugggggagauuagccuggaggucacaggcugaucuggcugugucuagggaaggaggguuggguggugggaccggguuuucuccggguagggaaggguuaaguccucccaggcuccuaaacuuucuccuccccaccaggaggccgcgcuuagaagccgcccagugcccugagcgucuccauggccugccugagccccucgcagcuccagaagguaggagccugcaagucggggccgggagggucauggcgggggggucccugccggaccuucaguagucccagugcccaacccacccccugccccauuuuaccgaggacgaaacugaagcccagaggagcggguucccaaccgcaaccccuccugacuucuucacacauagcccugggugucuagaucacaggacccaggguagggugggguggggacguguguguuugaccaaaaacgagaauaaggccucggaacccaccaguucagcccugggcgggagucggcaacgcuguuggggggcgcagcgcccaggagggggcggggccugcgaggggcccaggagggcccauguucguccaaucacaaaaggcuaccucguaggaauuagugugcaacagccuuuuaaaaaaucacucauacauuccuacgcugagacuuaauauuuucguauacagcucuagaagcuuuguuucaaagucuguuacaacagcuaccacgaaucaagugcuggacagguuuuuuugggaggguagggaggagacggggucuugccacaggcacacgcccccaugcccagcucuuuuuuuuuuuuuuuuuuuuuuuuugagacggaguuuugcucuuguugcccaggcuggagugcaauggcacaaucuuggcucaccacaaccucugacucccagguucaaacgacucuccuaccuuagccucccgaauagcugggauuacaggcaugcgccaccacaccuggcuaauuuuguauuuuuaguagagacaggauuucaccauguuggccagacuggucuugaacucuugaccucaagugauccgccugccuuggccucccaaagugcugggauuacaggcgugagccaccgugcccgguccuauuuuuauuuuugcagagauggggucucacuuuguugcccaggcugguccagagcuccugggcuaaagcgauccuccugccuuggccuuccaaagugcugggacaacaaggcaugagccaccgcgcccagccugccagcuucaauaaaggaggcuguacugcuauccccguuugguagcccgagggccagagaaaggagggcacuuacuuggucaaguucucacaauggccagauaaucauguauagccaaucuuugagaggaaauauguuucuacaugauuuuuaucagcuauacuguguuccagauagauaaacuauacuuuguuaaacuaauccccuugcgcugagcauuuagauuacuccccacuugguucugucaugaaacaaggcucagugaauauccccauauguauauguauaucuuugauccccuauugcguaauccuccuaaaacaauuccuagcuguggcucacgucuguaaucccaauccacuuugugaugccaaggugggaggaucgcuugugcacaggaguucaagaccagcuugggcaauauagcaagacuccuucucuaaaaaaaaauaaaacuggccaggcgcgguggcucaccucuguaaucccagcacuuugggaggccaaggcaggcggaucaccugaggucaggaguuggagacuagccuggccaacauggcggaacccugucucuacuaaaaauacaaaaauuuagcugggcgugguggcgcacaccuguaauccuagcuacucagaaggcugaggcuggagaaucacuugaaccccgaaggcagaguuugcagugagcugagaucaugccacugcacuccagccuggucaacagaacaagacugcgucucaaaaauaaaauaaacaggccgggcgcaguggcucaugccuguaauccuagcacuuugggaggccgaagugggcggaucacaaggucaggagaucaagaccauccuggcuaacauggugaaaccccgucucuacuaaaaaacacaaaaaaauuagcugggcaugguggcgggcgccuguaguccaagcuacucgggaggcugaggcaggagaauggugugaacccgggaggcggagcuugcagugagcugagaucgcgccacugcgcuccaaccugggcaacagagugagacucugucucagaauaaaguaaaauaaaauaaaauaaacaauaaaauaaauaaaauuagccaggcgugguggugugcaccugcagucccagcuacucgggagacugaggcaggaggauugauugagcccagaaguucaaggcugcaaugagcuaugaucacaucacuacucuccagccugggugacagagagagacccugucucuuaaaaaaaaaaaaaaagaagaaggaaagaaaagagaaaagggcugggugcgguggcucaugccuguaaucccagcauuuugggaguccgaagugaguggaucaccugaggucaggaguucgagaccagccuggccaacauagugaaaccccaucucuacuaaaaauacaaaaauuagccaggugugguggugcauuccuguaauuccaacuacucgggaggcugaggcaggagaaucacuuaacccugagagguagagguugcgaugagcugagaucaugccauugcacuccagccugggcaacaagagugagacuccgucucaaaaagaaaaaaaaggaaaaaaagaauuccuagcuguauuuguguauuuacuggaucaaggguauguugcacagguugcugugguuggcccaauucccaaggaggcaauuuucagcuugauacugaugugauuaauuccuaacaugcagagcugaggggcccaugguggguggucaugagugguguguggaagccagaacugagcaucccaugguggcggaagggguguccuuaaccggaaacuaggcucuuugugggugugugcaguaagugacuuucuuuucuuuuucuuucuuuuuuuuuuuuuugagaugaagucuugcuuggucuucuaggcuagagcgcaguggcgugaucucagcucacugcaacuucugcuugcugaguucaaaugauucuccugccucagccucccgaguagcugggauuacaggugcccgccaccgcaccuggcuaauuuuuguauuuuuaguagagacaggguuucaccuugcuggccaggcuagucuccgacuccugaccucaagcaauccacccagcuugacuucccaaacuguugggauuauaggugugagccaccaugcccagcaguaggugacuuucagugucccuguuggggcuaaaacuugguaacgcucugcaggcaaaugugcagauauucauucccucccuuucucucucaagagccucagaauaagaggaccagaggcaaaucagaagaagccaucuacuuccccucccuggcugccacugcgcucaggauagaauauagcucccagccuggcccagccccugccacccuccugccuccucuuccaccccuccccucacucugcccuauccauucccaauuccuuauguuccucccaaauucaggggcuucccauauccugcucccucugucuggaaugcccuucccuuauccugcugguccccucuugaaaugucacucccucagcgcugcugcucccagacccuucuccuucccagccagcuuacgcuagcugcuucugccuucagcacucacacucauccucucucucuggcacgaaguuugugacaguaaauuuaccugugugguuaguguaaugccggucucuuucacuagacuguagacaccaugagggcaggcaucauggcuggcuugcuuauagccauacuuuuagcuccuaaaaccgugucucagacacaguagaugcucaaucaauauuggcugaauacaugaauaagguuguguuuccaggugacccaagccuggaggggaagggcagggacaacuuucccuugccgcuccuuuuucuuuucuuuuuuugagacggaguuucgcuuuuguugcccaggcuggaaugcaauggcaugaucucggcucacugcaaccuccaccuccuggguucaagcuauucuccugccuccaagcuauucuccugccucagccucccgaggagcugggauuacacaggcaugcgccaccacaccuggccaaguuuuuguauuuuuaguagagaugggguuucaccauguuggucaggcuggucuggaacucccgaccuuaagugauccucccaaagugcugggauuacaggcgugagccacugugcccagcuuccuuuuucuuuuucuuucuuuuuuuuuuuuuuuuuucgagguggagucucaucuguugcucaggcuggagugcaguggugagaucucggcucacugcaaccuccgccuccuggguucaagugauucuccugccucagccucccaaguagcugggacuacaggcaugcaccaccaugcccagcuaaccaugcccuggcugguuugagaccagccaggauggucucaaacucaugaccucaaguuauugcccgccucagccucucaaagugcugggauuagaggcaugagccacugcacccggccucacuacuuguucuuccauucaagcagccaauauugauugcucuuugcugggugccagacuccaugccugggguuggggacagggcagcaaacaagauaccuggucccaccuucacacagcugcaagguugagggaagggucagacaggagcauuugcagacuggggaagccugagucucaagccugccugcaguuccaacaggauggauuccuggugcuggaaggauucuugucugcggaagaguguguggccaugcaacaaaggauuggcgagauaguggcugaaauggauguuccucuccacugccgcacagaauucuccacccaggaagaggagcagcuucgagcccagguaggugucuggggcacaugaggaugggauguggcuuuugagggagggcuugguccccggccagagcagcaucguggaagggaggaucccaaggcuccagggugucaggccaagccccuuacacaccuuucccucgcuccucacugggaaguuaucaaguaggcuuuauuguccuuuuuuuuuuucuuuuuucuuuuaaaacagaaucucacucuguugcucagucuggaauucaguggcgcgaucucagcucacugcaaccuccgccucccggguucaagugauucuccugccucagccuccugaguagcugcacuuacaggcaugcgccaccaggcccggcuaauuuuuguauuuuuaguagagacaggguuucaucauguuggucaggcuggucuugaacuccugaucuccaggugauccaccagccucagucucccaaagugcugaaauuacaggcuauuauuauccccccauuagacaguuggggaaaauuagguucagaucacuugccccaagccacacaguuaguaguggacagagucaggauuucaacccagaucugucugauaccaagucccugcuguucccagcuuggcuuuacuuucuguuuuccggcuguucucuggucaccgaaggccacuuuguggccagccaccuggaaugagcacaguggucuggaugacccccaccuguguaacuaucccccaugagacuaggaacucagauuuucuccccccagugaccgaauaggucacaugauaggacccaguacaguuugcaauggguaaauugaagacucuggggucucccacaccguucucuugacccuuccuagucagaguuuauuaugagccugcuugcgccugggccaggugagauccuggcacucacgccgaggagcaccugccaucuggugggcauuagcagaaauacaacagccggaagccaucccagggaaugggaagaauggggucuugagaaggaaaaagaaccaguuaaggaaugacaguuucuuccaaaaagcuggucucauuugcugcacagcugccuuccauucggggggauacugggggaagcagagacagcuccugcagccagagacaggcaggccacucaaggguuccuaggaguaagaagggccgaauccugugcccuccaagcugccuucagagacuaauggguuguggggugggaagaaagugagaauaaagcugauauauuggccgggcgcagugacucacgccuguaaucccagcacuuugggaggccgagguggguggaucaucugaggucaggaguuugagacuagccuggccaacauggugaaacccuguuucuacuaaaaauacaaaaauuagcugggccaggugaugcauaccuguaaucccagcuacuugggaggcugagacaggagaaucgcuugaacccaggaaguggagguugcagugggccaagaucaugccacugcacuccagccugggcaacagagcaagaauccugucucaaaaaaaaacaaaaacaaaaacaaaaaacugauauaucuugguuuauaaugcaugcaaagaaaagagcuuggcauggugcccagcacucaguaacauccucaauauucacucuugauacugugagaaaaaaaaagaucagugggcguccuguuucauuuucuuggguuaccuccagcuuuccuuguuugaguuauuuuacaacacuguaaguuggauaaaacugauaauaaugcacaugauacuuguccaaguagggggucaguaccacucuguuccaaucacguuaccaugaacuggguccuggggaaugcaauuauugcccuguggauagaacaguugggcagcugggugugguggcucaugccuguaaucccagcaguuugggaggccaagcagggaggaucgcuugagcccaggaauucgcaaacagccuggucaacaaagugagaccugucucuacaaaaaaauuuuuuuaaauuagcugggcauggugguauaugccuguggucccagcuacaugggaggcugaggcagaaggaucacuuggggccaggagguugaggcugcagugagcuauaaucaugccacugcacuccagucugggugggugauaaagaaagacccugucucaaaaaaacaaaacaaaacaaaaaacaguuugcaucuaucucuaaauucauuucaagggccaggagugguggcuuauaccuguaaucccagcacuuugggaggcugaaacaggcagaucgcuggaggucaaggguucaagacuagccuagggaacauggugaaacccggucucuaccaaaaauacaaaaauuagcugggcaugguggcaggcgccggcggucccagcuacuuggguggcugaggcaggagaaucgccugaacccugaagggagaguuugcagugagcugagauugugccacugcacuccagccugggugacagagcgagauucuaucucaaaaaaaaaaaaauucauuucaguuuccuuaguaucuacauacguguguguguaauucuuggaauucuccuuugaaccaguuguaacaucuuacugguucccucaugaaauaacgaauucaguaaaauauuugacauaugcuuagcaucauuaccuuuaauauuuuuaccauccaggcaugguggcucaagccuauaauccuagcacuuugcaaggccaaggcaguggacaaaucacuugagcucaggaguuugagaccagccugggcaacauggugaaacccugucucuacaaaaaauacaaaaaaaaaaaaaauuagucguggccgggcaugguggcucauacccguaaucccagcacuuugggaggccaaggcaggcagaucauuugagcccaggaguucaacaccagccugagcaacauggcaaaaccccaucucuaccaaaaauccaagaaaauuaguugagaguggugaugcacguguguaauccuggcuacuugggaggcugagacaggaggauagcuugaacccaggagauggagguugcagugagccaagauugcgccacuggacuccagccugggggacagagugaaacccugucucaaaaaaaaaaaaaaaauuaggcaugguggugugaacuuguaguucuagcuacuuaggaggcugagguggaaggaucaccugagcucaggaagucaaggcuacagugagccgugaucccauugcaccauucacuccagccuggccaacaaaaugagacacugucuuuuuaaaaaaaaaaaaacaaacccuggcaugguggcucaugccuguaaucccagcacuuugggaggcugaggugggcagaucaccugaggucaggaguucaagaccagccugaccaacauggagguugaggugagccaagaucgcgcuaaugcacuccagccugggcaagagugaaccuccgucucaaaaaaaaaaagaaaaaaacaaacaaaaaaagcaccucggccgggugcaguggcuuacgccuguaaccccagcacuuugggaggccgaggcggggggaucacaaggucaggagaucgagaccauccuggcuaacacagugaaaccccaucucuacuaaaaauacaaaaaauuagcugggugugguggcgggcaccuguagucccagcuacucgggaggcugaggcagaagaauggcgugaacccgggaggcggagcuugcagugagccgagauugggucacugcacuccagccugggcgacagagcgagacucugucucaaaaaaaaaaaaaaaaaggcaccucaauuucuucuucuauaaaauggagauuauaguagacccuaccucucuggguuuugggaggcugaguaagauaacacauguacaggcaugucucagagauaauucagguuugguuccagaccacugcaauagagccaggauuuuuuuguuuuguuugagauauauuuucgcuccugucaugcaggcuggagugcaguggcgugaucucagcucacugcaaucuccaccuccuggauucaagugauucuccuuccucagccuccagaguagcugggauuacaggcgugugccaccacguccugcuaauuuuuggauuuuuauuagagacgugguuucaccauguuggccaggcugucucgaacuccugaccuuaggugauccacccgccuuggccucccaaagugcuaggauuacaagcaugagccacagcacccauccuagagccaggauuuaaacccaaggauuucagcuccagaaucuguguccuaacugcuauaagauucagccucuggcugaagccuccaagaauugaggaggucaguuuuuuguuuuucuuuuucuuuuuuuuuugagacggagucucgcucugucacccaagcuggagugcaguggcgcgaucucggcucacugcaagcuccgccuccugggcucacgccauucuccugccucagccucuggaguagcugagacuacaggcgcccgccaccacacccggcuaauuuuuuguauuuuguuuaguagagacaggguuucaccguguuagccaagauggucucgaucuccugaccucgugauccguccgccucagccucccaaagugcugggauuacaggcgugagccaccucgcccggccuuucuuucuuucuuucuuucuuuuugagauggaguuuugcucuuguugcccagacuggagugcaauggugcgaucuuggcucauugcaaccuccaccuccuggguucaagcaauucucccaucucagccucccaaguagcugggauuacaggugcaugcuaccacgcccggcuaauuuuugcauuuuuaguagagauggggucucaucauauuggucaggcuggucucaaacuccugaccucgggugaucugcccaccucagccucccagagugcugagauuaaaggcaugagccaccgcacccggccuggggaagucaguucuauuauuauuauuauuauuguuauuauuauuauuauuuuuuuuuuuugagauggagucucgcacugucacccggguuggagugcaauggcacaaucucagcucacugcaaccucugccuccuggguucaagcgauucuccugccucagccuccugaguaguugggauuacaacaggugcccaccaccacacucggcuaauuuuuuguacuuuuguuuuuauuuuuauuuuuucuugagauggaauuucgcucuuguugcccaggguggagugcaauggcacgaucuuggcucaccgcaaccuccgccucccagguucaagcaauucuccuaccucagccucccgaguaacugggauuacaggcaugcgccaccaugcccggcuaauuuuguaauuuuaguagaaaugggguuucuccacguaggucaggcugcucuugaacuccugaccucagguggucugcccuccuuggccucccaaagugcugggauuacaggugugagccacugcacccagcaauuuuuuguauuuuuaguagagacgggguuucacuauguuugccagguuggucuugaacuccugaucucgugauccgccugccucagccucccaaagugcugggauuacaggugugagccacagugccugguuggucaguucuauuauuauuccuuauuuauuuauuuauuuauuuauuuauuuauuuauuuauuuuuugagacagagucuugcucuguugccuaggccagagugcaguggcccaaucuuggcucacugcaagcucugccucccggguucacgccauucuccugucucagccuccggaguagcugggacuacaggugccugccaccaugcccggcuaauuuuuuguauuuuuuuuaguagagacggggauuucaccauguuagccaggauggucucgaucuccugaccucgugauccgcccaccucggccucccaaagugcugggauuacaggcaugagccacugcacccagacuuuuuuuuuuuuuuuuuuuuuugagacagagucucacucugucgcccaggcuggagugcauagugcaaucucggcucacugcaaccuccgccucccauguucaaguuauucuccugccucagccucccggguaccugggacuacaggugccuaccacgcccagcuguuuuuuguauuuuuaguagagacaaaguuucaccauguuggccaggcuggucucgaacuccuggccucaagugaucugccucaauaugcugggauuacaggugugagucguuacucccagccauuauuauuccuuuuuuuacagaugagaaaaugaagucuuggugacauaaaaccaggggcccaaggcugcuagggaaccagcccuauucgacucuagcauccauguucugaaucacaguauagugagguguccaagaaauuccauguuugcaucuuuggggugugcuuccaggcacuugaaguucuggcucacugucugugccucaguggacaagucugagaagcccccagggugucuguaacccugugagggugggaagcuucugaauccgccucccucuuugccaggcccagcucugaccccaggaugcugucucaguccucugauguccccuuuccacagggcagcacagacuauuucuugagcaguggugacaagauucgauucuucuuugagaaaggcguuuuugaugagaaagguuuggagcuggggcccuagagcuggggaggagccauggugaggguaggcuggaccugggaaucugcccccugggcuggaagcaugcugaagccagcugcccauggaaggcuggacaccaguucucugccuuuaucuguucuuugugccacaggaaauuuccuggucccuccggagaaauccaucaacaaaauuggccacggugagcaggggcuuggggguacaggaaagaagaucggggaacaggcugggagugguggcuuacacuuguaauccuaacuaacacuuugagaagucaaggugggcagaucacuugaagucaggaguucaagaccagucuggccaacauggugaaaccccaucucuacuaaaaauagaaaaaauuaggugaguguaguggugcacaccuguagucccagcuacucaggaggcugaggcaggagaauugcuugaaccugggaggcggauguugcagugagcugagaugugccauugcacuccagccugccugggugacagagacagagugaaacccuguuaaaaaaaaaaaaaaaagaaaaggaaaaagcauggggaaacuggggaaacugaagccugaagaguuuaggagcuuuaaugaaagcccauaguggcugggcguggucguucacgucuguaaucccaggacuuugggaggccaagguggguggaucaccugaggucgggaguucaagaccagccugaccaauguggagaaacccugucucuacuaaaaauacaaaauuagcugaauaugguugcgcaugccuguaaucccagcuacuugggaggcugaagcgggagaauagcuugaacccgagaggcugaggcugcagugagccgauaucaugccauugcacuccagccugggcaacaagagugaaacuccgucucaaaaaaaaaaaaaagcaaacaagaaagaaagcccauaguaaauuaguggucggguaaauggcauuuguggcuucaggcuccccucuggucuugggccccucugcuaaucaugacacugcugccacagcacuggggauaggggguccaccugauccccccuaacaggugggcaugugcaggcucucuacugccuggccugggggagcuccuggguccagugcucccuagagccacccuaaggggcaccugaccugcugacagggucccuauucugacaccccaaagucaaguaagaaaacccucacuuuuuuucuuuaggaucauacauuauaauuuguuuuauaggcuauuuauuuuuuuaaauaaaauugagaggaggucucguuauguugccuaggcugaucuucaacuaccgggcucaagugauccuccugccuuggccucucaaaaugcugggauuauaggcauaagccacugcacuuggccuagaaugcuuauuguuaagccugaaguuauaucaugguaagcuuguagacaaguugugguaaaauacacguaagauuuaccauaucauugccgggcgugguggcucacgccuguaaucccagcacuuugggaggcugaggugggcggaucacgaggucaggagaucgagaccauccuggcuaacacagugaaacccugucucuacuaaaaacacaaaaaauuagccggaccuuguugugggcgccuguagucccagcuacugccacugcacuccagccugggcaacagagcgaaacucugucucaaaaaaaaaaaaaaaaagaaaagauuuaccauaucaucauaacccuuuuaaaguacguagcuuggccgggcgcggugguucacgccuguaaucccagcacuuugggaggccgaggcggguggaucacgaggucaggaguucaagaccagccuggccaauauggugaaaaaccauuucuacuaaaaauacaauaauuagcugggcgugguggcacaugccuguagucccagcugcucaggaggcugaggcaggagaaucgcuugaacuagggagguggagguugcagugagccgagauugugccacugcacuccagccugggcgacagagugagacuccaucucaaaacuaaauaaauaaauaaaaauaaaaaguacauagcucagugguauuaaaugcauucaaucuuauguuuaugacaaugagggacuaucccaugccaggcccugggcugucccugcacauucauuagcccaucgagucccacaccaguccugccucccagguucuucuaauccucauuugacagaagaggaaacugaggcuuacaggagagaaaugguuacccgaggccacacagagcaaauggugguaccgagauugcuccgcaugauuggugccuuggagcccuuagucgucugugagggguggggagucggggcuggacugagcuucccagaaggucaagaauaagggcauggguggcauagggccuggggugggggcaaggcuccuguggagcccauuacucaguuguaaacaagcagaaggguuaaugccuacaaaguaagugagaaugucaaaguaagccugagugugggugcccagagcuggguguggagggacacgugggccugagauggggccgacagcuuccuucugucccauagcucugcacgcccacgaccccgucuucaagagcaucacacacuccuucaaggugcaggugagcagaggugggggugagggccaggagggugggccauguguggcaggcuggcagcaugaccuuugccccccuccagaccuuggccagaagucugggccuccagaugcccgugguggugcagagcauguacaucuuuaaggugagcuccuuguccuugccucaguuuaccaucuguaaaaugggcagacugcucauaccaagcccuuccuuacaaugggccaaaaguugcuggaauuauuauguuggugggagaacauggaaaaucggucuccucuggcuaaagcaccuggaacuuaguugauccucaguuaaaauuuggugguaggggccgggcgugguggcucaugccuguaaucccagcacuuugggaggcugaagcgggcagaucaccugaagucaggaguucgagaucagccuggccaacauggagaaaccccaucucuacuaaaaauacaaaaauuagccgggcgugauggcacacaccuguagucccagcuacucgggaggcugaggcaggauaauugcuugaacccaggagguggagguuacagugaguggagaucacgccaauguacucuagccugggggauagagcaaggcuccgucucaaaaaaaagaaaaauuuggccaggcgcaguggcucacgcuuguaaucccagcucucagggaggcagaggugggaggguagcuugaacccaggaguuugagaccugccugggcaauauagcgagaccccauucuccacaaaaaggaagaaaaaaaaaaagaaaaaaaaauuuggugguaggagggagggucauccccaggccucccucggccuuccuccucccuucuuuggcaauugaaaugcugugcucccagcuuucaagggccagcucagugccaccucuucuaagaagccuuccagaaccccugaggaaagaaggacccaucugacucuggggcuggaaggcucaacugcuggccuguguccuagccucucccuccaguccuugcccugcucugcucugugaucuuguuaggcaugugugugcuugcacaugcuaggagcuuguugggcagggguggggguuuucucuuugcaucccuccuggggcuggcauaugguaggugcucaguagcuggguguugauguggaauccugagaggaaaaugccuguggccagagcaauagcauccugggagucucagcaagcccagcuccucucugcucucuucuguccucaccaggcuuuuccucucucuugcagcaaccucacuuuggcggugaaggugagcugagagcugugggccccugaaaaggccaugggugggacaucuaagacagcaaugguucucagaucuucagaaggagggaaagcgcuugcuccugucuguuguaggagccuggcccggagaggaggagccaccuuccauuccuuccccugauaguggauugguagggaaaccuugcguccuuggcauaguggguccugagccugccagcaaccccagcugguuaaaaauauagauuuccuaggacaggcgugguggcucaugccuguaaucccagcaauuuggaaggcagaggcgagcggaucaccugaggucaggaauucgagaccagccuggccaacaugcugaagccccaucucuacuaaaaauacaaaaauuuugguggguguaguaucgcacacccguaguccuagcuacucaggcggcugaggcaggagaaucgcuugaacccaggaggcagagguugcagugagccaagaucacaccacugcacuccagccugggugacagagugagacucugucucaaaaccaaacaaacaaaaaaaccaaaccaaaccaagcaaacaaaaaaaacagauuccugggcccuagucccugagaucuugagccaguagggcugcaugggccugggaaucuguuuuuuggguuuuuuuuugagacagaguuucauucuugucacccaagguggaguacaauggcacaauuucggcucacuacaacuuccgccucuccgguccaagugauucuccugccucagcuucccaaguagcugggauuacaggugccugccaccacgcccagcuaauuuuuuguauuuuuaguagagacgggguuccaccauguuggccaggcuggucucgaacuccugaccucaggugauccacccgccucagccucccaaagugcugggauuacagggaugagccaccgcgcccggcccuggaaucuguauuuuuaacaaguuuccuggaggacgaauucagcauagaaauugcugaucuaguuccacacccuacaccaugcagccacccuuuacagccucccuaguaggugauuaucuacuucugcucaaauaccucuggugacagggagcucauccccucccaggaagcccuuuccuuccuugcaugagcccaagucagccuccuugugaccaccuucuuccaccauucagccuguacgaaguuccccaaagggaugaccauccccacccuuagccugaguccaguuccccaaagggaugaccauccccacucucugccugaguccaguucucccaguuccuuccaccauuccucucccaaauguuucaaagccccuuccauuucaaauguuccuuuggaggucugucuuaaaguucaguauucagaaaacacgcaguugcccgggaaggaaggaggugagacagcaaccuguuuguucuguugcugaggaccauguuccuuuguucggugguuccgcauccuaacugugccccagcaucguguggggagguuuuuaaaaauguggaugcuggccaggagugguggcucacgcuuguaaucccagcacuuugggaggccgaggggguagaucaccuaaggucaggaguuugagaccagccuggcuaacauggugaaaccccaucucuacuaaaaauaugaaaauuagcugggcguggugucaggcaccuguaaucccagcuacuagggaggcugaagcaggagaaucacuugaauccgggaggcggagguugcagugagccaagaucgugccacugcacuccagccugggcgacagagccagacuccgucucaaaaaaaaaaaaaauaauaauaauaauaaagaaauguggaugccugaucauagcaucucccugcuucgcacccaacuucccaauuuuuuuuuuugagagggagucuugcucugucacccagacuggagugagguggcacagucucggcucacugcaaguucugccucccgaguucaagcaauucuucugucucagccucccaaguagcugggauuacaggcgccugccaccacacauggcuaauuuuuguguuuuuaguagagacaggguuucaccauguuggccaggcuggucucaaauuccugaccucaggugauccacccgccuuggccucccaaagugcugagauuauaggugugagccaccgcgccaagccccaaccucccaaacuuaggccacugggugaaccaucugguggcugggggccgcuugucccugguuaagaaggguggcuugaguuaucucacuggaauuaaacaguagugcuacuuuauaucaagcaguuacauuguugggcccuaagcacuuuucauacaucaucucauagaauccuccagcacccugugagguagguuguuguuggagccacuucacgguuuaggaaauugaggcuuugagaggugaaaucgcuugccuuagaguccugggccaggaagugaugagauucuaacugaucaugggaaggcuggcccuggagagcacccagaggacugaggaauagguaaugaggccaaggugagguggaaacaggcaaaaggaugagcuccucaccccccgugggccugcuuagucuccccucaucaggacgccuccuuccuguacacggagccccugggccgggugcugggcguguggaucgcaguggaggaugccacgcuggagaacggcugucucugguucaucccuggcucccacaccagugaggaacccugucucuucugcccacuugggacuccccacccccuagggagagggaccuugagaaaggaggaguuuaaggcucuccaucuuggccugcagguggugugucaagaaggaugguccgggccccuguuggcucagcgccugguaccagcuuccuugggucagagccagcccgggauaacagccucuuugugcccaccccagugcagagagguaggcagaugcagagggcagagaggcagggggcugaguccaucagucugugcuugcucgacuacccagcguccaagagguugcccucggggucaucugagggcagugaagucacagaaagagaaggaggggcuggaugggcgcugggaagucaggaagcagcauguuuuccugcaggcugauccagaucacccuggaauccacacucugcuacuuaugggcuguuucucugggcaaaugacugacucccugagccuuaauuuccccaaacguaaaguggaaagucagugagaugauaaauauguugauauagagucugccuagugcauagccacugcucaacaaauguuggcuguugggcggcccuuuuucuuaugaaaagggaaaaccaaugucuaacucagcaucaccggagaggucccaguggacuggcacaggacagagggcuucugccugauccugcaaagaccucgggaggggaggcccuuccuaaggcuugccaaggccacaguccacagcagaggggacuugaucccagaggaacaugcaucucaauagcuuagcuuuugucccugagggaggcugcagaugccugagcuuucagggaagggaauggggauggaugggggccacaaaaccacuggaaggaggagggcccaugucccuuccugcucuggggaggggggauguggggcugguagguuccugaccugcuugugucucugccaggggcccugguccucauccauggagaagugguacacaagagcaagcagaaccucucugaccgcucgcgccaggccuacacuuuccaccucauggaggccucuggcaccaccuggagcccggagaacugguaggugacagggugggugugugugcccgacaguccccuggaggcugggaacagugacccugcaccucaagguuguuucuccucuauccucugcaggcuccagccaacagcugaacugcccuuuccccaacuguacaccuaaaggcucucgcagggcaggagcccucgccccucccgggugaagcugugggcuguaaacaccagugccuugcucagccuccugguugcaacagggaggucuugucuccccuccugggcuuuccuccugcccugugggcagcagccuaggcugggucaggggcuucccuaagaucuucaccucucugccucccuacugccccaacauagccuugaggaggcuucucagccaccaaaggguucuggccccuucucacucuccucuccucucagauggaacucugguuauuaugguguuaguuaucgaauaaaaacgacuucagaaugcagcuucccuacugagccuucuuucccaagcagcauugcuuuccagagaagaaaacugcuuuccaggccaggugcaguggcucacgccuguaauccuagcacuuugggaggccgaggugggcggaugaccugagguuggcaguucuagaccaguuugaccaacauggagaaacccugucucuacuaaaaauacaaaaaauuagcugggcgugguggugcgugccuguaaucccagcuacucgggaggcugaggcaggagaauagcuugaacccgggagguagagauugcggugagucgagaucacaccauugcacuccagccugggcaacacaagcaaaacuccaucucaaaaaaaaaaaaaaaaauugcuuuccagacaagaugcuaaaaugcaucccagguaccccagcccugcuuggcguggcuugcaugauuuuaauaaguaacauuuagugggcagugaccgugugcccugcucugugcugagaccuucacaggcuuuaucucauggaauccucacucggagagguaagugccauuaucuguacuuacagaagacgacgcugagccaaggaggggguaaaugaccugcccaagucacguggcugcucgguuguucagcagggucagccucaugcagagcccgugcuccuaaccuugacacugccucgucuucucuucuuggggagcagagaugcccagagcuaggaauccagaguuccagguucugguccuggcucugugagcaacuugcucucuggucucaggccagggccuuuccuuccucugggccuguuuccucccauguccaguaagggggccagacuagggccuucaggggcccuuccuguuugggcaugcuuggcaggcacucagaccuucagaacaacugccaaaucuaaaaccuuagcugagguuuggcccagaggcuacaaacuggggaacacaggcugauucuagcccacagacgcauuuugucugggccucagcauuuuuuuuuuuuuuuugagacagagucucacucugucacccaggcuggagugcaguggcaagaucucagcucauugcgaccuccgccucccggguucaagcaauucucucccucaguauccagaguagcugggauuacaggcgccugccaccacacccggcuaauuuuuguauuuuuaguagagacaggguuucaccaucuuugccaggcuggucuugaacuccugaccuagugauccacccgccuuggccucccauagugcugggauuacaggcgugagccaccgcgccuggccaggccucagcauuuaagaaaaaacuugaagauuccacauaauaauccagguuccuaagcuuccucgaaugagcaugcaauugacaacacggggccuacacucuagcaugguggcuacuggcuggagcucccuuagaggcucagugugguccccuguugucguucacugcguuaccugauuggccuuggcagucauuugaguuugugacccugauguagccuaucccccaacuauauacauggacaacccaaggcccagaggauagagcccuuucccaaggccacccugggaguccguggggcaaagcuggugcucuuucaccaacauuuugcugcuuccuuuugcaagcaauaggagggagccuaagagaagggaagcgucuccauugagucccaaagaaaugucucaauacucuccucugagggaaaggacauggcagugauucucaagcagaagcuucgcucccuggagcucugcucccggcuucuggccuugguggaccaaagcucucaccuccucugauguccucccaagcuuggggagaaagggagaaccuuguccagccucaggaaucuugcugugcuaucuuccuagugacggaaaauguuuauccauucacuaucuguguaguguacaauucugggagggacacagugcagauggacucccaaaucuacugauuuccugcuccuugucagugcccugugcuagccuugggggaugggguggggagugaggcagugccggagccugucuucccagccagagagcaaggcugcagcgugggccccucauacagucauuuuaccucucaggaaacucccccagccccuguggaucuuuccuaccuuaggaaaagacaaacacagguuuggauaggauuagaacauggaaaggucuuaagaagggccccuugaugagguccuggugcuguucagcccaucuuucucuauggacaccacucagugggacaccagaggcggggugggguuggcuaaaacaagauccagcccaagcaggaucugauccucccucaacccugccaaaguugacccaccucucccuucaguaauuccuagcccucugcucuuucccucaggaguucuccaccuccaagugaagccaggagagcaaaggucacucugguuuccaagugguuugcccagcuuuucggcuuuucacuaagaugaggacuggucuuugguaaaaaugacucccuuucugacugcuuaucaagggugggcucuaggcuggacccucacaacaccccgcgaggugugggcugucauuacucccaucugcaagagaauugagguucagccuggcuaagugacucacccaaggucacaaaguuguuuuuuuguuuuguuuuguuuuguuuugagacggaguuucgcucuuguugcccagacuggagugcaauggcgcgaucucagcucacuucaaccuccgucucccagguucaagugauucuccugccucagccucucuaguaggugggauuacaggcauaugccaccacgccuggcuaauuuuguauuuuuaguagagacaguguuucuccauguuggucaggcuggucucgaucucccgaccucaggugauccaccugccucggccucccaaagugcugggauuacaggcaugagccaccacgccuggccauucaaggucacaaaguuaguaagaagcugugcagccaaggauucugaccagauuaguuugacccagagacuaaaguguuaaccauuaugcuuuacucccuccaguguccacucuggccuccuccgaggcugcagggcgaaagagggggcucuauagcacacucagguucuuugaguugcuggacuaucccuuaagacucuuuucuuuuuaaauaucagcaaggcugggaugguggcucacgccuguaaucucaacacuuugggaggccaaggugggcagaucaccugaggucgggagaucgagaccagccugaccaacauggagaaacccugucucuacucaaaauacaaaauuagcugggcaugguggcgcaugccuguaaucccagcuacucaggaggcugggacaggagaaucgcuugaaccugggagguggagguugcggugagccgagaucgcgccauugcacuccaaccugggcaacaagagcaaaacugucucaaaaaaaaauaaaaaaaaaaauauaucagcaaaacuagaacuaggagagcuuugcuuuuuauuuuaaaucugaaucaacugaaaaaucaaaucugcuuuucacaccuuggcucuucaugcccaaguagcugucugcuguggggacuguucacccuccccaugucuguuuccuccgucacugcugcugcacuguaacagcuaggccaucagcaauaucaggagguagagaggcagaaggagauugucuaucuguguaguguaugcuuccaggagggacacagugcugauggaccccaaaauccaagcauaacuguaguuuagguccacuccacugucaaagauuaagaucagagcuacagaaaugaucugcgcaaauauagaugucaugguccccucaaaagucuuuuugguuccaggccagcggaucucccccauggugcuaccgaagauggaggccacaguaucacccacacccacagccaggacaccggcauaggggacgagggcccuggcuccucccaggcuacccuucugugugcagggucuggggaucagccagaugggaagagacaugcccaggagcagguagaugugugucagaaugagugguccacugucucguucauccagaaaaagggacaggaagcuccguagagugugacccaaaggcuugaugcggaaguagcgcacauacuccaggaagaugaagaccgccaggcauacaguggcggcuacauagagcaguggccggucaaagaugauaccugggauguagguggcuaccacaaugagguggaaauacuuucgggcgauggugggggccuggugcuucuuggacucggaagaugaccgcuuggcauucugguacagcaccaccaggcaggccaagguggccagcagagaccaauaggcuaggagguagaugcgggugucugucuggaagagaaacugaagaagccagagcaggggauuccugcggaugagccggugcagccaggguaggaccacaccaaggcucagcacacaggucaugagguggaagaagauggaggaggcccaggugccugaguccaugaagacaaacagagugcugaagaaaaugcccaugaguaccaucccuacuaccaccaccagcaggaagaaguccacugggucccccugacuuuccaccagugucagagagcgcuugaugagcugguugaggacaaagcuaaugccacccaauaccagcagugccucaccaggggugaagcagcggggcagcagguacagcaggaucauguugagauaaacgaagaucagaaggacuuccaggacuucgaucaccucccccacgcucaacgagugcuucaugauauaaaugauaacaccuccagccaagcccaagaugacacaaguguugguuggcacugggcgagugaugccgagcgccaacacugaugagaagagggccacugccaugccaguggcugccaccacaaugccaaaacgcucaaagaacggguucccagcagucuggcaccgcuccuucaugacuaguccaagcaaaggcaugaccauggaggcgggcaauaggccacuguuugcggacauucggaacuggaagacggcgcuucccugcuguagcagccggucccacuuguauuggacguagaaggccugcacugcgagggccacggcgcaccacgaguaucggucccauacgguugcguggaugcucagcaccacugcaaacacuacugccgccucugccagcaccgauccacucagcggagccccaggccccggggccggagaugggcacucucgggucauaucucuagaccuggggcuucacggaggccggggcgacuacggacgcccuagacuucgggccccucagccccgucaagcagagggaggcacuuucacccggccagcaaccuucucccuccguucuccagcagcgaggagggaacuccaccgcaggucacuucugcggccugggagcuggcgcccggccaccccccacagccuccaaccuacggcguagacgucgccacucugcagccuuccucacaguuacagccgcccccgcugccggcuccucaccucuuugggccucgccaucuuggcaccgccccgcggcaacgucacgug

SEQ ID NO: 13132 - RNA, 65470 nt, Homo sapiens
cacgugacguugccgcggggcggugccaagauggcgaggcccaaagaggugaggagccggcagcgggggcggcuguaacugugaggaaggcugcagaguggcgacgucuacgccguagguuggaggcugugggggguggccgggcgccagcucccaggccgcagaagugaccugcgguggaguucccuccucgcugcuggagaacggagggagaagguugcuggccgggugaaagugccucccucugcuugacggggcugaggggcccgaagucuagggcguccguagucgccccggccuccgugaagccccaggucuagagauaugacccgagagugcccaucuccggccccggggccuggggcuccgcugaguggaucggugcuggcagaggcggcaguaguguuugcaguggugcugagcauccacgcaaccguaugggaccgauacucguggugcgccguggcccucgcagugcaggccuucuacguccaauacaagugggaccggcugcuacagcagggaagcgccgucuuccaguuccgaauguccgcaaacaguggccuauugcccgccuccauggucaugccuuugcuuggacuagucaugaaggagcggugccagacugcugggaacccguucuuugagcguuuuggcauugugguggcagccacuggcauggcaguggcccucuucucaucaguguuggcgcucggcaucacucgcccagugccaaccaacacuugugucaucuugggcuuggcuggagguguuaucauuuauaucaugaagcacucguugagcgugggggaggugaucgaaguccuggaaguccuucugaucuucguuuaucucaacaugauccugcuguaccugcugccccgcugcuucaccccuggugaggcacugcugguauuggguggcauuagcuuuguccucaaccagcucaucaagcgcucucugacacugguggaaagucagggggacccaguggacuucuuccugcugguggugguaguagggaugguacucaugggcauuuucuucagcacucuguuugucuucauggacucaggcaccugggccuccuccaucuucuuccaccucaugaccugugugcugagccuuggugugguccuacccuggcugcaccggcucauccgcaggaauccccugcucuggcuucuucaguuucucuuccagacagacacccgcaucuaccuccuagccuauuggucucugcuggccaccuuggccugccugguggugcuguaccagaaugccaagcggucaucuuccgaguccaagaagcaccaggcccccaccaucgcccgaaaguauuuccaccucauugugguagccaccuacaucccagguaucaucuuugaccggccacugcucuauguagccgccacuguaugccuggcggucuucaucuuccuggaguaugugcgcuacuuccgcaucaagccuuugggucacacucuacggagcuuccugucccuuuuucuggaugaacgagacaguggaccacucauucugacacacaucuaccugcuccugggcaugucucuucccaucuggcugauccccagacccugcacacagaaggguagccugggaggagccagggcccucguccccuaugccgguguccuggcugugggugugggugauacuguggccuccaucuucgguagcaccaugggggagauccgcuggccuggaaccaaaaagacuuuugaggggaccaugacaucuauauuugcgcagaucauuucuguagcucugaucuuaaucuuugacaguggaguggaccuaaacuacaguuaugcuuggauuuugggguccaucagcacugugucccuccuggaagcauacacuacacagauagacaaucuccuucugccucucuaccuccugauauugcugauggccuagcuguuacagugcagcagcagugacggaggaaacagacauggggagggugaacaguccccacagcagacagcuacuugggcaugaagagccaaggugugaaaagcagauuugauuuuucaguugauucagauuuaaaauaaaaagcaaagcucuccuaguucuaguuuugcugauauauuuuuuuuuuuauuuuuuuuugagacaguuuugcucuuguugcccagguuggagugcaauggcgcgaucucggcucaccgcaaccuccaccucccagguucaagcgauucuccugucccagccuccugaguagcugggauuacaggcaugcgccaccaugcccagcuaauuuuguauuuugaguagagacaggguuucuccauguuggucaggcuggucucgaucucccgaccucaggugaucugcccaccuuggccucccaaaguguugagauuacaggcgugagccaccaucccagccuugcugauauuuaaaaagaaaagagucuuaagggauaguccagcaacucaaagaaccugagugugcuauagagcccccucuuucgcccugcagccucggaggaggccagaguggacacuggagggaguaaagcauaaugguuaacacuuuagucucugggucaaacuaaucuggucagaauccuuggcugcacagcuucuuacuaacuuugugaccuugaauggccaggcgugguggcucaugccuguaaucccagcacuuugggaggccgaggcagguggaucaccugaggucgggagaucgagaccagccugaccaacauggagaaacacugucucuacuaaaaauacaaaauuagccaggcgugguggcauaugccuguaaucccaccuacuagagaggcugaggcaggagaaucacuugaaccugggagacggagguugaagugagcugagaucgcgccauugcacuccagucugggcaacaagagcgaaacuccgucucaaaacaaaacaaaacaaaacaaaaaaacaacuuugugaccuugggugagucacuuagccaggcugaaccucaauucucuugcagaugggaguaaugacagcccacaccucgcgggguguugugaggguccagccuagagcccacccuugauaagcagucagaaagggagucauuuuuaccaaagaccaguccucaucuuagugaaaagccgaaaagcugggcaaaccacuuggaaaccagagugaccuuugcucuccuggcuucacuuggagguggagaacuccugagggaaagagcagagggcuaggaauuacugaagggagaggugggucaacuuuggcaggguugagggaggaucagauccugcuugggcuggaucuuguuuuagccaaccccaccccgccucuggugucccacugagugguguccauagagaaagaugggcugaacagcaccaggaccucaucaaggggcccuucuuaagaccuuuccauguucuaauccuauccaaaccuguguuugucuuuuccuaagguaggaaagauccacaggggcugggggaguuuccugagagguaaaaugacuguaugaggggcccacgcugcagccuugcucucuggcugggaagacaggcuccggcacugccucacuccccaccccaucccccaaggcuagcacagggcacugacaaggagcaggaaaucaguagauuugggaguccaucugcacugugucccucccagaauuguacacuacacagauagugaauggauaaacauuuuccgucacuaggaagauagcacagcaagauuccugaggcuggacaagguucucccuuucuccccaagcuugggaggacaucagaggaggugagagcuuugguccaccaaggccagaagccgggagcagagcuccagggagcgaagcuucugcuugagaaucacugccauguccuuucccucagaggagaguauugagacauuucuuugggacucaauggagacgcuucccuucucuuaggcucccuccuauugcuugcaaaaggaagcagcaaaauguuggugaaagagcaccagcuuugccccacggacucccaggguggccuugggaaagggcucuauccucugggccuuggguuguccauguauauaguugggggauaggcuacaucagggucacaaacucaaaugacugccaaggccaaucagguaacgcagugaacgacaacaggggaccacacugagccucuaagggagcuccagccaguagccaccaugcuagaguguaggccccguguugucaauugcaugcucauucgaggaagcuuaggaaccuggauuauuauguggaaucuucaaguuuuuucuuaaaugcugaggccuggccaggcgcgguggcucacgccuguaaucccagcacuaugggaggccaaggcggguggaucacuaggucaggaguucaagaccagccuggcaaagauggugaaacccugucucuacuaaaaauacaaaaauuagccgggugugguggcaggcgccuguaaucccagcuacucuggauacugagggagagaauugcuugaacccgggaggcggaggucgcaaugagcugagaucuugccacugcacuccagccugggugacagagugagacucugucucaaaaaaaaaaaaaaaaugcugaggcccagacaaaaugcgucugugggcuagaaucagccuguguuccccaguuuguagccucugggccaaaccucagcuaagguuuuagauuuggcaguuguucugaaggucugagugccugccaagcaugcccaaacaggaagggccccugaaggcccuagucuggcccccuuacuggacaugggaggaaacaggcccagaggaaggaaaggcccuggccugagaccagagagcaaguugcucacagagccaggaccagaaccuggaacucuggauuccuagcucugggcaucucugcuccccaagaagagaagacgaggcagugucaagguuaggagcacgggcucugcaugaggcugacccugcugaacaaccgagcagccacgugacuugggcaggucauuuacccccuccuuggcucagcgucgucuucuguaaguacagauaauggcacuuaccucuccgagugaggauuccaugagauaaagccugugaaggucucagcacagagcagggcacacggucacugcccacuaaauguuacuuauuaaaaucaugcaagccacgccaagcagggcugggguaccugggaugcauuuuagcaucuugucuggaaagcaauuuuuuuuuuuuuuuuugagauggaguuuugcuuguguugcccaggcuggagugcaauggugugaucucgacucaccgcaaucucuaccucccggguucaagcuauucuccugccucagccucccgaguagcugggauuacaggcacgcaccaccacgcccagcuaauuuuuuguauuuuuaguagagacaggguuucuccauguuggucaaacuggucuagaacugccaaccucaggucauccgcccaccucggccucccaaagugcuaggauuacaggcgugagccacugcaccuggccuggaaagcaguuuucuucucuggaaagcaaugcugcuugggaaagaaggcucaguagggaagcugcauucugaagucguuuuuauucgauaacuaacaccauaauaaccagaguuccaucugagaggagaggagagugagaaggggccagaacccuuugguggcugagaagccuccucaaggcuauguuggggcaguagggaggcagagaggugaagaucuuagggaagccccugacccagccuaggcugcugcccacagggcaggaggaaagcccaggaggggagacaagaccucccuguugcaaccaggaggcugagcaaggcacugguguuuacagcccacagcuucacccgggaggggcgagggcuccugcccugcgagagccuuuagguguacaguuggggaaagggcaguucagcuguuggcuggagccugcagaggauagaggagaaacaaccuugaggugcagggucacuguucccagccuccaggggacugucgggcacacacacccacccugucaccuaccaguucuccgggcuccagguggugccagaggccuccaugagguggaaaguguaggccuggcgcgagcggucagagagguucugcuugcucuuguguaccacuucuccauggaugaggaccagggccccuggcagagacacaagcaggucaggaaccuaccagccccacauccccccuccccagagcaggaagggacaugggcccuccuccuuccagugguuuuguggcccccauccauccccauucccuucccugaaagcucaggcaucugcagccucccucagggacaaaagcuaagcuauugagaugcauguuccucugggaucaaguccccucugcuguggacuguggccuuggcaagccuuaggaagggccuccccucccgaggucuuugcaggaucaggcagaagcccucuguccugugccaguccacugggaccucuccggugaugcugaguuagacauugguuuucccuuuucauaagaaaaagggccgcccaacagccaacauuuguugagcaguggcuaugcacuaggcagacucuauaucaacauauuuaucaucucacugacuuuccacuuuacguuuggggaaauuaaggcucagggagucagucauuugcccagagaaacagcccauaaguagcagaguguggauuccagggugaucuggaucagccugcaggaaaacaugcugcuuccugacuucccagcgcccauccagccccuccuucucuuucugugacuucacugcccucagaugaccccgagggcaaccucuuggacgcuggguagucgagcaagcacagacugauggacucagcccccugccucucugcccucugcaucugccuaccucucugcacuggggugggcacaaagaggcuguuaucccgggcuggcucugacccaaggaagcugguaccaggcgcugagccaacaggggcccggaccauccuucuugacacaccaccugcaggccaagauggagagccuuaaacuccuccuuucucaaggucccucucccuaggggguggggagucccaagugggcagaagagacaggguuccucacuggugugggagccagggaugaaccagagacagccguucuccagcguggcauccuccacugcgauccacacgcccagcacccggcccaggggcuccguguacaggaaggaggcguccugaugaggggagacuaagcaggcccacggggggugaggagcucauccuuuugccuguuuccaccucaccuuggccucauuaccuauuccucaguccucugggugcucuccagggccagccuucccaugaucaguuagaaucucaucacuuccuggcccaggacucuaaggcaagcgauuucaccucucaaagccucaauuuccuaaaccgugaaguggcuccaacaacaaccuaccucacagggugcuggaggauucuaugagaugauguaugaaaagugcuuagggcccaacaauguaacugcuugauauaaaguagcacuacuguuuaauuccagugagauaacucaagccacccuucuuaaccagggacaagcggcccccagccaccagaugguucacccaguggccuaaguuugggagguuggggcuuggcgcgguggcucacaccuauaaucucagcacuuugggaggccaaggcggguggaucaccugaggucaggaauuugagaccagccuggccaacauggugaaacccugucucuacuaaaaacacaaaaauuagccaugugugguggcaggcgccuguaaucccagcuacuugggaggcugagacagaagaauugcuugaacucgggaggcagaacuugcagugagccgagacugugccaccucacuccagucugggugacagagcaagacucccucucaaaaaaaaaaauugggaaguugggugcgaagcagggagaugcuaugaucaggcauccacauuucuuuauuauuauuauuauuuuuuuuuuuuuugagacggagucuggcucugucgcccaggcuggagugcaguggcacgaucuuggcucacugcaaccuccgccucccggauucaagugauucuccugcuucagccucccuaguagcugggauuacaggugccugacaccacgcccagcuaauuuucauauuuuuaguagagaugggguuucaccauguuagccaggcuggucucaaacuccugaccuuaggugaucuacccccucggccucccaaagugcugggauuacaagcgugagccaccacuccuggccagcauccacauuuuuaaaaaccuccccacacgaugcuggggcacaguuaggaugcggaaccaccgaacaaaggaacaugguccucagcaacagaacaaacagguugcugucucaccuccuuccuucccgggcaacugcguguuuucugaauacugaacuuuaagacagaccuccaaaggaacauuugaaauggaaggggcuuugaaacauuugggagaggaaugguggaaggaacugggagaacuggacucaggcagagaguggggauggucaucccuuuggggaacuggacucaggcuaaggguggggauggucaucccuuuggggaacuucguacaggcugaaugguggaagaagguggucacaaggaggcugacuugggcucaugcaaggaaggaaagggcuuccugggaggggaugagcucccugucaccagagguauuugagcagaaguagauaaucaccuacuagggaggcuguaaaggguggcugcaugguguaggguguggaacuagaucagcaauuucuaugcugaauucguccuccaggaaacuuguuaaaaauacagauuccagggccgggcgcgguggcucaucccuguaaucccagcacuuugggaggcugaggcggguggaucaccugaggucaggaguucgagaccagccuggccaacaugguggaaccccgucucuacuaaaaauacaaaaaauuagcugggcgugguggcaggcaccuguaaucccagcuacuugggaagcugaggcaggagaaucacuuggaccggagaggcggaaguuguagugagccgaaauugugccauuguacuccaccuugggugacaagaaugaaacucugucucaaaaaaaaacccaaaaaacagauucccaggcccaugcagcccuacuggcucaagaucucagggacuagggcccaggaaucuguuuuuuuuguuugcuugguuugguuugguuuuuuuguuuguuugguuuugagacagagucucacucugucacccaggcuggagugcaguggugugaucuuggcucacugcaaccucugccuccuggguucaagcgauucuccugccucagccgccugaguagcuaggacuacgggugugcgauacuacacccaccaaaauuuuuguauuuuuaguagagauggggcuucagcauguuggccaggcuggucucgaauuccugaccucaggugauccgcucgccucugccuuccaaauugcugggauuacaggcaugagccaccacgccuguccuaggaaaucuauauuuuuaaccagcugggguugcuggcaggcucaggacccacuaugccaaggacgcaagguuucccuaccaauccacuaucaggggaaggaauggaagguggcuccuccucuccgggccaggcuccuacaacagacaggagcaagcgcuuucccuccuucugaagaucugagaaccauugcugucuuagaugucccacccauggccuuuucaggggcccacagcucucagcucaccuucaccgccaaagugagguugcugcaagagagaggaaaagccuggugaggacagaagagagcagagaggagcugggcuugcugagacucccaggaugcuauugcucuggccacaggcauuuuccucucaggauuccacaucaacacccagcuacugagcaccuaccauaugccagccccaggagggaugcaaagagaaaacccccaccccugcccaacaagcuccuagcaugugcaagcacacacaugccuaacaagaucacagagcagagcagggcaaggacuggagggagaggcuaggacacaggccagcaguugagccuuccagccccagagucagauggguccuucuuuccucagggguucuggaaggcuucuuagaagagguggcacugagcuggcccuugaaagcugggagcacagcauuucaauugccaaagaagggaggaggaaggccgagggaggccuggggaugacccucccuccuaccaccaaauuuuuuuuucuuuuuuuuuuucuuccuuuuuguggagaauggggucucgcuauauugcccaggcaggucucaaacuccuggguucaagcuacccucccaccucugccucccugagagcugggauuacaagcgugagccacugcgccuggccaaauuuuucuuuuuuuugagacggagccuugcucuaucccccaggcuagaguacauuggcgugaucuccacucacuguaaccuccaccuccuggguucaagcaauuauccugccucagccucccgaguagcugggacuacaggugugugccaucacgcccggcuaauuuuuguauuuuuaguagagaugggguuucuccauguuggccaggcugaucucgaacuccugacuucaggugaucugcccgcuucagccucccaaagugcugggauuacaggcaugagccaccacgcccggccccuaccaccaaauuuuaacugaggaucaacuaaguuccaggugcuuuagccagaggagaccgauuuuccauguucucccaccaacauaauaauuccagcaacuuuuggcccauuguaaggaagggcuugguaugagcagucugcccauuuuacagaugguaaacugaggcaaggacaaggagcucaccuuaaagauguacaugcucugcaccaccacgggcaucuggaggcccagacuucuggccaaggucuggaggggggcaaaggucaugcugccagccugccacacauggcccacccuccuggcccucacccccaccucugcucaccugcaccuugaaggagugugugaugcucuugaagacggggucgugggcgugcagagcuaugggacagaaggaagcugucggccccaucucaggcccacgugucccuccacacccagcucugggcacccacacucaggcuuacuuugacauucucacuuacuuuguaggcauuaacccuucugcuuguuuacaacugaguaaugggcuccacaggagccuugcccccaccccaggcccuaugccacccaugcccuuauucuugaccuucugggaagcucaguccagccccgacuccccaccccucacagacgacuaagggcuccaaggcaccaaucaugcggagcaaucucgguaccaccauuugcucuguguggccucggguaaccauuucucuccuguaagccucaguuuccucuucugucaaaugaggauuagaagaaccugggaggcaggacuggugugggacucgaugggcuaaugaaugugcagggacagcccagggccuggcaugggauagucccucauugucauaaacauaagauugaaugcauuuaauaccacugagcuauguacuuuuuauuuuuauuuauuuauuuaguuuugagauggagucucacucugucgcccaggcuggagugcaguggcacaaucucggcucacugcaaccuccaccucccuaguucaagcgauucuccugccucagccuccugagcagcugggacuacaggcaugugccaccacgcccagcuaauuauuguauuuuuaguagaaaugguuuuucaccauauuggccaggcuggucuugaacuccugaccucgugauccacccgccucggccucccaaagugcugggauuacaggcgugaaccaccgcgcccggccaagcuacguacuuuaaaaggguuaugaugauaugguaaaucuuuucuuuuuuuuuuuuuuuuugagacagaguuucgcucuguugcccaggcuggagugcaguggcaguagcugggacuacaggcgcccacaacaagguccggcuaauuuuuuguguuuuuaguagagacaggguuucacuguguuagccaggauggucucgaucuccugaccucgugauccgcccaccucagccucccaaagugcugggauuacaggcgugagccaccacgcccggcaaugauaugguaaaucuuacguguauuuuaccacaacuugucuacaagcuuaccaugauauaacuucaggcuuaacaauaagcauucuaggccaagugcaguggcuuaugccuauaaucccagcauuuugagaggccaaggcaggaggaucacuugagcccgguaguugaagaucagccuaggcaacauaacgagaccuccucucaauuuuauuuaaaaaaauaaauagccuauaaaacaaauuauaauguaugauccuaaagaaaaaaagugaggguuuucuuacuugacuuuggggugucagaauagggacccugucagcaggucaggugccccuuaggguggcucuagggagcacuggacccaggagcucccccaggccaggcaguagagagccugcacaugcccaccuguuaggggggaucagguggacccccuauccccagugcuguggcagcagugucaugauuagcagaggggcccaagaccagaggggagccugaagccacaaaugccauuuacccgaccacuaauuuacuaugggcuuucuuucuuguuugcuuuuuuuuuuuuuugagacggaguuucacucuuguugcccaggcuggagugcaauggcaugauaucggcucacugcagccucagccucucggguucaagcuauucucccgcuucagccucccaaguagcugggauuacaggcaugcgcaaccauauucagcuaauuuuguauuuuuaguagagacaggguuucuccacauuggucaggcuggucuugaacucccgaccucaggugauccacccaccuuggccucccaaaguccugggauuacagacgugaacgaccacgcccagccacuaugggcuuucauuaaagcuccuaaacucuucaggcuucaguuuccccaguuuccccaugcuuuuuccuuuucuuuuuuuuuuuuuuuuaacaggguuucacucugucucugucacccaggcaggcuggagugcaauggcacaucucagcucacugcaacauccgccucccagguucaagcaauucuccugccucagccuccugaguagcugggacuacaggugugcaccacuacacucaccuaauuuuuucuauuuuuaguagagaugggguuucaccauguuggccagacuggucuugaacuccugacuucaagugaucugcccaccuugacuucucaaaguguuaguuaggauuacaaguguaagccaccacucccagccuguuccccgaucuucuuuccuguacccccaagccccugcucaccguggccaauuuuguugauggauuucuccggagggaccaggaaauuuccuguggcacaaagaacagauaaaggcagagaacugguguccagccuuccaugggcagcuggcuucagcaugcuuccagcccagggggcagauucccagguccagccuacccucaccauggcuccuccccagcucuagggccccagcuccaaaccuuucucaucaaaaacgccuuucucaaagaagaaucgaaucuugucaccacugcucaagaaauagucugugcugcccuguggaaaggggacaucagaggacugagacagcauccuggggucagagcugggccuggcaaagagggaggcggauucagaagcuucccacccucacaggguuacagacacccugggggcuucucagacuuguccacugaggcacagacagugagccagaacuucaagugccuggaagcacaccccaaagaugcaaacauggaauuucuuggacaccucacuauacugugauucagaacauggaugcuagagucgaauagggcugguucccuagcagccuugggccccugguuuuaugucaccaagacuucauuuucucaucuguaaaaaaaggaauaauaauggcugggaguaacgacucacaccuguaaucccagcauauugaggcagaucacuugaggccaggaguucgagaccagccuggccaacauggugaaacuuugucucuacuaaaaauacaaaaaacagcugggcgugguaggcaccuguagucccagguacccgggaggcugaggcaggagaauaacuugaacaugggaggcggagguugcagugagccgagauugcacuaugcacuccagccugggcgacagagugagacucugucucaaaaaaaaaaaaaaaaaaaaaagucugggugcaguggcucaugccuguaaucccagcacuuugggaggccgaggugggcggaucacgaggucaggagaucgagaccauccuggcuaacauggugaaauccccgucucuacuaaaaaaaauacaaaaaauuagccgggcaugguggcaggcaccuguagucccagcuacuccggaggcugagacaggagaauggcgugaacccgggaggcagagcuugcagugagccaagauugggccacugcacucuggccuaggcaacagagcaagacucugucucaaaaaauaaauaaauaaauaaauaaauaaauaaauaaauaaauaaggaauaauaauagaacugaccaaccaggcacuguggcucacaccuguaaucccagcacuuugggaggcugaggcaggcggaucacgagaucaggaguucaagaccaaccuggcaaacauagugaaaccccgucucuacuaaaaauacaaaaaauugcugggugcaguggcucacaccuguaaucccagcacuuugggaggccaaggagggcagaccaccugaggucaggaguucaagagcagccugaccuacguggagaaaccccauuucuacuaaaauuacaaaauuagccgggcaugguggcgcaugccuguaaucccaguuacucgggaggcugagguaggagaauugcuugaaccugggaggcggagguugcggugagccaagaucgugccauugcacuccacccugggcaacaagagcgaaauuccaucucaagaaaaaauaaaaauaaaaacaaaaguacaaaaaauuagccgagugugguggugggcaccuguuguaaucccaacuacucaggaggcugaggcaggagaaucgcuugaacccaggaggcagagguugcagugagcugagauugugccauugcacuccaacccgggugacagugcgagacuccaucucaaaaaaaaaaaauaauaauaauaauaacaauaauaauaauaauaauagaacugacuuccccaggccgggugcgguggcucaugccuuuaaucucagcacucugggaggcugaggugggcagaucacccgaggucaggaguuugagaccagccugaccaauaugaugagaccccaucucuacuaaaaaugcaaaaauuagccgggcgugguagcaugcaccuguaaucccagcuacuugggaggcugagaugggagaauugcuugaacccaggagguggagguugcaaugagccaagaucgcaccauugcacuccagucugggcaacaagagcaaaacuccaucucaaaaagaaagaaagaaagaaagaaaggccgggcgagguggcucacgccuguaaucccagcacuuugggaggcugaggcggacggaucacgaggucaggagaucgagaccaucuuggcuaacacggugaaacccugucucuacuaaacaaaauacaaaaaauuagccgggugugguggcgggcgccuguagucucagcuacuccagaggcugaggcaggagaauggcgugagcccaggaggcggagcuugcagugagccgagaucgcgccacugcacuccagcuugggugacagagcgagacuccgucucaaaaaaaaaagaaaaagaaaaacaaaaaacugaccuccucaauucuuggaggcuucagccagaggcugaaucuuauagcaguuaggacacagauucuggagcugaaauccuuggguuuaaauccuggcucuaggaugggugcuguggcucaugcuuguaauccuagcacuuugggaggccaaggcggguggaucaccuaaggucaggaguucgagacagccuggccaacauggugaaaccacgucucuaauaaaaauccaaaaauuagcaggacgugguggcacacgccuguaaucccagcuacucuggaggcugaggaaggagaaucacuugaauccaggagguggagauugcagugagcugagaucacgccacugcacuccagccugcaugacaggagcgaaaauauaucucaaacaaaacaaaaaaauccuggcucuauugcaguggucuggaaccaaaccugaauuaucucugagacaugccuguacauguguuaucuuacucagccucccaaaacccagagagguagggucuacuauaaucuccauuuuauagaagaagaaauugaggugccuuuuuuuuuuuuuuuuugagacagagucucgcucugucgcccaggcuggagugcagugacccaaucucggcucacugcaagcuccgccucccggguucacgccauucuucugccucagccucccgaguagcugggacuacaggugcccgccaccacacccagcuaauuuuuuguauuuuuaguagagaugggguuucacuguguuagccaggauggucucgaucuccugaccuugugauccccccgccucggccucccaaagugcugggguuacaggcguaagccacugcacccggccgaggugcuuuuuuuguuuguuuuuuucuuuuuuuuuuugagacggagguucacucuugcccaggcuggagugcauuagcgcgaucuuggcucaccucaaccuccauguuggucaggcuggucuugaacuccugaccucaggugaucugcccaccucagccucccaaagugcugggauuacaggcaugagccaccaugccaggguuuguuuuuuuuuuuuuaaaaagacagugucucauuuuguuggccaggcuggagugaauggugcaaugggaucacggcucacuguagccuugacuuccugagcucaggugauccuuccaccucagccuccuaaguagcuagaacuacaaguucacaccaccaugccuaauuuuuuuuuuuuuuuugagacaggguuucacucugucccccaggcuggaguccaguggcgcaaucuuggcucacugcaaccuccaucuccuggguucaagcuauccuccugucucagccucccaaguagccaggauuacacacgugcaucaccacucucaacuaauuuucuuggauuuuugguagagaugggguuuugccauguugcucaggcugguguugaacuccugggcucaaaugaucugccugccuuggccucccaaagugcugggauuacggguaugagccaccaugcccggccacgacuaauuuuuuuuuuuuuuguauuuuuuguagagacaggguuucaccauguugcccaggcuggucucaaacuccugagcucaagugauuuguccacugccuuggccuugcaaagugcuaggauuauaggcuugagccaccaugccuggaugguaaaaauauuaaagguaaugaugcuaagcauaugucaaauauuuuacugaauucguuauuucaugagggaaccaguaagauguuacaacugguucaaaggagaauuccaagaauuacacacacacguauguagauacuaaggaaacugaaaugaauuuuuuuuuuuuugagauagaaucucgcucugucacccaggcuggagugcaguggcacaaucucagcucacugcaaacucucccuucaggguucaggcgauucuccugccucagccacccaaguagcugggaccgccggcgccugccaccaugcccagcuaauuuuuguauuuuugguagagaccggguuucaccauguucccuaggcuagucuugaacccuugaccuccagcgaucugccuguuucagccucccaaagugcugggauuacagguauaagccaccacuccuggcccuugaaaugaauuuagagauagaugcaaacuguuuuuuguuuuguuuuguuuuuuugagacagggucuuucuuuaucacccacccagacuggagugcaguggcaugauuauagcucacugcagccucaaccuccuggccccaagugauccuucugccucagccucccauguagcugggaccacaggcauauaccaccaugcccagcuaauuuaaaaaaauuuuuuuguagagacaggucucacuuuguugaccaggcuguuugcgaauuccugggcucaagcgauccucccugcuuggccucccaaacugcugggauuacaggcaugagccaccacacccagcugcccaacuguucuauccacagggcaauaauugcauuccccaggacccaguucaugguaacgugauuggaacagagugguacugacccccuacuuggacaaguaucaugugcauuauuaucaguuuuauccaacuuacaguguuguaaaauaacucaaacaaggaaagcuggagguaacccaagaaaaugaaacaggacgcccacugaucuuuuuuuuucucacaguaucaagagugaauauugaggauguuacugagugcugggcaccaugccaagcucuuuucuuugcaugcauuauaaaccaagauauaucaguuuuuuguuuuuguuuuuguuuuuuuuugagacaggauucuugcucuguugcccaggcuggagugcaguggcaugaucuuggcccacugcaaccuccacuuccuggguucaagcgauucuccugucucagccucccaaguagcugggauuacagguaugcaucaccuggcccagcuaauuuuuguauuuuuaguagaaacaggguuucaccauguuggccaggcuagucucaaacuccugaccucagaugauccacccaccucggccucccaaagugcugggauuacaggcgugagucacugcgcccggccaauauaucagcuuuauucucacuuucuucccaccccacaacccauuagucucugaaggcagcuuggagggcacaggauucggcccuucuuacuccuaggaacccuugaguggccugccugucucuggcugcaggagcugucucugcuucccccaguauccccccgaauggaaggcagcugugcagcaaaugagaccagcuuuuuggaagaaacugucauuccuuaacugguucuuuuuccuucucaagaccccauucuucccauucccugggauggcuuccggcuguuguauuucugcuaaugcccaccagauggcaggugcuccucggcgugagugccaggaucucaccuggcccaggcgcaagcaggcucauaauaaacucugacuaggaagggucaagagaacggugugggagaccccagagucuucaauuuacccauugcaaacuguacuggguccuaucaugugaccuauucggucacuggggggagaaaaucugaguuccuagucucaugggggauaguuacacaggugggggucauccagaccacugugcucauuccagguggcuggccacaaaguggccuucggugaccagagaacagccggaaaacagaaaguaaagccaagcugggaacagcagggacuugguaucagacagaucuggguugaaauccugacucuguccacuacuaacuguguggcuuggggcaagugaucugaaccuaauuuuccccaacugucuaauggggggauaauaauagccuguaauuucagcacuuugggagacugaggcugguggaucaccuggagaucaggaguucaagaccagccugaccaacaugaugaaacccugucucuacuaaaaauacaaaaauuagccgggccugguggcgcaugccuguaagugcagcuacucaggaggcugaggcaggagaaucacuugaacccgggaggcggagguugcagugagcugagaucgcgccacugaauuccagacugagcaacagagugagauucuguuuuaaaagaaaaaagaaaaaaaaaaaggacaauaaagccuacuugauaacuucccagugaggagcgagggaaagguguguaaggggcuuggccugacacccuggagccuugggauccucccuuccacgaugcugcucuggccggggaccaagcccucccucaaaagccacaucccauccucaugugccccagacaccuaccugggcucgaagcugcuccucuuccuggguggagaauucugugcggcaguggagaggaacauccauuucagccacuaucucgccaauccuuuguugcauggccacacacucuuccgcagacaagaauccuuccagcaccaggaauccauccuguuggaacugcaggcaggcuugagacucaggcuuccccagucugcaaaugcuccugucugacccuucccucaaccuugcagcugugugaaggugggaccagguaucuuguuugcugcccuguccccaaccccaggcauggagucuggcacccagcaaagagcaaucaauauuggcugcuugaauggaagaacaaguagugaggccgggugcaguggcucaugccucuaaucccagcacuuugagaggcugaggcgggcaauaacuugaggucaugaguuugagaccauccuggcuggucucaaaccagccagggcaugguuagcugggcaugguggugcaugccuguagucccagcuacuugggaggcugaggcaggagaaucacuugaacccaggaggcggagguugcagugagccgagaucucaccacugcacuccagccugagcaacagaugagacuccaccucgaaaaaaaaaaaaaaaaaagaaagaaaaagaaaaaggaagcugggcacaguggcucacgccuguaaucccagcacuuugggaggaucacuuaaggucgggaguuccagaccagccugaccaacauggugaaaccccaucucuacuaaaaauacaaaaacuuggccaggugugguggcgcaugccuguguaaucccagcuccucgggaggcugaggcaggagaauagcuuggaggcaggagaauagcuugaacccaggagguggagguugcagugagccgagaucaugccauugcauuccagccugggcaacaaaagcgaaacuccgucucaaaaaaagaaaagaaaaaggagcggcaagggaaaguugucccugcccuuccccuccaggcuugggucaccuggaaacacaaccuuauucauguauucagccaauauugauugagcaucuacugugucugagacacgguuuuaggagcuaaaaguauggcuauaagcaagccagccaugaugccugcccucauggugucuacagucuagugaaagagaccggcauuacacuaaccacacagguaaauuuacugucacaaacuucgugccagagagagaggaugagugugagugcugaaggcagaagcagcuagcguaagcuggcugggaaggagaagggucugggagcagcagcgcugagggagugacauuucaagaggggaccagcaggauaagggaagggcauuccagacagagggagcaggauaugggaagccccugaauuugggaggaacauaaggaauugggaauggauagggcagagugaggggagggguggaagaggaggcaggaggguggcaggggcugggccaggcugggagcuauauucuauccugagcgcaguggcagccagggaggggaaguagauggcuucuucugauuugccucugguccucuuauucugaggcucuugagagagaaagggagggaaugaauaucugcacauuugccugcagagcguuaccaaguuuuagccccaacagggacacugaaagucaccuacugcugggcaugguggcucacaccuauaaucccaacaguuugggaagucaagcuggguggauugcuugaggucaggagucggagacuagccuggccagcaaggugaaacccugucucuacuaaaaauacaaaaauuagccaggugcgguggcgggcaccuguaaucccagcuacucgggaggcugaggcaggagaaucauuugaacucagcaagcagaaguugcagugagcugagaucacgccacugcgcucuagccuagaagaccaagcaagacuucaucucaaaaaaaaaaaaaagaaagaaaaagaaaagaaagucacuuacugcacacacccacaaagagccuaguuuccgguuaaggacaccccuuccgccaccaugggaugcucaguucuggcuuccacacaccacucaugaccacccaccaugggccccucagcucugcauguuaggaauuaaucacaucaguaucaagcugaaaauugccuccuugggaauugggccaaccacagcaaccugugcaacauacccuugauccaguaaauacacaaauacagcuaggaauucuuuuuuuccuuuuuuuucuuuuugagacggagucucacucuuguugcccaggcuggagugcaauggcaugaucucagcucaucgcaaccucuaccucucaggguuaagugauucuccugccucagccucccgaguaguuggaauuacaggaaugcaccaccacaccuggcuaauuuuuguauuuuuaguagagaugggguuucacuauguuggccaggcuggucucgaacuccugaccucaggugauccacucacuucggacucccaaaaugcugggauuacaggcaugagccaccgcacccagcccuuuucucuuuucuuuccuucuucuuuuuuuuuuuuuuuaagagacagggucucucucugucacccaggcuggagaguagugaugugaucauagcucauugcagccuugaacuucugggcucaaucaauccuccugccucagucucccgaguagcugggacugcaggugcacaccaccacgccuggcuaauuuuauuuauuuuauuguuuauuuuauuuuauuuuacuuuauucugagacagagucucacucuguugcccagguuggagcgcaguggcgcgaucucagcucacugcaagcuccgccucccggguucacaccauucuccugccucagccucccgaguagcuuggacuacaggcgcccgccaccaugcccagcuaauuuuuuuguguuuuuuaguagagacgggguuucaccauguuagccaggauggucuugaucuccugaccuugugauccgcccacuucggccucccaaagugcuaggauuacaggcaugagccacugcgcccggccuguuuauuuuauuuuugagacgcagucuuguucuguugaccaggcuggagugcaguggcaugaucucagcucacugcaaacucugccuucgggguucaagugauucuccagccucagccuucugaguagcuaggauuacaggugugcgccaccacgcccagcuaaauuuuuguauuuuuaguagagacaggguuccgccauguuggccaggcuagucuccaacuccugaccucaggugauccgccugccuuggccucccaaagugcugggauuacagaggugagccaccgcgccuggccaguuuuauuuuuuuuuagagaaggagucuugcuauauugcccaagcuggucuugaacuccugugcacaagcgauccucccaccuuggcaucacaaaguggauugggauuacagacgugagccacagcuaggaauuguuuuaggaggauuacgcaauaggggaucaaagauauacauauacauauggggauauucacugagccuuguuucaugacagaaccaaguggggaguaaucuaaaugcucagcgcaaggggauuaguuuaacaaaguauaguuuaucuaucuggaacacaguauagcugauaaaaaucauguagaaacauauuuccucucaaagauuggcuauacaugauuaucuggccauugugagaacuugaccaaguaagugcccuccuuucucuggcccucgggcuaccaaacggggauagcaguacagccuccuuuauugaagcuggcaggcugggcgcgguggcucaugccuuguugucccagcacuuuggaaggccaaggcaggaggaucgcuuuagcccaggagcucuggaccagccugggcaacaaagugagaccccaucucugcaaaaauaaaaauaggaccgggcacgguggcucacgccuguaaucccagcacuuugggaggccaaggcaggcggaucacuugaggucaagaguucaagaccagucuggccaacauggugaaauccugucucuacuaaaaauacaaaauuagccaggugugguggcgcaugccuguaaucccagcuauucgggaggcuaagguaggagagucguuugaaccugggagucagagguuguggugagccaagauugugccauugcacuccagccugggcaacaagagcaaaacuccgucucaaaaaaaaaaaaaaaaaaaaaaaaagagcugggcaugggggcgugugccuguggcaagaccccgucuccucccuacccucccaaaaaaaccuguccagcacuugauucgugguagcuguuguaacagacuuugaaacaaagcuucuagagcuguauacgaaaauauuaagucucagcguaggaauguaugagugauuuuuuaaaaggcuguugcacacuaauuccuacgagguagccuuuugugauuggacgaacaugggcccuccugggccccucgcaggccccgcccccuccugggcgcugcgccccccaacagcguugccgacucccgcccagggcugaacugguggguuccgaggccuuauucucguuuuuggucaaacacacacguccccaccccacccuacccuggguccugugaucuagacacccagggcuaugugugaagaagucaggagggguugcgguugggaacccgcuccucugggcuucaguuucguccucgguaaaauggggcaggggguggguugggcacugggacuacugaagguccggcagggacccccccgccaugacccucccggccccgacuugcaggcuccuaccuucuggagcugcgaggggcucaggcaggccauggagacgcucagggcacugggcggcuucuaagcgcggccuccugguggggaggagaaaguuuaggagccugggaggacuuaacccuucccuacccggagaaaacccggucccaccacccaacccuccuucccuagacacagccagaucagccugugaccuccaggcuaaucucccccacccccacaacuaauccaggauuugcccuuucccaucuccaaggauuuuaucugcuuccucuguguuucuucuggaaaccaccccccaccacugcuuaccaggugccgggaaauuaugcugugagagggucaggccaagcagcugggcugagucccaguccaggcgccgccauucccugugacucugaggaacgccugccucucucuaggccucaaucuggauagaaugggaugcaggguuggucugggggaugugcggcaccccccuucuccagguaaugggcauuccaaagguggaagagguccuggggagaacuaucugggccccucccagcaccgaucugaaacccucucgguccugggaggauuauggaagggaauuaacgcauccaucugcagcucagacgaaaguaggagacaugggguaucuuaguaggaggaaggggcugaggagagagagaugcuuccuguuacccacccucaggcccaagauacuuggcaucucaagucgggcuggcacaguggagcuggggucagaacaacaccugcaggccgggugcggcggcucgggccuguaaucccagcacuuuggaggcagaggcgcgcggaucacgaggucaggaaaucgagaccauccuggcuaacacggugaaaccccgucucuacuaaaaauacaaaaaauuagccgggcgugguggcgggcaccuguagucccagcugcucgcgaggcugaggcaggagaauggcgugaacgcgggaggcggagcuugcagugagccgagauugggccacugcacuagagccugggcgacagagcgagacucggucucaaaauaaauaaauaaauaauaaauaaaaauaccaaaaacuagccgagcaugguggcaggugccuguagucccaguuacucgggaggcugaggcaggagaaucgcuugaacccaggaggcggagguugcagugagccgagaucaugccacggcacucacuccagccuggacgacagaguaagacuccaucucaaaaaacaaaaacaaaaacaaaaagagagaauaacacuugcacaccaccacccuucucagcuugcccugcucagcagcuggcagggccacucgcuggcucugaaaaaccggcugcugccuuccccaaaaugaugccuucugaauggcgaagggacaaaguguuucaggagugugcauggggacacugcucagcccucaagagccuuggccucgagucaagucguguuugcugggccaccgcucugggagcugcugcuugguccaggccguccggggggcaggggggagcaguaagugcagcucaggcuccugguucagagggguuaggcugggugaggggcaggcagaugacagaaccacgagguucacuagaggcaggauguguucccagcuguccuuaacccuucugaugcaacugcccaacaaagacagaugccuaccaugugccaagaacacugagguccccucggacugggccagccauuccccugggagcccccacagaaggcuuguaguagagacucagugaagcagacuguguuugcgucccagauguucaggccuuacuuucccagucuguaauuuggggcuagcaguaggauccccugugagcaguaaauaagaugaaugcuucgcagcugauaaagagcuuggcaccaggccuggcgcugaguaagugccuaccaacuggugaacaaguuguucaccaaauguuagcaggggcuguucugaguggaauauuauuuauuuauuuauuuuuuauuuuauuuauuuuuuuugagauggagucucgcucugucacccaggcuggagugcaguggcgcaaucucagcucacugcaagcuccgccucccggguucacgccauucuccugccucagccuccccaguagcugggccuacaggcgccugccaccacgccuggcuaauuuuuuauauuuuuuaguagagaugggguuucaccgcguuagccaggauggucucaaucuccugaccuugugaucugccugccucggccucccaaagugcugggauuacaggcgugagccaccgcgcccagcuggguggaauauaauuuaaacaauuuuuuugagcuuccaaaauugcuguuacaaucagagagaagaccaccacagugguuuuaggcagaguggagagcccugggugggugggggagggggaggggagaggcccagccucccacuaacuguucauucugcucaacuuugggaagugggugggcgguguuucuacauggugguuuuuuccaaauguaaaccagcuccagaucgaacucuccugcuccaggcgcuggacagccucaaggccagggugggggcgggaguggggucgggggguggugggaaggguaccaaacugggggagggaccuccaccacggaaacagaaaagaaggccccagcccggcagucacaguccagcugcucagccugucagcccauggcagggggagaagagggagggaaucuuggcucaggccugaguucaccuggaggggucagaguccccguggagggaggagggauagacucuguccaguuguagaggaggugcccaagcagccacccaggccucaucacuaaggucaaagucagauaugauggccuuucuuccucacccagucuccugccgcagggcgcccacguuggcccaccacaaggauccuuggucuggguggaagauacaaggccauuuauuggguacuagcagccagguccuccaccaaaaaccccaucuaccuacauaaucgccauuguuccuugaacaguccugcaagugugccauuaccuuccugauuuuacaaaugagaacacugaagccccacaucaaacacggcagaacuggcaucuggaagcagcugucucagccucugcccuuuaccacacuaccucccaaaggcccccaaaggggcugggagcugaggcaggcuuccccacgaugacucucagccccaccucuguagaccacuugggacucacuguuggaauugcaagggaccuuugagagcacagaguggaaauucccauuguccacauggggauacagaggccacuggagaagggaucugccuagcuucaugcacauccugucccaugaagcugggacaaaggcccaggacuacugguucccauuccagugcccuccucucccauccccacccaucaaaacucaugaggggccaagcacgguggcucacgccuauaaucccagcacuuuaggaggcugagguggguggaucucuugagcucagggauucgagaccaaccugggcaacauggcaaaaccccgucccuacaaaaaauacaaaaauuagccagcacggcugggcgcaguagcucaugucuguaaucccagcauuuugggaggcugagguagguggaucagaaggucaggagaucaagaccagccuggccaacauggugaaacccugucucuacuaaaaauacaaaaauuagcugggcaugguggcaggcaccuguagucccagcuacucgugaggcugaggcaagagaaucacuugaaccugggaggcggagguugcagugagccgagaucgagccacugcauuccagccugggugacagaguaagacucugucucaaaaaaaaaaaaaaaaaaaaaaaauuagccagcaugccccugugguccuagcuacuugggaggccgaggugagaucaccugagccuggagaggucaaggcugcagugagccgugaucacgccacuauauuccagcagugcacucuaggugacagaaugagacccugucaaaaaaacaacaacaacaaaaaaacccccucaugagugcccaaccacaggugaguaggaugacagagauugugcuggcuaugggauccccagcccaggucacagccuguuaccuagcaggugcugcguccagcuuacaagcuccaguaacugccuccaaaggcacagagucucauggggcaggagaugagcagaguuaacucuccuguaggugcccaagcaacguuccacacggcccggcaggcuucagagaagugagggaagcguccucccaugacacaaagaccuccaaaggccacuuucuguuauagauuuuauuugauacugugaccgagucuacaaguucagacccacauguaacggauuuuugcuucaugguugucagaggcuagugugcauuauuucugaggauuauauccaaugacacgacgcagaaaacacaaauggacggacagacggauggacauaaucauuaagacaagagacucuaaaacgugccuuaguguccacgugauugaucuaaggcggggacccuucuaagguggggacccgagugaucuaaagcaggguggcuuccagccaccaggugccgacugggcugugugcacuccaggcgccagggacgggaaccggcuuggaaccaacgccugcccucccaggggcgaccuccccauucccgaccagccucuaagugucugcucuucaugaaggaccagguggugacagggcugauggaagcagcggaggccagcgguggcacuggacacacccaugccgcaggcgguggggaaacaaagucugggcgaaguggcuccucuuggcuccuuaacacugugcguggagaggcagggcaggcacgaggaggggaggugcgaauggagcaccguucauccggggauuagccaacccgagucuccucccuccuuggcagcuccagaacauucccucuggccgacagccacagaaaugagugccugccaagacacauggaggagaaagaaaacaagacaccaaaaaaacccaaaaaacaaacaaaaaaaccucccuccccaggaacaaauagaacuccuggaccaaggucacaccagauccggaagacacccugcacccugcgcccagggaaaggaaacacaguucaacgucuggcugcuuugcucaagggaaacugccacccugcccugagacuccaacucacuggccguuagugucuuuuuuuuuuuaaguuuuuuuuuucuuuuuaauacccaaaccauccauuuucaaagcuuuuuuuuuaaaaaaauuguuuuuugauuaaaaaaaaaaaaacaaaaaacuaaaacugccacaaauacugaagaggcaagcuccaggccuggccuuuccagcuggaggccugcucucccguggaccgcaccgcagagcccagcccggcacugcugggugaccgucccauggcugguucgccccggaccacucugcugaaguccagguggguguuaaaugcccggcggcaucgcuaaauaaggacaaggggaaaaggcagcccaccuuucccugaacaccuuccaucugggcugaacuuucuugggaauguauaaguuaucuggaugaaggaggugggagauggagaaaaauaaauaccaagaacuaaagugagggucccaggaccucugguggcagcucagccccuggggcagagcuggccuccagggaggagacccugauuauccaaauacugcgcucuugagacuugcucuccuccacaagcacuugcccugggggacgugagucucagagggagaaaaggggccagccccacagauacuguccucucgcucuggccugacucacaagcggccccaggcuccugcccagccacgaggcuguccuggcuguccgggaguucugggagaagcuaggccugccccuccgggccugaggacugggcagcgguccugcugcuugcugugcugggccggccucgcucaggccugcuccuugucagcccuccacagccgcuccuucaccucggguggcaguguguugaacagguccuccuccaccaccaagccgcugcgcuugagcagugggcacucgcccagcuccacaggcaggcacuccagccgguugccccgcagcucgaucugcgucagguuggucagcucgcccacccuggagggcagugacugcagcacguuguugcccaggugcagggcccgcagcuuccggcacuggaagagcuccggagggagcgucucgaucuggagggaaaaaagcaggggugagagugaggugggugugggcuuggacggggccucugggcuucccuucccucucuccccaagaucucagcaucuuuucugauccccaggcccccagcaucagcacaaucugggccaaacucuggccaacaucugccugugcaccaggucucagcucuugcucacuuccuccaggaagccuucccugaucuccugggucucauggcccccauguccccacucgcagugcucauccuuccaucuguuacccccuugaugugggcucuaaggaugagaccugccugccucgauccccacuaucuuccagcaccuggcccugggaaguauaucgcauuggccagcugcucccaccuccaucccagggcucaccaggagccaggcuguugguucugcccagcuuaacaacaauuuaugaaagcaaaacagcaugcugagaaaauccacccccuaggccgggugcgguggcucacgccuguaaucccagcacuuugggaggcugaggcgggcggaucacgaggucaggagaucgagacuauccuggcuaacacggugaaaccccgucucuacuaaaaauacaaaaaaauuagccgggcauggugccgggcgccuguagucccagcuacucgggaggcugaggcaggagaauggcgugaacccgggaggcggagcuugcagagccgacaucgcgccacugcacuccagccugggugacagagugagacuccaucucaaaaaaauaauaauagccucaaagccuaaguguacuaugcuuaauuuauaaauuaaacuuuaucauagguaccugugaauagcaacgaacagaacauauaggguucugcacuaccugcagugccaggcauccacgggggaccuuggaccacauucccugaggauauggagcaauuacuguuaacagacgacacccguaugcagcuuaauguguggcaggcucacugugagcacugauacuauuaauuuauuuaaccagcaaacuaccuauaaauauucugucaauacucuuccaauuuuacagaugggguaacugaggcccaaagacgcugacuuguccagagguucagcugguaagugauggagccaggauuugaacccgguucaacagcccaugcucuggugaaccguccacacuguuagcggagcaaggagcaaacagggggcugcaguggguucgugcugucuccuggcacacaggaagagccucacguaugccagcuucuucccugcccugcugcgaggaaucagcuggggccaugaguucuuacugcguguaaguaaggccaugaguugagccugcccgucccgaggcugccuccuucagaugggaugggcaggagggcaggagccaggagcccugggccuugaucccaagugaggaugauggggagauggcacagcagcccuucugagcuugcucuaucaccgcccccauuuuccugccaaggagacugaggcccagagagaugacacgccacucgucugagguugcagccucuccgaaagggucaggagaggauguacgucuuauuuccucccacucagagcccaugcuguauuucccuucugccaaauauggcacucaguuacaggguaacucuggaagucccucccucucugggccucaguuuccccauuuguaaaaggcacagguuggacuagaaacugagcuuggacacucuguggcugaggaccguuuugcagacucggaccucaaccucacgggcaccugcucucuccagccgcguuuagagaagggcccaggaguuccuggggagcaacguggcuuucccagcagggagauaagcauggccaaggcccggcagagugcuuuuucuuuuuuuuuggggggcgggggcgggggacggagucucacucugucacccagagagugcaguggcgcaaucuuggcucacuguaaucuccaccucccagguucaagugauucuccugccuuagccucccgaguagcugggauuacagccgcauaccaccaugcccggcuaauuuuuguauuguuugcagagacgggguuucauuaugucggccaggcuggucuugaacuccugaccucaggugaucugcccgccucggccucccaaaguguugggauuacaggcgugagccaccaugcccagcccaggcacagggggugcuuucaaaaaggcuccuaaccuguguauccuacacugccaccacugugaccaaggaucaggaaugcauuugggguuggcuuugaggucagcaggggcugaaggucagaggguagacaggaagugggcucuggagcacccaggggccagagccuucccagaaagaccccacucccaccccgugaucuccucugcugacacaugcaguggucagggacagugggaaagcucuggacagcgaguggcagagcucggguccauauggagccuggcucuggagcccccucccugaaaggccuccuccccagaacaugcccugcucugagccagggagcccucuccaggccccagagagaaaaggggagguacucucaguugcucggcucccaccacagccacacccauccucuggaccgauccuucucugcuggauugucggauugucgccggcccgugcccuggaggcuugaaguugguucccaaucccccaauugcacccucuccuaccuccccagagacuucaguggguccccaucggcacugaaaggccucaacucgaccugaucuuugaaaaggacaacucucucaggaggcuuccagggccccagcguuguccuuggcucucuggccuuccugaccaacugcaggaaagccgcugucucucuccucacucugccuccaugacccuguccacccuuaacucucuggccaaagucaccaguuccuaauccagccaacuccccaggccccaugugccccacgcucuggccucgcccuccucuucugcagacuccuguccuucucccucucugcucuccacagugagcaagucaaggacccaucuucacccaugagccuggaaagggugacuccuugggcuucagguggauucaagauggucccuuggacaucccagagccccagacaccugacaugagacacaccuuggccucugaaaaccugugcuuccuccagucucaacaauccacaaaaaaaagcucaagucacucagaccacccccaccaucaacucccgucccuuugaauucccccuccagcgucucccagauccguccaugucucuccaucccuaccugccuuggccacgccaggccccguggccucaccugauggcuaaucguggucucuuaacagcucucuuccaccucccaccucucacucaccccaccccacacacuaccgcaagaggaaccucacgcugcaagucagcucauuccuucacccacucaaucacuaggaauucgguaaacacuugcuugaacaaaagagcuaggucuuagucaucagagccuaugggcuggcaagggaucggcuguuaaacaaaugaagagacaauugaaacugagguguaggacaggaccccccugccauccacacccccccccauagccccaccucugcucuccaggaugcccacauuccugggcagcccaucucacugcuccuccccaccagaaccuccuggacugucccuuuccccuccaccuggcuuccuccuccucguucuucaggggccuguuccucuguguucccagggaccuggugcuccagcagagcgccuacgcacugugcuaacugccucguuacuuggccuucuucauccccauguccccggcgccuugcuccauagcuggauucuagaagugcucaaaaaacaucugcacaaaggccaggcgaaguggcucaugccuguaauaccagcacuuugggcggccaaggugggaggcuuugaggccaggaguuuaaagaccagccuagaaaacacagugagacccugucucuaccaaaaaaacaaacaaacaaaacauaacaauuugcacacaucaguaaacgagugaacgaaugaauacugucuugucaaggcuuucauuagcaagaguauaaaucuggagaaacagcacgcaagggcgugggcaggccacgcccaccccuccuggucaccacuggccaagguggcugagaaggagccaucaagcccgagugaggaggaagaggggcucaggccucccacucagaaugaggggccugccugggguuggcccaagugaacuguuuucccuauuaaggcucugguguuccaggggguggggacaggaugugauuaagccaugugcuaaacaggguguccagagggucuccuuccucugggacagcgugcuugccgccagcuccuuuccugaggggugaccucagccagcaggcaugacacuaacaggcaagcuuggcgggaggagcugggggugggggacaggauggggagccaggcuggaggcuugaacccucccccaaccaggaggacagccccagcacagcacccgggacagggcaggaauggcaggagcugugaggaagucccagcuuaucaagggcagcacugugcuauggggaagccacagggucucccccuccacagauuaaagaagggcuggguuuguucugugcuucccaaauguggcuucuccccaggggacuccaguuuuccuauucagugggccugucccgaaacuacaagagaaaacccugcccugguccacucucccacugugcucaagucauaauaugggguggccggagauaaggacuugucaaaaucccugauacauguggguugcagguugcucugcaguaagggagcccuggggaagaggggaggaaggcuuccaagccagcaggcaucuggagggccugaagcaucuagucugagugaugcuggagaagguguguccuguccuggggcccaggaggacagacagggcauuccaggggccaccucccuccgugccugaggauacuauagacagaccgggcauuccaggggccaccucccuccgugccugaggaugcuauagacagacccuguugggaggacucagcagguugguggaaggaggacaggugcaucaugccuggcacagggcgaacacagagcaggugcccacgaaaccaacagggacugcaccguggggcugcugcauggcagaugcacccaacagcaacaaccgaacuaagaaacgcggguugccacacggaggcugcagaggggagggugcuuagugaaaaugcucuaugagcugcacgcuuuuuauaagcaggagugguuuuccuauuuggcucacugcugcuggaccacccuguaaguaaguucccccaaauaaaccccauguuucaauggccggcuccagggcucuucauuuuacuuugagacugggucucacucuauugcccaggcugaaguacagugguacaaccauagcucacugcagucuugaacuccuaggcugaagcgauccugccucagccucccaaauagcugggacuacaggcacaugccaccaugccuggaucauuucuguauuuuugguagagaugggguuucccuauguugcccaggcuggucucgaacuccugagcucaagugaccgccccaccuuggcuucccuaagugcucggauuacagguuugacccacugggccuggucaacuccgagucucuucuucagccuccugaaccugguggcaucccuagugaaguucacaggggcccggcacgacagcugcugcugugucgggggcagaaggguggcuggcugggcucucccuugucucccagcgccuggccucaggcuuccuccaccacaugucucacuacaggaaucuccaccuggaugugaggcccaggaaaaccugcagguccccaggacggguggaagagggacguuccccacaauggcaguggcuuuguuuccauuucggaggccagaccacagagccacaggaguacccagcccuccauccacacugccugccuccaccaaggggcccuuggaugggggcuuccccagccagguaagagacuggcacccacagaccaccaacagucuugaaaguaugucgaagguguggccucccaaacucccagugacaaugauuugcacaauuuccuuuucagaagggcaggcagaaacaaacuagccccaucuaggcccaacucugccucugacaccaccaaaugcaguggagaaaggugugugggagcugcagagaccauccaaggcuuccccucagccagcacuggccacccacacaguuucuguccuggguggacccggauuggcuccuugccuccaaguccgacugggaacaagcugaggaagacacaaacuccaggcuaagucuugacucccaccacccggcuuugcgagagaacccccggguuuggaccuccugcccaagcacaucccugcugaagaggaacccggcucaaggucaccuugggggacagaccuugccuggccaugcagucucuccaggcaggagaacugcaacauuuuggagcaaagacaggcccggggcccagagauucggauucagcaggccugggauggggcccaaggagucugucucuugaacagagcuucuauccuggaugguucuguaaaccccaggugaggacuccacacucaggggcaucgacggucccaggacacugagccugccgagugccccaccacaagcccuggccaggccacccgccagcccacacgcagagcuguggccgggccacucacccgguuggccgugauggcuagguucuggagguucugcaggaggccgaugucggcagggaggaaggucagguuguuguggcugagguccagguagcgcagcuugcggcaguagaagagcuggguggggaucuucucgaucuuguugcgguucagguagaggcgcuccagguuggugagguugccgaucuggauggggauguaggcgaugugguuguaccacagcuuaaggcaggugaggcggugcaggugcuggaagcugaugaucuccucgauggucuugagguuguuguccuugaggucaaucuccugcagguuguggaggcugaagauggagugggggaugcgcuccaggucacagcggaucagcuccagcucagucagguucgccaucuucuugaggcuguugaggacgaugagcuuggugcccucauuguugauggacagcuucugcaggugcacgcccacaucugugaccaccuguggcagcuugcuuagguugcucuugagccgcagcaccuugaggcguuugagcucccgcagcccgucgaugacgauguagcgguuguucuccgcgcucagguugcccgucaggugcagcuccuccagugucuucaggcuauagauccacagcgggaucuccuugaugucggugaacuugaugugcagcgcccgcagguucucacgcaggaaggccagcgcgggcgcuucaaucuuggccgcugugugguagagccacagcuccuugaggcccgugagcugggcaaugcugggcgggauggucacgucggggaucagcuccagcuugaggaccuccagcuccaccaggucaaacacagugucagggaugccacugagcaugaacaggugcagcuccagcuuguccugcgcguucuuggugagccgcugccggagcuuguccagcguccacucguuguugagguucagcugccgcagcuuguucucacucaccuccgacaggaagacggcgaagcgcuuggaguagagcgggucguauuggucaaugaggugcagcaugaaggcgaagucguucuugacgucggggaugucgcuguagcugcucuccucacggaucgacucaaacgaguacuucuugagggagcgccguagcauccaccacaguguauacaugcagaugaggccguagaagaugacuaggcugauguagaaggacgccaggaucuugaagaguguggccagggggugggcacagcgguaggugcgguagcccgucaggcucucaauguccacggugcaguccacgucgaacuugauguugugcacguaguagacgguguagcagaugaugaggaugaacuugaucaccuugaugauggucugccgcauguagaggcgguacacaaugucccccuccuccacauggguccggaacuucuucaccuucucaaacagcgccuuggcuugcucccccuccuucuuguccagcacgcccgucucugagcgguccacgauacccugcucgauccgugacuugguccgcugcagcaugggcacgguggccuccacguccucacugacggucgaugacuuuuuguccauggacccauucaucuugcugaaggccggcuuggggucgcucuccuccaccacugucuccgacagggcccucgugguccagggcgagucgaagcacuucagcaggauagacacaaagugcuccagcuucgagcuggugcgcgggaauuugaaccagaaguugcugcaggccaggaagaugagcgugugcagaagcaccagguaggggaaguacuuggcaaaccagugcagucgguucucauagcacacagcguccacguaguuguacuggugccgguccaggucauacuugaugccuguggggcccgugucaggggucggcagaaugguggaguugggguaggugggcuccgggccaggggcugcccagccccggaacgaaucauugcaggaguccuuggugacccacuuacaaggcaggcagaucaucuugucuugggugaccugcagcguccccccgaagacggcaaucaucagcaugacgauagagauguagucugugaacacaucccaccacggcuucaggauccgguaugcuggcugcguguccgcaaaguagcggagcucugucaccggaaucaugguucaaccuaaaagggagccauaggagggggguuagcacaggguggccuggcuuuccuaggaccaggggucaggggaagaagacaaugaaaauucuuccauuguccaaaauuccaccucaaaucuagcugggagccaaagccugccuacuccacggggcagcccacuuaucagcccuucugcagaaagcauguggccacuuggcugggaaaccacccugggggaggcaggcaggcuccccauuuaauacacaggaagacugagcacagugagauuagacagauccccagugcagccucaggguucucugcuccaucccuugcauuccaguaagagcaaucgggaacuccuuucuaaaguccaccuauuuaaugaacagauugaccagagggacacauuuaaaacucccaguucacugggaaccagcugcuguaaagcugcagcaaagggcuggagggauucccgcaaaauaugaggaaagaaagcaacaugcagagggggcacaacaugaacucacuuccauaaaacaaagagcaagguuuaaaaauuccacgugguucacgucuguaaucccagcacuuugggaggccgagguggguggaucaccugaagucagaaguucaagaccagccuggccaacauggugaaacucggucucuacuaaaaauacaaaaauuagccuggcguaguggcgggugccuguaaucccagcuauucgggaggcugagacaggagaaucacuugaacccgggagguggagguugcagugagcugagauugugccauugcacuccagccugggcgacaagagugaaacuccaacucaaaaaaaaaaaaaaaaaaaaaaauuccacaugggggcuggcaugguggcucacgccuguaauccuagccuguaaucccagcauuuugggaggaugaagugggaggaucgcuugaguccaggagguugaagcugcagugagcuaugaccccgucgcuguacuccagccugggugacagagacccugcuucaacaacaaaauuccacauguguguauaguuauguguguacaagauucugggaacacucggaagaccaaaggucacauagugggucuuaaugacaggcuccuaggggagcggccucaagagaggggauuaagaauaaggcucuccucccucacaaacugggugaucacagagaggccuuaauguaaaaucaucucugguugcguguguauaaaggaauuaaaaacagcagcaacagcaggcucucccagagagagucuaguuugacuacuauggcgagaagcuggaaaucugauuuuucuuuuuuuuuugagacggagucuugcucugucgccaggcuggagugcaguggcaucauuucggcucacugcaaccucugccuccaggguucaagugauucuccugccucagccucccgaguagcugggacuacaggccugcaccaccaugcccagguaauuuuuguguuuuuuaguagagacaagguuucacgauguugaccaggauggucucgaucccuuuaccuccugaucugcccgucucagccucccaaagugcugggauuacaggagugagccaccgugccuggcugggaaccugauuuuuaacacauaacuuuggugacucuaaugauuggccaagcuugggaaacacuggcugagaagccacauuaggaaacccagacugugcuacacaggaggcacgcagcaagaucucugugagaaugccucucuguggccauucguggucacacggccaaggcugguugcucuuacaaugaaagacguauggcugucacggagggauaagguacuagauguucccuggagaacauacggaaaauuguaaaaaagcguagcagcaaaaaaagaagaauccgcuuuacaauccccaccaggguuacacacuguuaacuuuucacugaauaauaaccuuccaguccuuucuguguauuuuauaauuuuauaauuuuucuuguaagagauuggaucuugcucuguugcccaaacuagagugcgguggcgugaucauggcucacugcagccucaaccuccuggucaagcaauccuccuaccuuagccucccccagguagcuggggcuacaggugugugccaccaugccuggcuaauuuuuuuuuuuuuuuuuuuuuuuuuugagacggagucucgcucuguugccuaggcuggagugcaguggugcgaucuuggcucacugcaagcuccgccucccagauucacgccauucuccugccucagccuuccaaguagcugggacuacaggcacccgcccaccacacccggcuaauuuuuuuuuguauuuuuaguagagacgggguuucaccguguuagccaggauggucucguucuccugaccuugugauccgcccgccuuggccucccaaaguacugggauuacaggugugaaccaccauaccuggcccaugcccggcuaauuuuuaaaauuuuuuguagagacaggaucucacuauguuggccaaguugguuucaaacuccuggccucaagcaauccucuggccuuagccucccaaaguguuggcauuacaggagugaggcacugcacccagcccuuucuguguauuagaauaaauugugcuuuuauuuauuuauuuauuuagagacagaguauugcucugucacccaggcuggagugcaguggcacaaucucagcucaccacagccuccgccuccuggguucacaugauucuccugccucugccucccaagcagcuggauuacaggcacacgcuaccacgcccagcuaauuuuuguauuuuuaguagaaacggaauuucgccacguuggccaggcuggucucgaacuccugaccugaggugauccaccugccacggccucccacagugcugggauuauaggugugagucaccaugccuggccaaauugugcuuuuacuuuacauucaauuuuuacuuuacacuguaacccagaaccuagauuuuuaucuaaaccaaguuuuaaaugccugugucaaaugugucugucucucuuaggagaggaacaggggugcccagaugaugggccaccuuucuuugauuacugauaauguuaauaaccagaauaguaacaaacuuuuuuuuuuucccuuuuugagacagucucacucugucacccaggcuggggugcaguggcaugauccugacucacugcaaccucugccuccuggguuuaagugauucucauguuucaaucucccaaguggcugggauuacagacgcccgccaccacauccagcuaauuuuuguauuuuuaguagagacgguguuuugccauguuggccgggcuggucuugaauuccuggccucaaccaauccaccugccuuggccucccaaaguucugggauuacaggcgugagccaccgugcccggccuagguaggaacucuuuaagaacagcacuucucgggccaggcacagaggcucacgccuguaaucccagcacuuugggaggccaaggcgggcggaucacgaggucaggagaucgagaccauccuggcuaacaaggugaaacuccgucucuacuaaaaauacaaaaaaauuagccgggcauaguggcaggcgccuguagucccagcugcuuggaaggcugaggcaggagaauggcgugaacccgggaaguggagcuugcagugagccgagaucacgccacugcacuccagccugggugacagagcgaggugccgacucaaaaaaaaaaaaaaaaaagaacagcaccucucugcaaaugccaaacacuccccagccccaaucuuucuaggcuaugcuggauggggaggacaggaggaaggcagagcaggaccccaugugaggcagguggaauggggcacucagcaagggugaugauggccacagccagugcugagggccuggaagugugccaggcaccaggcaggccuccccugcaggcccuccuagggucauccuugaugcccaagaggccaggccucuauagccccaucccagagaugggggugcuaaggcucaggaaggugacaucaccugccaacaucccccugcuauuaaggggcagaguagaguaagaacaaacccagcaggccugucccucuaccaccgggcucagguccucgccaccaugugggacuugcccuccgccugcccaaggucucacccaggcggugccaagagaaacaggacugggagugcagcuuccccgccccucagcauuaccagcgcucaggucacaaaggggccagcagacaccaccgcccgcccugggcuggcagcuccaggccagaagucaguccuccuagugaugccaggacucacgggccagggcaagcacccgccccacaggaaggcccgggcccucuaaugaccagguggguccacgcaccaccuacacugcugggaaagaaaguggcacugggagagcuucugaaucacacagcugccuccacugagacauguggacaccuggaguccccauccagggccaggaccuaaagacuggggaacagaagagggaggagaggagcccggugcaugcagcagccugccugcccccaagucuggaaugagacagccagggcgggcgcggcuguuugagcgggcaggauguggugacaaugauacugcaacaccucccucguguucagggagugggguguguucgcucacagaaacaccugcuuccucugcgaggagccgccccagccccgccgaccuggggcuugucuguaccacccagacuccuccuucugaggcaggaaguguucccagcucagucacacaggugagggaaacugaggcucacagaggcaaaaccaccugcccaaggcaggaaacaccgucccaaucaggucugauucugaccacccgccccaacuccgugcuuggucugggaacauccggacucuguucagcccuuggcuagguccagcggggguaaaaaaaaaugaucaaggugggacuucugcuucagguuccucucuccaguuugagugugucuggggaguggaggagggcccugggguuccaauggcagagccuggggcuggcugcagagcugagaagggccuggacuggagucucucacaggccuggcccggcuggugccugggccuaccccugguaaggguaaccugucuggaggggucacccccagcugcacccguuuccuuguccucugcugugugauucuggaaaagucacugccccucucugauggggcuucgggggagaucaggaaagagggugcaggcaccaaauccaggguugaguucccaaggguguggggaaaggagccccaccccaacaggagccagccggguggucagagccaccugccugcccccuacaggggcaggcucccucccacacggcucuugccgaggaugaagaggggaagccaguaccaaggugugggccuggacucugguagccucucugugggaccuuggacaagcucuucacugcuugcagccucaguuucuucacauacauggugggcaugauaccacgcagggcugcugggaggaggccauggaauuauuuuaauuaaaugggacggggucuugcuauguuguccaggcuggucucaaacuccuggccucaagcaauccuccugcuuuggccuccagaguagcuggacuguaggcauguagcaccacacuaggguaaaaaaaaauuuuuuuuuugaggcagucucacacuauugccaggcuggggugcaguggcacgaucugggcucacugcaaucuccgccucccagguucgaauaauuccccugacucagccucccaagcagcuggcacuacaggcgcgccaccaccacggccggcuaauuuuucauauuuuagucaagacgggguuucacuauguuggccaggaugguuuccaucuccugaccucaugauccacccgccuuggccucccaaagugcugggauuacaggcaugagccacugugcccggucuguuuuuuuugagauggagucuugcucuaucgcccaggccggagugcaguggcacgaucucggcucaaugcaaccaccaccucccgaguucaaucaacucuccugccucugccucuggaguagcugggauuacaggcgugcaccaccaugcccggauaauuuuuauauuuuuaguagagacaggguuuuaccauguuggucaggcuggucucgagcuccugaccucaugaucugcccaccucagcuucccacagugcggggauuacaggugugagccacugcgcugggccucacacuggacuaauuuaaaauaaaaauuugagagauggggucuugcuauguugcccauuuggccucaaacgccugaacuugagugauccucccaccucagccuccuaaguagcugggacuacgggcaugagcuacugcacccagcaagucuuaggaacuaaaugcuuuuauuuuuauuuuuauuuugagacggagucucaaucugucacucaggcuggagcaguggcaugaucucagcucacugcaaccuguaccuccuggguucaaacgauucuccucccucagucuccugaguagcuaggauuauaggcgcccaccaccaugcccggcuaauauuuguauuuuaguagagacaggguuucaccauguugguuaggcuggucuuaaacuccugaccucaagcgaucugcccaccucagcuucccaaagugcugggauuacaggcaugagccacugcguccagcccccaaaugcuuuuaaagugcuuugugcagaguggggcgcagucagcccaggcugguauaaucuuucuuccaccuccucagcaccuagugaagccagauucucuuugaggacaagagucaauuguuaggacucgauacacucagagucucucccagagagcaccugaaaggggacaaggugggguggggugcugcagggcgugggcccccggugugguggagaggccagcagcaguuucagguggauguggguuggggcugggguagggaaggcagcuaaagccaggaagccugggcccuuccuuucccugcccagcccugaggaauccccacagggaggggcccagugcaaggaccugcccaggaacucaggacugcagaugacuagauacccacaagagagcaguuccaguucagaaacagacaaccaaggccaaggccagauucuccccugcacugagccaggagguccccauuguuuccagguccauuuuuuccccucaauuuuuuuagacugucauaaaacacauguaacugaaaauguaccaucuuacccauguucagggguguaguucaguggcaugaagcacauucacuguugugcaaccaucaccaccauacacagaacucucuucaucucguuaaacugaaacccacaccccuuaaacacgacaccccuuccucccaccgccuccaagcacuccaucccacuuccucucucugucaaucugacuucucuagggaccucauguaaguggaaucauaagguauuuguccuuuugugaugggcuguaucacuuaacguaauguccucaaggcucaccacguucuaacacauaugagaauguccuuuuguuaaggcuuuuuuuuuuaagguguccauuuuauaaccacggaaaccggcucagagacagaagucuucugcccaacuucauaccgccuauaagugacagagguggcguucaaaccuggauuuacagugggcccagacaggcagcaccuccagggugggccauucagauggagcagaccccaccgagagcccuucuuggggugcaccuggguguggucagaaaugccccggaagggaagggagccuuugaggcgugggguggggguggcugggcuaucucugccuuacggaaagugcccuugcuuauccucccugugcucggcccucucagcuggcacugcguccuggcggagcuguggaacagcuucucucccagggccucaguuucccuguauagaaaggagcagcaaaccuguuaaacauguguccauguuguguaaaaaaugggccaaggggugggugcgcccaggccucugcccagccuggacuccuccuucccccucagcugcccacccccgcgucagacugcugggcugugacugcagagcugccgccaccaucacagacaccccuugucccgacuguucuggccuccagcuggcagagagggaggggcuauccaggagccaggacgccuuccccucucagcaccuugguuccccaugguaacauggcggaaggugacaaaugcccugugggcucucaggacuaucaugaagaucacagaaaugaggcuucccaaacuaccugugugagagcccaggucaguggagagcaagccuacaugagcuuggaggcaagggccgggccagggccagacuggcucugcuacuugugauguugggcaggugacuucaccucucugagccuuaguuaccccaucuuugaauggggcuaaagauaggcccugccuuagagggcugcuaaaaggccagggccugaaacauucaacacauccagugugccaaggccagccagagccugcggguggaugugaacaggaaguggagagcaaaauaggccuggcccagcccugccagagcaacccugacuucaggagacaccuggugagugaaugaaaagugcauucgagaguuaaguugggaaauggaagaaggaaaaccaucagagggcuccaggacaccugguaaagagacaggcggggccuggcacgcaguagguggacaauaagcacacccugguuaaagaagcuacuggaucaacuacuugggaggcugaggcaggagaauugcuugaacccaggugguggagguugcagugagcuaagaucgcaccacugcccuccagccugggcgacagagcaagacuccgucucacaaaacaaacaaacaaaaaacauacucaaugaucagauaagggaauacuaugcaaucccaaaagugcauuagaacaaaacacuugauaacaagaggaaauguucaaaguauguuaaaucuaaaaaguacauaaccccucugccauaaauuacacacacacacacacacacacacacacacacacacacacacacacacugaacaaucuuagaagugagguuagacugcuguuuauuacccuuuuucaccccaaacuuaucuuuuuuuuuuuuuuuuugagacagagucucacucugucauccaagcuggagugcaaugucgcgagccacugccccugcccucuauuuuuuuauuauaaccauuuguuacucauaauuaagaaaaaagauuauuuugccaggcacggagguguacgccuguaaucccagcacuuuggaaggccgaggugggaggaucaccugaggucaggaguuugagaccagccugacuaacauggugaaaccccauuucuacuaaauacaaagaauuagccaggcgugcugcagggcaccuguaaucccagcuacuuggaaggcugaggcaggacaaucacuugaacccaggaggcggagacugcagugagccgagauugcgccauugcaccccagccugggcaacaagaauaaaacugucucaaaaaaaaaauuuuuuuuuaaaucacgaucucaaaggaucaagaauagcuaagacaggccgugugcuguggcucacgucuguaaucccagcacuugaggaggcugaggugggcugaucaccucaggaguuugagaccagccuggccaacauggcggaauccugucucuacuaaaaauauaaaaaauuagccaggugugguggaggcaccuguaaucccagcuacucgggaggcugaggcaggagaauugcuugagccagggagguggaggcuacagugagccaagaucuccagucugagcaacaagagugaaacuccaucucaaaaagaaaagaaaaaucagagacugucuuaaugucauuaagauaggaauaucuuaccacaaaauguauaaauccuuauaggaaacguaacguauugaucacauuaaaguuaaagcauacaucgaaagacauaauaauaaacaagugaaaagaagccacagacuaggaagaguuauuuccaaaguuuaaaacuaccaaaagauuaauauccagaauacagccgggcacaacugcucacgccuguaaucccagaacuuagggaggcugaggcagguggaucauuugaggucaggaguuugagaccagccuggccaacaugcugaaaccccaucucuacuaaaaauacaaaaaaauuagcugggccugguggcacaugccuguagucccagcuacucaggaggcugaggcaggagaaucccuugaacucagggggcggagguugcggugagcagacaucguaccacugcacuccagcaugggugacagagcaagacucuggcucaaagaaaaaaauaaagaaagaaagaaaaaagaaaagauuaguauccagaauaaauacagaaauccugcauaaauaagacaaaaacaauccaaugaggggaaauggcaaaauauacgcauaggcaauucacaggggaaaaaugcaaauggaaccaauguaugaaauaauucuuagccuugcuaguaaucaaggaauguaaauuaaaacgaucacauaucacuucacucccccaauuggcaaaaacugugaacucuuagagaagguaggaugcacguacucuacaacccagcaacuccucuccucauuauuuaugcaucuuagaaagcugcuccacacauaagugagaaaccacacacaaggaugcucacugaagaauuguuuguaauagcaaaaaaucagaaaugacccacauguucaucaacaggagaaaggauacguuguucuaaucauacaauggaaaugcuuuaaaucaauuaaaguuaaugaacuguagcaacauguaucaauguggauaaaccucaaaagcaauguugauccaaaaaacaaguuguagaugaugcauauguuauauaagguuuucuacaagguguauacccaaguauaccgaagauacaaaagcaugcauggaaagucuccaaaccaagauaaugauuguaucuagggagggaagaaaauggggaagggacuucaacugugcuuggaauauuuuacuuaagugccugcgcacauucaagugugugcgugcgugcauguguguaucugaaacaauuacugcaaaacacugaagucugacaaagcugaguucuugauauggauguaucuguucuaguuuuuauacuuuucuuaaaccauuucaucacacaaaacucacugaaacacucaugcauuccuacccugcauagccagugcucuccccaaccucccacaggcgaaggcucagcggggagcagcagcuacugcaucuuaccagguuaccggagcagcagaggcagcuccuccuaccagcugcugcuccucagccccugaggacccugcagaacucguaagcacucccuaccugguccugcccugcccccagggagauguagaagugggcaucaugcagaacaggcccuucccacaaggcagcucaagcaggugccuaggacaaaugggaccagguuccuggccagggccagggcaucucugugccuggggguuaaaugaguaacccagagagccccagccuucccucaggcacagguggaucucagggagcagagagagcaaggacuuggaguuugggacauguagguucaaauccagcuccagcaagaaauaauucugugaccccaggcaaauuguuuagccuaagccucugcuuuuacaacuuauuuuauuuuaucuuggagacagucuugcuuugcuccguggcccaggcuggagugcaguggcacggucuuggcucacugcaaccuccaccucccggguucaagugauucuccuaccucagccucccgagcuucuacaacuuuaaaucaggaauaacgccaccuuccuuguagauguguaugcagugaccccagagacaucuaagagauauuaagcauaaaagaauuuugcugagcaguauauaaaauguguuaucugcgaaagaagccagucauaaaaggcaaauacuuugauuucacuuauucacauaagugaauagacagaaaacagaagggauaccagggccugggggagcaggaaauggggagugagcguuuaaugggugcagagaguuucaguuuugcaagaugaaaacaguucuggagaugggugguagugauggauacacaauaugaauguacuuaauaccauugaaguguacacuuacaaaugguuaaggugguaaauuuuaugucauguguauuuuaccacaaugaaaaaaauuaggaaauaugauaucuuuuuuuuuuuuuuuuugagguagagucucacucuguugccaaggcuggaguacagugguguggucuuggcucacugcaaacucuaccuccuggguucaagcgauucuccugccucagccucccaaguagcugggacuacaggugugugccaccacuccuggcuaauuuuuguauuuuuacuagagaugggguuuugccauguuggccaggguggucucaaacuccugaccucaagugauucaccugccuuggugucccaaagugcugggauuacaggugucagccacuguaccuggucuguuacugguauaauuuuuuuuuuuuugagauggagucucacucuguugcccaggcuggagugcaguggcaugaucucugcucacugcaagcucugccucccagguucacgccauucuccugccucagccucccaaguagcugggacuauaggcacccaccacaaugcccggcaaauuuuuuuguauuuuuaguacagacgggguuucaucguguuaaccaggaugaucucgaucuacugaccuugugaucugccugccucagccucccaaagugcugggauuacaggugugagccaccaugccuggcaauuuuuuaaaacaagaaugauggcugggcacgguggcucacgccuguaauccuagcacuuugggaggccgagguggguggauuacuugaggucaggaguuugagaccagccuggccaacauggcgaaaccccgucucuacuaaaaauacaaaaaaauuagcugggcgugguagcacacaacuguagucccagcuacucagcaggcugaggcaggagaaucacuugaacccgggaggcgcagguugcagugggccgaaucugugcugcuguacuccugccugggugacagagugagacucugucucaaaaaauaaaauuauaucaauaacaaacucauuacuguguacagaaaagaauuuagaaagcuaugcacagaacuauauauaguuaagucuacucguggugagacuguagagggcugucuauauuauacauucuuccauuauuuaaaucugguauguuuaugaguagaaaaacugcuuggaaauaaaucaaaagaccuuccucacugugugguuucucaggaugauaaaagaauuuaugcguagcugccauccguacauuagaaacaggucagccucauccucccugcccugccucguaacacucacgcucagcagcuugcgguccucaccuccugggagcagagcagggaggaguucagaccccagaguugggcaacucaaacgccaaccccacuacugccucacuggggccucagagccucuguguccucaacugcaagauggaaauauuacauccuaaaauggguuauagcugugaaauggguuaucgugagaauuaaaaguaaggcaucaugugucaauacagcaccgggcacacucaggcugucguuccacggucccaccugccaucgcagaugacccucccagaauucaguggggacugaccugggugagggcggagccucaagcaccaugucucugagcagggccagaccacucagagacccacaggaccccccaggacucgcagaaccucgaaaacucgcagaccacucagagacccucccaggcucaggaccccguguggcagaguuggccaucugcucucagagccagucauuagguucagccccaguccacauccccuggaugcuucucgaagacagggagucaagaaaugacaagcugcccacucugucccagagagagacccccccagcacgcaccagaccccaugugggcccacagggauuuggcguggcucccacaccugggcggcaggcagucgggcugcggguaaacagggcacagagagccuuuugugaaagcacaaacaaggcugagccaggaaaacuucccaagcaggaggggaggcgggagguuggcaccccuccuguaccagagaugggaaggcuggcccuccagugcucucccagggagcgcgaaggggccgcucucaacaggcccugucccgggaggguuccaagccuguggaucugcucccaccacgggccaugggucaugugcuuccccugucccagagccagagugggaggagaggucucagccucgucuggcacacacagccuccacccuccccagggcggacacugcccuggaggcccccacacccagcuggggugagucagaggcugcuggcuggggguguugccuggcuugggacucgcccuguguagaaggguacacccucacuuccuggggagaggaagaggggagacgccagggcuggagggggaggggagcacgggucaguuccaaacugcucucaccugggcugggcucccaaacagguucauccucacaccaacuugcaagggcguggcccgccuucuagggugaaaggcaacaggugagggacacccaccugggcuucccccagcagcuccggagccaagcagagagaggcagcagguggggcuggaggugcagccucaggaccugcccucgcccugccaggcuggggcaggagcgcccaguuacugaccgucaacuaagugcccaguauguccuugccccaucucccaaccuucaugcauagcagcaagguggcacccaccucaccacgagaccgugagaaagucccuucaccucgcugggcucugguuuccucaucuguaaaauggguugacaagucuauugcuuggagggcugugaugaggacagaaggagacaguccauauaaagcuuuuggacuagugccugccauacaguaaggcucuggaacguucacugcuguuauuauuaugguagaguuuaaaucaguccuuuuaugggugugaugucggaggcccagagaaguuugguaaccugcccaaggccacacagcuaggaagagcugggaagaugcaccccaagcccgacuuuccauugugccaaccugccucaaagacaagcaggccucccggacccaccugggacccaggcccuugaagauacuucuugagacaagauacucuuuuccuuaggggguacauggaaaccagggcucuacagggaaccccaucaggccauacucagaugccucuggucucacggguacugcuauaaggaagcucuggaagggagccuagcccuggguuuagggccagaaggcaguguugggucugggcccugggggcagaagggccuagaaggcaggccguuuuauuuuuuuugagacaggaucuugcgcugucgccgaggcuggagcacaauggugcgaucaugacucacugcaacuuugaacuccuuggcucaagcgauccuccagccucagccuccgaguagcugaaacuacaggcaugugccaccacaccuggcuauuuuuaaaaauuuuuuguagagauagguuguuauguugcccaggcuggucuggaacuccuggguucaagcaguccuccagucucaaccucuaaguagcuggaacuacaugcacaugccaccacaccuggcuaauuuuuuuuuuuagacgggaucucacucugucaccaggcuaaagugcaguggcacaaucucggcucacugcaaccuucgccucccggguucaagugauucuccugccucagccucccaaguagcugggauuacaggugcaugucaccauacccggcugauuuuuguauuuuuuaguagaaacgggguuucaccauguuggccaggcuggucuugaacuccugaccucaggugauccaccugccucagccucccaaagugcugagccacugugccuggacuaauuuuuuuuuuauuuuuguagagacaggucacuauguugcccaggcuggucuggaacuccugggcucaagcaauccuccaccucagccucccaaagugcugggauuacuggugggaaccgccacguccagccaacguuuguuggcucauauuugcacauggagucacggccacacacgguuuacaggucuuaaccuguuaugaauaccagcgcugccuucuuagacagguuaugaaauguggccaccaguacccuagagaggcagcagacacaucuucugcugagaucccaggggagugggcacuggccaagcccuaggugagccagggggaggacuggggggucugacagagggugagcugccugguacccgacucucugggauggaagggggcuacccccagggauccugacucauggagucagcugggagaugcgaggugucccuucagggccaggauucccgcccaccgcccccgcugcuggucagugcguuugucaugcugcccgucagagggcgcagguuuggcaguggcacucugacggcguccagguggcacgugaaagcuauggaauuuuacagccacuuuuacuccacuggaacauugcucuaggcgugaggcuuagauugcagcaagcaauuuaauuuugagguuuuaagcccucaagagacguuuagauguagacaaacuugcugcaagacgcaagacgcaacagaaacgcaucuggaagacagcagggaacauuuguggcugggaguaaaagcccuucuagaaaccucagccccacacguccuugaggagggaagguuaagccccucgccuucccagcacacacacacacacacacacacacacacacacacacacaaaaugaagccacuaaaaaacaacugucuggccaggugcgguggcucacaccuguaaucccagcacuuugggaggccgagguggguggaucaccugaggucaggaguucgagaccagccugaccaacaaggugaaaccccgucucuacuaaaaauacaaaaauuagccaggcgugguggugcacaucuguaaucccagcuacuugggaggcugagacaggagaaucacuugaacccaggaggcagaggcugcaaugagccaagauggcaccauugcacuccagucugggcaacagagcaggauuccaucucaaaaaaguaaaauuaaauuaaaaaaauuggccaggcgcaguggcucacggcuguaguccuggaacuuuggagaacaagguggguggaucacaaggucaggagaucgagaccagccauggccaauauggugacaccccgucucuacuaaaaauacaaaaauuagcugggcaugguggcgggcaccuguagucccagcuacucgggaggcugaggcaggagaauagcuugaaccugggagguggagguugcagugagcaagauugugccacugcacuccagccugggugacagagcaacacuccaucucaaaauaauuaauuaauuaauuaaacaaaaaaaaaaaaaccuguccagucccaguccuguggggagcucagcccugcuuccacaccaagggcaugaguucugcgguagacgacugggacuaaggcugaaagaauggcguccggucaguguuucucagcauuguuuguagcccaccagccucacaacugcuggggaagcaucuucaaaguucagauuccuggggccaaccuuccagggcagacucugcaggucugugguggugggcccaggggaacagcauuuuagacaagcuuccaggugacuuugaaggcccccaaaagccugggaaccugagaaaagaggguaauggagggugaaguagaaagagccccagcugccaagccauaccaaccuggguucaaguccuagcuuugccacauguacacuguauaacuuugggccagagaccucaucccucuggggcuuggucuguaaaaugguaaagcaaccucacacgcaaggcuguggcgaagguaagaugggcaaaugcgugcagcaucccagccuguggcucagcacugagacauggugcugagaaugaccacggacuaugaaggugcuacugcaggaaggagaagccagagacgcugagcaccaucuguggaggggccagcucugcagcucucucccaagcaguguaugggagagaaaagagacuccuggggaagaauggaggaagugacgugggggagggaaagcgacaggacagugagccugaaaaacacaggugagaugucaggagcucuggcacagaccucacucccagcgcgauccugccagacgcucucgcagccccgcaaaacgaggcugccacgccuguaugcucuccuugcccaaacccuuccugaggucagcuauaccccaaaagagagcaucuuuggacccagguggcagggugggcccuccuccugcuccucaccugcccacucucagaacuaaaacuugaaaggagcaugccaaaaggaccacaaccaacacuuccuccagauacagcaaggguaaacugagucagggucugccuguuccuuccuauccccaggaagggcugggcucaggagaacaauggcucagacucaauuugucucagcuugauucauguguguccccugaacccaggugguggguggaggccaaaaccccucaggccggcccaugcgguucauuccacgccauccuuggcaaaaaggaggaauuaugaucugacaagcaggaccugcugcuuccugcucagcgcugcccagcaugaaagacuacagcucaggccuccccucucuccaggggacagaguuccucaaaaccaacaggaaacuccuauggggcagagccaggaguuggcugaccuuaucccauaaacaggagagucgacacaaucacacaccaggcacuuccgaccucccucugcugcuguaaaugcccaaacagcucaaaacucccagcaugugagggggaggggccaggggggcucaagggugugcauucugccaggaccacacacagcucuaucuaccucuugcaugggaaagagguccaggggagccgggcgcgguggcucaugccuauaaucccagcacuuugggaggccaaggcggcggaucacaaggucaggagaucaagaccauccuggcuaacauggugaaaccccgucucuacuaaaaauacaaaaaaaauuagccgggcgugguggcgggcgccuguagucccagcuacucgggaggcugaggcaggagaauggagugaacccgggaggcagagcuugcagugagcugagauugugccacugcacuccagccugggugacaaagacuccaucucaaaaaaaaaagagguccgggggauaucauuauaugaaacaaaagcaaacugugaaucagcaacucaaacaugaccagauuuuuauaaaaauaagcaaaugguaacaauagauguggaagaauauaccccuucccauucacaccucugaagaugagaaucagcagagacucauuuccuagaugacauuaaagauccaaacaggucuggcaugguggcucacacccauaaucccagcacuuuaggaggccaaggcaggagcaucucuugaacccaggaguucgagaccagccugggcaauguagagaggcucuaucuccauaauaaauaaauaaauaaaauuagcugggcacaguagugcacaccugcagucccagcuaguugggaggcugaggcaggaggaucgcuggagccuuggagaucgaggcugcagugagucaugauggugccacugcacuccagccugggcaacagagugagacccugucccccaaaaauagccaaacaguauaaaaccauauaaugaauauacaacuauguugguaauuacaaaaaaaaaaaauuacuauuucuuuuaaaauccaggcugggagacucaggccuuccuucacacaaaaaacugaggugagagauaaaggcaggaaggccucagggcagacaacagaagacccuggcccaggauuccagggucuggauucaagccgcauguccuugccuucuuuacagaugagucugggcaagcugcuuccucacucugauucucaguuuccacaucuguaaacuggagauaauggccacugccuaagcauccucaaauggucaaaugagaucaccgaccugaguaugucuggcaaauuacacagccgucuauacacacaccagcuaugacucgggaccaccuucuaggacaugcacucugccaacugccugcucuaugucaacauauuuaauccuccaaauguucuaaagggacucuccugccucugggaacuguuuuccaaagcacaggccaaggaaucccaguccccaaagaugucuacacgaucaaauaaguguggggaaacacgagucgcuagcucccuuaucgugaucagcucaauccugaugacggcucugauucaagacucugauaaguccugcagcaaggauaacaagaagucuuuguuuccuggaauuaucaaaccacugugaccgaagaaacuggugucucauggaacacacuugggaaacgugguccacgcuuuuugggaaauguggucaugaggcugcauuagcaagacccagacugauaagaucuggggugaaggagaaaaaacagagguuugcaaugaaacaacucagcauucaaugagugcggcaagcacacauuacucagcgggagaaggaggaagagaguaauucugcugucugccacucuacccuggaccuacagcaagaaaagcaaaggacuguggggauggagaugcuacccuuugcuccccaggcugggaagggcacuugacuggagcuggagcuggcugagaaggagaggggcccaguccuuaccccaaggauggcucugcuaucugcgcgucggcugucggugcugaggcuggcccgcgucugccugugcaggauccuggcauuccuuuugcuccauggacgcugccucccuacaaggaagcgagagcugccgucagcaggcacaugugugacugucgcaguuaccugccacaccgccagcacuuccugagagccugcuugguagcaggcccuuggcugggcucuggggugacaaaagagguuuuuuuuguauaguggugcaaucucgguucacugcaaccuccgccucccgcauucaagugauucuccugccucagccucucgaguagaugggauuucaggugcgcaccaccaagccuggcuaauuuuuuguauuuuuaguagagacagcguuuccccauguuagccaggcugcucucaaacuccuaaccuccagggaucugcccgccucggccucccaaaguauugggauuacaggcaugagccaccgcgccuggcagacaaaagagguucugacagagcaccucccuccagaaccuggucuacugaggaggugccaagucaguagcgacggucugagagcucagagcucugcugcgggggagccaggagaagcacuagacccagacuaguggggucagggaaggcuuucuggaggaggaguugucugaguugacuccuaagaguaggagcuggaaaaagagcauuccaggcaggaggaacagcacauguuuaccuggaggagagaguacauggcaucuggagaaggcuugcgggcucggcauggcgagauccagagccagagaggggaaguggcaagagaugagccacagugggguggcugggucaggcagagaccagccagugcccagacuccaacuuaaacaccaaauccacccaucaucuccgacagucaaccagccucuggugagcaucuacuccauaugcgccagacacugugcagaacugugcaugggaguggcaggguagggaaagcugugaucacuacgacacggguuucggggagccaggagcugggagaguggcccagccaccagagagagccaaaggaucagcaggaguuacccaggaaggaggagggcggggguagacaaagacaccuggacugaucuaggagggauggcuguuuuuccaucauuucuaccacuggguauuuacuauauugacuaaguuccaggcccugugcugggagggcagacauggaagauggucuccgccgucaugggagguaggucaauaacccugcaauuccauacggggugguggugacuaggcaguaaaguaccuacagcuauauaggcacggaggccauccaagccaaccucuaccucacucuacccuccuugucaaggauggggcacccacugaggcugggugguccaaucaccugcccauggcagagccagguccagaacuugggccccuggacucccugucacuaauuauucuagucccuccucuuccagaaagcauacccugaccacccccuacauaaccacccagagcuaauuccuucuuccucugggcugccucuguaauauuucuauuaauaugguggccacaguauaucagaacuuaugugucuucugguuugccuguccucccagacugcagcucucaggaggccagggauguuuucccagccaucccaggcccaagacaggcacuuucuaaagaauggcugaaugaaugaaugaaugaaugaaugagucaaggcauggagagacacugugcugggcucuaagagccccacauccaucccaccugaaucuccaagaggucuuggcccaucagugugugccucaguuucuccaugugaaaaccuggaaucagcucuacucuaagacgaggcagucaggaaccaggcugauuucccuccaacuccuacaggcaagguccaggccaagccaggcagcaacccaggguccggccacuucccugaguucugacccacggcagugauccccaggauucccuacaguccagaaaggucauucaagaguuugcaaaggaaacggcuuccuggugggugugccuaagggauggagaaccaccacaucuagucaaguucuggggggaagucaugaacauuuccugugcccccgcucuguuuuuuuuuuuguuuuuuugagauggaauuuugcucuucuugcccaagcuggagugcaauggcgcgaucuuggcucacugcaaccucugccugcuggguucaagcaauucuccugccucagccucccgaauagcugggauuacgggugcgcagccccaugccuggcuaauuuuuuguauuuuuaguagagacaagguuucacuauguuggccaggcuggucucgaacuccugaccucgugaucugcccgcuucagccucccaacgugcugggauuacaggcgugagccaccacgcccggcccugcacccccugcucuguacccuauggucccuagaacgcagagggcaucagaccccaugccaaagcccugagaccaggaaaacaaggaagcagagaccagccacccagucacucaucccuggcauguccacaacagccuccuccagcacaggucaucuguccuugccucacuucaugagccagaggaagacuugaccuucauggaagcaacaccagugagacugagcaaucagcacugcccagucucucugaacaaacucccacucccacauccccuccacaggaaguaucagcaacagccgaucuccucccgcuucuuacagccugucugucugccagguugucugcuccaaagggcagaauacaguuuggcagggguuaagaguacuacuaacagaagagguggaagagguccuugggaacuucgggcucccccaguucccuuccucuuaccaggugcucucccuccacaccucauucucaaaaggcuuccugagguagggcaggggaagaggagucaguggaaguguggcucacccaggaaccgcccacccuuccagccaagucuccaucaggaggcggcuaccagacaacccccgacccaucccuccuucccaaaaaaggcaacaaucgcaacagcugagaaccggcagaccucgguucaccccgguccagaucaaggggaagaagcagucagcgaaagcagcagaaucaucaugaacuccaugaccccagcuaugccccuucagccugggagcucaguuugcuggguauccagcucaccuagggcugcaccaggccuggaccucacuggaucucgccucgcccucgggcccaccugaaugcacaggacugggacagggucuggguucuuagauuccggaccggucuucccaaauaucccaucccagaaaggccccaagagccuagccggggauccugcccccaagucagggcacugcccccaucggaacgauaggaaggaggggugcaagggaagagaaggggaccaggaacucaggagaagacagcuaaggaaaucuuugaaaaagaaauggcaaggagagagcccagagguggaaccucuaggaacgggagaguguguguggaggggugaggaucuggggggacccaggggaugacaaggggacaugggggagccgaggcggaaacuccugguuucugaagcacaaggaggcacaggggugccugggagggggcucgcgcgccgcggagccggcgagaagguggugccccggagacuccgggcacuggggagcccagagguaggccgaacaccgcgggagguccccagggggccggcccggagacagagccccagaugccccgggcgccccgggccgggcagcuggccgagggcguguguaaguggguuucgagaggugacagcucgcgccccuuuccccaccccguccacucaccugggcucgccgcgcccggccgcccggcaggcagccccaggccccggccgcuccgucccgccgccggccgcagcgcugcuccggcgccuccuu

SEQ ID NO: 13133 - RNA, 9489 nt, Homo sapiens
ccaggggccccgcucucugauucgccgcucgggccagcccccacggccugcacgcugaauggcugcgccgcuaccuauauuggccuccgauugggugcacggcgccuccccggcgugauaggucaggaccaccgccccccuggcuccccauuggcugcucgaagaagcccggucuccggguaagauggcagcggacggacagugcucgcuccccgcuucauggcggccggugacccucacccacgucgaauauccugcagguaaaaggcggucccggcuccaaggacgccuucccagggacggccucucagucccgggcgcuccggccugcucgagcccgcggagggggcgccgggggaccggggugggaacugucaaauagugaaccacggaggggcucggccggcgcgcgcgccgcgcaggcgcaguggugcgaggaugagcugggcgaaauugugaggcgcucgcucgcgcacucugcggcugcgcggccagggcgcucccccgggucccggggcgccggugggcugaaauggguugaggaucugugugaggcgagaaaagaucccuggccuggaccuuggcccuucuuccccgcccuccccugucccagagaggccgcacuccuguuccagcgugcagggagugucuuguuuccuucgaacagugcuuugggcugcuuguaagagaaagagcuccccguugcugggagugugcaagccgaagccaggcuuuugaguacuuguggugccacgcccugagcagggcacgauuccacaacagagaggacccgaugagggggcgggcagccuccgggaacuugacuucuguugcuucccaucagacacaccucucgaagugcagggcuuuccaguugagagguccauuagcggcguucuggaggcugucuaguaagaguggcgcagagccugggcgugggggucagacccaucugggcuccaguugaggcugaggccuugugcaggugccugccucugcuuaaguuaauucaucucuaaagugggacugauuacagugcuuaccuucuggugaugguaugagcaucaaauagcaggaggcacaagaagggcugaguacagugcccggcaugcaguaagcguucaguaaauaccugcaguuaauguuaucccaccuugcaagacccucccuggguaagaugguugagugccagggaaggcuggagccccucauugagcccugguugccugggaagggccugcucaugcugcugucuugcgagaugugagaaccuggguccgcugagggcaccaggacugaaugccaaagaacguugacgcugguguucuggguuguacugggggugguauggcccugccagguccugggcccugccugccugccugucuaccauucauucauccauucauucauucagucaauauccacugaacacuucugagugcuaggcccugggcuagcucugguuuuuagaaugcuuaacaggccugaaauaucccugcauuccugcacuaugaaaaccagcugcuuuauaagaggaaagccaaagccuggagguggggaaagacuugcuaaggccucugcaccuucacagcuuccccuccuggccucagaguagcuucuuggagugcucacaauccaacaagccagaaggaaccuggcaggcaguugugugcagcaugauacaggcugugauggaccuggcugagccuggagcaucuggugaggucuaguccccuauuaaugcuuccaugguucccugcacuucuccgucacaccccucuucacaccgucacuugcuuacuucauucauucaacaguuuuugagcccaguuaagagccaggcccugugcugggcuugggggauagagugggauauaaagagacccugucucuacucccagaugcuguccugauaucuacauuaguggaucaugaacugagucuggauggcagauucucccgucagaccucaagcucugcacuagcagggacauaugugucuuuuuuuuugccacugugguggguucuuaguuguuuguugaguucacccagagagcgucccagguggggggaaacugugugcaaagguccagaaguaggacagggcacgaugcgcucagggaacucgaguuugguccuuggaacuggagcagagguugagagggaagcagggccaggacugugcagggccagaugagcugggcugagggggaacuuguccuaagggcagugggaggccugagggggcuuggaucagagaguagagaggccagagucccugguagcaucuucaggaaaaccccaggguagugcuggcucugggacaggcuauggagauggcuaaagcuuuggggguaccagucacucacuaucuucauagcccagugcugugagggugagcuucauaguggagaggcccaggaaagagaagggacucacccacugucacccagugggacuguggcagcaccagcacuugaccccaggcacuuagcugggcugcucugcucucccagaccaacuccaggccagucugauccuggguaggaugggcuggguaggauccuguguguggaugagaccgggcaugugugugucuaugucuucagcccuggaaucugggcucagcccucuguggacaacuucccugcugcuugugugaggcugguggcauggaccauuucccacacuggguucucuccaccucugccccaacauggaaguguccugguugccagggaccaagcugggugucucacaggucccaucucauugagucucaugcagcuguaggagguaggcacugauaucccuauuccacaagugggugagcugaggcuugaauccuugccucaguucaugcagccagugagugugggcauaggagcugaaccaugcucucagaccccagaguggcuacauagcugccugucucaaguggugaggguggccuucagacucagccuccccugcccuuggauucucagcuugaguguccccaucuccuaaaaggggccaguguuccucugcugccuccaucccaggagugaugggagugucagaagcugguaaucaauagguaggcaguuuccugccagagaaguggcgcgcagcuguuaccgucgcccuauugggcuugguuucuguccgagucuucaguguggacccaagucugugugguguccagagaacgucggauuucccuggaggcccagggcucagccagggcagccccagcacaacaguguguggcucucaugugccugccgggcugccucccaggucccaggcuccaccucuggagucaccaggccggguucaccuuccugcuuuggcaggagggauuggucuagugucuggaacaggucagagacuuggacuuuaguccuggucccaccuccuucuggcugugugaccuugggcgagucacauaguugcucuggaauucaguuucuucaucuauagaaugggaacagugaaggcaccugcuuuaaacgcaugcugugugcacuuuagugcuaaguaguagacagcaucacguauggcugugacugaguuggcacaaucggccgguaaacaggugucccuggcugccuggccuccauucuccaggcccugccgggaccuccuuucuggaucaggccuuacuuguagggggcuggucccucuucugaugccugugcccuguccuccugauucuguucucugucuugccaggugaucucucuggccaccuccuugccuaccugagccucagcccuguauuugucaucgucgguuucgugacccucaucauauuuaagcgggagcugcacacggugagucugucuugcccacacccuccccaccccacccccagugcccccacccugcuuugggaagcccguccgccccucaguccaggguucucaucccugcguccaccugucuugaggugcguggagccuccuggcugguucuagguuacucaccuguugggcugggagguucagucagaggccauggucuuugggacuagguagcagccaacaggugcacagaggcccagcugaccaugcgucuuccccagcagaucuccuuccuugggggccuggcacugaacgagggggucaacuggcugaucaaaaacgucauccaggagccacggcccuguggagguagggccucagcugcgagggccugagguucccccagguuggggcguuacugggaggucugcauccccccgugaugcccuggucuccucucucucccaggcccccacacagcagugggcaccaaguacgggaugcccuccagccauucccaguuuaugugguucuucuccgucuauuccuuccuuuuccuguauuuaaggugaguuuccaccccggucaggauggcccugaacuugcucaggccgaguucugcuagggacucacugcuagcccuuuggaugccccuggggugggaggggcugcagcggaggcagaagguacccagggagcauuuggauggggccagggacuguuugggaggccugggcugggcugugggcugaggucaucuggugggccuguuuucgcagaaugcaccaaacaaacaacgccagguuccuggacuugcuguggaggcacgugcucucccugggacuccucgcuguggccuuccuagucuccuacagcagguauggaggagggagagccccugccugcacccugcccaugugggguccugcugguuccuggucccugucggaccccaccauggacccuagucccagaaccuguagugcaggacuggaaaaggggucccagaccucuaguuuuaaaaggacagggcuccagcugccucuucuagcccaguccgcacugagcccaagauucugggaccaacuccacguaucagccaucucuucccagcguuccggaggagcccacuguagacaaauucagaggucaagggcuagaugggaggcaggcagaucccagcuggcccuucacugcuacagaugggagagcuguguuugggguccagcgcccucccacuuggaaauggaucugaggcugugccccguggagucaguguccugucugugucuccacaugugugggcacaggucccugggaagcuggcacaugggcaguggggauugugcgggccugugucugacuggcucucacauacuucgcuucuggccuuggcccagggucuaccugcuguaccacaccuggagccaggugcucuauggaggcaucgcuggaggccucauggccaucgccugguucaucuucacccaggagguccucaccccgcuguuccccaggauagcagccugguaacugccuccugccuuccugggcacugugggcccuguccccuccuguggguggggccaucagugggcggaccuaggagucuugaccccagccccugucucccugggaaggccccagugccccaggguuuguggcagagacacaggggguuuccucaggcccggaagccagagugccauccucuguccucgccuagguucucagggacuuagaagccugaguccugcugggcugugugugccgugggacagugccccugccugaggugacacaggugacauagcugggucucucaguggcucuggggucucaggccaggcaaagacucuaggcagucggggcgggugccgugccagccccgggcaaugguggggauggcuggcaugguaacagacucaugcccugaugugccccuggcucucugaugucugucucuccaggccugucuccgaguucuuccuaauccgagacacaagccucauucccaacguacucugguuugaguacacgguaacccgggcagaagccaggugaguucaggggacagcagugcucacugggccagccacaggcagccucugccuccauguuuggagggcucuccgggagccucgcgccugccuaagcacuucucuugcauuaacucauugaauccugcugugacccccauuuugcagaugaugaaacugaagcuuggagaagagaagucacuugcucgagaucuugcagauagugggugggggagcaggguggugaacccaggcugucuggcccagggcccaugcuuuuaaccucugcagcccagaaccagagagcugggcagcugagguucucagggcuccuguguguggacaucccuagggauuaguccagaugcuuucuuaggccuggguaaacugaggcacauugaguuaggaggccagccuguaguugugcagcaagucaggacagagcugagcuuuggagacuccugacucaugcuguuucauucaccccaaauccugggugagguucuuaggggagugggaaggcuggcuuuucuuuuuuuucuuuuuuuuuuuuuuugagacggagucucgcucugucgcccaggcuggagugcaguggcgcgaucucggcucacugcaaccucugccucccuuguucacaccauucuccugccucagccucccgaguagcugggacuacaggcgcccgccaccacgcccggcuaauuuuuuguauuuuuuaguagagacgggguuucaccguguuagccaggauggucucaaucuccugacuuugugauccacccgccucggccuuccaaagugcugggauuacaggugugagccaccucgcccggccgaaggccggcccuucucuggguucagaggggagcugaggcuccacaggaagccugggagguuucuaggcaggcugagagggacuguggggcgggguaggguggggcguccuagcagccaggaaacguguuuagugcaucaagguccaaauuauccuaacgagcuuaagggcaaagccggggauccaugaggaaaggggauuggaggggguuagggcaggcaauccuauuagaggcagaaaggucccagcuggccccgcugaucucucacuggccugccccgccucacccugcccugccccgccuggccggccuccaccugccuucauuuaccaaaaucucagggcacaccuguucugugccaggcugugugcugggggcaagcacagugacagccaugguccccugcucacuguguucacggcaggcagggaagagcugcgacgcaccugccuaugugaucagugcuguggccugacagcuugugucgggagccuauguggggacgugggagcuggggguggggggagguggggggggauggggggauggggaggguaggggggugggaggguguuguggggguugggggaaacguucucagcagagggaagggcaugcacaacuccugaagcugacaaagcuuggugacugcaccagacggaggcugccggggcuggagcccagggagcaagggguguguugugggaugaggcuggggacagaucacacaggaccagucagguuucuagauuuuaacugggacccuagacaaaccccauucuccucuacugagucucugucagccccucuagaaaaugggggugauuggcccugguucccucagguuccugggcucacucuggauauagccacagcccaaauugggugcucaaauccccucaguaaccuccaucaguaguucuccugcuuucgcuugcauaccucccggauggggagcucacuacauuucuguacuucuguuuugaucaauaacaacugagcccacuugugcugccucgucuauaaagcgaaacuccccauaacuaauuggaacccagccaggucccucuugccucuguagucucauccuggucccuaccccugcuccaauccccuggcuccacuucugggauugcagagcugagauaacugagguacaggccucgccggggagaucagcccugucuaggugccauucccagggcaggugcucugauuggcccaguucaggucaaucgcuggcuacugggugugggcauuugccuacuuaguugggacuacgggugggguggggacagcuguaggucacugaacaccagaugucuccacaucugacccccauccuguuuugcaggaacagacaacgcaagcuggggacgaaacugcagugaccaguggguguggcuggguccagccuccagaucuggcccgcacgaugccuugcaggauggacaggaugacagacagggacgaagcagagaccucuacagacccaagucaccaaguggagccuuuuuuuuucuuauuuuaauuuuaaugaacaagguggaccaaagggcugaaccagccccucaaccaggacccuggggggccugcugccugggggccguggccagagacccucgcugugcugcugccagccccuggcugggcagaaagugcccucggcaugggcaccugggugugggguggaggaggagggcucgcgccucuggucucggggccaggaauuccagguggcgugagaaguacacacuauuuauuuuuugguuuugucagaggcaggcaggauuuuggagcuggaagaaucugcucuccgguggcugcccugugaacagagggcucccggucagcuucccaggcccuucgcccuaugcccagagggcagacugccucucccugggccgggguggccugggugccaggaggaggggagcauaccccacacccucccugccaccguugccguuccagaaccucggucaguguuucccugucugggggcagggcccagagcgagcacgcgucuggcggcugcugucguuguguucuaccccguacugacccaacaccacaagggcuuucucugguccccugucccuaagacaauaaucgcuuucugacaaaggagccugcacauuugggugagcagacccaagcuguuuacagcucuuucuuguccugccauccaguagcaguuagucuucauccccacgugaacaaaaugggaaggagccgugaggagaggagugaggcaacaggcacccgaagucccucguccuucccucugugugcucugaauauguccuuguccuuccugacccaucucugaccagcugggaaccugcuuggggucccccucaaaccugugucuggggugugggcucacagaucccuaucagccugguucgugggagggcucuuccuaaagggacccccaucucuaagucacucugaaagggaguuguggagaggagacgccuccagacucucagaaguuuugaggacugaacugggucacucgggaucuguguucgaauccuccccaccccuuucuuuguggaguuuccuaaccugcugcugaagcacaauguuuuggugcuuucuuuucucauuuguuaaaggcaguguccaaaagccauuccagaugccaagaccaggggcuuauuucuagggaagguaggucgguuuccauguuucccucccguuauuuuuauuuuuuacuuuuugccugagacaagccgaguaugaggugguuugauuuaagaaaaaucaaugaaauuguuuacuacuguuuuaaaauaaaaccguaaacucugg

SEQ ID NO: 13134 - RNA, 22659 nt, Homo sapiens
auaaccgaaaaccgagaguuaaagucaccacagcgaagacggccgccaugucggugcggggcgcucagggagcaagccuauuaacggccggcgcgcggcggacgcgcggaaccgggcgacggccaugucagugcggggcgcgcggggcgcaugcgcgccaacggccgccaagcgcuaggaccgcucacggccgcccgaacgucgggcgccgcgacugccacgauugugcggggcgucaaguuuggguugugcucagccauguuuuuccgggacagucuccugucccggaguaccaccugucaucuuugugggugguacugacccuaacccaaggaauauuagaggacauuccccggucaacaugguuguguuuuccuaucacucuaagaguuaggcucaaggacaccagacggaguuggaaaggugcacaccacuaccuccaacagcuuagaagacauguggggacaggggagagacagcuggacggugaccuccuccuuccuccuccacaggucucaaugacucgcccucggcccugccccucuguccccgcccgccguggucccgcccccgacucgcagccagccuacugcgacccgcuaccgggcgacgccccgccccuccguccccgccccuccugucccuccucaaggagacuccgccccaucgaugccccguccccgccccacagccaaccucccgggcaccguugcccgcccggggcccgcuaccggcccaggccccgccucgcgaguccuccuccccgggugccuucccgcagcccgcucggcccagagggugggcgcggggcugccucuaccggcuggcggcuguaacucagcgaccuuggcccgaaggcucuagcaaggacccaccgaccccagccgcggcggcggcggcgcggacuuugcccgguguguggggcggagcggacugcguguccgcggacgggcagcgaagauguuagccuucgcugccaggaccguggugagugcggcggaucccgggccugagggcccuggacggccugggcgggccgugcgguugcguccgggaacggagaccgcguccugcggccgcuguucgacccggccuccagcugaugggguggggucaggcgggcgucccagguuuggcagagcaggagauuggggcgcaaggucagaagcgggauuaaacccacguccuggagcauucaguuccaacgacccaggaaagacaagggggaccccggcuucaguuagcacccccacccuuagacccagagacaggccgguaggggagagagaccaggagcauccagacccuagcucacucucccaguuauucuccgauugacacacccgucgcacgcuuaggccagagccacuccuccgacccuguccaguuggucacacuccuuugguuuaucagacggucccuggggaauuguguguggccagagaaacacgcggaggcaucaagcuagaaaggccucagaacuggcagguggcagccccauggucucccuccccuccagcccccuuccccacccuggcuguauccuucccuccagcccccuuccccacccuggcuauauccuccccucuagcccccuuccccacccuggcuauaucuaccccucaguccuccccggugagcagcccggaugcuagccuaauuucagucccuuccgucccugauccaagcauauguugcuggugucucacucugucucagacacacacuacggggccagagggcggagggugcauccaggcucaggccuagaggcucuuuuagguguugcaacacccugagccuccaccgcacccuugucacugucucccaagcugcauccaucccacaaacagccucuagaucauccuccaggaccauccgacuggacugguuaccuuccugcagggaaacugaggcaaggagggacuugcccagaguccccuggaccugcucauucaaauccagcccaaucccaguguccuuugguuuauuuuucauaccaaaaguccuccgcucuuggacccuagcugaaugagccacagcucaggaaaaaaugaguguucguagagggauggcucagaugggucccaggaguccuggagagaaacaggaaauaggcagggcuucuggcugucccauccacugauggccuuuuccuggugucugcucccuugcaccaacccuaauuucaggaccgaucccagggcugugguguaaccucagcggccaggcagucucuguccuccagccaaguuuucccucaucaaaacgaucuucgcagauucugacagguggauuuuuuauuaccuuuuguccugacucccuggcacugagcccaugcagagaagaaaggaaagaacuuuccagguucccuucuacuggaaugcccccccacuagcccucucaccugcuccccauuccucuacuucugggagcucgggaggguggagcagcuucuagaguccaggagcuuccccugccacugccacaacccccgauuccaccacagccaucgccacugccaccugccucccgcugaaucuuggcucuugucuucucuuuccagcccaggcaaguggcugccucuggcuagguucugcucacucacuuuguagcacaguuaggcuuagagauccagccaaggcagacagacagggcccagaaccucaguccugccauggaggaggacgggcagcagagagagaagguauggaacagagcuccugccacucgccugcccacugcaagagcagccucgggcccuccugucucugcccacuccagggccuccuggacuuucucuuucucucucugccgccucucacccuccaugccaggccacccggcucucucgccacagcacugcccucaccccaccccugccccaucucaaaggcaggaggaagcccaaggccccucacccgaaggugcugccauugucuggcucucugugauucucucuucuucccuucuguuucucaaccuggaaagggugggagaaaaggacguggggaccuccaagagggacagucaccacucugcuggcuggcuccucuuccagggugagaaaggaggggccugugcaacccaacaggugggcggucccccucaccucugccaccccaaaggugccguucauccugacuugguuccccugagccuugcuaagaaccauggccacaccccacccucccccaucccuaccugcaucuccaggccccagagaggcggggacaccuagagcucuagggcugggaggccagggccagccccacccaagaggccgucucugcccccagggaugggcacuuaagugcccaggacuacagcuuuggggcugccagggcuccagagccggggagggaaugaacaggauguucugcuaccugcaggugaagccucugggcuuccugaagcccuucuccuugaugaaggcuuccagccgcuucaaggcacaccaggaugcacugccacggcugcccgugcccccucuccagcagucccuggaccacuaccugaaggcgcugcagcccaucgugagugaggaggagugggcccacaccaagcagcugguggaugaguuucaggccucaggagguguaggggagcgccugcagaaggggcuggagcgucgggccaggaagacggagaacugggugagugagggcauccucacugugaccugcugcuggcugcacaugcacaguucuccagugcccacugcucuggcacggccguucguuugcugcccagaguuucgugagcacauacucugugucuggcacuuggcagggugcugggugaucaagaaggacacagucaccagcuccuuggagcuaacauucaaguagggaggagagaaagguaaugaacaggauacagguuguggacaagguuucauguuccaggacagaggcaggaguggggugcacggcagguacaaccagauagaagaugcccuugugcuuggugggacagccucaggcaggggauaugugucacucagugaccgaucgcccagguucuguaucugaucuaugacacagguguacccaguuuggcaaauaugucuacaccaauguuuggugugcuuuucuauuugcaucucauacuucaauacacagauuuaaaaaguggcagcuggaugcagugacucacaccuauaaucccagcacuuugggaguccaaggcgggcagaucacaaggucaggaguucgggaccagccuggccaacaugaugaaacccugucucuacuaaaaauacaaaaauuagccaggcguaguggcacgcaccuguaaucccagauacuggggaggcugaggcaggagaauugcuugaaccuggcagguggagguugcagugagccaagauugugccacugcacuccagccugggcgacagagcaagacucugucuugggaaaaaaaaaaggugacccagcugcugggagggaggcagaguggaagccagaggcgagggggaggggugacaucacccccaaggagcuguggcagccugggucugacaccggaugggagagagggagagucguuagguccaggacuguuuuggaggcagugccagugucacuugccaaugaggugggggcacggguggaauuugccaagucgggguugccugagagagaagcuaccugugggagagccagagcggguccggcccugggaaaugcuguguuauagggggugccauggggaggggagguagagcucuagcccuggggcuuggcggaggcuguggggcugcacacaggaggugggaguugucaacauuugcugagacgcgucaggucaggacuuuggacuccagaaccaagaugcuucccccgaaagguccuuagagcgucugggggcuggugguuuuccgacuucauuuagccugggacuccuucaaacagaagcuccugguuaaaggggugggggcaccccuccuuccacucacggggccaccgaagggucuccgccaccaccuggcagauucucgcugggggaguacccauaccugcggggucuccucuggucucccaagcuuuggccagaggcucugggaucccuaguggaguacaggccccuggcuguuuccccaagggaaggaagcuccugucugcccuucacugaucuacagaugaggaaaacuaaggcccagagagguggcccaaaagcccagagccacacagcagcucucaaggaagcccucggccacacaggaaggucugacugacucagggacccaguucuuaggggcuaccagucaccuguuguacaacuuggggacaaguugccucccccucaccccuugccaaguugccucccccucaccccuugccaaaggcuaguggcccagugcugcaggggagugcgugugaugaagaggcgcauccugcugcuguucaccacggguugagggggcgcaggugggcccaggucucuggggguggaaggccagagaaagcuguacuggcugugugcaggaaggguggguguugcagucagcauagaggacacagggugacagucaccugggagugugcgcagcgccagacauggagccuuuaauaccacaucccuggcuggugcccagagaccccccaccccccagagagaggacagaccgucagggcagagaguaaggaugugucacccacaucuugucacuagcauaaggauucauccuugcagggagcauccccucaagauugcccugaccuugagaucaaaguggguaucuacuccccgaggccacagguuccucaggcugcucugauaccccagucuccugccuccuuggacaguucucugcuggggauggucaaaaacucacuuauugggccagacgcgguggcucacgccuggaaucccagcacuuugggaagcugaggcagguggaucauuugaggucaggaguucaagaccagccuggccaacauggugaaaaccugucugcagcaaaaaauacaaaaaugagccaggcaugguggugcgcaccuauagucccagcuacucaagaggcugaggcaagagaaucgcuugaaugcaggagguggagguugcagugagcugagauagcaccguggcacuuuagccugggugacagugagacccugucucaaaaaaaaagucacucauuggacuuuguuuuuguagacccuucccuuuuuuccuuucuaucuauucaggcauacauuuuaauuuaacauaugacagucauugacagagaauguguaagaugagaauuuguucaccuugccgggcgcgguggcucacgccuguaaucccagcacuuugggaggccgaggcgggaggaucacgaggucaggagaucgagaccauccuggcuaacacggugaaaccccgucucuacuaaaacuacaaaaaaaaaaauuagccgggcacaguggcgggcgccuguagucccagcuacucaggaggcugaggcaggagaauggcgugaacccaggagguggagcuugcagugagccgagaucaugccacugcacuccagcgugggggacagagcgagacuccgucucaaaaaaaaaaaaaaagaccgggcacaguggcucaugccuguaaucccagcacuuugggaggccaaggcgggcggaucaugaggucaggaaaucgagaccauccuggcuaacacggugaaaccccgucucuacuaaaaauacaaaaaaauagccaggugugguggcuggcgccuguagucccacuuacucaggaggcugaggcaggagaauggcgugaacccaggaggcggagcuugcagugagccgagauugcgccacugcacuccagccugcaugacacagcgagacccugucucaaaaaaaaaaaaaagaauucguucaccuugcugccccuccccacaccccggguuuccuccugaucuuucuuucacauccuuucuuagcagcagcaucggauugaucuggcuaauacugaucacucgggcuaaagggaagaggcugguggguuuaaguuguggggcagggaggguggguucuggaucuaggcauuuacuuugagaaucuccauagccagguagagggcaugggggccagccagguccccuagcccuggggaacagggggcaccagggcccaugcaccccuccugacaggcucuggcacuuuucccagcugucugagugguggcucaagaccgccuaccuccaguaccgccagccuguggucaucuacucgagcccaggcgugaugcuacccaagcaggacuucguggaccugcagggucagcuccggugaguggcugggguuugggggccaggaggcagccgggccccucgaguucacuucgcccagccgcuuggaggggccccgacccuguuuaucuuucugccccacaagcagccuuaugaaguagggagcauccucccuauuuuacaaauggggaaauugaggcucggagcagggaagggagcugcccaagaccccauucaggaagcagggucucuccagcucuaaagccucauggcuguuaaccaccacaucuucgcagaggccccauccuccuccauaccugaggcuucuccccgaccccaguuuuagcacuucaccucuccuuuccacucuucucagcuagccacaggggugaccucuguacacaguccucuuuuccacauucagccaggucaccugccccagccccuauuccaguccuaccagagauaaaaauaccagugacaaggaucuccugcccaaggaccagccacuggcugccaccaccugcuucucuuaaagggaccaggguacccugggaagggccgggguucaggcccaggaacuccagccacugguccccauggugggauccaggggcggccccaagcauugagggugguugccaugggccagacagcccugggaggaaggcggccugggggacacagaggcccagaguggggaagggaccuaguggagggaacaccggagccacugcucucccaucacaccaccccaggggcccggggccuccagaaccgaugcuucagagcagaugacacccccuccagauucuaggcugagguucaggagcucaggcccuuuguggguagacccagcccacugaccccuaaccaagccacacuccagcugcagggggccagcacccaaguccuacuaggcccuuggccaccagcacuuccccgagcccucccgaccaugcucccucuagagguuaugaagaagcacacacaggcuggcaagcugggacucgcaggccccucccuugcgcucccaggcuuucuggaagcggugagagaggcuggaagacuagaccucccgcuccccaagcaggugucccuagcccggggccucccucaggguguccacgcagcuucuaaucucuaaucaaucuuuccagauuugcugccaaacucauugaggguguguuggauuucaaggucaugauugacaagugagcauccccaccccugcccagccccacaccugcccaggccugcuuaauuaccacagccaccucugaccccagcccuggcccggcaugccagcuugggcccugggcccugcuccagcugcuggaaucuccucuuggugggugacccugucccaucccaacuaaagaggaccccagaguuuuauucgcugcuucaucuccccugugacaaacugaagcccagagaggggaaaggagggaguuucuagaugacuucugaacagggcccaucuggggcagaaagcgagcccccugcccacagcacagcccugagguguccugcucaucugggagugggagcagggacacugugugagcccccagcaguaccuagcaggucccugucuacccugcccuccuccccauucacuugcccagugguggccucacugccccucuaccccauagcgagacccugcccguggaguaccugggggggaagccacugugcaugaaccaguacuaucagaucuuguccuccugccgagugccgggccccaagcaggacacagucagcaacuucagcaagaccaagaagccucccacgcacaucaccgugguacacaacuaccagguggguggcccccacccacaccuacaagccccggcccugcugcaggaguacagccggacggccgcagucggcuuccccacugggguuccccagcacacgugcccacgugccccaggaaugggcgccccuggcuucuccauugggggcccagggaggccaggaggggccgugggccugcccagcccagaagggugauccaaggaccuccucccccucucacccuuggccugacuccauccccuccaaggccaaggccaggaggaggcagguguggggagguggcugcucucagccugagguccccacucagcucccuccucuuaccugccugugccccaacaguuuuuugagcuggauguguaccacagugacgggacaccccucacugcggaucagaucuuugugcagcuggagaagaucuggaacucaucccuacagaccaacaaggagccugugggcauccucaccuccaaccaccgcaacuccugggccaaggcauacaacacccucaucaaaggugccucuugggggccgugcuggggcugcacacccaggccucuuccccuguuggggaccagccucaacuccaccuguaggguacccgaagucugcuggcaacaaaggaaugagaagagacagguuaagaguucaugaaggugggagccaggggccaguugcaaaauggaggcugcaaaaggcgcagaguucuggucuccacacuauugagugcagucacuuagcucuaagaagcacauguucagggcgaaacagugaaagggaggcagugccucauaggaggcauaaucuauagcaauagcaguuuaaaugaaucuccuuugugcucaaacagcgugucuuuaacuuaucggagaguagcuggugggagcgggcuuaacuaggagccugcacaucuguccacuucccaguguuucaaaggagugucuuucuccuugaacacaguguuuacagauaggagagcgggucucgcucugagcaugggaacaugauggcaauuaguaggcuuuccuccuccguggccucuucuggcuuuccacaacuuauuguccccuauuuuuauggccaguuuauacaggcaccccacaaguccuuuucccaacauucccccggcaugcugggccccgcacagccaugggcagacauguuucccgcugcauccucucaacguggagcaggcaaugugggccccauguccuaguugaggacaccucaugguuaggguaguuucucucagcuaaauagcaaguuaggauuagaguccaaguccucuggcugagaagcccacccgccuccacacccccugugcccccaaguaccagcaguccuccaaagcaugucuugcucaggggcauugaccccaaagucagaccaccuguguggguuccccggcugccacaccagcucccaugugaccccugggcuucgguuuccugugucuaaagugggccagguguugggcccugccucgaggagugcugugggccugcaggguccuguugaguucgaagcucugaacccacacccugcacuuggugaaugcccuggagggccggcgagguggggggucuccucaucccagagagguacaaaugggucagaagagcccagggcaggaggcugcggaggggcugguccaucucucccacaccaugagaccccauuuugcgucuccccgccccaugccaccugcagacaaggugaaccgggauuccgugcgcuccauccagaagagcaucuucaccgugugccuagaugcaaccaugcccagggucucagaagacguguaccgcagccacguggcaggccagaugcugcaugggggcggcagcaggcucaacagcggcaaccgcugguucgacaagacgcugcaggugaggcccggcagggcuucgcccacucacacacaccugaacaggaccucugcagccucgggacuuccugcccguccccggcccugcguccccagccuccuagcuuguaaagcaggcaggaagccagcaggcuggacgcugccguaauuaccaggcagccagccugucaucaccaguccugccucuggccuggaaaccgcugucacccccagcacacccccucagcaccucacagagaaccugggauccggggucaccagugcaauccuggcacaacagucccucuccacaccuguaaaauggggugauggucaaccucaccgguagaguaguuugaaggacucagucaggcacgcugagcgugggaugugcuuagcacaccagggcaccuggugagugucagcuauuguuaauaacaguaauaagucaucauagccccuugagauggcuucagagaggcccuugccucaaccaaagagugguugggugaggggccaccccccagggcccuggggcugaccggggucucccuucccuuccacaguucaucguggcagaagauggcuccugugggcuuguguacgagcaugcugcagcggaggggcccccuauugucacccuucuggacuaugucaucgaguacacgugaguacagucacaucucucgccuaguuccccagcuucuagugacaggugacacacaggugauagaccagcuuauagagaaauaucacucuccuuugugccugggaaucuguuuuuuuccaaggaagccagccagauaugguggcucacgccuguaauccugacacuuugggaggcugaggugggaggaucaauugaggucaggaguuugagaucagccuggccaacauggugaaaugccaucucuacuaaaaauacaaaaaaaaaaaaaauuacccaggugugguaucacaugccuauaaucccaguuacucaggaggcugaggcaggagaauugcuugaacccaggaggcagagguugcguugagcggagacugugccacugcacuccagccugggugacagagcaagacucugucucaaaaaaaaaaaaaaaaaauuaggccaggugcaguggcucaugccuauaaucccagcacuuugggaggcggaucaccugaggucaggaguucaagaccagccuggccaacauggugaaacccugucucuacaaaaauuagccaggcaugauggcgggugccuguaaucccagcuacuugggaggcugaggcaggagaaucgcuugaacccgggaggcagagguugcagugagcugagaucacaccauugcacucuagccugggugacagaaugagacucuguuucaaaaaaaaaaaaaaaaaaguuagccacgcgugguggugggugccuguaaucccagcuacucaagaggcuaaggcacaagaaucacuugaacccaggagguggagguugcagugagccgagaucguuccauugcuccagccugggugacagagcaagacucugucucaaaagaaaaagaaaaaaauuagccaagguggcgggcaucuguaaucccagcuacucaggaggcugaggcaggagaaucgcuugaaccagggaggccaagguugcagugagcugagaucacaucacugcacuccagccugggcaacagagcaagacuccaucuaaaaaaaaaaaaaaaagaaaaaagaaaaaaaagcugaagugagggugguuuucagaacaaacucacaccucccugggcuggcccccuccagcuucagguacccauccuccccacccuggucccagaauggacccaggcucuagaggcaccagcaugagccugaggccccguuuacugugcaggaagaaacccgagcuugugcggucuccccuggugccccugcccaugcccaagaagcugcgguucaacaucacccccgagaucaagagcgacaucgagaaggccaagcagaaccucagcauguaagugccugcccccgccaucccugugcuggaugggugaggccaggcccuugagcuugagaggcuccugugccagcucugucaugacacccagacccuccgugggguuggcaggggcugccggggccugcuccucaccugcucuucccacacccccagcaugauccaggaccuggauaucaccgugaugguguuccaccauuuuggaaaagacuuccccaagucggagaagcuaagcccagaugccuucauccagauggcuuugcagcuggccuacuacaggugcgccucuguggcccacccauggaggagggaggagaccugggggcaggggagggggugcccgccuccaaggggcgugcuuagccccauuucccaccaggaucuacggacaggcaugugccaccuaugaaagugccucccugcgcauguuucaccugggccgcaccgacaccauccgcucggcuuccauggacucacucaccuuugucaaggccauggaugacuccagcgucacggugagaggucuggggcgagggugggugagcugggccugagccccucccuccugcucacucagucaacacacaauaauugagcaccuacaggauuccagccccauggugggcacggggaaucuaacagaagcuggagccgugaaucuagcucugagcuuccuggggaccaaagaggaaaagggagucauucauuuguucauucauuuauucauuggcaguaagcaacugcccuaugucaggcccuggcugaggaccaaggaguugguaguugcaauacucgcucuuuuuuuuucuuguuuuuuuuuagaaagagucucacucuguugcccaggcuggagugcaguggugugaucucgacucacugcaaccuccaccucccggguucaagcaauccuccugccucagccucccaaguagcugggacuacaggugccugccaccaugcccggcuaauuuuuguauuuuuaguagaaacgggauuucaccauguuggccaggcuggucucaaacuccugaccucaagggauccaccugccucggccucccaaagugcugggauuacaggcgugagccaccgcucccagccccaauauuuccucuuaaagagcucagaaucuagugcugggugggggugggcuacugaggugggccagaagagaagggacagugcuucagcucccucugacccucaccacucuaggagcaccagaagguggagcugcugcggaaggccgugcaggcccaccgaggcuacaccgaccggguaagugagcccgcuugugccuacucacuugucccuuagugucagccaucugucugucccucugacuguccgucccugcagccaauggcugccaacccuuugcuaggaccacaucucccccaaccugggagcaccuggagccaggcugaauagcccccaacuuuuucuuuuuuuuuuuuuuugagauggagucuugcucugucgcccaggcuggagugcaguggugugauuuaggcucacugcaaccuccgccucccagguucaagcaauucuccugccucagccucccaaguagcugggauuacaggcacccaccaccacaccuggcuaauuuuuccauuuuuaguagaaacaggguuucaccauguugacaggcuggucucaaacuccugaccucaggugauccacccaccucaggcucccaaagugcugggauuauaggcgugagccaccgugcccggccaaauauccccauuuuaaaguuggagaaacccagccugggcccaguaacugccuugguuccagguuccagggcuggccugggcccuagauguugggucacacucucucccugaugcuagguaucucucccugacgcuagguauacaugguccagcagacagccaguuuccugcccuccagcagcuugggcugcagucagggagguggcugucuggaugcguguccuggcucugucucugagcaccuguguguccaggcucugaccgugcuacaugcacacguccauuuagagcucaccgccacccugcgaggggaguguaggacucaccccucuuuacagaugaagacacuacaguuccagaaccuaagcaaccugccaaggcccugcagccaggauggggcuaggucacccagcuccagggcccugcccuacaacccugcacuuuccugccucccugggcaaauccccgccccucccugagccuugguuuccccaucugugaaacgaaggcucucucuggccagaauacucuggucuugugguuuugaguggccagugccugcgaaggguggcgcugccacaggcugaagagggcagggauaccccggggguccacagccccugcuccugacagcucucccaccccaacaggccauccgcggggaggccuuugaucgacaccugcugggccugaagcugcaggccaucgaggaccuggugagcaugcccgacaucuucauggacaccuccuacgccaucgccaugcacuuccaccucuccaccagccaggugggccacugccccaggugccccgggggcuggaggcagagaacccacugguaguuugauguggccuacacaggccccacugacccauugccaacacagcugaguuccagaggaggagcugggggcaggggccucucugcagcccaggcaggcugagaaggggucagugcuccucaugggagaaucagcuucgcugacucacuggucagguauaaaggaacauuugauucgugccagccuguagugguugcugggauauagcaggggacagaccaugaucccugcccacaaggggccugcagucuuggcggaagcacaggcagccugggaagugcugggggcgucaagguaggggagcugagagcuuucauccugccguccccaggucccugccaagacagacugugucauguucuucgggcccgugguccccgacggcuacggugucugcuauaaccccauggaggcccacaucaacuucucccugucggccuacaacagcugcgcggagaccaacgccgcccgccuggcgcauuaccuggagaaggcgcuccuggacaugcgugcccugcugcagagccacccccgggccaagcucugagccccuaggacucaggccugccaaugccacagccaagcccacccugggaugggccacccaccagggcucagcuccuugguucccucuuccuugguucccucuucccugguccccccaaaucuacugagccacggaccgcauccuccagggggccugcaggccccagccaagugccuuccgugggucaucccagcaccugccagggcccgaccuggggcugagugcagaggcugagcaggacguuaggcccgggccccuggcacguccuccaccggugccuccucuggggaagggaaccagcccuccagagcaggagacuggcaagagcucuuugucucaccagcucagccccggccacucccugccaacuccaugaccaggccaccaucuguacccugcuucccaaacucccaggaccuggagacaggauugucuggggccgaggggccagggugugagguuucaccuccguugcggcugugcuccuguggauaacauugcuagcgagccgccucugguuccacucagcuugguuccugcccccgcccugcuguaugauauuaauguggaaggucaucaauaaaggggaauuguguuggugaagagguguuucagcugagaggcaggcagggugggggcaggcaccuggccuugcccucuucagcuuucccugggccucggagcugguguccaagcagcuggugggccugagggcuuuggcccaggagccaagguccagcugugaccuuggggcacugggcccagaaccauaccagagccagggcugcguccuucaccagcagcuucccaccuaccucuggcuugggccuucccaagucccauggguuguggguaggggcaacucucccaggggacuguggggcccagcaggcccaggucuggugggcugaugaauguugcuaauacccaggggcccagggugucauucuacuucccccaacugagcccagcaaaaguaggaguacagcagcaggcucagcuugccccaggcccagccgcugccaggacagacaccuucgggggugggcaggugcgaucagagcagaaccacauaccugcccauagccccguguccauggcugaggcagggcauccuggcaaaaccaagcgugcaguuuguggagaggggagagucucccauuaggacacuggccugugaggaaggccugugugaaaccacaagggcggaugccggggugggcugggggagguuggcuggccugugagugaagggcucugugaccugacuaagcugggacagucauccgagaguggggccuuugguuuucuccguuugucagaugaggaagcaggcuuagcgagguuaaggucaccgggacgcuaaauggcagagcaggauucacagaggccacacuugucuccucuaggccggggcuccaagaagccccucccuagagccagguccccagccccaggccacauccaccuaggugucccgcagcaggggguggagaaagggaugcuauggguggaaaccggcccagccucaggaccacaaggaagcggguaaagagggaggcugggcugagccugagcucuaaucaggcgcagggaccugccaggccugaccauuggugguguacucagcaggagagggcagccacuugcccagugccccaaggggacaggagguguagcccagacaauggaggaaauggauggaggcagagaaagggaugccucuggggggaacacgcaggccuggaagagaaugucaccuggaccagcacccggacucugcuccucgcuacacaacagggugcucccucugggggugacuagaaccgcuaggaaacaggguacacagcagggcagagugcugcaugagcagccaggagugggccugcagccagcccaggcaggacagggaggggagagcgaacagucaagaggcugccagacagacacccuggauucccaaaacucgccuaagaacccuacaggucugaauauaagguuggauuuuuuuucccccagaauuauccuucugaauugaggggcauccccuuagggugguggcauuacaggccccaucacauggaagcccccucaauuccuuggagccaccaaguauuguucagggagggcgcauucagcaucugagcaaccucagucauggugagagggaaucccuagagguccuuugugggggaaaaaggcaaagaaacaagauuucgccguucuuccuuagggguaauuccugagaccucacacuuucaaguguuggaugucgggauaaaccagcgcuuaacguugugccagggggcacuuguggcuuggaaugaaauuucuagagcuagugcugugcaugaaauccuacaggcgcugcuuaaaggcuagcauagccaagacagcggccccaggagagcaggcucagcugacccagagggggcuccaggggugaccaaacucuggcgccagugaugcagacgaaaaacgugauucguuuuugcaaaaugagugaaaaaaagcucuucugaauugguauaucuugagcaaugcaucauuugacauuugaaugaguaauaaauuuuuuuuuuuuuugagacaauuucacucuugucacccaggcugaagugcaauggugcgaucucagcuuacugcaaccucugccucccagguucaggcaauucuccugucucagucucccaaauaguugggauuacaggccugugccaccacacccaguauuuuuguacuuuuaguagagacaggguuucaccauguuggccaggcuagucucaaacuccugaccucaggccugccucagccucccaaagugcugggauuacaggcgugagucaccacgcccagccuaauaagauuaaugaauucaagagaaauagacguguggcuuuacggaaagucuguacauccagcgggcaugaacuuuuuuuuuuuuuuuuuccugagacggagucucgcucugucgcccacgcuggagugcaguggugcaaucucaguucaccgcaagcucugccuccuggguucaugccauucuccugccucagccgcccgaguagcugggacuacaggcacccaccaccacgcccggcuaauuuuuuguauuuuguuuaguagagaugggguuucaccguguuagccaggacggucucaaucuccugaccucgugauccgcccgucucggccucccaaagugcugggauuacaggcgugagccaccgcgcccagccgcgaaaaguggauauuucaaagaggcuucugagggcuugaagaguugggcuucugcccagcaccgcaccuugggcagguuggagcggggucaggguaagcaggugaguguggaugaagugaaggcgaugaguuagcgggggcgggugcgccugaagcugcucccgguagcuuucccacuccacacugcagccgggaugucuucugacacacccuccaguuugcuuuuccuuuuuaacucucucucaucugcuguuaaaucuaccucucggauccuuguuuuuuagcuaugauucgaggccagggcucgccuuauaguuuccuguucccugcagauauugccauuuauuuauuuuuuugagagggagucucacucuaucacccaaacuggagcacaguggcgcgaucucggcucacugcaaccucugccuccugaguucaagcgauucuccugccucagccucccgaguagcugagacuacaggcgugugccaccaugcccagcuaauguuuguauuuuuaguagagaugguauuucaccauguuggccaggcuggucucgaacuccugacccuaagugaucugcccaucucuggauuaugggcgugagccaccgugccugguguucucuuuaaaaauaguaaaacaggcugggcgugguggcucaugccauaaucccagcacuuugggaggccgagauggguggaucacuugagaucaggaguuagagaucagccuggccuacaugacgaaaccccaucucuauuaaaaauacaaaaaaaauuagccaggggaggcugaggcaggagaguugcuugaacccaggaggcggagguugcagcaagcugagaucgcgccacugcacuccagccugggugacagagcaagacuccaucucaaaaaaaaaauaguaaagcagucugcuuaaucauuccaguauuugaagaauuuguggguuuguuucuauuaucuguuuucugcugcugcuccaucauggugucuuuuuuccuuuuauauuugaucaucuuuguccacauauauuuguuuuugagaugggguuuuucucaggcuggagugcaguggugugaucacaguuggcugcagccuugacucccgggcucaagcgaucgucccaccucagccccucgaguagcuaggaccacaggugugcaccaccacgccuagcucauuuuuaaaaaaauauuuuguagagacagggucuugcuacguugcccaggcuggucucaaacuccugggcucaaaugauccuccuccuuuggccucccaaagugcugaaauuacaggcgugagccacugugucagaccaaguggagauguuuauccuggcacacucugaagggcacacuggcugccccugaguccucaaggcugucccacagaggaggaacaaggcucagugagaggagggccagcgccacacagggagggagacugacagugaaaagaggaaaacuuccuaaggcugagaguguccagguuugguaugguggcccucagugagguccccuggagggauguaaucagaagcuggacagacccugacaggaaaugccgcagaggucauucagaccccugcugugggcuagaagggacuagaucacuucugguuuuauggucuucaccguauccuugccccuaagggucauguguccccacagcugccccaaucuccucuccugagcucaaucagcaagugcucaagcugccagaguuuacgguuuuauuuuaaaacaguaguaaacaauuucauugauuuuucuuaaaucaaaccaccucauacucggcuugucucaggcaaaaaguaaaaaauaaaaauaacgggagggaaacauggaaaccgaccuaccuucccuagaaauaagccccuggucuuggcaucuggaauggcuuuuggacacugccuuuaacaaaugagaaaagaaagcaccaaaacauugugcuucagcagcagguuaggaaacuccacaaagaaagggguggggaggauucgaacacagaucccgagugacccaguucaguccucaaaacuucugagagucuggaggcgucuccucuccacaacucccuuucagagugacuuagagaugggggucccuuuaggaagagcccucccacgaaccaggcugauagggaucugugagcccacaccccagacacagguuugagggggaccccaagcagguucccagcuggucagagaugggucaggaaggacaaggacauauucagagcacacagagggaaggacgagggacuucgggugccuguugccucacuccucuccucacggcuccuucccauuuuguucacguggggaugaagacuaacugcuacuggauggcaggacaagaaagagcuguaaacagcuugggucugcucacccaaaugugcaggcuccuuugucagaaagcgauuauugucuuagggacaggggaccagagaaagcccuugugguguugggucaguacgggguagaacacaacgacagcagccgccagacgcgugcucgcucugggcccugcccccagacagggaaacacugaccgagguucuggaacggcaacgguggcagggagggugugggguaugcuccccuccuccuggcacccaggccaccccggcccagggagaggcagucugcccucugggcauagggcgaagggccugggaagcugaccgggagcccucuguucacagggcagccaccggagagcagauucuuccagcuccaaaauccugccugccucugacaaaaccaaaaaauaaauaguguguacuucucacgccaccuggaauuccuggccccgagaccagaggcgcgagcccuccuccuccaccccacacccaggugcccaugccgagggcacuuucugcccagccaggggcuggcagcagcacagcgagggucucuggccacggcccccaggcagcaggccccccaggguccugguugaggggcugguucagcccuuugguccaccuuguucauuaaaauuaaaauaagaaaaaaaaaggcuccacuuggugacuugggucuguagaggucucugcuucgucccugucugucauccuguccauccugcaaggcaucgugcgggccagaucuggaggcuggacccagccacacccacuggucacugcaguuucguccccagcuugcguugucuguuccugcaaaacaggaugggggucagauguggagacaucugguguucagugaccuacagcuguccccaccccacccguagucccaacuaaguaggcaaaugcccacacccaguagccagcgauugaccugaacugggccaaucagagcaccugcccugggaau

SEQ ID NO: 13135 - RNA, 8076 nt, Homo sapiens
ugugggccuggcuguggcugucuuguuugucacuguguccccagcacccuccuggggcccucucuggguuugguuuucagccuggcuccaccaagaggcaggaaaaagggagccccagucccucccacccucuccuccaggaagcccucccuggagagacccuggaguaucaggggaggccuccuugccccuccccuagggcucccaagcccugugucccaguggccaccaaagggcaaggacauauuggcuggagagcccccagaacagggcugcggcugccuugugccuuccacuccuccaagcccagcgccccgccccaccgccccccuccccgcccccgcccgggccuagguugaugaugcuggggggcugcucucagcuggggcaccaggaggccaggauggagcuccacagagccccagggguacgggagagguggcagugcccgcuccgcauccauuccuccuccccaggcccugccagcuggcuucuccagcuccaacugggcucugccuuucccucucccuccaucacccugcugccuccccuccuucuccccuccucuccugcucucuuucccguucccuccccucuccccauuccccuucccggaccucccccgcccucacuucuuuccucuccucuccucucuuuuccucuccucuuuucucugaguccuucucccucgccuccuuccuuucuucuuccuggguuaaaaauaaucaacuuucugggaagcagcagcuccugcugagccgcccuccccacacucgggagccccugagaauagcuuucugcgguucuccacuagagccccuccccuccccucgccgccuccccgcgagcugacuaauaagcccggccgcgcggugccagcucggcuggaaaggcguuaaccacuucgugcccggacugcgcgaaaggggcggaccggcucccugcaggcccggggggagggguggcgggcgcgggcggccccgggacacggcucaggacgaggcccugagcggcaggcgguaggcccucgauuuuuacuggcggugggaugaauguugacuucugaccgccacgccggcagguccugcugcuggugcagcuagcagagcuuaguggccucggugggcgcgccaggugcgacacccaagggaugggucggggucacauggagggcguggcugggccggugaggcucucuccccguggcccgagggacuccuagguccuggcacugggcaccgccugaggggaagccggggcugggaccguuaaaguucgggccaagggcagggaagggcugaaaacuguccugggauccaaggacguccacagcugguagggucuuuagcgaucacccacucugcuucuugcagaaagggaaacugaggcccagagggugugacugaggccgggacgucucucaguuccugucccagacuaagggaggcccgcggcccugcagccgacuuucaguucgggcgccucugcagggguaagguugggggaggggaggguguacaucaaggucaaaggugagggguagguggggagagaagaagcgcugagcucugcgggguccccgucagccccgcccacuccgcguggucccggcauuaccucaucgcggcgcgcgcucauuggcuggcuccccccuugaaggacagcccaaugcggcggagcccguuaacccuuuccgccccgcggacucugcccuggccaugccaccugccuccgcggcccccaagcggcuuucaggcgcuggagggccacggagaacagggaaggguagugugggagccggcuugaggccagagagcacagugguuagagcacaggucagacaacuacgucuucggccccuguccugcggccggccggccggcugugugaccuugggggacuggcuucaccucgccgagccuccgcuaguuugcucagcuguaaacaggugaaugauguaacuccugcccuucccaauuccuucuucccgguguacuugccaagugccaggcacacgugggcucugcguucuauuccaccuugucuccucacuggaagagguacaguuauuauuauggguuuuccggggaggaaacagggcucagggcagcaaagcugccucccaaggucacgcaucaagaaagucacagagcugggauuugaccccgagucugcggguucugagcuguacuccuccccagggcaagauucugcuucugcugggaggcgcugcuucuaggagcucuccgucucuccggaaggagggacaggacucauacccagcuggucagcucgugacagaugccacuguggccaaauaaaaccagagcccaggaucuccauggacaagggacaggaagaagggugagggcagggaggggcuggaguugaauccucaaacagggaggcaggaggacccucagacaaaggcagggggcuggacugagcccagcgagggugcauggaguaggaagcucugaagaagccugcaggauccccugggggucagccugcugguuaggggucagcccagggaggcggcuucucucugggcagcaccaggggucagccuggggcaggagugcaagccgaggcccacauaccucaugucuagguauuuacaaguuauaaaucaagcuaacaaacugcuaaauaaaauauguucuguugccgggugcgguggcucacgccuguaaucccagcacuuugggaggcugaggcgggcagaucaccugaggucgggaguuggagacuaaccugaccaacauggagaaaccacgucucuacuaaaaauauaaaauuagccaggcaugguggcgcaugccuguaaucccagcuacucgggaggcugaggcaggagaauugcuugaaccagggagguggagguugcagugagccgagaucacaccacugcacuccagccugggcaacaaaagcgaaacuccgucucaaaaaaaaaaaaaaaguucuguccuccuuccuugacaaauacaccuucauaaggacaaacacaccuggaaggcuggguuuguguuuagaauucucaggcuccuuggagaccacaggaggagcuguagcggguuggggagcccgccucucagccucuggccuccggcuucacacucgccucuucuuuucuuuuugccccagguucuguccuuuucccugaggggcugugcaugcucagguguaggcacuccaggcuguaagcacauguucuguccacacccccugccaacagccaccuccuggucacuccugggguuuaggggugcccaaacagguggcucagacaacccucaggaggaugcacacaggacgcaggcuggggccauugaacagggaacuccagggccccaggugccagaucauggucaaggggcccauggcuccagcuggaaaugucucccugguccaggagcgcugcccucuaaagcacagggcucaagucugugggcugauggccccagggugcugcggcagcugggguggccagagcuggacacggggucucccuccauccuugagcuugcuccuaaccaucaccuccagccauguacccccgccccagccagauuccccaugccccaaccaaaugccgacccuggggagcuucccaccucaaugagucagcucccuuuacccuguccccacugccccccacccuuaucccccuuauccggcugcuccaucucccgccugcucccugggcuccuagccccuacucucugccugccccccaaccccccuccgccacccuaaccuccuaucugcccuccucagcucagccagccagaucuuucuaaaaugcaaggcugcaggcuuccuucccucucuaaccagcgcugguucccgggcucucuacauaucauccccaggcucuggaggucucuccuuuccuccccucuccucuccucggguucugagcucuagccauuugggccuucucuccaauucaguuuugugugcuuucugccucacggucuucaugcgugcuaccccccucuaccuggaaccauguuuucugcucuuuguccccggcuccccagaccagcagaaaccacauggcgaugagcacauggaguuaucaguuuccaguguguuuccuaccuggccugcaggcaacaggaggacaggcugggucagugcuguucacugcuccaucuucagugucuggcacagagcaggugucacugaaguuucguaagucagaugcaucugcacugggcuugaaaucaagacaccacagcagcuaaugucuauuguaugcucacuguguccugggcccugcuuuuaagcauaugacauguauuaguucacuuauuucucacaacaaucuuugaaauaggaaugauuacuaucuccacucuacagaaugaggacacuaaggcacagagaaguucagagacuuaggcucacagcuggccagugacagaccccgauuugaacccaggcaauggagcuccaaugcugaaccaccucuugccaucuagccccagcugggccaaggccuugcugugggucccugggccagugucuccacuucucugagcugcagcuuuguuuuuuuuuuuuuuuugggauggaguuucgcucuuuuugccaaggcuggagugcaauagugugaucucggcucaccgcaaccucugccucccggguucaagcgauucuccugccucagccuccugaguagcugggauuacaggcaugcaccaacacgccuggcuaauuuuguauuuuuuagcagagacaagguuucuccauguuggccaggcuggucucgaacucccaaccucaggugaucugccugccuuggccucccaaagugcugggauuacaggugugagccaccacgcccagcucugagcugcagcuuuucugugugugcaguggaggguuggccacaguggugaucccugaggucccuuccagcucuggcagccuggcagcuccucugaugauccauccuucagggagccaaggacuccccguggagguccugcagggaugcccaagaguuggguggcugggaaacagcucaccguguguuaggcuguagaccugaguaccuggccagggacccaaucguccccagcagucuugucauugugaccggccuucaucucacaggaacccaggcugggcuacguaaaugaacugagcugaacugccaggugcugggguucaggcagagacuggaggcuagaaguugaggggggccaaguacugcaguugggcugggggacaguacuuggggcaggguugagcuuggguccccacaccaagagcuccacagucaucucagggacccuucaacaacagcccugagggcuaugcauccauuuuuuagaggaggacaugauggggaggcacagugggggacagugaccuggccgaggucacacagcaagaaggagucuagauuuggcuuuuaaccacucugcccccagccuugggcaaagguguucaguguagaugugagagugaacugauagagaaguucuagaaggggucaggugcaguggcucaccccuguaaucucagcacugugggaggccgaggcgggcggaucaccugaggucgggaguucgacaccagccuggccaacauggugaaacccugucucuacuaaaaauacaaaaauuagccgggcaugguggagggcgucuguaaucccagcuacucgggaggcuuaggcaggagaaucgcuugaacccaggagguggagguugcaaugagccgagaucgugccacugcacuccagcuugggcuacagaacaagacucugucuugggaaaaaaaaaaaaguucuggaagaaacucugggacauacauauggguauauggguccauguguucauacccaugagcauggguacccccuugcuccccaucccagcaccucuccuugcccaccucugucucacugccuuuguuuauucgccuguggucacuguggacucugcuagacccugagccugugagggcagcggcugucuuccuguucccugcacaccagcacgugacucgagcacaggcaggaggaaggcggauggaaacacaggcgcagcccagggcuguuccacccuguguucagucccuucccuccuugggccucuguuucucaucucugcauaugggguaaaaugccccauccuuaguccgggcucaggugagccgcuggguuccuacugggccaugggaagggcccuaauaccugaagggcagggaggaugagggcaggcagcucagcugcccucccuccauccuggggccugccaccuccccucugucuucuccugauuccgguuccccaccaggaagggcucacuguccugcucagcaaguucucucaacaagcugggcagccaggggggggugcucugcuggacuggaggagccgaugugagcccaggccacccauggaggcucccucugaagagagggaacagacaacccagccacuugucaggaaccccgaucaaauaccccacccccaaggcucagcacuaagugucccaggggccugauuugcaggaagggcagcaggaugcucacuuggggguggaacacucaccugagggaggaacuguaccugccgaggcuuggauuacccacaaacucagcccagcaggagcccgcuggcugugcuaacaauguccucugugacguugcugagauucugcaagguucuuucaguguuagcccauuuuacagaggagaaaguugaggcuccagacagaugugagcuuaagccucuggcccaguucaaguuuccaaauauuccagaggccagggccuggggcgggguguggggcaccccaaaguccaggugagggugaccugagggugaagucugggucuggagaggcaauagagggagugaggacggcuccugccagaaacaggggagggguguuugagaccuugaaggaggugggacugugacaguggugacugugggaggaguccggguccaagcaacaacugggagagacuuggugcagggcccugagcugaaauggaggaaaacggagcugggugggucccugcccucaaugggggguaaaugcugaggcugggggcacgagcccagaggagggcaccagggcagcccagacaugagcucuguggucuguguguguuuacuguguggccagagcgugugaggaguguguggaaccgucugugugaugugggaguagggggauaaguguauuggcauauggagugggaguguguaugugugcacgcaugcaccuuugugccugugaucugcgucaugcagugugucugugccugugugggauguggucccugugauguggggcguguaugucgguguguguguguguugugggguagugcuaaccgggacacucuccaggggaagauccuagcucggauggagguggaggaguuaaccaggagaaugggagagggaccagcacgugcaaaggccuggaggcaugaagauggagccuggagcacuggaggacuugaaagugguccagugaggcugggaguagggagggagaggcaggggcugggagggacagggcaggccuuccuccaccaguuugaauuccguuagcuugaggguguguacagccaggagggguggaggggcugagaggaggccgagccaccacugaccagguggagggguagggggugagccuggaccggggcaggugcuggguggaggugggggagugagagccagagcucucaaccaagccucugggaggccgcagggccugggaucgcagacccgagccuaaucccugcucagcccaagagcuguagccagaagguucuuaguuuccccucaguaaacugagguucaggacauuucuggggcacuugcucugugugacugggcaagggcugggcaggcauuuccagcaugaacacgcuuucccaggcccacugguuggagggcaccgaggggagaagggggacagaggaaaggagccggaagcaggauccagaauuugaaccuagguggucugacuccaagagggcccucucucucacuugacuucaauagugacauuagccaacuucaauagu

SEQ ID NO: 13136 - RNA, 11317 nt, Homo sapiens
cagcauaucuagugccuggcauguacaagggucuccguaaauacaagugggcucguguuguuguuauuauaauggcccccuccucacuccuucucugucggcggagcccaccagccacgucaaggaguucgucauuggcuccaagacugucagagcugggagggcccucagguuauaggugaggaaacugaggcccagagaccagaagggccaugccuagggucacucgugacaguggguuuaugugugcuccccaaaaagauauguuccaguccuaguccuggugccuggaacgugaccucguucagaaaaagggguuuugcagauguaaucaaauuaagauguggccauaauggauuugggugcgcccuauaaauccagugacccaugcccauuuagaaaggagggggaaggcugggcacgguggcucacgccuauaaucccagcacuuugggagacagaggcgggcggaugacaaggucaagagaucgagaccauccuggccaacauggugaaacccugucucuacuaaaaauacaaaaaaaaauuagcugagggugguggcacacgcgcaccacugcacuccagccuggcgacagugcgagacucugucucaaaacacaaaacaaaaaagaaaaagaaaaagaagggagcgggggauuuggacaguggcauagacagcaggaagaaggcuguguggagacagaggaagguggacacuggggugcugcugucccaagccgagguaccccuguggucaccaggagugggagaggcaagaaagggaccuucucuggagucuuuggagggagcguggcccugcccacaccuugaauuugaccuuuccgccuccagaacuguaaaggagugaauuucuguuguuuuaagccaucaggucugcagcaccuuguuauagcagcccuagggcaaaagcagggcucagacgaagucagcccacccagcuccaccgggaccccacgggacugcaccucccgcaguuacucaccaugcgcccuuggguaagucaggccuccgucuccugaggguugagggccaaaggccaucacauaggugaggagaccgaggccugacucaacacgggcauggugucacgugaucaaauguguugugugaucaaacgagagaggggcugugaagaccugggucgccugagagcggcuguaccguucagggccucgcgauccauugagggggacccuucaagcaggggcagacacuuccaaacgcucagagucaugcccaggcaggugcacccagggcaagcaccccaucuggaugcaaaucgcugucugguaagaaucugggcccuucugauuuuuacaaggcaaguuggaaaaucuccauuucccugggagcaaaaugucccgauuucccucaggaagauacuucuuucccucagcaagaaucaaggcagacauguguggggagccgugggcccucguagucugcaguugcuucugggacgcccaagcuaguguugccuuaaagggucuugaacccagcugcccacccccaccccuccuuccuacuccuuuagguaauggaagaggaagcaaacugaggcacucugaaugccuggcgucggaggugguuuuccgagagccugucauuggaucugacaacagcuuuaacaaccagagccagcaguuaccagccgcugcugccacacccucaaccuugccgguugaggcucguugcuuuggguuuucuuguacaguuuguuuugcacaugguagagggccuuacucugcccauuuaaaaauguuucaucuggcugggcguggugggcucacgucuguaagcccaguacuuugggaggcugaggcggguggaucaccugaggucaggaguucgagaauagccuggccaacauggugaaaccccgucucuacuaaaaauacaaaaauuagccuggcgugguagcgcaugccuguaauuccagcuaccugguaggcuugaacccagggguuggagguugcagugagccgagauccugccacugcacuccagcuuaggcaacagagugagacuccgucugaaaaauaauaauaauaauaauaauaaauaaauaaauauaaaaauguuuacucuaagacccaucggauugucuugaaaugcgccuuuaaauguuuuuuuccugggcugggcaacucucgcugucuggcagguuccagggagaggggcccaacuuggcagagcaaggcccaggaggccaacgcugugauguggacugcuggggcgggaaaccccucuucaucaucagcuucccagaagcaagaaggcaucaaggcccccccacgcagacuccaggugggagaggaggcucaaaugcauggcccaaggggaggugccucgacuccagaaaagugguuuuuccaaggcaagcuggaaauguccauuuccaugugagcagaauuucccgauuucacccagggagaaauuucuuuccuacagcgagaaccaaggcagaaacgugcuggcagcuguggacucugcggccuggagcugcuucuaggaagcccaagcugguguugcccuaaaggggcuuaaacccggcugcccacuccgccccuucuuccugaaccagaggguuuuggcuccuucccacugaauuccacuuccaccaacaauuacagugcgcuggcuccagcaucucaggugagugugauuauacuuuuuuuuuuucuuuuugagacagaguuucguucuuauugcccaggcuggagugugauggugcgaucuccacucacugcaaccuccgccucccggguucaagcaauucuccugccucagccucccaaguagcugggauuacaggcgccugccaccacgcccggguaauuuuuguauuuuuaguagagacaggguuucaucauauuggccaggccggucugcagcuucgaacuucugaccucaggugauccaccugccucggccucucaaagugcuggggauucuacccauuuuacagaugaggaaauccaaguucagagacaggcgguagcacacuccuguguucccagcuucucgggaggcugaggcgggaggaucaccugagcccagggguucaaagcugcagugagucaugaucacuacacuacacuccagccugggagacagagugagacccugucucuaaaaaauacacaagauucgggcugggcaccguggcucaugccuguaaucccagcacuuugggaggccgaggugggaggaucacgaggucaggaguucgagaccagccuggccaauauggugaaacccugucucuacuaaaaauacaagaauaagcugggcgugguggccagcgccuguaaucccagcuacucgggaggcugaggcaggagaaucgcuugaacccgggaggcggagguugcagugagccgagaucgugccauugcacuccagccugggcaacagagcgagacuacgucccccaaaaaaacaaaaacaacaacaacaaaaaacaagauucacugaguccaucaaggcagagguggagagggcuagcagccguccuggccaggugcuccccgggacagagaauaagaaacugaggaggggacgugcgaguacccugguccucaucauuccagucagcgggccggguggugacagagguggcccagccccucuucagggaaggcgagggccagcccgaaccggaaggggcagugucugaugaccacagcucucaggggcgcccagggccaguggggcagcggcagggccgagagcacgaccggcggaacucggacggcgcccagcggucgcgggcgggaucgcagggcgaagccgagccgggccgggcccuggcaggaaggggcggacccgccugagucucggaucuggcuuggcucgauccuccacucucccacuccgcuggggccgcccacuggacaucgcccgagucggccuggcggucgugccccaggacgcgccgagguccuccgagcccgcagggggcgcugucgccauauggcccacccugagucggcgcgggcaggaaguacgagggucacuuccggcgggggcgcggcuuggacugaggagcggacccggccgggcgcaggggcuggacuggcggagcaggugggguccgcggccgccggagcguuccggucggcgucugggcaucucggccucggcagaaagcgcgacggcccugcugcgcggggcccgcggcgaugccguuccugcacggcuuccggaggaucaucuucgaguaccagccgcugguggaugcgauucugggcucccuggggauccaggaccccgagcggcaggagucucuggaccgguaacucacccccucccgugagcuggccgaggccgcuccgaccccgcagcgucccacuuuaucaccacaagccgggcgggguggaugcgucccccuugacagaggaagggacgggcggaagccgggguugcguggcucggagugcgcgcugccccgcgcggaucccacuccugccccuugcauggcggagacgaagggcggggagggcccgagggcggaggcccgcggguugucgcagggccugcgccucagccccacccugucgccugccuguccugugccaccccccggcguggcagaggagcaggguggaauccgugaggccucagauguuaccccagagcagugugaaggugggcuuuuguagcagaguuugcguuuuuauagacaagagcuggucugucguggaccugcaggaaaggggucgggagcgaaucugcauucacugcccaugguacuaggcaccugggguccaucaguggcucagcaaaacccccgccuucuuggcgcaugugcuccagaggagagacugacaaguaauuguacggcggcacgcgagguggaagggaggggagagcagaaggaaggggcucggcucagguguugaggggguugucaguugguauuuccaacacgugguaaugaugagucucgccauccagggacucugguggaaacguaggcuuucuucaucaauaucagcugaaggucucaaugugaggggagggaggaggcuguguugcuguccuggcugcagguguugccggggcugggguccugcggguuugaggauggaagggcuuucugaggaagaagcaucaaagucgggcuugggcucuuggccuccaggcugguggucccuucagucccagcagcccaggugugugaggcuuuguaccuaagucugcgaccggacucugggcaacgcgggaggagagcgcagacagacccagcccauucuccgcaaaucccagucugcucccguauuaagagaugcagcguggcccucucucuacuucagagcuucccccaagccccugugacccacagagccagggcccugcuugcugaugaugauagcaggacuaaagcccaccaacccacaggcugcgcggucacccggucccacagcugugccuacccucagccucucuccugucccaggcccaguuaugucgccagcgaggagagccgaauccuuguucucacugagcugcuggagaggaaagcccacucucccuuuuaccaggaaggcgugagcaacgcccugcucaagauggcugagcuggggcugacgcgggcggccgacguucucuugcggcauggggccaaucucaacuuugaaggucagcgagagccccgggggugggcagguggcuuaaacgcggcccgacgcugggugggcgcccauguccccagccuuggcuucuaccauccucugaggagugacuucccccccuuuauuuccuggguggcugcaacuaaggaaacucccauuggguggccucccacccccugcggguuuucacauggcucuucccaccucuguuccaagagcgaguguugcugcuucuaccaugugauugauuagcaaacuuuccccagcucccagauuaauccccacuuccauuaaugcaaaaaugcggcugcuggcacugugcccagagcuaagggaagguaauuuucugcuacuuacucugagccaauuuguuuuuuuuuuucucaugccguagggagaggggaaaacaggcugcauuaggcauaaaucaccacaggacacccuggcuccuggcuccugagugccagggauggagauggagccgagcuccuuucucuguguuuuucagcccagggagggcaggguuagucggcagacaggcagggcugccuugugaccuaauaggggccugagacagccaggcacgucuccuuuccccauccgaagacgggcuuggagucugcugggcuccuggagggucaaggagcugagacgggagggccgguucugaagccagugacuuggagaccagcuuggagaaccuggcuguuaccaccaggccuacaaagcagagccgccagagcugcuguguagcgcggccucccagccauucugagagggugcgccccguuuuauggucccuucuuacagaagaggaaacuaaagcccccaacagcuucaguagcgugcccacuagaacaccccgagggcccucuaguaucuggugaggacagcucuguccuaacccuugauggugacaggaggcugggccugugcuucuggacacuuuaggugggaguuuggggcugggcucuggguccgggggccccauaagaaugcggacagauaggacccacaugagcugugucugcaccuucagacccagucaccuacuacacggccuugcacaucgccguccugcggaaccagccggacaugguggagcugcuggugcaucacggggccgacguuaaucggagggaccggguaagugccagguccagcuugcuuugaagcaggguugggcaggggccugagcagcuucccaagccaaccuggcugugcuuccuuggcucagauccacgagaguagccccuuggaccuggccagcgaggagccugagcgccugcccugccugcagcgccuccuggaccuuggagcugaugucaaugccgcugacaagcauggugggugccuccugcaggaaagcaggacagcugggcccccaggcaccuugugggggacacccagggugccccaggacaacagcuaggugggcagacuggaugcuggcccuggcugguggcacagcauggcugggcacacagggauucugcugacuugcugagcucagaggcuucagagaggcagugcagucauugucccugugcuggcccucaagggccuucuauaggaagaaauagggcaugugugcacuuaguuuccaagaaacaauggcuucccauugggagaggcccagccaacaucucagguagcaucuugggguccagaaaaauccuaccuuuccuggccuuuccgcucccacuucucuggguggaaagggaauggccagaagccugucacccucagcccucaccugagcugagaguugucucugaaaguucaucuucugauccucugagugucuggauuucugccaccuccucuggguugcccugaccugggcuuccuggccuccugcuccuccuugcucucccucccucccuaggaaaaacugcucugcuccaugcucuggccagcagcgacggggugcagauccacaauacugagaacauucgucucuuacuggaaggaggugaggcuggcgcgcuccuaggccucguccucucacccgccccuucgaugugugcuguugcuuugccaggguugaaggccuucucccagcaucucuuguucuauggcucuucuaggggcagacgucaaggccaccaccaaagauggggacacaguguucaccugcaucaucuuccugcuuggugagaccgugggaggggacaaagaggaggcccagaugaucaaccgcuucugcuuccaagucacacggcugcugcuggcacacggggccgaccccagcgagugcccagcccacgagucccucacccacaucugccugaagagcuuuaaacugcacuucccucuccugcgcuuccuccuggaguccggagccgccuacaacugcucccugcacggugcguccugcuggucuggcuuucacaucaucuuugagaggcucuguucccacccaggcugcacggaagacgagagccaugcggaccuccugcgcaaagcugagacuguccuggaucucauggugaccaacucucagaaacuccagcugcccgaaaacuucgauauccacccugugggcagccuggcggaaaagauccaggcccuccacuucuccuugaggcagcuggagagcuaucccccgccccucaagcaccugugccguguggccauccggcucuaccuucagccguggccuguggaugugaaggucaaagcccugccucugcccgacaggcugaagugguaccuccuuagcgagcacaguggcuccguggaagaugacaucugauaggucucaggcuacaggaacgggggacacgggcagcucaggucagccuguugguagaugcugggacagcauuagaagagggucuuuuugaucugggagaugagacgggauccuucaugagaaaagccagccagguagagccugaagcugugaucacuccaguggugaagggugcagcucugguucuuccagagagacugcccccuucccuccagcggcacuccaagucccccccauguuggaaagaggaacagggcuuggauugauguuuauacccucugaauuggagggcagugccagggcauuugcagaagcugggaaggaccaagccucagcaccccagggcugcggggcucuuguuggccgcacguggcagugcagcuggagaggaagccuggggcacguccugugcggugccaccaaggccccaccccugccccuuuuccuuccagguucuguuacucacagaaguguuucuggugggcucugcgggagaagacacuaagggccccacaggcuuguuucaugguguugcaagccaagcuggccccugccuguuccuguagcucuggggccaggucagccguggccccaccuaccagaacugugcucugcuggcagcugugcuuuugccaaacccagggccucagcgaccaugacuucugcuaaaaagcaaucaugagugcguggcuggggacagaccucucugaagugucuccuguugugaggggcucacuuuggagccacugaagagccgacugugccacccacuugcgagccucagucccuuccaagcugcacuggucauugggaauuguguaaacaccucuggggauaagcugaggugacuaaaugauauauuuauauuauaagauuaaacugacuuucuuggccuuaacaagguccuuauauaaaauuuccaccccgccccuccauaguucaggauagaggcucccacagcagccgguaaggaaguggguggcaggugugaggggaugcuguguuugggggguuguuuccaagucccugcaaagaagcaccacucuagacuggcaagggccuccacaguguggaggucccauuuuauuauuuuuuuuuuucgagacacucugucacccaggcuggagugcaauggugcaaucucggcucacugcgaccucugccucccagguucaagcaguucuccugccucagccuccugaguagcuggcauuauaggugcccaccaccaugccuggcugauuuuuguauuuuuaguagagacgggguuucgccauguuggucaggcuggucucaaacuccugaccucaggugauucgccugccucggccuuucaaagugcugggauuacagacaugagccacugugcccggcccccauuuuauuuuaguuuuauuuugagacagagucucgcucugucaccuaggcuggagugcaguggcgcaaucucaccucacugcaagcucugccucccgggcucaccccauucuccugccucagccuccugaguagcugggacuacaggcgcccgccaucacgccuggcuaauuuuuuuuuuuuuuguauuuuaaguagagacgggguuucaccuguuagccaggauggucucaaucuccugaccucgugaucugcccgccucggccucccaaagugcugggauuacaggcgugagccaccgcgcccagccccauuuuauuuuuuacuuuaaaugccugccaaggagcagccucaagcccagagaagacugaggcuacggggaacuucccuugcugcaggcuguuguaacacuuuaagggccccaggucuccacugccaagcaggacuuggcacaugagcacccaccccacagcaccaucaggcagcacccaugggcuccaccagcccagcucugucccuccccuagguaaagaucacacugaagucuucaaguccccagcaaccaaguugggggugguuuccuuccucuucaggcagccaggcccauggcuggaaggccgggcuggaggcccagggaaucgguuacugauguggccacccuauucccacauggggagcaccaggagcccuggagccccuuccacccaaucccaucucgcaggagagcagggucugggcuccugccucaccgcugguucagcagcacccuccccgccgggucccaccuugccuuuugaagaagagcccgcauaaugaguggacggcagacagcuauauuuaguggugccucgacacucacgaaccgccagcguggcgccuggaucuugcccagcugccagcuccccccaccaggacugugguuccucaguuucuccugccagccccggcucaucucagggcaaagcuauagacaugguagaucucaucggggagguucuccugccucuccucggccaggaggcugaggccugcacugcagaugauccugcggaccacgucaaggucccggcacacgcugcuguccacgucguccagaaucacgcccuccugggccauguugucuuugaugacgaugaugccguuggggcggaggcugcccuugcagcgccgcaggaacucggccaggugcugaucggugagguggccuggggagggcagaggcaagguuaccagggcaccaugcaagcggaugucggcacuggaugggauguacuucucagccccgcugagccccucauuugugcccagcauuuugugugcacacauggccucauuggcucucagucccgagagauuuacuaaaccccaauucauagaauaggaaacuguggcucagaggucaucuaccuaaagacacauuaagccagaauuugacuugacgggauggcuuacaaguccugccugauaccuacacaccaugaugccccaccccugccaggcuuggaucggaggagugaaccug

SEQ ID NO: 13137 - RNA, 1482 nt, Homo sapiens
cccuucuucuuugcccauuuuauuauuucgauaauaaguaucuuugcgacaaacuagaacuagcuuaacuacuagaggaagccaccaaaugacuuuuuucuugaauaacucacugggugcuguaggcacugugggaggaaguggguauguggugagcucuuaaaagcuacccaugaagacuggugaaagcacagcagagcacagccucggaaaugucagcccugggcaggacacuccucguuuaggccucggcaagucuaaggaaaaugcccuguagcaggaaguggcaucugaguaaagaaccaucgagugguggguuguggggaaauaugucaguuuguugaauuccacugcuuucugaagaacaguguugcuaaucucuuuauuuuggggugguuuuuaaacuugcagcuccuggaugaaacggccacacuggucuucuuuguucuaacgggguauaaauuccguccggcuucagauaaccccuaccuacaacuuucucaggaagaagaagacuuggaaauggaguccguguaagaaaucuuucuucccucuuccuuagcccugaccccuuugccuaacacaaagcagcacagugugaaucgggucggcugcucucagcauuucguggcugcaggggugguuccucuauuuuuagcagaaggaagcggacacuggagccccaggcugucugaucugguuugaaguacaguaucugccaaaccuagcugggucuugucagggaagauggaacuugccguuccacuaagcaucauuggagccugcuuucaagaacucaguggcaagaacuuaggaauauacguggccaguucacgagggagaacagggggccgacuuucugucaggcccgccaucaggcgcuuacgucugaaaauggaaucuucugagucaucucuaagucugcuaaugauccucagacauccucuaucgucagauaacugcguggcuuuucacagcacaaugacuuugaccuauaucugagcacuaauaggggcuuuucugagucacacagugaaugacucuaggguccuauuuucugggaaagggccaucauugucuagaaaaaugaguagugauuaagcauauuugcuuguuaacugaaauuugauaagccaggucaaugcuguguuugaugauuagccuaaggcagaguuuucccuucuugguucacugguaucaaguguucugcccccagcccuggcagccuuugaauucuucccaauucagaggcugagacucggcccaugcuaagcucugcuuggcugucagcgggucaggcagcaugggacagcucucucugcucagcuccacggcaacaguaaaggaaggcagguccugccagcgggcgccaaacagcaucuccccaugcagaggaagaaacaccuccuucuaaacaguggagaggagugcaggaggcccaucagcugugccuuucccagaaguggcaggaucugagcaagu

SEQ ID NO: 13138 - RNA, 1504 nt, Homo sapiens
gucuacuccaggcauccaguccuuacagaccaaggaagagcauagcgaugccuguuggaauugcagaugcauucuggccuucucccccguccugaaacauuuucuuugaggaaggcucuuagaacauuagauagucugcugagguuguuggcccagcuccauacacccaguagaacaguggaacaacucaugcuucaugcugccaagcugcuguacuucaaaggaaacagaucuagcacacugcugcaccccugcuuccacacuccacacuucaccccgcugcuuuucucugacccgccccuggccuuguaagacucacguaagcuaaguccaggaugccuguggccugcggcuugauucuucccuuuaggauucagcaaguuaauggcuuccucgcuauagaagugagacuuugacuugaugccucuugguauaucaaaaagauauucauccagaaaguaccaaauguucugaaagacccgcucuucacuccaguuuucccuaggguguuucuggcagggcguuuuuaaaaggcaucuaccugaguugacgcuaauacuugucaccaccuggaacguaguuaucggucggcaggcugaacauacuccagauuccccagaggccacuucuguagcccagcgaugcaucugagccucucugcgugguuuaugcuugaaaaauagauaaugcuuuuagaugguucacugccaggccaugggccccacacaucucaggcccugugugagggagcacacugagauggugcaggagugaaugggcauggcuuggccucgcuaccucggggaccuguuggaguucuggcagcagggugucugcaggugggacggcguucugggcagagucagaauggucagaaugaaacagaacagccaacucacccacaggacagcuuauuuugaggcaagguuuuggauuuuggaggaagcagccagaugaggcggugagccuccagaaggucagccuuuggagcacguaagauacuguuacaggguccagaaaucguguucacaugggggcuuugacucuucaaacagcuuuugcagaucguaaauugcauuugccuagucgugugaccucaaaagaagucagacauauuuaauccagaaauaguuucguuugagggagggcuugcaggucuguaaauagcauuugcuuuccugguuagagauugggaugcagaaggaguuuucaguauuuuuuuuaaaacacuaaugaucauugaagaguauuuauguaaacauacaacguauaaugggugggggauccgaucauggugauguacggggugaauucucuugccguguugcaaauguguaaaauaaagauuaucuggcagaaccguguguguuugagaugcagggaguugccggcuccuggugcugucucuccuccaccuccaucucauaauuuuuuucuuugugauuuuuguucauuaaauuaguuaacugccucccaccagcuccuacugacaauagugacaccu

SEQ ID NO: 13139 - RNA, 56409 nt, Homo sapiens
ggggcggggucuguggcgcgcguccccgccacguguccccggucaccggcccugcccccgggcccugugcuuauaaccugggaugggcaccccugccaguccugcucugccgccugccaccgcugcccgagcccgguaaggagcccucggccccucucgcugcccacucccuagccgagagcacccgcuucccgggcccagaggaggaggcguagaagacgcccgccccggggcccgcggaggcagagggcggaccccgaucgccacucgccggggacugggaccgaggcaggagggaaggggcucccgaugcucaaacgccuggcaccggauuccagguuucuggagcgugggggacgcggcgggggcgcgaguccccgggggcgcgaguccccggguccgaagagcggcucggguuauuuguucccugcgcagccggguccuuucuggacuccuugucggauccggcuuccucugugucgugaagcccccacauggagaccuggggaguccggagcgugugggggggcucccgauucucucucccucucucggacucgccgucugucuccaccucuauuucucugcguaaaaccaggaguccagccccucuggggcuuggacguaucgcuuuccccgcagccucaguuuacccuggacagaugggcaugguggcccuggcucccuucccugcagggggcggcagccaccuggcccuccccgguggggcuggcggccucgcggcgggguuuccugcuggccugggcugggcucugugggaggggcagugccaggaauauuuucuauucgggcugcuguugccuuuggccccugggcggcugcgcccuccagggaggcagggucauugugaaagagaggaaacuccucucccaggcggccagggcuguuccugaggagggcuggccuggccucaguauucuucucugagaaguggagaguccacucccgagcagccgagucaggcugcaggucucagggcaggaacagaccuguucucuccccagggguagaucaagaccuaggggacuugggcuuugauccucccgcucccagcaagcacaaacccagugauggggagagcuggugaggccuuggcucagccuccagauucccaagcuuccuuuucauuuucuuuucuuucuaaaaauuuaucagagauguggacucgucauguugcccaggcuggccucgagcuccugggcucaagcgacccuccucccucgggccuccuaaacugcuaggauuacaggcucgagccacccaaagugccuggcccccaagcuucagucuguuagagcuggcuggggcugagggcucaggaaacauuugcagauacugugcggcugcuaagggcucuguagacuguugggugcugggccuggguccaauugcacaauaacugugccugggguuagguucugaugagagggagggagaagcagccacacggacugggaagcuuggcuaggagcaggaacuggaggagucuccauuccaaacucccucucccucccagaccccuuaggcccaaggccuagggcggggaaguuugggggugggggcgggacccuguccuggcggggccaucugugcaccaugcugagaaguaauucugguucugcucuguggggguggaucaagugaaugaauagugacuccugccugcugagcgccuggccggugcgggggcagacacgucgugagagggaaggggaggccccacucucagcacagucuccauuccugagugcuugggaagcaggcccagggccgcaggagccuugggguggagccaggcccaaaacagccugcugcacaagcgcuucccccucccaacccgggcccaucucaucuuuggccugcugggaggccagccaggucaaccagaugccucaucugagcacugacuacacagucccugaagucaguggcuugccugugggcaccaggcacccauguggaaagagguaacuucgcuggaauucagagucuaaggcucugauuucugauguagcuuugggcaaaguugaucuuccagggcguggcucccuccccagacuuggggucgaccaggcacccauaggcacuuugauaugaguggaacgaaugaaugaaugugcccuucguccaucaccaaagacaaaccgagcucagcugaguuagaaugucagcgagggguugcaggggaaucuuccacggggcaguaggccugagcuauagcacacaggcucuccagagaaauagugggcagguuggccaugacucacuggggggcugguuuucuggaagguguguagagugaaggggagaucugaggucuccuaggagccagggaguggaaggccuagugcagggaagagcaaguggccugcagucaggcuggguuugaagccgcuagcuugugaccucggcuggccgcuuagccucugccuccuccuuuguaaauaggugguaauggcagucuccaccuugagaggaugcaccugugacugugaacauaguagccgcucuuguugucauuccagcucugacguuuucaaguagcacgaguuuuccuuagugucaagugagcgcccaggcuggccuguuugcuggaagcuggacagauggcuguggcuggggccacagagaaugccaucccaaugaaagccagguggcucugguaccuugacgcgaggccaccuucccuccucccaggugucucuuccggggaaggagggcuggagggcagugggcauuugccagggagcuggagaaaccugccguggcccuuucugggggaugugguggggguggagcugggacuaggggaggcugaauucagccaggaucugccugccaggcgcagcucccaggaagaaagcccaaugucugggagggucagaacccagagggcugucagguuguacagaugaggaaauugaggcuuagcaagccaggaacuuggcugaggucagccauagcagcggugcacagagcuuagugggcacauacaugcuuggugcccagcucugggcuccuucccccagcaucucacccaauccuuacagucgcccuguggggagcaggcuguuugcaccccuauuuugcagcugagcaguuaugcuagagagcugaagccacucaaacccaugucugguggacuugaccucuguccugugccuggagugagcgcucacuggauugcagcugugguuccuucucucccugucacuuccucccccgacaucaaacccucaguuucauuuaguuuuugccucgggcugcaaaugcagcuuagggaccugcggaggcugagggaggggggugccccacccgcugcugggagggcaggagcaacgcugcugucugauugcaucauuuucccaagcccaucugcccagcucauuucucugcaugcauacacuggccccaacacccacacacgugugcaugcacacaggcacacaugugcaagcccaaacacaucacacacaugcaugcacacacauuguguacucucagguacgcaccccugggugcacacaggugugugcgcgcgcacacacacacacacacacacacugucucagguacacacgccagguccaugcauugcuucacacugcccagccccagaggcugaaggccucagagcccacaccugcccagcuacaaccuggcaggcaggaggggcucacugguuucuuuugguuuauuuaagacagaguuucacucugucacccaggcuggagugugguggcacgaucuuggcucacugcaaccuuuaccucccagguucaagcgauucucgugccucagccucccaaguagcugggacuacaggugugugccgccacacucagcuaauuuuuguauuuuuaguagagacgggguuuugccacguuggccaggcuggucuggaacuccugaccucaagugauccacccaccucggccguccaaagugcugggauuacaggcaugaaccacugugcucggccaugagagcauguguaggacuccacagcuucagggcaccccagcccucuuuuugcggugaggagcugaccuccagagaguggaacuaguagcauuguucuaagugccugccacaggcaucugggagauggucccuguuuccauggagcucauagugggggagagggcaguuagaauacagcaugauggccggauguaguggcccaugccuggaaucccagcacuuugagaggcugaggcaggcagaucgcuuaaguccaggaguucgaguccagccugggcaauguagugaaaccccaucucuacaaaaaauacaaaaauuaggcaggugugguggcaugugccuguagucccagcuacuugggggugguggcacugagcugggaugggaggaucccuugagcccaagagguggaggcuguggugagcugagauugcaucacugcacuccagccuaggugacagaaugagacccugucugaaaaaaaaaaaaaaaaaaaaaggauacagcucugaugggcaggaggcauggcgggucacugaggcgaugcaggugauccagcuguuucuguggagcugccccuccguguuucuguggagcugccucucuuggcuccaggugccucugggaggaggcaggagcaggggugacucucagagcugggugaaucuugggccagcaucaucagaucacacuugcccaggacuucccuuccuugagucuccagugguggucuuguaccuaugagcaggggguuaaggagccgagcugaucugaguuggaguccuggcucugcugccuaccagucaaacgagaugcagggcaaguuccucagcccaagccucaguuuuccugacucuaaaaugaagagaaccccagauggaagggcuuagccuaagacggacaugucuauucccuugauugugguguugaugucacgggcgcauccgcacgccgaaacuugcuaaauuggacacaaaaaaauaugcgauuauuuuuguaguugaugaaugugcugauuggguauucucgugugugugugaggugccacccucaaacuuuguuaugauguuggcacauuacccaucugauauuuaaaaaaugcaauuuaugauaugucaaguagaccucaauagagcuguuuuaaaacauacaacagaauuucccgcaacccaaccacaccacccgcgccaucacacgcaaacagggguaggcuuccacauauuuccugaaugccuucuggagcagggggcaggaggcaggaggcaggacagguggcucuggggcuccuggaccuccucugcucagugaggcugcucacaggagauugggcggcuggaaaguaagguuuagggccucugggauggcccaggcuaccugcaggcagcugaguagcucugcuuuugcagagugguucacugcacugugaaaacagauuccagacgccgggaacucacgccuccaaucccagguacugcccaccuuaaguccucccugccugccuuccucccuccuucccuccauccugcauggccaauugccuggcugcaguugccauggauaccaccugcuggcuccaggguuagggcuggcugagucaccagcaacucaggggcaggggguugaaugcccaguagggacguugugggcaccgaccagaaccaucuucucugccccagcugcaugguccaugagguguuuccccuucuaaguccaaagggcagcacaggccugugagccccggcugacuggcaggugggaccgugcagcaugcacgggacugaauucucaugugacggagcuccaaaguccaccuggcuacacggccaggcucugcagcagaggacgggaggccugggaaaggcacuuccucuccccgagcuuccaggcacacagagagugcucaggauagcgaugccugcaucacugcaauggugauggccgggugacccuucugggcuccacuuccccaguagugucuaauaaagacccugggugacucugaccuugugacguuggucagacuccaguggaaacguucccaggcagaacaaacaugcccuguacauuugggaaaugcgggaugcuggggccagguguccacggaggcuggaaccaggaggccugggcccacaucugccccugcugcuuguugauccgaugacccugggcaggugaccucgucucccuaacccugguuuccuguucagcaaauuggacacagugaagacgcccaagcccagggccacaggaggcaugugggggaggggggugcagggcgagcccaagggcagcccaggauucagggagagcccucggggaagaagcauggcugcaaagaucaggagacaggaggccuuggcgccuucgggaggcuucauugugacggaggguggggcaggaugggagaccgcaggcacuucccggcugcagagggccuggcugcagagagcccucgugcccaucuguccccccgggaagggccgcugguugcagaggucuuaggccucugccugucuaucgccuucccucccugggccucaguuucucuaccuccacacugggggaaguuggucucugagccccuccaaacugggcauuggcagaguugaauucagaggcgcucacauuuggagacacgaugucuaaaauuccagccagugaagguuccaugggguugcagguaggagagggacuggggcugggccccugccccacagcauccuucuccaccugcaggugggcggcggcacugcgugcuggggaagcacagauucuugugcccucugugaccuugagccugccacugaccucucugagcccugcuggcugccuccccaauaggaaugacaacuccuacuucaugagguuguagugggggcucaggggcacagggagaucccgcugaggcucccagggcccugccuggugcuuggcaaggagcaguucugaugggggaugugucagcugccagaggcucagagccaaggccccucccacaucuccugccugcgugcauuccucacauccuggccuugggccaaacugcucagccucagccgccuucccucgaugcuggaggaucagguccaagagaugccucuccccgaccagccuaggacugcagucagcauucccaggccccaguguggucuguggggcugugugcagagugugcgaggucaggguucccggggguggcaggcacugaaggugaacauccuguucccgaccuucaguggcagcuugcccaggagacaaggcuguccaaggccaaggucggggcugggcugucugcaggggcuggcggggggcacuggcugucucagggucacucagguuguuccucgacucccgccagacgcuauguccagcaaaggcuccgugguucuggccuacaguggcggccuggacaccucgugcauccucguguggcugaaggaacaaggcuaugacgucauugccuaucuggugagggagcgaccugggugucugucuuccugcguguccugcaaccuguccugucugcccccugccagccucugucuggguugucagccugucugcucaccgucacucauucaagccuggccucuucucucgaagccugucuugaacuggaacuaggaaaauagcuucucguuguacugccucacuuucuccaucugcaaauuggccauccuugagaugccuuccagagccaggugauggaggcgcggggagggcacagaagugaacuuggcagugcugcuggcuuagccugcuugcagagaggcaugggcugggaccugcugccagcccugggaaggcacacagucuucccaucuccagaguaugcugucagccugcaguaauucagcaaagauuguggaauccugagcuggaaggacccugggggaucaccugguucugggaugggaaauaggucacaggugauggguuaugugugaagccacuuccucauccagggcccauaggagucaucccucucaaacuagcuccucuucgacugaaccuggccacagcucugaguccuucucuguguggcugugcuguucaggacucuuaggugcaaauuuuagaaacugaacucaaaccaacuuacgcaaaaaggaaagggaaaagacaauucuuggcucacacaacugagaacuccagggguaggauggcuucaggcagggcuggauccaggugcuucuaagaucuaucuccaacucuacuuggcuucauucuuggccucuccacagggcaggcaaggcucauggucacccucauagcccaccuuucccaaaaaggagggcuuacccccaguagggcccauggggacccaccacgcauuagucccuauggcugcaucauggggugcgaggcuugggccaugagccuacuccuucagugggcgggauuucuuccucuccaucccuguggaaugggguccacccaggaaagaagguucuguuuccagaggaagugagccugggucucuggacagacaaaacuuagcucuugccaaaaguggcuuguuugccggcauauuggcaugucuaacugcgcccaaugcccuugucauucagguuggggaaagugaggcccaggggaagaaauacuuugcucacagucaccuggugggugagagcacagcuuugaggggcugcaaagagcccaggguguauccaucucacuguagguagcacagcggggcaaucagagcuggagcugggcguauagaccccugggcuaccaccugggggauuuaaaagcugaaugugauucagauaagcaccugcagcugggcuuuggcaagauuccagggucuggugagccgaaugaagggagugagggcugaggccaggaucugggcagcaggccagaguccaggcagcaggaaacauggcagugucuagacaggggcugucagaccccgaggucagggcacuggccacagggacggagcuggaaguuccugagcacgggcuucucugccucccgccucucagcugccucaggauggccaaggcauggccuuugacuagggaggagagcuggaggcuaggaaggcccugacaagcuaaucuuugcacuggcugagaaagaguuuucuggaaaagacagaugaguuucaggagaacccuagaccuuccagcaaugacagcagaugguugucucccagcagccuguguggccagggccaggcucagccaaugcuccaacccauggaagccaccagccaucaccacgcuacaauccagcucccaaucucaccuccuggaagaaucucaccucuccaggccuugggcuuuguccuuuuuccuucuuacugugacuuggccauggaauggaagcugucucuguagcagggggugggaggcugcugcaugcggauggugugaacucagggcuccccccaggggcugacggagccucuccgcuucugcuucucaggccaacauuggccagaaggaagacuucgaggaagccaggaagaaggcacugaagcuuggggccaaaaagguaccaggcgggaggcagggauuugggcugggaguggggcggugauguggagggcagugguggaugcuccugccccagggaucccaucccuuccagugugucuucuugcuucuaagaguaugagaucauccugcucucaggugugugaacccucuuguuuuucugccucccccacgcccucuuccacccacccaccuucccauccagguggagugucucuuccccacccacauaccuucccuucucuuuuaucucucuguccaucuaugcacccacucacccucuuuuaucucuguuuaucuacucguccacauauccauccaucauucaucccuccauuagcuauccaucgauccauccauccauccauucagccauccauccauccaucacccacccauccauucacccaucauccauccauccauccauccaucacccacccauccauucacccaucauccauccauccauccauucauccauucauccaucauccauccacccauccauccaucacccauccacucauccacccauccauuauccauccauccauucauccauccauccaucauccaucuauccaucuauccauccauccuccguccauucauccaucauccauccauccauucacccaucauccauccauccaucauccauccauucauccaucauccauccauccauccauucacccaucauccauucauccagccaucauccgucuauccauccaucauccauuuauucauccaucauccauccauccauccaucauucuucauccuuccaugcaucauccauucauccauccaucaucuacccaugcauccauccaucauccauccgucuauucauccauccauucauccauccaucaucuauccauccaucccauuauccauucacccauccaucccuucauuauccauccauccauccacauauccaucugucauuaaucccuccacugucuauccauccauucauccagacagccagccauucaucuauccaucccccauccauccauccauccuucauccauucaccguuuuucuauccauccauucauccauccauccaucugucauccaucauccauccuucuguccaucaucccccuaccuguccuucccucuuuuaucucucugucuacccauucuuccauucauucaacagaaucagagaacuccaauugagucuggugccuugauugugaaucuaggcauguggcaggcagaccccugucccauacagggcauuuaugaugaacagugucaucaggaccccugcucacaugugcucacuccccauggagaagcccuugccacuugugccccuucauuugggagagugagcaggggacauagcagggaugaugugcaaggccaccagcccaccugcagggucagagcugauccccucuguggggugcuucugcaggguugccaggguaauuagcauguuaaaaugaacacgggagggaguggaugccccagucccaagucaccuacuggccacaggccuggaacuagaaugucccuccuugguucugugccucccgagugcuggagagcagagggguugucugagcaguaguccaggaaggggagaaagagcccugaguguugaagauucgagugcgcuuucagcagcgcaggagcaggcuuugugcacggcuucagcuuuuguccuuuauucuagaugagcaguucucaaaacuuguggucuugggaauccucuacacucuaauuuacguggcguuuuuaauguuuauuuucuugcauauaacauuaggaugggccaggcacaguggcucacgccuguaaucccagcacuuuggcaggcugaggcaggcagaucaccugaggucaggaguucaagaccagccuggccaacauggugaaacccugucucuacuaaaaauacaaaaauuagcugggcgcgauggugggugccuguaaucccagaugcucgggaggcugaggcaggagagucgcuugaacccaggaggcggagguugcaguaagcugaaaucacaccauugcacuccauccugggcaacaacagcaaaacucuguaaaaaaaaccaaccaaccaaccaaacaaacacaaaaacacauuuauccuaauguuuuuuauauauccuuagucccaauugcuuucuuuucuaugccuuuuuauuucauuuuuuaaaaggauuuuuuucaaaauaauuauagacacaggaaguugcaaaagcaguaccaagaauuucucgacucuuaaaaauuauugaaggccuuggcugggugcgguggcucacgcuuguaauccuagcacuuugggaggcugaagugggcagaucucuugaggucaggaguuugagaccagccuggccaaccagccuaguuucuuuaguagagaaaccccacaugccuguagucccagccacucgggaggcugaggcaggagaaucacuugaacccggaaggcagagguuacagugagccaagauugcaccucugcacuccagucuggaugacagagaguccaucucaaaaaaauaaaaauuacugaaggccuuagagagcuuuuguggauuacaucuguugauauuuaucacauuagaaauaaaagcugaaauguuuuaaaugaacaguucauguuaacauaaguaacauuacacuuaugaaaaauaacuauuuucucaaacaaaaaauuuuaguuaagaaucuuauuggcuuccauuuuugcaaaucucuguaaugucuggcuugacagaaaacagauggacucuuguagcgguuuucugcauucacuuguuuuuucguuuguuuguuuguuuuucuuuuuuagccucccagggcuuccucgcuaugugaugccuuguuuuauugaaguuuaugaagaaaacugggcaacacagugagaucccaucucuacaaaaaauaaaaaacuuagccgggcgugguagcacaugcccguagucccagcuacucaagaggcugaggugggaggauugcuugaacccaggagguugaggcugcagugagcuaggaucacaccacugcacuccagucuggaugacagagaaagacccugucucaaaaaaacaaaaaaaaaguuuucacucagugucucccugaaaagucauugggaaccccugggggucuacauuucaagaaccauuccucuggaucgggguuucucagucuuggccuuguucccguguggcuggccguccugugcacgggaggauuuuagcaguauccccauagccuuuacccacuagaugccagaauuccaccccccaccugguaguuguggcaaccaaaaauaucuccagauacuuccaaaugccuccccuacucccacccccaacagggacaaaaccgucucugguugggaacuacugcugugagaucuuaggugacaacuaaguuucaucuuguuggggcugauuuagaagccacauccaguuucacagaacggugcaucaggauugauuagcaggcuggccgcgguggcuugugccuguaaucccagcacuuugggaggccgaggcagcuggaucaccugaggucagggguucaagaccaaccuggccaacauggugaaaccccgucucuaccaaaaauacaaaaauuagcaagccaugguggcaugcgccuguaaucccagcuacucaagaggcugaggcaggggaguugcuugaaccugggagacggagguugcagugaguugagacugagccacugcacuccaaccugggcaacagagcaagacuucgacucaaaaaaaaaaaaaaaaagagagcuauugauuagcaaugucugccaugagugcaggagggagaguaacagugcagugugcugggauugaugaaugaugucuacuacagaugcagaagaagaagcaccagguacagcggggguggccccguauaggucucagcuagcugaggccccuggggcucuguaugccagauggccccuguccuugccuacuucuuccuucugggcuccucuucccguagguguucauugaggaugucagcagggaguuuguggaggaguucaucuggccggccauccaguccagcgcacuguaugaggaccgcuaccuccugggcaccucucuugccaggcccugcaucgcccgcaaacaaguggaaaucgcccagcgggagggggccaaguaugugucccacggcgccacaggaaaggugaggcaccugggaagggccgggcagagggagauggaggcggaggggugugggaaggagaugagcaccccucgagcgguuuccuggugugccuccggggcagacuuggugcaaggcagcuacauggcuuuguuuagaccccaaugagagggguaacagcucgccccugcgcucugugcacuguggcaccugaacgcccauucugaguccucaccuccaccuucugcugugggagcgaugucaccccauuuggcagacuugcugcugaggccuggggacauuguccaaggucgcauuggccaaggucacugcgugagucccccaggggacacgcaggaaaguguugaaaacccugaguuggcagaguaggguucaaaggcagcucugcugcuggcuugccguguguccucagccagggcccuucuccccuuccugaaccucaguuucuucauuugcaagauggggcucaugccaugucuuaguuucccagggcgaggguaacaaaaugucucaaacugguggcuuagaacacagaacuguucugccucaugguucuggaggccugagguccauagugagggcaugggcagggccacgcagccucugaaggugccaggaagccuccggcucaggccucucuccagcuuccaguggccucuggugucccuuagcguguggcugcgucacuccuguccuuccguccuccaucuucccaagcugucuucuuccuguaucucugcauugucuucccucugcuugucuguuuaccuuccccuugcuacaggaacccgucuuggauuagggcccuucaaugaccucaucuuaacuugguuacuuuuugugugugugugugggggagagggacaaagucucacucugacgcccaggcuggagugcaguggcucgaucuuggcucacugcaaccucugccucccagauugaagcaauucuccugccucagccuccugaguagcugggauuacagguguguaccccaccacacccggcuaauuuuuuguauuuuuaguagagacgggguuucgccauguugggcaggcuggucuugaacuccugaccucaaaugauccaccagccuuggccucccaaagcacugggauuacaggcgugggccaccaugcccagccuuaacuugguuauuucuguuaagaccacaugaggccacauucggagggacugggguuaggacuugaacccauuauuuuguggaaacacaaaucaacccaucccguaccccuucccuccgggccgugugucccagugcagacugcgggguccccguggggugcaagacaggaagcccccugccugcugcucuucggaaggcaguccuugagaaaccagauuccugacaauguuggcaacugucagccgauguuuuuauaaagacccaagucaugagcucucagucagcggacagcaugccaagagccugguacaggaauugacuguuuaccaaccccacagucagaaggcucggaaacuccccagugacggggagcucacuaccucgccugcccgggcuggucagggugcugauggugggaaguccuggcucacugugggagguccuggcucacuguggugcagggacacacacagcuaagaugaugauggaggagacgcgguugauuugaggguggccugggagacagccacccaccaggauggcaccugucaugucuuugaaaguccaaguguucauuucuucaccggagcacugguucagcaagcuugcacuggguaucugcugggaguugggugcuugcuggcauuggcacagugcuaacuucuugggcucauugcguaccuucagagagcccauuuccuggcaagagaagagaaaauggaugugugaugaggaaugggaguggggccaggggucugugccagggaacugcgggagcagcaggcaggggcugaggaugagucuagaggagugaauaauggcauggaagagugugagaggcagagggaacagccuguggaaaggcuuagagccaagaggcccugaaggacagucugucuggggcuguggagcaggagcuauugcugugggggaggcaauagggccaggacugggcugaggccaugcugggagguuuggcuucauccugagggcaacugauuaguggguggaaggaggucucagguuggauggagguggccagugacuaccccagcgagaugcuggggaagagacaggggagagcuucucacagacugcggccuugguuuuuacugucacuccagcuguggaugaugggaugguaggaaaccaggcaaggagguuugggcgggccugagcuguugggcaggaccguguguaugcugccaucugugcaaaggugguggcagaggaggagaacccagaggaucaggacugggcgacacagcgagacucugucccaaacaaaaaaaaaagcucccgacccaucugccuuaauggaaagagcuggaucgugagcuuccuaucccagaaggcauacaagccgagggcaggggaucagaauucugggagggguccugcccucaggucuuuccaacgguaccauuaagguucaguagggcggcauucaggucugguggagugcaugggugggugggugaguaugggugggucggcucuggcucaggcaguucccggguccaugcggagacccccaccccggaccagcccacauuuagccugcaacagccucccgcagccgugugcgccccuccuccauguggccaccagagggcgccagaggcuuggguuugaggccuugggggccgacaaaggcgggaggagguggcggcaccaccgggguccucuguuccccauccuggaccugcagggcgugguucugaggagaacgccccccaagcuagugcuauggccgcucgggacuugggggcgucccugcauucacacucagaagacccaacagggacggacuccggggaugccggggaguaggugcuaccuggcacagccaccucuuuccugggguugacaggcaaggcguacuucugcgccucagugucccuuuaugacaguacccaggaaacccccaacagccucuggagacaauuuccgagaacuggggguaugaguggagaaccaggaaggcugggagcgaggggaauccaaggccuuggaggugcugguccagccuucaggcauuuacccccugaguaaccacccagcaccaccaucccaugaguauccacccagcacugccccgggcgccaucacgggggacgggccagguggaggcuuucgggucuuugggcucagggaaggugacagugaaauguuggggggacaacggauuggccugggaugugagggggaagggcauccuguuugcuggaaccgccugagcccagcccugaaggcagaggcggaggcagccucccuucccagcaccccguccagacagcaccuggugcagaaauugagccgcacucuccccucccaugcccugcugccagccccaccccugcccacccagagagcugcaccgaagcugggguggcccuugcggggcuccucucucccccuaguuuuggaagaggggccuggaaauaugauucugagacucuagccggggagcgagaguuuuguaaauggcaccaucuguaugggugccccagggcagaugggagaccccaggccccccagucccagugggaccguguuuacaugcauguuuacacacgugugcacaaauaucagcaugcggacacucgugugugagacacuacauccuccuucuccccggaaagcugccaggagcugcccuggugcuggggucuugggguucagagggggaaggauuagacuggccuccuuggcucuugccugagacgagggcagaguuugaaccaaggaagcguuuguuuggccucuucgagggucucuggcuccugaacagauggguguccgcauggcagcaucuggaugggcagacagcagcccagccgugccuggcuggugaggcacaagccgucuuuguguuggggaaacaugaagcugugggggaaaauagcugggccaugcaacgucggaccaugccuuaccaucuaaaaugaggcugucuuuuaguugcuccaggaacggggccggcugggggucagcaggcaaauguggccgcccccaccucaguguccucauccguaagaugggacuaauagaaccugccuccuggggcugcucaaaggauucagugaguuaauuaugcauggagcucagcugggaagccugagugugaaccguuaggaugagcgaguuugcuguguggcccugggcaaguggcugcaccucucugagcuucacuuuccucacccauaaaauauggcuaaaaaucccccuggcccugggggccucucugagugacagcacauaguaggugcucacuaaaggggcugcauggagggugagugaggccagcccaaggccugugccgcacacacagcucccagcucugcagagaggcugaacccuggauucugugccaccugacgagagucuggaaaauagcauguaauucccaccgcugccuggcugcgcccaugcaguuuucacaguaggcaaaaggucccucugucauuuccacagcgcuuaagucucccucugggcugccgagcccacggggaagcaggagacgugcgcggccauuuucucucuggggacagagcugggcuggcggaugccugcgcugaccccggccuccuccuccucggcaucaguguggacgguggucccggcuaugucggggguaacguucacagcucagugggguguugaggugucuccauuugcccacagaggaugcaggcgaggcaaccugcccgaggggguggcuguggugcuggggaccugggcuugggucccgggccugcccuggcuguguguccuuggacugguuccuuucccuuccugggccucaguuucccucucugugcagagaagagcugaggagcaaaaggcccucaguggucaccuaguuccaccuccucccugacaccagccauugaagagaugcggaaacugaggcucagagaggugacaggguucccaaauguauggguaugggggaguccaagcacccuggugccccagcccugaagugagcuugauuuggggcagggcagggucagcaaugugggggccuugaggaagagacuauagugcgagcucuggggcugcaggagcagggccuggccccccaggucuugccaguggcugggccuccagcuccagggggucagauguguccugcacccacccacgugacaugugugcccucuccuauacucugccauguccccagacgugcacaucucccuccugccacaugcccacacauacacgaccuacacugcaugaccucacauguguacacgcucugcccagcucugucuccgccacgggcuguccuuguccucacguccucccccagacuccagaacccccauccuguggcuccugacagcccucuguucugcauugcaggggaacgaucagguccgguuugagcucagcugcuacucacuggccccccagauaaagguaggauguggcuccuccccuuagcagggagcacuagcaucugcagcaccugauggggaggagggcacaggguucugggagauuccacaggacaggcacagaaucuccuccguggcaggggugcccaucggguggacagccugcuggggaggcucccuucgcuggggccagcuccaggggacacacuuucuuccccgccauucauucuucccggagaggcuguccaggugcuggggcacgggauagaaagucccugccacucuucagccacaucccuggcaucccaggugugggcaggcauggcucuggcaccccaggugcgggcagggauggcucuggcaccccaggugcggguggggauggcucugaaacgugguugcuggugucugggaugcucagagcccuccgagccccagucagagcccccagcuaugccuggcuccuccccaggccaccugugccugguccccagcaucucuugagccuuuccuggggugggaaucaccaggaucucagggccucaaccgcccuggcccguggcaugucacccaggcaggagggcaccuguggguauugcccagacugcuacuaccauccccaccccuccagcuugaccuuggaccuggccugcguccaugcaugaaugauggacacguuccuuccuucacucgcuagcucauccuucauccagugucuacugagcacccacucagcuccaggggugccgagugcagggcccagggcagggccgagcagugggaguuugaggcacacugccgcugcaagcugcccaauuuuucuaguagccauauauauaauauauaaauauuuuuauauaauauguauuacauauaaauacauauguuuuauauauauauauauauauauauuuuuuuuuuuucuuuuucuggagacucgcucugucacccaggcuggagugcaguggcacaaucucacugcaaccucugccucccaaguucaagcaauucucccugacucagcuccugaauaacugggacuauaggcaugcgccaccacaccugggguuucagcauuuuggccaggcuggucuugaacuccugaccucgugaucugcccgccuugggcucccaaagugcugggauuacaggcgugagccacugcacccggcuguaguagccauauuaaaaaauagaaaaaugaaacaagugacaugauuuuaauaacauguuuuaccgaaaccgauauauccaaaauauuaucauuccuccuauaaucaauguaaaaaaauaauuauuaauguuuacauucuuuuuucuucuguguugagucugcaagacccagaaugugcugcaugcaggcaugucucgcuagcuggcuggauuucaggugcucugaauggccacccguggcuuguggccaccugugggcagcacaggccgggacugagcucuuuugaggccgcuuugggcucaagcucuggaagaguugcccccuccuaagcccccaaggggcucacaggaguuuccauuuuguucuuucuaagaggaaucucuuuccccgucccuuuaaccagcugguagcucuugggaugcguggccuggaggugagccguaaugagcucuaaugaucuguuuugaccccagacaccaggcagcucaguggcugggacaguagcugcuuguugacuugcugccagcgaggccgcaggacggggcccucccucgguucccacagcagcuuguggggccaggguguccaguuucgaggucuuugucugcagaggccaagcccaggcacugagaugggauuggggcaggggccaagcugcuccaggagcugggaguagggcuguggucuucccauggcugcucugaggggcugaggagguggcgggccccuuccauugcccugcaccacugucagcuccacggcccagcagccaaaugacaucuccacccccacacacacaugcccccgaguccugcucagaggcaggggccuggugagcuccagggcugagucgggggcucuuuuuaccagcucaggccgaggggcucaaggggaaugagcuuggucccucagccaggcucagagucuucccccacuucuuucccuuccacacccagagaaguggguggggggcagccuaugccucucugggcccccgaccacacguggggccaggccagcagcggcagcucuguggacucucccugggucacggcaguggcccuguggcugaaggugcuggcaaggaccaugaaccccgucuaguucaaacucucaggucucaucuggggagacugaggcccagggaacagggacccccuucucaccccaacacaccaccauucugccauggagugcaggcuccguccagccagccccggugagggagucuguguccuuccccuccuucauggggcucccucucacccucacaacagcauccucucuggggacaugcuggagacccccaugggccccucccaggagaggccagcucugcagcuuacaggccaggggaagcccacagcucggcccucccggcucugaccccuuguccuauguccaggucauugcucccuggaggaugccugaauucuacaaccgguucaagggccgcaaugaccugauggaguacgcaaagguauggccgagucuccccaccacccccaaccuuucccuauagcccccuucccgggcacgucccugcugggggcugucugagccaguggccuaggccgggacugaccccaugugaugggggauugaacuuccaccccagcugccuacacacguggccucuguccccugggcugaccccacagagguguggucaucugccagcccguugccagggcggagccgcucugaggccauuucccagucccccgagccagaggacacagggcucacucucucuccugcucccugggaggcggagaccagagcccugcuugccaccuccgcagugugugugucuuggugugugucacuuggggggauggcugggggaugugauggccggccggggggaugugaucgggagcuguucucccaauucccuggauacuaauugccccuagcgcuuuccccgggaacagguaggcgcuccaagggacagucgcagacaaagccuuuuauggcaccagcccuuuuugaaguacaaguugcaauaaaacauauuagaaguuuugcaucaagauccuuagccgcuccccagggcaccuuucuuuuuagcgacucgauggcagcccuugacaaacagccucaaucaaucaggccggggaaaagcaacucagcgcacacaccagaaaauugcucagguuuuuaaauagcagucgccaaggcuggcugugagcucucgcugcagccaaggugccgcgugguaggggaggcggcagggacgcagcccugcccccgccgccagcaacccauuaagaccuggagugcugggagggaagaccuucuccaccaucuguuguuuuauuauuaagaggggaguuuacaagagcaagcccauauguugccaaacaaauugucaaauagcagagcuauuaagggagccggguuggugagguuucuccccuggucuccuugaugauauagaauaugaagcguguuucaucuuuaagaauaaugaauuggagcccccacccagcucuacccucacgccucgaguccuggauagagaggggcagggccgacccauacguugcccuuucuuuccguuaaguccccagacaaaagcagcuucugguuuuucuagcauagaugagucucaggagcacacugcuguccuuccuucucagguuuugaggagaaggugcugagcucagcuuccaucccaaauaaccuuuugagccggaaaaguuugccagggaaagaugagcauggcccccucggccaccuacccucuccuggagauggguuucaucagaaaugacuguggggaaucugagcacguucuagaaggaggcagaggcaguguuucugcacccaggaaaugucagaaugacugagcagugaugaggccuccuccaaaauucugagccaggcaggaucugagauggaugacacaaaaaucaauggggcuuucaaaaaucucugcuuucaagacgcuucgguagccaaggcaaaaaggcgccagaggacucauaaaaaacaugcauuugcuucgcuggccauccucucccaacccaucguccaacggaaaaacacucagaaccaccccauccuugucacugucaccauaauuuaaaaaaaaauuuuuuuuagagacagugucucacucugucacccagguuggagugcaguggcacaauccuagcucauugcagccucaaccuccugggcucaucugacccuccuaccucagccuccugaguagcuggaacuacaaacgugcccuaguacaucuggcuaauuuuuguuuuucauauauuuauuuauuuauuuuuuuacagacagggucucaccauguugcccaggcuggucuugaacuccugaacucaaguaauccacccuccuuggccuccccaaaguauugggauugcaggugugagccaccacacccagcuuuggcuaauuuuuaaauuuuuuuuuguagagacagggucuugcuauacugcccagccuggcuauaauuauuauuuuuaaagccagacuacaaggugggagcuagaaacaggauggucucacguugucuacauguuggagaucguuuuguuuuuucuccucaauuacaaugagagugugaggggaggcaccucgggaccgagagaggcugggaaacacaaaucucuuuggucuugggagggucauugucauuggccccuguugcuuuccuccccgcccuuuagccucuccuugcuccuggacggagguccgcugagaagggaggcaaagguucuuucacgccaccgcccaaaaacagaggcuccacggagccuggccggcugcucuucuuagcacccagcugcugagcugagugaggagcgaggacggagcccagcaggccaccaggacaucucugcuggagaguccagucuugccuugcacaggguccggguacccaugccuggccaagggcacagggcgagugugugggcugaagagucuucaaauucuagaguagaucgugggcuguguuuuguuuuuuuaaauuucaguuuucacguguaauaugguaacuguugaugagauaaucuacacaaacuaaggcucuuaggggcccuuagugauuuuuucuuucucuucuuuuuuuuuucuuuuuugagauagagucucacucugucacccaagcuggggugcaauggcacuaucucagcucacugcagccucugccucccaaguucaagugaugcuccuaccucagucucccaaguagcugggacuacaggcgccugccaccaugccaggcuaauuuuuguuaucuuuaguagagauaagguuuuaccauguuggccagacuggucuugaacuccugaccucaagugagccacugcaccuggccuuguaggcuguuuuaaaaugagucuccuggcuuucuagaaaaccccgaaaccagagcauuuagccucauuuuaauguuaagguggugauggggaaacagcugcucccugcaggaggccucuagaaucucaccaucuugggaaugagccugaguggggucgaucccaucaggagagagaugggagggugacccggugggggcugccugugguucccacagggauccaguggggcugaggggcugaaggggcucagaggcagagcauccagucucgcuggcucugaggggcuggguggggccccuucagugcacccugugcccuauaagcuuggggccaggagagcagugccagguguccgagugcaggaggaggcuggagugcacgagcuggauuccagucgggcgucaucaaggguggugcggguccccagggcgacaagccucaucuucuuccuccucuuaaggcugagucaggugggccuuccaugcgugaccugcagcccucuuagccugggccuccugggcagagguggguguccuccuguaacaacagacugggccauuuaggaagcgaaacagagccagagccgagugccuuggagacgggaucugcuggguguuccccuucuagggucugcagagugauguguguggcuguugcgccaggcccagggaggggugcccccagaaggugugggccaugagcuaaaagcucucccugcauccuaccuguccugggguccacaggaagcacugccugggcucuggugccaggugccccgguccacagugcgagcggguucacacaagccccagcucguagggugguggcggggcugguuggcuggugccgggagaccuggcugggcauggcaccugcgugcuugcucagugcuucagggguccuugagauguagacucaaagucuucuggaaggaaccuccaaggucagcauugcagacacacgguccugcaguuucucuggggcauguccagcaauaggguccccccagggaggugaccgugaccaacacuaggagguagccagggucuugucugaaugggggccagaguuuggggcucucugaaaaagcagggccccugggacggaccucacgcguccuuccagccgccuuaccuccaccugugcugucucuuuccugcagcaacacgggauucccaucccggucacucccaagaacccguggagcauggaugagaaccucaugcacaucagguaaaucccacccuccacccauccuugguccucccgggcucauuccaaaggacggccacgcgcugccccaggacguccuggugacccccacaccaguggucccugcccucggggagcugagaggccucaggcaggacagaggucgaagcgcccggcucaugcacugcccucauugcaguucugcugaguguuguuggggagauagaucauggggacccggccucaucaggaguaucaaggagggcuucuuagaggagguggcauucaaggauggagaagaggcccagauguggcacaggggaagaguguuuaaggcagaggcagaggcccccccaaccacgugcagagccccggggcaguccccagaagacagguaaaggccccagcucuuucuuacaaccugcagcuccacgggugacuauggugggcccagaauguuucaggcagguuggcagcagaugcucuggcagagaguaaaaggcagaccaggcucaugggcacaaugggguguguguguugggggauggggacaugccaugucccuccccagcugacccugucuuuccuuuccccuccgcagcuacgaggcuggaauccuggagaaccccaagguaaucccccaaaccccaucuccucccagcuggccaccuuuggugguagcagcuccaugccgaugcugucugauguauuuauagccuaauuugaaauuucacgggggccagccguggggcuggggccgagcccugccuguguuccccgacccccgcacuggccccccucugcccaccgucuccucgcugcauuugaagaccuccccccgcccuuccucuucuaauugccucugggaugaacaggggaaggaaauaucucagggcagcauagagagagagugugauugugagacaauaaagaaguaauuaggcagaugagacacuugggggagggcccagccugugcccaccagcucccaggcugugcugcuggaguuuugguugugggggguggggggaggcauggcugagagcccuaggccccauuugucuggauccguguugcacacccgccaccaccggccacccugauccggucccaagcuucccgggcgggcuggacugggcccucagcucuguuugaaguuucggguuucucucccggggguagggggcuucuuugugucuaccccugcccacugugggaggugggggaggcagggccaaaucuaucaugggaagagaaaaaucucuuugucccugagggaaugugucuuaguucccgggcccagccccacaccccggggaggcugguuuggaggcgggaaaagugugcuuuuugaggggaugcagcugggccugggggaaucaagaagaccagcuggaggggagggugcccggggagguuuggugaaauuggggagcgccagagccccgcccaggaucccccagggcccgggcgucugucacucucacgcccgcgugccgcccccuggucgguguuggcuguaauaucacauggcagccaccaugucuggggagcgggccggggguggcauuguccuggcucaguuccuaggacacuggcugggagcauccucacuuuaugguugaggaaacugaggcccgggcaccggcugcucagggcgagggaacgggcccuggggcuggugcccuccagcucuguggcuccccuacugcccacggccccucccuguccaaaccugucacucaggagagcugccacccuugcccccugggggcugauggccccuguguguggcugcugccugcuggucacagguuuuucuaguucaugcucugcugaccccacaacacucaggccagccacccuaauuagccagucagucagcuccaagggaggcagggaggccgagccugcaggguggcuuccaggcagggcauccucucaggcccgugggccccaagcaugcugggcaaccacucccggccauucuccaagcagccuauggccucugcaagcagccuaugggggcagagaggaggcccccccagaauagaggaccucaggauugagaaagcagagcaaggccagagggaaaucacccccucggaccgugcaggagggcauccggggccuggagcagguuacugagcuacggugggcagguccugcgcccucccaggccuccugucucaugagggcauuggguggagaagucaguacuaaagagaaucuggauuaaggauccugcuaccucacccacacuugggucccagagacaggaaacccgagucuaaaucccaacuuuucuucuuauugcugugcaaccucgagcaaguuacccaaccucucugagccuccaguacuccuugcccaaagugggaaaacacagcaccucccuccuagggcaucuaaagcgcuuggccugucucagggcaagcccucagucaugcagcugggggucccaugcuaccucuucaugggaggaaggguccaagguccucucagggaccccucucaagaaaggcugggcugggcuaagcugggugugagucaggggaaacaucguuccugcugagaggcccggggcacccagagucccacccaggcacccagagucccacccaggcacccagaguccagucacucuggaaagaaguuugccccagccaugcagacuccccaagggcuuugugcugaggguggggcucaacgucaggacgcacccuugcaucccuggaccuggcagcccugucccccucgggaugagcucaggggaacagagccuggggaacccgugccccucccccucuccaaaagaagccaggagaccugcggaagggagggcuugaaggcagauggcugagccauuuucugccuccgugagggcugauugaagggcaaugaggcagcuaaugcgaagaaagauagaaauuuacuugcuuuaacuucauacgguccacagugaaagaguucauucagucgccggcccgccauagcugauggaugaauaaaccauuugcggcaucgaucaugccucuacaucaugguuuaguucaugggccauuugcuuccaauuucuccuucucggggccuguuucaugcuuucuuucgcccucucccccuagcccccaccccgacucucucucucucuuuuucuucacucucuucccucccccgcacccccccccccccacagaugacauuggaagugagcccucccgcugggagggauaaauagauggcauugauacuuggcaacaaacuauuugucauuagaacugggcuuuuaggaaggagaguaaaaagaaggcaggcgcucgagccaccgcggaaugcaaagcaaaugucauuuuauuucuauuuaguuauuuuauuuaaucggcgcugucaggugccugcccgacagcugccucugacuuccgcugcggucugcagaaacucguccuccagucuucccauccccucuccuuccaaaugcacacacugucagccuccacuucggucuggggcucccucaggaaguguggcgggagagaaagugacaagcaacgcauugaaaacaguugacagucgggcccagcgcagguggaggugggagagagcugggcuugggugggaguggggcccucguaccggcacccugguuggaggcuugggggagucccaggcagcuggagauggggcuguggaguuguguggucaccccaagauccaguccaguucacuuuaccuuuuugcugaggaugagccuugggacccgucugugcccagggaaugcugcaguuggcagggugggccagcccugaugccuaccuguggcugugaugcuggcuggcucuggccacaggccucacccuguuucucagcccagguuacuacagcagcugggaaccagcauaagguggcggaaagagucccuguguuuagcuuccaaagcaugguuuggagaagccaccucucagccuuggcuuucccugugguccauagaggcaucaggcugggggucccucagggccccuccuaccuccuggagucugucuucagggaagguucuggguucuuguuccugccccacaaaugggcacugaugcagggauacagcuggcccugagucacaucguaccuuggagguggggguggaggauccaccacagucccugucuuagaaggaucaauuguccugguuugcccaggacuaagagguuucuugggacaaaggacuuucagugcuaaaaccaggagaaaucagggcacuuggucacucuaacacagagccacaggcaaaugaccacaggugagcuuccaaggcacuuauguagccccaucccaugcagaaugaggaggaggcugggccgagcauguacccccagagugaauuucagcugcccuuuccaccugcagagcauguucccguuuguaccaggccuucccugacauuuuccuguguguuuucauguccaauuaaaaaauauauauauacuacuuaaauuguaagauggccaagggcagguaucauuuuccccauuuuacagaugaggaaacugaggcuggaggaagugaagcuuccccaaggccccccagccugagcucuugauccuggcacgggguaaugcccaucacucuaaaauacaauguguauuuggcgaggaccucgcggggcuccuguccugagugccagggaacaagucccacguggucucugccugcacagaacucacaguuguagcuccagucccucccgcucagccucaauuucuucaucuguugaugggguaagagcgcuugaccuucuuaccaaauggggcugcugagaacucagacugcagaugggaagcaauacgugaaugugugcaagguguuuuuuuuuuuuuuuuuuuuggugggggggugggggacggaaucuugcucucucacccaggcuggagugcaguggugcaaucucggcucacugcaaccuccgccucccagguucaagcaauucuccugccucagccuccugaguagcugggacuacaggcgcaugccgccauacccggauaauuucuuuuguauuuuaguagagaugggguuucaccgcguugcccaggcuggugucgaacuccugagcucaggcaguccacccaccucagccucccaaagugcuaggauuacaggugugagccacugugcccagccgucugcaagguuuuuaaagcaaagaugagacagcaguuccuggaugucagcaggugaacaaggaccccaggcacaggaugcccacaggagggaccugagcagucaggcccaagaggccccaguccccacaguggcaaauguccaagccacggccugggggagcuggggccuccgaaggugggagggaauuucgagaguuucaggcaacacgcagccccuccaccacugcaucagacgagaggcccauuuuccaacacgcccaagaaaaaauauacauaaagguugauguguuuucaaauggguuuuugcuuugcucuucucuuuucucccugugaguauuaaccuuggggacccuggggacggcucggcuugccagagcaccugcuggggucacaggcagucauuagcuuugcggucagugcagaauaaaccccaaucccgagccggcgagagcgugcgugccgcuccugggaagcccucggaacgccgccuugcuccuccaaagucacacuuuuuccugccugacuuguuccucuccagcuauucuaccuccagcugugggggcgucgaagaaaaagaugagaucaaguugaggggaaaaauugucugauuucuccagcccuuuguuucccaggccucuggcaagcgaggcuggugcuaggcugagggcuggggaccgggggaucugccggaccccaccagcugguggggaaauggacagaggagaggggugcagauccccgcgggaggugggcuguaggguguccagggacugguaugucaucugcccaccacuuucugucuuuuuucagaaccaagcgccuccaggucucuacacgaagacccaggacccagccaaagcccccaacaccccugacauucucgagaucgaguucaaaaaagguaugugcccaccuguugggacucgaaggggguugacuuuuggggcccuggcuccuuuccccucccugccugggaaccuaggcccucuuuacccccgcccugcauuccuggaagcuagaguucaggcaggggcuucaagguaacgcacagcccaccucccuggacaguacaacccauggaccauggaugccucuaggcuugggaggaacaugcccucggcuacccaucacucggguucaugggcaccaggucuggaaugagagcgcucuagucccugaacagccacucaacuuuccugggccucaguuuccucagcuguaucugaggaugaaagagugccugcuguuuuccugggguagaaugaggccugcaagggagcguccagcccugggcccugaccccggaaggugcucaguaaacggugaguguuggcgagcuggccucauggaccccugggaccccacauggaaagccuucgccagucuucauugagccgcucugggccucacccugcugaccccacguucaaagcugcggccacucuugcuccccucggcaguggaggcuguccugaucgcucccuccuucucacugcugucaacaagaagcguuugcugaccuggccugagugccugggugccugagcuugggagagggcaucucuuggccuggaggaaggauggagaagcgaggcaugcccgccugggcucagagggagggcucagagggcgggcucagagggccugaagggguaccuuuucaggaggcuggagugaucagggaggcuuccuggaggagguggugcugggcacaggggcacccaaggaccaggcggggggcuggcccauucguccacaaaguggcugcccacacuggagcugggaugagagggagagaggcucguggagaggccuggcccggcucuggcgcucggcucuuaccccggcuaccacagaaaggaggauaggguggggaagccucaggccgguggggaggcagagcugcagaucccccucucccccuugcuggugugaccuugacagccagcuucaccaugcugggccuugggugcacucaucaaaaaacggaccacaggcaugaugcucacaggugcccggcaugguauguggaauggggugucggaggcuaagugcuuuaauaaucugccucuucugggccuuucccaagagcuuggccaagccagcgacugucuuccuugcuccccuucaucugucccaaccuacuggggggccaaagaggaccccaaaggcagccgggcccccaggccuguuugcaggcacagagccucccuuuaggaucaucucugagaagauggugggaguggccccagcagcaccuccuggcucccugcacagggcucccaggagccuggagagccgugagggugggaggcggguggcaggcugcggaggguccugggcaccaggcucuggcagcccugcccgaggaccagggcagcuccgcaggcugagcuggagaagaaacgugaccuauugucaugauuuggggacugucuggaagaagaaaaaaagaccggaggaacccuccccuggcuagugcccauucacucucuaguuaauuuauuugaaguuuuaaucuaauuauuaacuauuuuaaaggcuaagaggcuuucuccagcagcagcaccaacaaugucaccucuucucccgggcaggccccaucuaaggccccagcgaaggccgauaauaggaccggggagggagagaaagggagagaggagaggcgggggguggugagaggggcuuaagguucauuauugggcagacuuacauuuaauagcaauuuacaaccaaguuauaaaaccccuggaaauggggguuaagaauggcgaggcugacagcgccuugagugaagccccuccaagcggcgccuggcuaauaaagccucgaaagccgcuauugaggccugauuggcacccgauggcucgcuccaugguaaugagccgggcagaugggugggggauuagccgccaacuuugaacagcuuuucuuugucacuguuucagcucucuuguuagccccaauacauuuauugcucauuucacaccgcucgagaaagugccccuugcuauucaaagucaaccccgaacccacccacugcccccacccaaccccuucccuccugccaccccggacccagcuccucggauucagggacgcugccgacaccucgccugcuggagcgggcaccgugucacccccaucaaucagauggcugcgugugggucugggguacagggucggggcgcgggguccgccugacagacguggcagggggcugugugugugugugugugugugugagcgaguaugugugugcuugagcccagccacaccucggccaggcggcccccgggugacuggugggacagaaggugcucccggcguaagacaaugguggagcgugaaauucaauuaguucagggccugguuccaauuucacagccccuaaaugcaaaaggggcaaagagaaugggagggugggggagagcguuuuuauugcauuuucucuuucauucuggggggcuuucucgccccuucucucccugcagcaggccucaaccugcacagggcuuuugaaggagucauuuggaguccauaucugucacauccauuuaaggcguuucgggaggagggagagggugggguggcgggugcagacuccuccgcugagccgggcccagaggcccacugcccucucuucccacccuaggggucccugugaaggugaccaacgucaaggauggcaccacccaccagaccuccuuggagcucuucauguaccugaacgaagucgcgugagugucugcagcccuguccggccucuugggaaccgccgucucgggcgagcacgagccuggaccguugcagcuaaugguuguggcugaggcucaggggugcggagcacaggccaugucccuuccccauagccacagaguuucccggaccagggggacccauuuggcaggagaggcuccgugguccuuagccuuggaagauaacaaccccaggaggucuccugccuccaagggaucauuaggccggggcucucaggcccuuggcuggaugggaggccaggauagaaggaaagggagcaguaguuagcuguggcgcuaggcagggccccaggacacagggaacggaaggaacaaugugaacucacaccugggcaaucccugcucucucugggccucaguuuccccaccuguccagugggcaccuggacuaggugacccggcucagauguccucuugagucuuagauccugaaaugcugccuaauguguggccuaagcugugcccacccugggacagcccagcugggugggugacucugagccuugcgguagcgcccgaaccuaauggaccaguucuucccacaggggcaagcauggcgugggccguauugacaucguggagaaccgcuucauuggaaugaagucccgaggugagucugcucagccucccucagggccugccucgggacccagcaaacccagagaucccugagacccuguccccuuuggacgcuacuacccccaugcuccgugggcgaccuugggcacguccuuucaccacaccccgugagaccgcaguuucccuccugccaaguggggaucgugggcccuuugccccugacuuucaggguguuaugagaagagcuguccaagggcugggagaggcccaggagggccuggggagucuccgaggagcagggaggccagggccaggccuggaggucaggcugucuugugucuggggugggcaggccggguguggaggcagaccgugcaggcccgauuucguggucauuaaggccgcauggaggccgccggccaggcagggcgaaaauccugccaggggugggcgcuguggcugcacaggcacugggagccggccagggccuaaggaccugucccagcaucaggcacggcucacuggcccuuuucuccagggauggggcugugccacaguuggggcugugccgcaguugaggcugagcuucagugugacaugccugccaccucggcuggccucuagccugccuagccucguauccgccuguggcugggcccaggagcagggcaguugguccccaagcaggugccucugucuucucuuaguagccaaagcccaugauucccuuugucagccaaucagcauuucaucuugaccacaacccuccucuccaggacucaguuuccccauucauacaccaaggggaucucagcucccugagggucugccagugugugauaaagccaugcuguguucuuucuuggggguccuaagagggaaagagcaagguuucagcaguugcagccccugaauugggcaccugaauuuuuauacuggugguggggucagggcuuccuguuucgguaaauguucaggucucuuugcuuaggguugauuugaaaagauaccacaaccaaauaucaccuggccacgguauagucacggccccaugucucucaggcuauuuuuacuaagauucuaaaauccaaagagagccgaucaccccaugugggccagaagaaaaggguggugguccggagggcaggaugccugcuucuggucucagguuugcccugccuugcccaacaaccuuggacuugucaucuaucgcuaggccucaguuuccccaaguguaaugcgguaggcgcugggaguugcaucacucuggcucugaccugucugcguuucccuggaaaggcauggcagcauggaccggggcggggacgggcuugccucgaaagacaugggagcgcggaaggggaggcaggcucgccucuuucuuguggcuuuagcuccuugcuugcuguuauucaggagaaacaaccuaauugaagcucuggggaggccuugagaacaauguuacuaauuagcugcuccuuuuuauccgggcuuaccuuugucucuuaccuauauuaacaugugauuagaugccccuuugucgcagccugcccuugggagccagcgcggugugcacccuccagggagagcugggagggaccuugaggagccacagaccagcaccccauuuacagaugcggaagccagggcuggggaggggugggauagagggcuugcuucaagucccaggcacuuuaguggcaggaccaggacugccaucugggcccagaguggcauggaguggagggcuaacagcuuagacuggaguuggacagaucuggguucaaacucauguaugguggcaggaacugguacacuggaagugcuccauaaauagccaucagucccccgggcauguggaauggggacagaagcagcccccauccucugggagcugucaguguggcggggggugggguggguuccaguauugcaccugucuuaucauaauaagggccugccacaggcaugcccuugccaugccuguggcaggcaucaccagucaaugcuggcauuauccuguugacuccagagguaucucagggcugcuugcaggcacuaccaaaugaucaggauuggcauacgugaugaaaguguauugccuucccuauuggaaagauaaggacuggccugaagucacugugaaauggcauccugugggguggggcgagucaagcagaguugagcaaaaaugaacugaaggaggugguuagugaugaaaaccuggaaugcacuauucugaauguggaaugguagcugacagcauuccacggaggcuggaccuuuuucccagaaugggggccucauccccguagaaggucaaagccaugagaucaacagucuguuccaauccccguggcuccuuaccacccaccuggggaaagcuuccuggagcccagccuucacucugcccugguacuuugugugugcuguuggaggcucuccccaaaagcacagaauuuagucagugucguacagggaagaaaaucgggauucugacggcaagaacuugcugugugaucuuaggcaaguuucucccucuggaacuccaauugucaaggggccagaugaggaggucguaucaucucccucugaauguccucacucaccuauuuucuugcuuuggguuggggagagaagacaaaguugcuagguaauuuuaggguggugucuuguuuuuauuucucuacuccaaauauuucaugugagaaggaaagaggagagacgguaaauuagggcacuguggauucccccaugacaagguuuuuauuaaguguacaguaaugagagaagcuguuaaucgucaauuauauugagggcagaacagaaagaugcuauuguccguaucucgguguacaaggggaacaugucauuuguauugauuuuacaaagcucguaauugaaauucguuaagggcugauuuuuuucucuggggggcgggggcggguagggaguugggcagcgccagugcccugggucugggguggccuagucagcggcgcucagggucagggacagggggcuggggaagccgcggcuggaguagcuuucuccguauuguggcuguucacaugucauuaucacauuaucuuuuuaacucuggaggggggcuaauuaagugaaguaaaugaaaucaguggggaggagaaggggggcaaggcaggccggagggaagccgagggaggccgggaaggagccagcgcauguccuugugcucagccucuuucucugucuccucucuggccccagacuucucccgccgcucuccccucuccgcucuccucccagcccugcccgucucaccucugccugcccccgccuugcuccuccuccuugccuuccuuuccuccucccucucucccuuuccuccucccucucucccuuuccuccuccuuccccucuucccucccuugcccuucccucuuugcacauccuccuccccauuccccacucuccccuccugucucccuuccuccuuacuccuccacuuucuggcccagaaggaacaagggcugucacccacuugcccaacgugcccacccaccaucuggaacauuccagauggagaauggagggagaccugugaagcaaaaagguuuucagccccagaggcccacccaggauggggcccgccaggcaccaggagcauagaggauggcuagagucccacccugacuggccucccaucaccauggcaacugcuucucaccuuggcccugguaccuaagaggggagcccuugggcuccagccaaccccuaugccccaccucuuccaaaucacuucuucuacuuucccaaaggaccagagccuuuaguccaggugcccucaccuccagcccaggccccagcugagcuggcggaucccacucaauucugcaaaauugcucauucugccuaaccuggcagccucagggacagaugagaagaauuugggccacaguagcuguuugguucccaccucuuucugcuugguccacucuccccccagccaccccuggccaccccuagauccuugcccgucuccccacuccccgcugcaccuuucuuggcaguaauuauggugugauugaagcugcuccacagagaacugcugacaccucugucuuuuuccuguaaacacggggagaugaaaauagacacuuggagcugcugugugugucacuccaaagauguccguugucucuuccacggcaacacagaggcucagcugucauuuccuccuucucucugcgcagugguuuguaugccgacugucaaaagccccaaauucauagucuuuuagcaucagguuucugucacuguuuuuuuuuuccagaagaaacacacagaaaucaucuguacccccuaccccuguggagaggagagggaagagcuuuaaacgcacacacacacacacacacacacacacacacgugcgcgcgcgcgcgucggcagcaaccuaaaaacaaguuuuuugauccgucacaauuaacacuuucgaagaaaaggagcaggaauauuaauugcacugguguguuuuguggcugcagccuuuccccuugcccgugagcccuccggaggcugccugggaggguggcagccaggaagccggugcugggggcucaggaagaggaggguucugccuggccucugcccaccagacauucucugcucccgguggcacuggccucauuuuccuggggacaccugugaugggccaguagcuggaggaccuuggacaagucacagcucuuccucgagcccugaaccccaccugcgcccuccccucucuggacugaugggaggcgaugcuguggccucgaauguucucgagacaagacugucaguaaguagggcacaccuggaggacgcucugaacacuuaccuuugagguaggucccaaaggaaguuggaaugucagagcagcaggaacuugcagccuucuuguuuuccagauggguugccugggucuaagagagggggcugagaccggccaaagucacacagcaaagccaagcugggcaccuucuguaaaggccaagcugggcacuuucuguaaagcaugguuguaggacuccuggugcccagcuccagcccugcaaauguaguuuggacugcccuacaguuggccgagcugaggacagaaaagcagggaggcgggccugggugucuaggaguugaaaaugaggagggcuccugcuaccggccuacccaggauggcgccauuacgacucuguggccaguguaaggaugggcuuugcaaguuucuggaauuuuccaaaauguacccaaacuaaucacuagaaggccuguuuccaacccgauauguauccaguucuagcaugugccaggauggaggaccagcaggacuuugucagugucgugcucuugggaaauugcuuuauuucugguaauaagguuucuaggcugauugaaaauuugcuccucgaacuuuaucguuauaucugccauuuuggagacagagauuuccuguuucugcacacacuggucuuucuggacacacugcugaaccauuccccuuucugguggcuuuuuuggcacugucauguuugugugcggucaucauguuuuguuuuguuucucuuucagacagggucuuguucugucaccgaggcuguagugcagugguacgaucaugacucacugcagccucaaccuccugggcuccagcaauccucccaccuagcauacaccaccacacccagcuaauuuaccauuuuuuuguagagacggggucucccuauauugccuggguuggucuugaacuccugggcugaaacgauccucccaccuuggcguaguagcuaggaccacgggcacaugccaccacgcccagcuaauuuuuuuaauuuuuugguagagauggggucucacuauauugcccaggcuggucuuggacucagcucaagcaauccucccuccuuggccucccaaaguucugggauuacaggugugagcccccgcauaccuggccugugcuaaguucuaugucccuguucuccaggcugucuauaaugacuuuucucagucauuccucuguuucugcugccaucagccuuuuuaccccuuccugguuuguggcucugagcuacucugcagaaaaugaugacggacccauuugaacuguuuuacaagagucacggugaggccugaggaacucccgagggauuugagggcuuggaucucugcauaaacuuggagagaggccauuuccuaaucagaggucacaacuagauucagacgguggacaugccgaaggcugcagcccccaccaaugaagcgggaugggcucuuucacagcacacgauacucauauuugcaccugguugcucugaggggcuuucacaagcaugucaccugacaccaguauaucagggguuuacagaugagagaaccaagcccccagagagguucccuucugcccaggaacacggagccauggugagaaccaagcuuuuccuccacagcaacagccuggacuugggcuuuuucucucacgcucugguuagcaguugaucacuuugccaaaggcccuucgaggccaccuggagcugagaugggagaccccggggccgggcccauucccccuccaguuggcugggugguauuaggcaagccaccccccuccccaggccucagguucucauuuguaaaacuggugugugggacuagauuuaaggugaguccagaguuugcagaggggccucuguuccucccagcacaaccucugccaucucuucuauaugcugggcuucugccgcaggcuguuugaauauuagguuggcagcuaacagucgggagaacacgguaccggauugauccuaaugcaagcucugacauuuccgugauucuaagacuuaaagaucaaagacuggaggaguucuccaaggaggaaacuucugguuagugcacgagggcucagcagacucagccuccccagauccccgguaggcuucagagucaaaaccaauauccuucaugguuuuuuuuuuuuuuuaauuuaaaacugugguaaaauacauguaacauaaaaugaaccauuuuaaaaugcguaagcgugccgcucaacggcauuagguccuuucccagggcugugccacugugacuaccguccaccuccagaacauuuucuuuuugcaaagcugagacucuggccccaugaaacuccccauuuucccuaccccggccccuggcagccaccauuucuggcuguaugauuuugaugacucgagggaccucgcaugaguggaacauacaguguuuguuuuugugccuggccuuugucacuuagcgucacggccuuauguugaugcuguggcaugugucaggauuuccuuccuuuuuuuuuuuuagacagagucuugcuuugucacccaggcuggagugcaguggugugaaaucagcucacugcaaccucugccucccaggcuccagugauccuccugccucagccucccaaguagcuggggcuacaggcauguaccaccaugcccggcuaaauuuuuuuguuauuuuuaguagagacgggguuucaccauguuggccaggcuggucuugaacuccugaccugaggugauccaccugccucggccucccaaagugcuagaauuauuacagucaugagccacugugcccggcccccuuccuucuuaaggcugaauaauauuccaucguauggauggacugcauuuugcuucuucacucaucccucgauggacaccuggguugcuuccgccucuuggcuauugugauuaaugcugcuaugaacaugaguguacaaauccuuucuggguuuuuuucaagcagccacuguagaaagauguuaguaaauucccaggauaacugagaaccugcccuuuuagugauguaacguaugguggaagaaaggaagcucucgggguagaauccauggagaugggggagcuauggccccugcuccacccagacagcagcugcagggcaggcuugcccaagggccagcucugaaguugaugcgagaggucgcacuccuggggcaagagggggccugggcugugugcugugggcgguccugccucuuggugccccacuguccuccaaugcaguaggaccuucccccagacccagcucagcccaagaccaggcauuucugucucacucggagaucaucuguuccaagcagguuguuuuccaaauggagggacugggccugaggucacaagaggggacuugagcaaucccuucuccccugaccuuccaggguugggccuccacggccaggugacuuacagggcagcagacagcacuggugagggacucgggggccuacauucaguucccagcuccaccuagagcaagucccuucuccucuugagcucaguuuccccaucugcacggugcggucagccuaggugauugcccaagcccucugccaccccaguggccucuggagagaccuggccgcaggggccccaugggcugaagguggcauguguguacacauguguacauguaugugcacagcugucccccuccccuggcucccugguggaagggaagaagggauauuuggggcucugggcucuaccguagucgcuuuaauuacaggcuuucaaccucgggccggugggcacgcauggggagggagggguugcugcuccgaaacccugucauuuucuagcgucugagggccccuucaaagggggcaucuagacauuuucuccacaagccgcagaguggacugucguggccccagcaugaacauaaugacagaugcauuuugcagcaagcugggagugaauggguccggccggcuugucuccugucagacgacucauuauuauuauuauuuuuuuuuuugucauuugcugacaguuuggguuucaugcguuucucucuuuuuucuccuuuucccccugccuggaaaaauggcuagguaucuacgagaccccagcaggcaccauccuuuaccaugcucauuuagacaucgaggccuucaccauggaccgggaagugcgcaaaaucaaacaaggccugggcuugaaauuugcugagcugguguauaccggugcguaagacucuauggcugcccccucuaaccgccucacaagggaucccaaaguacuaucaggcucucgggccuggcccuccccuccguaucagcaccuuccuccccugccgcccacugccauccucaugugagaccccaaaaggugcaggccaaaggggguugagggaaagugcagggcaugagggagcaaggggaugcuagaaccugccuugccaugggguguguccagggagaugcaccggcuucccaagguguccggcagcuuccacccccuacaguuugcaugacugcagcaaugccaggcacugggcacugugcggcgacaugcaucaccccgcaugguccucacaacuuucccaggaggucugcagcuccuuguacacgaggaaacugaggcucagaaggaaagcauaaaaccagaaguggccuagcuggguuugacccccaagucaggcugucuccaggaagaaccuggaccuacuccaugaacuugagggagaggcucccuggaccaggaacucagccccagaccccaguaccgcaggagccagaucuugaccaugaaaccacugggguggccacagggccugagcccugucacacacccagcccauguguggaaggaccggugggugacagcaccugaggcggggguguccccguuuugcaggugaggagcccggguuuccaugccuuggaauccaggccuccugacuccaaaauccaacccucaugugguguaacagagguccccaaacuacagucccugggucaaauccagcccgucaccuguuuuuguucagcucaugagcuaagaauaguuuuuacauuuuuauuuuauuuauuuauuuauuuauuuauuugggacggacuuucgcucuuguugcccaggcuggagugcaauggugcgaucuuggcucacugcaaccuccgccucccugguucaagcgauucuccugccugagccugcugagugacugggauuacaggcaugcgccaccaugccuggcuaguuuuuguauuuuuaguagagaugggguuucaccauguuggccaggcuggucucgaacuccugaucucaggugauccgcccgucuuggccucccaaagugcuaggauuacaggcaugagccacucugucuggccaguuuuuacauuuuuaaaugguugggaggaaaaaaaauuuuuuaaugcuauuucaugacaaauuauauaaaauucaaguguugccgggcacgguggcucaugccaggugagguggcuguuucugcauugucuguggcuccccuggagcggcaaggggagguugagccauuugagagagaccauaggacccaaagagccuaaaauauugacucucuggcccuucccacccaccuccauaacauacacauagcccugauuuggggcguuacauuaaacagcugcccugagcugugggaggacaggcugcugccugaggccgauccucacaucuucgggggccuggacgucaggggaccugugcaaaguuaguauuaguuaaucgaauagcuaccugggcuaagcucuccuccccucgccucucccccuccacucccagauuuuguuuccuuuuaagccuccuaaucacuguaacucaucucaggauuucgagagggcucgaugguuauuggcuggcguuauuucucccugccauuguuccuugcagcuuugaagccaaguuucugcccccguucccagggacagacaggugcuuaaauaccauugucuccugcaggcuuuccagcccggcgggauugcgaccccgaaaggaggauuuuaguuacaaagugagagagucauuaagacguggcggaggagagagcaccuggccgggcugcuccggggccuccacggaggcugaucccaccguggccgcggccacggcugccacuuauccugccaucuugcugcuaggcucugagcugggcaccugaugggguauuaucuaauauuagcugcgcagaggugaggaaacggaggcccccaggugaagacacucacccaggcucuccuggcuggugaugggcagcuuugagccggggacaggccagcuguagcggccaaguucccaguuacuccaacagauuccaggaugcucgugaucaaggggcacggcggcacagacaggggaacccuggguguagggcacaguuuggcuccuggcugcggucacgaugccucuacacuggacuggcuggguugagucccugcucugacagccagcgacaagcccucuacaucccaaacugagguacaaugauuaggagacuuaaaaggaaacaaaaucucagaguggaggcgagggagaguaggggcuucuucuggguaguuaucacuaauauuaacuuugcccugguccgcugacaugcagggccccacaaacaucaagaucggccucgggcagcaggcugacccccacagcucagagggccuguuugaugcgauuuuccccaugagggauacagacaugguauagaccagggcuuugccugaucauguuacuuaacuucccuaggccucaguuuucccaucugaagagugggaauaacaguucuaccugucuggugggugaggacuaaaaguaugaguauuuguaaagcaccuggaacaaugucuggcagacgagugcuuauuccagugcgugaaauaacugcgagcgcccggcgugguuucccaguguggaggcgcggcacuuggagucuugccucuggcuggguuaauggucuugagcagggcugucucuuccuugagccucaguuuccccuccugucaaauaaagggcaccaggcugagggcacgccagggucucuucccagucccgucuagcuccuggguggaaagcccaccauucugcuguaaugcuuggcuuccucagagcccuuguggucucggcacagauagggagacugaggcacagggaagcccuccugccccagccucacuccuagaggcccuagguucugugaccacugccacucugcaucugugugucuguguguggcuggcuggcucccucuccucucccaccauucccaaauuuccuggucuggcugugugagcuucaggcagacugucuccaggaguggcaaccaggguuagccuggcaggaccccagcuucaggacccuggcagggcccagaggagcaucucaucuaggggguauagcucacuucuucuccccucaccuccauuucuucagcaauaaaauggguauaaugugcaacucacacagaauugcuccaguuagaaaggaucgcauguguuuggcugggccuagcagcacgggggaggggucccucuccagcucagcccuaagccccacccacagugaucugcaggucuggggggugcagggucucccccauugcagcuuaugccaggcucacuggcccccaacccaggcuggguccgcugggaaaagaaaucugagcagaagaacccuguggggcagagguagaaaauucugagauaaagcccaggccaguugcucccacagagaucucuguccuaucucuggcuccaucuccugccugucuuccggccuggaaacuuaaugggcuaauuaucccagcuccgucagaaagauggccaagcccaggacaccagggcauggggggcugggagaacaucaguggcccccuccacgagggucucgggguguguuggaaaaagcccugggccagaguuaggagugcuucaucagaccugggcucuuccaaagucuugcuguguggccuuggacaggcucuuucccucucugggccucucucccuguguacagugagggcuggcacagagcaucauguucaaacugcaaaugcaaaacgcuuugcgcucugugcauucccucacugcauccacacaaccucugguuagcaauguuuucucacugugcaaaugaggaaaccgaggcacagggagguuaaucacuuguccagguguggcugggaugcggacucacagggugggacacuggagagcaaggacucaaccucuacucuccgugcuuggcccucccccgccucugcaagccccaggaccccaucccagaagccuguccccuuucccacggaggaccucugcaggugcccccaggggccugggccucccacaauagccgcagccccugggcugacccagcccuuuaucagggcaggagaucaugcgccaucuggcccugcagcugcccaggugggcucaccuuccaggcuccauuucaggaaacucuagccuugcccugucccuccccccgccauggccugccugccugccugccugccugccccuuggucccagccuccaucagcagaggcuagagagaggccgggggcagacuggggucugagcgcuaccccucccuggccuuuagggcucucggggagaggggagggagcauguuucucaggcaccuccugcccccaccuacacaccaagggauguucuggccauagagaaagcuccaaguuuaucauaggaagcagaguuguuacaacuugggccaacacaagucaaauggaggcuccccacuuccggccugugugauccuggagaaguuucuuaacuucucugagccucccuuccucacccagaaaggggagaggcuaagagaguuucucucagagugcugucuaugaggauucagggagcuagcccagaucaaagccugagcgcagugcugcuuaucuaugcagaaauauucuaucugcccaggaaaacagcagcaggugcagaaaacagcucacugauuccaaggggugggcucuggccaggacuccaguucacaguagccccuaaggcuggugcugcucagugcuaggggcuccacaugaaauauuacugugacauccccacucaacagauggggaaacagaggcacagagaggggaaggcuaugcauggccauggucugaaccaccacccagcugccugcacuggacacccauaucaccaagccccaggcagcaugugccucugaguccugucugaggucuucugccucccccggagauuagagccuccauugggccagggauggggucccuuuaccacuguguccccaguugcuggccuguggcacuuccugaaugccuauggcaugaagcagugggucacuucccuccuccugacccuuagggaaaugaccuagguggucaccuccuuacccacaggcccuuugcaagguuagagggcagggcuaugaaagcaugguccucaacucagccacuggcaagcgcacauugugccagucucgcgggaggcagucauggucugcauggcgggguaaaccauggggcacccuuccugugccccaggucucccuguguccucgcggugcaggaggccucccuagugguauccuguuuuccucccuguagguuucuggcacagcccugagugugaauuuguccgccacugcaucgccaagucccaggagcgaguggaagggaaagugcagguguccguccucaagggccagguguacauccucggccgggaguccccacugucucucuacaaugaggagcuggugagguaggugccccacaccucauucugacccccacuugggcacagagccuaucuuuugacuggauccucaagacaucugugccugagcacaugucaggcaccaugcagagcacagagugauggucacagaggauauagacaccacuaugcucccguggaacuuacaggcuagcugggagaaaggcauggaucaaaccauuaccagaauguagaauuagacaagguggcagcgggcugugaggaaugcaggauagucuggcuggguauaauaacugggauuggcuaggagggguggugcaugccuguaauuucagcuacucaggaggccgaggugggaagauugcuugagcccaggaguucaagaccagccuaggcaacauagaaagaccuugucucaaaaaaauauauauacacacacacauacauauauauauauauauacacauacauauacacacacacacacacacacacacacacauauauauauaaaauaauugggguugugaagaagcuccuuugcuauucaaacaauagcagaaggaguuaacaggugaauggggggagggguggaagggcaaaaguggccagggggaaggagcugaagcuagaucuuaaagggaagggcaagaucagaucugugcauuuagaggguccuccuggcugcucuggagaacggauuugaguaggugggagguggaagggcaccuguggaaaugcgguagcuuggaccaugcugaugauuccuggacuagauagcagcaggcgaaugugacacauaucuaggaggagggauugaaaugacuuggauguggagggagauggaggguccagaaucacccuggugucuggggucgugagcagcugggugcagucccuggguugaggaaaugcucuugaggaaggaucaugcauuuggauuuaggugucaugaguauggguuucuuuugagauagcugggaaaaacuaacuggaaggccgccggacacuugggucuagaguugaggagaacccaggcugaagacccuggagcaucauaggcauuuugauguucucugaagcgcugggccaagagagacugccuaggggaaagcguggagugagacaagaagggaacuagccaggcaagauggugcacaccuguaaucccaacucuuugggaggccaaggcaggaggaucgcuugaggccaggaguucaagaccagccugggcaacauagugagaccucaucucuacuaaaaauaaaaaaauuagcuaagcgugguggcaugugcucguggucccaacuacuugggaggcugaggugggagcgucucuugagucugugagaucaagggcgcauugagccaugaucaugccacugcacuccagccugggcaacacagcaaaacccugucucaaaaaauaaauacauaaaguauuagccaggugugguggcaugcaccuguagucccagcuacucaggaggcugaggcaggaggaucacuugagcccaggagcuggaggcugcagugagccaggauugcaccgcugcacucuaaccuuaguaacaaagcuaggcacugucucuuuaaaaaaaaaaaaaaaaaaaaaaaaggaaacacaacuggaaccaugagauuucucauugauggaccaggcagaagguggccaaggaggagccccuggaggggcaggagggcccuggugagccagggcaaagguggcagguaacgauuggccacuccuguguccgccccguggaugagagugaccugcaccaagggacgaggugucaccuccagaggucaccuggccaaacuagagauggggcaggccccugugggacagacagcccccacuagacguggguccccuaaggcccagcuuagcucaggcuaaggccagccccucccuccuggaggcugguugggaauuaaaguacgagucuuguuuggcagucaauauuauuuuuuucuuucccuucuccuugccauguugaguuucuccccgcuucaaucuuucuaaacacuuuauaagccauaaauacaacugagucaguuuagaucaguugggguaaaugucaaauuaucuucucucuuucucucucuggcucuuucuucccucccccuccaaaucaacagccucuaauaaucuguccaacccuucauuaagccuuacagucucacucagggagauuaaaugaauaaaguaaaaagggaaaggggaaaaaagagagaaaagcaggagcauuuauucucacugugucuccgaccauuucccuuuucuuuuugauuucuacaucgcugacuugaaagcccuugagugacagcgucacagggaccagcgaggaagccgugagagguagcagagcuggaaaugccguggcucaguagguagaaaguaacguaauuauagagcaggucagagccacucgaaugagcaaaaauaaaagcacagagguuuucuguagaccgucaggggagguaaaaaaaaaaaaagaaaaaaaucauuguaaacucuuuuuccaccuccccgcucacuucaaaccacaauuuuaaaaagagguuuuuuaguuccugagaaaccccucuuggaacucccagcagccucgugggacaaguuugucccuggaugugggcccucuuugcaggggcugccagggcagcugggaaguucccaccuuggggaacgggauggggagaguuuguugugacuugugagagauggaggugaagggacagauggacacagagguggggggauucuguguccuacguucucccugggcugaguauaggggccaguggggcugaggcucgguuucuaaaacaaggucuguugaagggaucugaggagguugguggucuaguuuggucuagcucuuccuaagcacugacugcacagaaagggguggccagcaaaagucugguaucuccuccucuuccagggaaugcaagcuccuaguggcuucagugccugagcccuggaggggccguggagguguggaggagggaggaagggacaucaaggagguacaggagcaugggagugacucugcagagaguuccacgcacccaccggcuucaaggccuggugaaggucagggcccggguccugaacaaaucacuggggccaggcagaugcagagaccucauuuguucuuguaaaaaguccacugucuacaaagaaccagucagagggccagccucagggucucaaagcagcagauccuccugccucccaacaccgacccccgcuaccccuaccucgagaaccuugagucagcuuugucccaaggcuggaauucugcagacaagggucugauucagagcaggacaugacaagggaccccauccucucagaggcucagaggcuggccuuguggaguaggaggcaucugaguccacgugcccuaagugcuuagcacaaccauaauuaaugaaggcaaugggugauugauugcuucggucuggccccucccuguggacaccacucuugcucuuccuuccuuggcaccuggcccagcaucuggcaggcagcaagggcuuaauaaaugccugaacaaaugaaugagugaaugaauacuguuaguacuagugggugcucaccaugugccaggcaccagcuacauuauuucauguggggccaaaugugacacugagagcuaaccaccaucacgcauuucacaagugcaaggcugaggcuccgagugcaggaauacuggccugggcucucugguggcggguggcggaaacaggacgcaaaccccagucagcuggcuggagugacugccaugguuaggaagguugggaggagcagcuaaggguggagagccccaaagcagaaggcuggugagucugagagguggaaacuguagagagguaaaaucugcucugcugaguacagcagcagucaacccagcauuuuccaugacacacuggcagugggugcccagguuucaggauggauuagguaaggucuaacugguuggacacaugaggggaaaggugacuuggugggcccaucucgcugugaaugcuggaggccucccugcagcuugcgaaaugcccuugugcuauugcaauucacaccccaaggccuccugagccuucaggucacugcaugccauccacacagucccaagggcacagcuggcuuggacgaguuacccauuuacagacagagugcucugguugguggaauucauagggcuaguucugggguggcugcuccuagccuccugccacauuguguagcagggaagaggcugcugugugcuccacuagggcucuccaaccuuugggugggugccuggcccagaacaggguucccugaguuguacagaaauucaauggaaagccgacgugcagggaggguuuggacccacacaggggaaaugcccuggcaucugggagguggggcugcuucuggccccagcaguccucccuucaagcagaggccagggccaggcugagcugacaagcuucuacucuccuugcagcaugaacgugcagggugauuaugagccaacugaugccaccggguucaucaacaucaauucccucaggugagaagcucagggcccugacgggccuucagagccuccagguguaaaggguaggcuuugagagcccccagguguaaaggguaggcuuugaugcgaccuugacugcugcccugcccugcccugcccugcccuagacaaaccccacuuuccuguccaucugcccauagcauccucagaagcaugcuuugauagccgacaguaacagaggguccuaggcauugggguccuagguuccugugucccaccgggugccucugauacuugcccuccccucccgcuaagccacagggacuccacuaugagcuccuuugcagggcagguuaaacaaggaaauagcauagagguggagagaagccuuuguuuucugucaccauaccugagcuguaggucuagcuggaagccauccuagccacguggaucuccauggcccaggaggguggugcacgucaucugaagucacucagaccuuugauccucugugagucaccaguaagagugucagcuguaccugccucacagaugcagugaagguucaauaugagccuguggaaaucaagcaugcggcucaggcuuagacccuggcaugcaggaagagccaggggcagugccagcagcaagcacacucagcccagggccggugugcucaagggcaaacagggucguuugucaccagcagcuaacauagacuaagcugcucugggacacucuccuaggaugucucauuuaauucuuacacaaaauuugcaacuccccgggaacaggcugagugguuaaguaacuuuccaagggucacacagcuaggaggugguggagcugaguccggagggccuguccugcuguggguucuccaucaccagcucccuucucauggggauuggagucuagaagaagaugcaagucagucuccucuugcuaacaacaugcccugggcacagagccaucauuuucucccagagccagucucuugucccuggaggcaccucaugccccgagagauguugaagcccgcccaucugcccaggguccucucccuuccccuccgucaccuccaccuccccugccuccugcgcccucuguuuguauuuuaugacucuauaaacccuuuuaaauggcccagaacaaacagggcuuacauaguggccucuucauuucuccuauugccaguuaaacgcuuugucuucaacaaugacaaacaauguuuucccccuaagauaaauuaauuacauuauccugauuggagggcaggaggggccagggcgggagagggaauagaaaaaaaggcaacuucacacacaucuuaacaaacagcugccccagccaccccagcucugccugaauuaauugaacccaguguguguuguuauuguuaauuuacauuuuucuuuguuuugaaucugguuuacaggcugaaggaauaucaucgucuccagagcaaggucacugccaaauagacccguguacaaugaggagcuggggccuccucaauuugcagaucccccaaguacaggcgcuaauuguugugauaauuuguaauugugacuuguucuccccggcuggcagcguaguggggcugccaggccccagcuuuguucccuggucccccugaagccugcaaacguugucaucgaagggaaggguggggggcagcugcgguggggagcuauaaaaaugacaauuaaaagagacacuagucuuuuau

SEQ ID NO: 13140 - RNA, 6703 nt, Homo sapiens
gagcugcuccccgagcacguugcgccagcggccguacaggaagcugugcaggaugucggaggugauaaccucggccagcgccagucccggcgccuucagcccggucuugagcaccagggccucagccgggagcacggagcccaucaugggcggcccggagcuccccggcgccgggggacggccgggccgacgggggaggugggcgggcgagaggggagcccaaggggcgagaggagagcgcugcgauggagaaggaaccagagcagggggaggacggagaggaggaggacgcaggagggagcgggaggugagggggcgacugggaggaaagcgaacgagggggagaggggaagagagauggugaaaucuguagagauggcaaaggcggcgcggaggguggagagacgcggguggaggcggaggcgggugcggggggugcagggugggugagaggcgggugguugcagggaagcggcagcaaggggcucaggcgcgcgcuagccucucgcacacucggccggggccgucuuccccuuggcaaaaucucagcgccuuuauaggagccgcagugacccuccuaauugguuauuaaugacccccugacgucggaggacagacuuguuguacccggcugggcucgaggagccuucgucgcgagagcgcgaggggcgggggcgcgcggaccgcuccaaacaguaccccuccacuccucucuccccuuccugguccuuccuccccccuccuguuuuuccuucucuccccgugggaagcgcagggcagggagggaggcucagccggcucugaggagaggaggggacggagaaggggagggggugcggcgaggcucucuaggacuccagggaccaggcuagacaagaggggacgccuggcuucgggccccgcgcuccccucaggccugaucuauguucaccggccuggcccagcccggcguucaccuuuacuuugcugccccggcuggccggcccagcccugcaccgcucucccuccccggccagagcccgcguccucuucccucuccggcccugcacuccccgggccgccacagucgccccgagcucgcgcgcagcccuaguugccacgcggauccccugcucagacugcgcugcugaagccggcgcuucgcuucauacgggccgcgccaacucggucgcugugcacggucgggugcgaaacuccuccgcgggcucacggggcugccgaggcggggccgcagcggccgucggggcuggggcuggucccggccugagacagcuucauggaaggccaggcucccggcccuugcggggccaggucgggggucgagaugggcggacaggaaucgcccuggcagccugucucugggaaaagaauuuccuacgggauauagggggauugaaaggggucccgagacccuuccuaggugggagcaggcgugccugagagcgaagucccucagaaacugcaggcagcuccgcgagaggccucagugcggguucggcuugcggcccggcuuuccggcuccuugcugagcugcaaccucgggaagccgguggcguugcggcgccccuuccuucuugccuccuaguucuuucuuucuccucugccucucucuucuuucccuuccucuccucuauuccuccugcccaucaucccaggagcagacuugcuuugcggcgguuucgaggcaccucggagcccagcgauccccucucccgaagcagguagcugcugagcccagcggaaggccccgcuuccugcaggcuucgcggcuccccagugucagccucaagccucggaccccaggcccugacaugcugggugagggagcucaccccaccugccgcacuucuggcucccaucaccagccuacaauuucagaugccgcuaacagaggugccuggacccucucggcgugggucaggcucacggauuagucuccgcuggacuguguggacucccuagaccuucuccucagcgcggaggacuuggguggaagaacagcgagcugaccucccaugagcgagacccuguccaaacgccuguuggcauagacgccccuccaccacccggacgcgccuuggcuaagagggucucacaccuggcguccagacuccagaccccugguccccaguuccugccaguagucuccggcaucccccguccccguugggacgcaaagggaggaaggcggcgguagcuggccuucagacccugcguccggguccgcccgaggcuggagcccaaggaagggcacaccuggcagaaggcaggaccguugggcagggcgccagcagagggcagcgcugcugaggagggagguggguuagggucgccgaacccuccacucauuuuucgacgcagcuugugggucgcaucggcucccuggccagagcucgagucugagggggcguauggaguccgauggcuccugcaggggagccucaccggggccuacuucuuggcuucugggaagaccuagguggagaggacaaagugcuaggagcgagggagacgacgucggggagcgcugccaggagccaagcgcugcggcagcucccaagccccgaaagcgaccucaguuccuccaggacaccaaagggggauaaggacugcuguguguccuguggacugccccuuuccucucugggccucggugucccugucugugcaaugguuugaguuggacuuugugaacugagguuucuuugcuuggucucucuuuggguaagaucacuuuaccccacgacaaccccgaggauuuugcccucuccagggccacgucccacugcgggaagcccucaggucugugcauccuccgugcuggggugcagcguuuggguccugaaccccggcuuagaguuagaggcuuggauuccgcuggcgcagugaccacgggcucggacugcggccagggagucccauuccucuccuccggacccgcaagcccggagagcaguacugggagccgggcagaagcggagcgcagaacguccucccagcuggugcgcccaaaucuccaccgcgcucacauuuugugcuucuagucuagcggcaaaacccaccuggacccccgcccggggaaaaaggagcccguagguagcgcccagucucaaggugcauugaaauagggagcaagacccugugcucacaucuccccgggaggagauuucgaggggaaacauuccgggcuuucccagcggaugacccguguuauuuugucauuuuccgcggggcccaggcgcggaaugugcucgcgcaaaagcccccuccccucggccgggccggagcucucaggcuccgucgccccccucgcccgcuggccgccacuuggcgaucucuuuaauauucaugggcguuaauagagaggcccucaguauaucgguccauugugggcggcucguaggacuugaauaggccucggcccccuuucuucggcgcggcuucccgaggggccgggccaggagugaauggccccgcuucccgcuccgcgcccccucccccuuucagggagaacaucuuuauccucuucuccgcugccgccgccgcccgggcccccauucacgcggccccggcuccgggcggaacgaaucaauuugccgcggcucuucggaggucauccucgccgcccgggugcccucuuccccugagcccacgggaguggagagagggccgccgcggcaggccgacggccccacggagggacauugaaggggaaguggaggagaagagcaggggcgacccggagggguggcugggccggggcgggcaagacagucucagggcccggcagccgcccgggguuggcuaauuucuaguuguugccccgcucagggcggagcgccgaggggaaggaggccgcggcccaagcccggagguccguucguccuccccuugaggcaccagcgcgcgucccuucggcccggcugaggcaccuaugagaacgggggcgugugggacagcccagggccccgcacgacgcuuucguucucgccggugcgccggggcuuagcuccgggagagccaggucccgacagugcgcuucagggggacgcucggaagggcggccggcuucgcggcuccugcgcccucgcucuggggcccgggccugggugcgggggaggggggugcgagucggucaggcggggccaaagcgcacggguccccgcccugcccgccccgccggcccucagaggcgcagaaagaagcccauuguccgccgagaaauacauuuuugggggccgagugaaagcccgucuuucuuuugaacuuuagaagaaagucuccuguucucgccccucggagggagagauuuguccccccucccgggagcuccgcgcgccuccuccucccgaaacaucugccgggggaaaauccacccuggagggcagaucgcgcucgcuuuaagccuggcgaacucauuaaaaagauauuagcggcgggggcaggucccgcgcagguaucgaucggccggaaugagcccgaggaagaaaaggcgaagaaugcgcccgcgccgcgcucagacgcccacccgccccgcccagccccugcgccccagccccgcauagggagaggggcccccgcgccgccucgcacugucugugagucccgcggcccgcgguccagccgcccccacccgggcuccucggcacagccccucggcaacccuccccugccggugcugcgcuccguccuggcuuccccugcgcgcagguucccggccgcuccccuccuccgcccgcugccgucgcgcgcccagcauccgcgucucucuucucccccucuccuucucuuccuccuuccccagcgcuccccucuuucgcuggcgcuccgacucccucuccagcuucgcacacccucuccgcuuccuccucgcacgucucucucuggcuuucugagccucaaucuuucgcaguggcccaggaaauuccuuccucgcguggggcccgcgccgcuccccuccccccacccccguuccccguaagacgguucaggguuccagggcgcccccgccggcgcguacaaaggcgcggcuggcugccaaggcgggugggggcgaggccgaaaaaaacgguuucaacagacgugacucggggccaggccugcgcggggcugccggcggaguggcggccucggcucagugaauggggacagcggcccccucucccaccccaccccuguccccucccaauguaauuagcuuucaaggcucgggagagacaaaggcgcgccccggggcgcccacguggagugcguaggcgcgaagucggcgccccgaccggcaggugacuggcacgcgagucuccccaggcgcccaggggcggaggaggggaagccccuccccugcgccucucgaacccccuuccaucgcccacaccccgguccccaggccagcgaugccagcgccacagcccaggcugaucaaggcggcgggaacgacgggagagacgccggggacaccaggagaccgggcggugggagagacagaggcgcaggcuucuggaagcagagggggcgagacaggggucgggggagacugaggcaaggcgaugccgagguggagggagcagaugaaaggccgagucggagacgcagggguacaaagacucggagaugaaggaagcagagggggagaggcacggcuuccgaaagagcgggaggccuggagaggcuuucaagagcuggaucaccaagagggagcaacagggugcuacagagagacuggagugugagggcaaaaggaguccuggggaaaacagcagggaaagguugaagagggcaggcugguuggggucugugggaggcaggcgcccucccuguccgucuucccuggccccuccagccuccagcucacccuccucuguugccugccccucuggugggucuaggggcagccagaaggagcccucuccgacccauucacaaccuccucuucugcccgagucccuucccaccccacacccagcccuuccuccacaacuucccugagccgccuccugccuuccagaaccuugcacucaauuccaccugaaauguccucccugcauugccccagagcagacaggggguuggagucagggggcugugcccugacugcugcucccugaggccaccugcugccauccagaccaucuccugccucauggggaaucauugcauuguucaacaaacauuuuuugagcaccuacuauguaccaggucccauacaaggcccugggggcaccaagugaccagggcagacccaguucuugccuucucagaccaccuuccaagcggugcacccugguaggccagagcuucuccuaggucgcccugguggcucugaggucucucuugacagcuuucucugagggcuccugcugaaauggcugugacuucauuuguagagugggaacaauaaccaggccuguuugugaugccucacguaucaggugaaugagcucacacucaaguugcagagugaauggugaaaaggugcuuguggcuggcacuccuauuacuguccccuccccagagaccacuccccaggugaauagguccucuggggccaucaagaaaugcccagggccccagagaccugcagauguggguccaagucugguuccagcagcuacuggucaggagccaaggcacccacuuguccucugugagccucaguuuguucaucugugaaauggagauaaaaauagaaccuccacugggaagu

SEQ ID NO: 13141 - RNA, 10799 nt, Homo sapiens
accaagcaaaaggcugcuuguuuuuuuuuuucuuugaaacacagucucgcucugucacccaggcuggagugugguacgcgauuucagcucacugcaaccuccgccucccagguucaagugauucucccaccucagccucccaaauagcugggacuacaggugcacaccaccacaccuggcuaauuuuuuguauuuuuaguagagaugggguuucaccuuguuggccaggcuggucucgaacuauugaccucaggugaucugcccgccuuggccucccuaagugcugggauuauaggcgugagccaccgugccuggccugcuugguuaacuuuauucuuccaacuuuaccagcugcauucucagucauuuaaaggauauaggaauggaggccaaaacagaccauuuggaggucagggaugccauguuuucuauuggggcaauuucauggggcacugugccuugugaaugacagugaguggaagacaaaggauucuccauauuauuccaggaugggagcccauucgacuguaacacugugcacuuugaaagagcugaaacuauucccuaauaccgggacucagcuggcaacccaaggaagcacuguucaucugccacccaggcuugguguuaggacaggagaaagcaggccugugggcuggaggccgucacagggccgucaaugcagacaaagggaugaucucucgagucuuugcugagccacauauggggaccacacaucacagucuucacuccugcaagguccacagucccgugcuucuggagcaccuccuuaucccuccuguuccaaaagccucuggcguguuuccaucacaaucuccuccauuauuucuggcuuuaagaugucuuugaucugaaaaagggaaaaggcauuuguucagaaaagaaaccaaccauaaacagaccaccaagccaauccaaacauaaaucaagccguuaacauaaacuuucuguauuccuuucaugucucagagacuaagcguuacaagauaugaucugcuagaagcagccuaauaaaucagcaagaugcucugggauauagucgacaagaacaaagauauuauucugacauucauccaaaagcuggcugaaauuugggagagguaagauguaguccagagguugcucucauaaacuagucccaccugacaccuccugccccaaaauccuuagacugacacuaggcauugagaauauugcaaguuucuuagggaaagaucuaccagacacucauuaaggcuguuucaggccaguucauacugacggauguugggaaaguauuggggagaugugcauauugucucugaacaaacaacagagcagcucacagaucagugaagaagggagaggcccuggggagaguaccugauguggaagggaugcuucauagcaguacaggaugcugguaucauacagcaucauccucugaguuaccagcgagaugaugcaguuccgaagccgggauaucaccucucgaucagcaagagagacaggcuauaaggagacacagagaggggaagggaaauacaaacaggaccaaaauacgugaccagccacagaaauucacaaauaaaucauuuaugacucagacaguaucacccuggaacuccaaaucaaccaaacagcuaauuccaagggagauuaaaaggaauggggcagggugcagugucucaugucuguaaucccagcacuuugggaggccgaggcggguggaucacaaggucaggaauucaagaccagccugaccaacauggugaaaccccaucucuacuaaaaauagauaaauuagcagagcaugguggggcacaccuguaaucccagcuacucaggaggcugaggcaggagaaucacuugaacccaggagguggagcuugcagugagccgagauggcaccacugcacuccagccugggcgacagagcaagacuccgucucaaaacaaaacaaaacaaaacaaacaaacaaaaaaacagaaaaagaauggcuucuucacuggcucuucggcuauuacccugcaacuuugccaccuccaccaacaaacaccaaaccauucacugaauucaucuccuuagaagagaagauaauaugggcuucaugaacauaccgugauggaaagucaaagugacucagccuacaccaguaacauagcuaaaaacaaccaacuucacuggccacaaaaacacagcaaagacugagcccccuccaucccacugaaaauggccacaguguuugcucaccuccagguuugcaaugaagcccccugcuuccucuucuuugugcucagguguuggguaaauccagaugaagccguuguuaccgagaaucacugaggcaccacauggcaaaucaugaaagugggucuucugccguuucaccagggagggggaaaccuggaccaaaacccccugaccuagcuaaagaaauauaucacgaagcuaggucacugcaagauuggcgggaugaaugaaaaggagacuacagaauauacauccuaaguauauucaaauugguguccuuccuguuuauaauugcugucgccuacaugcauacacauaguacacauuuuugcagagaacgcuuugggacucagaggcuauucauacaucccagcagaaggugaccuucaauacucuucucugucauuucccuuugcagucuuccuugcacucuaagccagaacucaugugccagacauuagagaagcugaagccaaugaggaagugagcuggagccuccugcuggcccaggagcacugcguuguuccaugacccuagcucauaccugaaccccaaacacucaucuugccugugagaugugugccucuggguagguaaggagauggguggagcugggugcaaauccaugucugguccuggcaggacagcucaaguccacguccugccaaggaagaguccgcaggacccaggguugugaaagucagcauacugcagcaguccucugccuacuccauguacaucaacguggcugucugcagccacuccauuaagggaagagguuuuuguuccacucagaaaauaaaaacguucacccagauaaagcuaagagacuaguaaauccuaauuuguuuuaggaaguaugcucuccuuaaaauaguaaauagcuucaauaaugcaaccucguacaagaaaagcagugaaauuccauuuagaggcucagaugacagagcaagcuuugccagcaauaacauccacuggacugauuggacguuugucuaagggcuguuuaaccagacccagccugccuuuguucccaggacagccucagccccagugcugagcugcagcgcccccuggaggaagagagacagcugcaccucccagcccacaguuggaggggcucuucuggugaaagucagucuccuuggagaaaaaggauaaaacuuguucuuuacaaggcuacugacccaugacccugugaacccugaccguccugauguuacguuuaaggaacacgaucaguuugugggaugccagccucuauuaaugcuuagcuacugggguucuuuaggccagaauuccagagagcuauggggauucaaaaauagccuuguagucucagucagcaaacaggaacaucaagagcccgacuuacuuuuccauauuucaggcuccucgugugcaaagagacagcuccgucagagaacacugccuggaccucagccuggccagggugaugaaggaacaaacagcagccuuggccacacacuguccuguccucugcagccucuccccuugaccccacaccuccaucuuuuccuccccucuccaaugguccaggcucaacaaucuuugacccagagcacaucacugugaccuuaccucuccccuugguugucaugaauaucuuuuuuuuaaaaauacagacagaaggccaggugcgguggcucacaccuguaaucccagcacuuugggaggcugaggcaggucgaucaccugaggucaggaguucuagaccagccugaccaacauggagaaaccccgucucuacuaaaaguacaaaauuagucgggcauaguggcgcaugccuguaaucccagcuacucaggaggcugaggcaggagaaucgcuugaacccgggaggcagagguugcagugagccgagaucccaccauugcacuccagccugggcaacaagagugaaacuccgucucaaaaaaauaaauaaauaaauaaauaaauaaauaaauaaauaaauaaaauaaagacagaggccaggcaugguggcucaugcccguaaucccagcacuuugggaggccgaggugggcagaucaccugaggucaggaguuugagaccagccuggccaauauggugaaaccugucucuacuaaaaauacaaaaauuagccaggcaugacgcacgccgguaauccuagcuauuugggaggcuaaggcagaauugcuugaauccaagaggcggacguugcagugagccgagaucgcgccacugcacuccagucugggcaacagagcaagacuccgucauuaaaaaaaaagaaaaauuuaaaaaauaacauaaaauagagacagagucuuguucugucacccaagcuggaaugcaguggugugaucauagcuuacuguagccuugagcuccugggcucaagcaacccucuggccccagccuccugaguagcuaggacuacaggcaugugccaccacgcccggcuaauucuuuuuuaauuuuuuuguagagaggggggucuugcuauguugcccaggcuggucuugaacucuuaggcucaagcaguccucccuccuuggccuuccaaagcgcugggauuacaggcaugagucaccacacucggccugucauuaauaucuugacgugaacaacaccuucuccacucccugcgcuaaaaguuaacaccauuaacaaaagccuagucuaaagcacaggccaccguaaguuacaagacccaaagaaaugacuuagcagcaggucccaacaagagcuggggagucagccugaauuaaggagacugagaaaggaugcagcagagcccgacacuuggucuaagacucggaucccugcaaggaugacaugguucuuccgucagagacauacaauggaaggcccauuucccagucccacagaaaagcaucaagaggcuggagugcaaagcgcaggauacacugauaagguccccuuccuguaagaaaccucucauugcaagcucaucuucugcagaucuucuccucugaaauacacaaagaaaugacauuacuuaagccagauccucagaaaggucuccaucacuucucuuucacuuccuuuugagauguuugaggccaaccacaauauucaagcacugagaacuauagcaagaguagguaacccaagccacuugaggggaaucagugauaaucacgacuuuccaucucaaaagacuuuuccacagcuccucuuccucuuucccucccuucucugaggaacauucagaccccucccaaucucaccuagccaacauuuccauagucaucuuccaugacagcccucugugguccagcaggaccagacuaacuccugcuuggauauaucucugcucauacauuucccuuuaucucagauucccugaacuagucauucaaagucucuccauccuuccaggaucaacuccaaugccugucuuuccuacaagcuucucucacugaaauuuccuuuuguauaaccacagcuuauuuauucuucuacugccagggacuaggucaguuaucuuauauccccugcuggggaacucaaucgugcuuggcacucggcacagagcuuggcacaguaagccucucuguaaauacacgcuggacugaagaucaaggugaaccauggcauuuuacaaaaggcuguggcuuaguuacugugguugucuggaaugccagcaaccacauuccacacaugguugaaugaaaugccuuucaauucacaaaaaccuaauguaaagacaacuuuucaaggaacaucuucacuaugcaaggcuguuauauccaaaaaggaaaacuguuaacaaccagcaucuaagggcuucucuccccaacucucuguugggaucccaccccauggauguuucugauccuaccauaugccaacugcucccucuuucgggagaccuggacagggugaaaagucuacauacacaucuaggcagcaaacuucacagcagacaaacaggagucaaaggggcaaccucaguguaaaucaaaguccucugguggaacaaagggucccacggcuccccccagcccacugggcccuaguccauggccccagcuguagcccuuaccagcucuccuccaggaagguucauggacgagagcagcaagaccgaauccagccuggaguuggucuccaccuuccaccucuucuguugaaccuauaagccaaguuccacaccuggacacaugcuccauguucaugugucauaucauaaauaaccaguaaggccagaugugguggcucacgccuguaaucccagcacuuugggaggccgaagcugguggaucacuugaggucaggaguuugagaccagccugaccaauauaaugaaaccccaucucuacuaaaaauacaaaaauuagcugggcgugguggcgggugccuguaaucccagcuacuugggaggcugaggcaggagaaucgcuugaaccugggagguggagguugcagugagccaagaucaugccacugcacuccagccugggcgacagagcgagacuccaucucaaaaaaaaaaaaacaugaaccaguaaucugaaaucgaacaagccacauauuuacaucagaagccacacaacggccaaaugcaaugaaugccuuuuucauguaacuacaaguggaaugacugucccaugaaugaaaucgccagccugccucgacuuuguaaacaccaaucugauaucgacguuaccucugugauucgucccacuacgaugucuccuacuucaccaauguaucugaaagacaaaacacaagggguucauccaucugugagcagacuuucugacaagaccacacaccauuugagaugucgguucaacagggugaaagccuggaacaggcgccacauucagcaaauucauguaacuauauugucuggacuuacuuucagaaacugcuaacuucaaacauuccuccacguauaaagucuccauuaacuauccuuagacauaucaccauuccaaguaguucauuuagcccaaaaacccuauuuuguucgauuacacgacaaugaaaaacacggacuauuuuccuguggcacauggaugaguucugcaccagccaaaggaagagaaaggaaaucugagccaggacuccaaccacacaagucugcucacgucuccuccacuuacucacugccugcuccucucaagccccuuugcuaguuccuuacccgcgauucuaaugagacguacucagugcugaggcuaaguccuuagaccucuucacuuuucggccacucaaucuaauaccuuuaaaacaccacucugugcugugacugugccacucuccugaauuccaaauccuacucaacugcuagcuacccaacucugccaucuagaugacuaacaggcauuuucaaauguaucaagcacaaaacuaagcuuucccgcagcccccuccaguccuccauagcaaaccgagauaggggaugaguuguccccaucucagucaacggugacuccauccccucaguugcucaggccaaaaaccucggagaguuccuugauuccucucucucucucacgcuccaggacaaguccaguagcaaaaccuguuggcucuacccuuaaaacauaugcaggaaauaaaaggcauccaaauuggaaaggaagaaguaaacuuauuucuauucacaguugacgggguccuaugcacaguaaagcccaaagaauacaaaacccaacagcuuuucaugauuuuaaaaaaacacucggaaaauaaaaucuguguagauuccaaucacuccuccaccuuccacugcucccaccuuaguugaagccaccaucacuucagaucaugaguauggucccuaauccaccucccuaagcuugcccuaucccccuucaaucucccaucagcagccagagugagcuuaaguccagaucaagucccuccucugcuccaccccuuccagugcuucccagauuacacaaaguagaagccaaaaugcuuacucuggcuacaaggcaggcccacgcccgcccaccucagcucucugcuuacaucugccccuucucucccccucacucacucuguuccaaccccacuggcuugcuuucuggggcuaaccuucauugaaugcuucuagguaucaggcucugugcuaaauacuuuacaggcaccaucucacugaauucuaaagaaaauccuaggccaggcacaguggcucacgccuguaaucccagcacuuugggaggccaaguggggggaaaucaucagaggucagcaguucgagaccagccuggccaacauggugaaacccugucucuacuaaaaaucgaaaaaaauuagccaggcgugguggagggcgccuguaaucccagcuacucgggaggcugaagaaggagaauuguuugaacccgggaggcgaagguuguagugagccgagaucacgccacugcacuccagccucggcaacagaguaagacuccaucucggaaaaaaaaaaaaaaaaaaaaagagaaaauccuaugaaguaggccaugcuauuauacucacuuugcagaggagguaaccaaggcuuggaguggugacauaacauggggaaaccucugaagccugcacugaucugcaccaccccaccuacagucauggucaaaaccucagacuuacagcaugacagggcaggcagggguggggugggggauaaggagggggcaggaaaagccugguuguacaaccugaugcugcaagaaagggaauacacaccuuuuguucucaccugguuuucaaagcuuucacacagaucaacuuguuuacucucuccacagagccagcaacagaugcaaugagcuucucuucucccauauacguuccauggccccugaugcaaggcgaagauacaaagaaaggauacgaggguaacucgaaaugacuucucucccuucaagaacaacguguuccucaaagcuaacaggcucccccugcaaagcguggcuucugugcuggcugcucccucugccuucagugcuccuucuccagacagcuacuuggacaucacuccucucacucaggucugcucaggugucacuuucugcagcaggccuaccuugacugugccauugaaaacacagcccacccuguugccaccauuccccccacauaccauugacccugcuccacuuuuuucccuauugcauuauugccuaacauucugaauaacuuauucauugcgcuuauuaucuaucucucccuguuagaacuccaccaggacagagauuuuucacucugccauaauaacccaacugcacaaaauauauguugaaagcauuaaugaaagaaugaaucuuaagauuuccuaggggccaggcaugguggcucaugccuguaaucccagcacuuugggaggccgaggcgggcagaucacacuugaggucaggggaucgagaccagccuggccaacacagugaaacccugucucuacuaaaaaaaaaaaaaaccaaaaauuagcuaggcaugguggcgugcaccuguaaucccagcuacucaggaggcugaggcaggagaaucacuugaacccaggaggcagagguugcagugagccgagaucgcacgacugaucuaagacagacuccgucucaaaaaagaaaaaaaaauuuccugguauccacuaaccuuaaacuaacagguuaaagggcaaugcuaugaaugcugugccccuuguacauauacaaguaaaaaaauaauaauaauaaagguugaaacacuaguguuaucuaugaugauauaauggcugguuuuacuucuuuucuuacauaauugucucauuuaauccucauuaccguaucauacuguuauuaucacuaucuuacagaugaggaaacugaccguggagaggcaaugccgcuaauaagaugugaugguagcaggaccggaaccccaacugucugacucaagagccuucccucuuaaccacaauacacugcacuacaccccuuagauucaaaauguguauaaaugggugcaugcagcacaauguaacuguuugcccuaagaucgaacaauuacggauucuaaacugaagaggaggcagccaagaacgcccaccguccccucagagagcugaaaacuggaaaagagccugcaccuaacccuccccagcuuuccaggucucccacaaggaaggaucaaagauuuggacuucaggcagaagacccaaaagucacagccaccggaggucaggaguggaggguuucagggagcugagacaaaugcagacggggacacacaagaugcagggagcaagaagcacgaggcucggaagcgagguguguaggaugcucagacgaagugcccugggucccgcggggaguuacacacacagggauacgaggccuggaccacgugcagagagcccugaagccgcucucugaagccucgacucccccaaguccccacguaccgcaugaauccuguguccguagugauuguaucccccggcaccacuagauguuucuuagugucgcggcccagucucucgcuaagaggcuugcgagccacuggaagccucaucuccaucgccaucuuggcgccaaugaguugcgcaggcg

SEQ ID NO: 13142 - RNA, 1518 nt, Homo sapiens
gccagagauuaaaacccccauuuuacaggugaggaaacaggugagaggguaaguguacagucauuuucccguuagagcagagacgacgaauucacacucucacuggauuucuuuuuucuuuucuuuuuuuuuuuuuuuuaagauggagucucucucugucucccaggcuggaguacaguggcaugaucucagcucacugcaaccuccaccucccagguuuaagcuauucuccugccucagccucccaaguagcugggaucacaggugcccaccucuaugcccaacuaauuuuuguauuuuuauagagacgggguuucacuauguuggccaggcuggucucgagccccugaccucaggugaucggcccaccuuggccucccaaaaugcugggauuacaggcgugaaccgccgcaccuggccucacuggauuucuauacaaacucaagaagcagaucaugauucucauuugguagauaaggcaauagaaguguggggagggccgggcgcgguggcucacaccuguaaucccagcacuuugggagucugaggcggaggggugggagcggggggaucaacugaggucaggaguucgagaccagccuggccaacauggugaaaccccgucucuacuaaaaauacaaaaauuagcugggcaugguggcaggcgccuguaaucccagcuacuggggaggcugaggcaggagaaucgcuugaacccaggagguggagguugcagugagcugagaucgcgccauugcacaccagccugggggacaagagcaagacuucuuaaaaaaaaaaaaaaaaaagugcacggaggaaugaaugagcucaggaucacauuccuaagaaguuaaugauggaaccaggggcuugucuuuggagcucacagcuucucggaucugaagcuggggugucuugggggaggggcacgggucccagcauugguaauguagcugcuggcuggagggcuuagucacccguagugaacccucuggggccuccccaagcugcugggcaaacuuccuacccacaggguggccagugcagaucugccuccaaggggcgacaggaagccggggugaacaagggacaaacugggucuggucgcaccugguuacccgauaggagggaaggcccccggacagugggcccaugugugggugacuucuguccccagucccuugcucagcacuguccucucaccucuuuaggaguuucugugugaccagaaguacagugaugaagagaaccuuccagaaaagcucacagccuucaaagguaagcuggggcgggcugcccugcauuuauuccugggggaggugggcuggccccucauccuugcacacaggaccccucagccccacaggacuaggcuguggcccuguuuuguccagaaugcccuucuuccuggagaaggcuuggagacagggacccccugagagguggggagaggccccuccaccugccucccugccccugcgggccccgucaccccucgccugcagcccgguccug

SEQ ID NO: 13143 - RNA, 713 nt, Homo sapiens
accgaggacauucuuucuaauccauuuugcguuggaccuguucuuagaagcuuaucauuggaaggugacaguaauggugugauuguucaccccaccauggaaacuugccuguuacauuucuaguauauuauuauuauacuagugagggcuccaggcuucuacuuugacaccagcauuaauucugucucuuacuuuuucacauucuuuuaacagccccaagauguucucguucacacaccucaguuucucaaauccccaucugagcaaagacccaaaaccauuuuuguucacauuugacaauaccugcucccacuuaaaauaaguaauaauuaaaucauuuuacaaguugaguauuuuuuuuuuuuaucaacagugaaaauuacuuagcuuuugggcuugcuuugaguugucuaaauuguguuuuguuuggggcuuuuguagccagccugucucgaucagccuuucugucucagagauauuaugaagacuuggaugaagucagcucaacgucaucugucucccagucucuggagagugaagaugcacggacguccuguaaagaugacgaggcagugguucaggccccucggcacgcccccgugguucgcacuccuuccauccagcccagucucuugccccaugcagcaccuuuugcuaaaucucaccugguucaugguucuucaccuggugugaugggaacuucagguaaguaa

SEQ ID NO: 13144 - RNA, 19576 nt, Homo sapiens
ggccauuugcaugucaucuguauugucacaugaaaugcacauccaaaacgggugacuuggaaacgaccuauuaggucacacggaguccggccccugggggccaaagccucaucgaugcccacgggcgguggccagcacuuuccucgggcuguggcgugugcacccggccuccccagaggagagucagcucacaccccaggcccuuuagcucucuggcagcagcucccaaaacgcacuugaggaaccaauaauuccuuggggguuaauagcuguuccccaagaaaaggguucuguggucaaauaaguuuagaaaacauggguuaaagaagguuuagcaagaagcuuuucuauagggcuugucagagccuuuacggcaauaacggccuuugugaauguccaacuuggggacagagugugcagcacuuccgaaaguuauugaaccacaaaaccccuuucccccaaaagcaucucgcaggcuggugucccaugggcacccguuggaaagugcugcccuaagcugucgaugaccgcuaauggcaauggcaccugcaucaggcaguagguugggggcauuuuggcaggcgucgugcuguggcgugaugggcacagccaagaacucaacagucaugaugaugaaaggacaagacaagacucggccccucccaccauccugauuuuugcuguucccagagcagaagcuaaauagggcuguccccauggguggguccuggcugccuagagaggagacuuggaguccaagcaaaggggcaagaggccuggcacugccaaacacgcuugucuccgggagggguggccuggguucgccagccuccagccaggaggggaagaugagguggggguggccgcucugacuccuggccgcucuguuccacccacgcccgccaccucgccacccccugccccuucucuagggccagcccugcccccagaggcuugugugggccggcgggcgcuucaccaggcagagaugagcaucuggcaggugcuggagggcauccagaccagcuccaccagacggaacuggagguagccgaugacaaagccggagaggacguccgugacgugguggcggccgaucaucacgcgggacaggcccacgcagagggcccagagcaccagcagcacacgcaggggcaccgccagcaccagguggcugaggaagaacuuggacaccauggcggcgcggcuggcgugcccggccgggaaggcguagauguccauggugagguaguccaggaggcuggggcucgucucguacgggccgcgccgcuugaugagcuucugcacgccggccaccgucaugauguccaggagcagggcuguuggggggagacagaggccccugggccaucagggccaccagccaggcccaggcccuggccccccacauuuccaccucgccuccccuuucugcuccucacucaggccacucagccacacugacccccaggcaggguccccucucaggcuguugccuuugcugucuccccugcccggcacauccugccuuccuguagcuacuuccuuuagcggagaagccuucccugaccacgcuguuuguaaaaagcccccaccacgcugucuccccucaccuuguuuaauuuuuucauacagcuuuucucaugcccugacauaauacgcauuuuauuucuuuggguuuuuuuuuuuuuuuuuuuuuuuuuuuuuuuuugagacagaguuucacuuugucaaccaggcuggagugcagaggugagaucuuggcucacuggaaccuccgccucccggauucaagcgauucuccugccucggccuccugaguagcugggauuacaggcacccaccaccacguccagcuaauuuuuguacuuucaguagagauggggcuuugccauguuggacagacuggucucaaacuccugaccucaggugauccacccgccucagccucccauugugcugggauuacagguaugagccacugcgcccggcccuuuuuccuuuuuuuuuuuuuuuugauacagggucuugcucuauugcccaggcuguagugcaguggccugaucuuggcucacugcaaccuccaccuccuggguucaaggaauucucauacuucagccucccgaguagcugggauuacaggugcacacuaccaugcuuggcuaauuuuuuguauuuuugguagagaugggguuuugccauguuggccaggcuggucuccaacuccuggccucaggugaccugcccgccucagccuccccaaguguucacccauuacaggcgugagccacugugcccagccccauucccauuuuucaaaaauugaagcaaaauuuacaucuuguacagugaaccauuuuagagugcacgcuucagcggcauucagcacaucacaaugucagcagccaccuccucucucuaauuucaaaacauuucaucaucccaaaagaaugccccauacccacgaagcagccacuccccauccccuucucuccagccccugggacaccaccaaucugcuuuccucuagaggauuugccuccucuagacacuccauguaaauggaaucagacagcauguggccuuuugugucugccuuccuuuccuuagcauaauguuuccagcauccacccauguggcagcgcuucauuccuuuucauggccgaauaauauuccacuguauggauggaccacuauuuguucaucuucucuuucuuuuuuuuuuugagauggagucucguucuguugcccaggcuggagugugguggcaugaucucggcucacugcccaccucccggguucacgugauuuucgugccucagccuccugaguagcugggauuacaggcgcacgcugccucgccuggcuaauuuuuguauuuuuaguagagacggggcuuugccauguuggccaggcuggucucaaacuccugaccucaagugauccgcuugccuuggccucccaaagugcugggauuacagacaugagccaccgcgcccggccucuuuauuuuauuugauuuuuuugagacagagucucgcucagucauccaggcuggagugcaguggugccaucucggcucacugcaagcuccgccuccuggguucacgccauucuccugccucagccuccugaguagcugggacuacaggcgccugccacuacgccuggcuaauuuuuuguauuuuuaguagagacgggguuucaucguguuagccaggauggucucgaucuccugaccucgcgauccgcccgucuuggccucccaaagugcugggauuacaggcgugagccaccgcaccugguguuuuuuuuuuaagagacggaugucucuggcugggcacggugggucacacuuauaaucccagcacuuugggaggcugagaugagcauauugcuugagcccaggaguccgagacuagccugggcaacauggcaaaacccuguuuguacaaaaaauacaaaaauuagacaugugugauggcauacgccuguaguuucagcuaucaggaggcugaggugggaggauugcuuaagcccaggagucugagaccagcaugggcaacauggcaaaaccccaucucuacaaaaaaauacaaaaauuagcugagugugguggugcacgccucucaucccagcuacccaggaggcuaaggugacagagugagacccugucuuaaaaagagagagagagggaaacagagagacagagauggugucucuuucuguugcccaggcuggaguguaguggugcaaucauaacucacuguaacuuugaauuccugggcucgagagauccuccucccucagucuccugagccaccgagacuacaagugugccaccaugcccagcuaauuaaaaaaaaauuuuuuuuuuacagaugggcaucccacuuugcugccuaagauggucucaaacuccuggcuucaagcuaucuuccuaccucagccucccaaagugcugggauuccaggcgugagccacugugcccggccacaauuuguuuauccauucaucuauugauggcuaucgaguuguuugcgccuuucggcugccgugacucaugcugcuaugcacgugugugcaaguguuugccgagugccuguuuucaguucuuuugguagaucccuaggacuggagucgcugguugguaaugacaguaacucugugugugacucuuugaggaaccccacuguuuuccccagcaacugcgcugugucauuccccccuuuauagaggacaagaugaaccccuggagcucagagcacucauaccugaggcucuugcuuucuggaauguuccacucuuucccaacucaccaccucagggaccugccccggccuuccagacagcucaggcccugaaugguucagucucaacaucuggcccucuguuucguggcuuuucccccgcagucacugaggcaucuguugggaggugaggguucgcugucugcggcaugaagucaucacuucguggaggcaggggcugugccuguuuguucauagguuuuuuuccccguggcuagaaacagagccacagucuccaaacguaguugaguuacuggccugaggcucauaaccagcgaggugggcucuuuccuuccuuuucuuuuucuuuauuuuuuugagacagagucucacucugucacccaggcuggaguacugcagcaugaucuuggcucacugcaaucuccgccuuccggguucaagugauucuccugccucagccucccgaguagccaggacaacagguaccugacaccacggcuggcuaauuucuguauuuuuaguagagacgggguuucgccauguuggccaggcuggucucgaacuccugaccucaagggaucugcccaccuccgccucccaaaaagugcugggauuccaggcgugagccacugcgccuggccuuucuuuccccauuucggaaacacaggggagaccuggaucuccaucgugucucugccacacccugcuguguggccuuggggggcugcuccgccuuucugugccgagagaggaaggcaccaugccaggaccccaguuucacccagcugaucugaguggcacccagaccgccaauguggggguuccaggucaacccuccacacccuuagaaaggcccuuggggcucacacccucugaccuggggguggggguggcaucagcaggccagacagcacccccagggcagguacagagucggcagggagcccgugccccugcccccugugcuuccccaucucaggugaccuuggggaccccagugaggucacagcuccugcaagcccugccucacggacagugaagacaacacccacagugcagugugguggcaaagcucacaggcaucacagccagagacccagcugugagcuccagcccuggagccucccagcugugugaccucaggcaaaccaccuaacuuuccucaccugugagacgaagcucagggacacccaccucccagagggggccaggcaccaugccugcaggcagguugcugacugcagggugacaagguuucacugggacagagggguuuccuaggacacaagauauucagugcuaaagcauggaagucgcagcaaaugauugaguuggucccccaaacgccuggcccaccaggagggcuggauaaaggugggggguuaugacucaaugacaguucagugcagccagaugcugggagcuuuccuagaaaacuuuucaguauuuaucggaauguucagcucuuggcagaaauggaaaaaaaguaaaaaaaaaaaaaaagacacagaagaugcuauucacugcagaacauuuacaaaacagaaaacaaaaguuagaguuuaaaucaccuguaauccugccccucagagguagucauuguuccagaccuuuccauccacuuauagagcacagcuuuuuuuuuuuuuuuuuuuuuuuaagacagaguuucccucuuguugcccaggcuggagugcaauggugugaucucggcucaccacaaccuccgcuucccagguucaagcgauucuccugccucagccucccgaguagcugggauuacaagugugugcuaccacgcccagcuaauuuuucuauuuuuaguagagauggaguuucuccauguuggucagccuggucuugaacucccgaccucaggugauccgcgcaccucagccucccaaagugcugggauuacaggcgugagccaccgugcccggccuuuggagcauagauuuaauaaagcuuguaacaugguuugcauauguuguucugcugccugcuuuugaaagucuugcaccaucacauacccccgauccccuugcugcagggugugaggcacuguggugcaccuaacuguccaugccaggcaguuagacuguuccagaucacgcaguccucccuggaggacuagaacuucagggcuuccccuuuuccugcccacuucaggguugcugcuuguagucuggucucucuguuugggguuugaaucguggcaucuccuggccccucucauuagccacagggcuggcugagagccuugcacccuggaagugccuggccagcacaggagggggcugagcagguacacagaggagcuggcuggcccaaggagggcggggccugaaggccucgagaaaaccuugcucuacccuugccugccaauuucacggcagcuguuccccugggcugggucuucccaggagguggcuggggaggcguguggcuggccagcucgugugcugaccaugcccggguuucgugccaucugaagccugugggaggucacaguuccagcaggagagagggacuggggacugccagguccccagggcaggcgggagagggagguagcugugcugaccuuggcaucccuucgccccaugaagcagcugaggaagccagcuuagaggggccagcugguccucuccagcccagggagcccucucaucugcaagccccaccacuuccccaaaaauggccuggugacaggcuuucuccaccuggcgagggaaggcaguucauggggaggggguuaaaucugaaggcucuggagucacaggugggguucaagucucacuggcuggggcuuugaggagggguccuggugcuucuggccgaggggucgacccugcuaauuaagaacaaguucuggccgggcgcaguggcucacgccuguaauuccagcacuuugggaggccgagguggacggagcgccugaggucaggaguucgagaccagccuggccaacauggugaaaccccgucucuacuaaaaauacaaaaaaauuagcugggcaugguggcgggcaccuguagucccagcuacuugggaggcugaggcaggagaaucacuugaacccgggaggcggagguugcagugagccaagauugcgccacugcacuccagccugggcgacagggcgagacuccgucucaaaaaaaaaaaaaaaaaaaaagaacaaguuccuuccccucucagcgccuuggucuacucacccauagcaaggguggucccaggaggaaauaagccaaugaaccggggaggagugugguggcugacagcauacugcugccauuacacugccugugaguccuagccccgccuggcccgggaagcugugggaggcucugguccuggaggcuggggcaccgugcaggaacaccagcgaaggcuuuuuuuccuaaggucccaccagggucaaaauugucuggcccagguuccaagaccuccaccaccucaagacaaguaagagaggccaggccaagcaaggccuccuggugguggugguuggugacugguggccagccagggucugggugcccgaacagcugccagaaucugggguagggggugguucaugcagaccaggacugggcuccaugguaggcugaaauaugacaccagccacuggaaggcaugggccaucuguccuacuggugaccaggucuuuagguugaaaaccaggacucagcagcugauggguucaaaaucugccuuucgaggccagcgcgguggcucaugcccguaagcccagcacucugggaggccgagguggguggaucaccugaggucaggaguucgagaccagccuggccaacauggagaaaacccaucucuacugaaaaaacaaaaauuagcuggaugugguggcaggcaccuguagucccagcuacuugggagucugaggcaggacaaucgcuugaaucugggagauggacguugcagugagcugagauggcaccacugcauuccaaccugggugacagagcgggacucugucucaaaauaaauaaauaaauaaauacauaaauaaauaaaaucugccuuuccagcacagggcccuaauggacagcugcuguggucaaggaaaauguggggaggaaaggcugacuuuacuaagucacccgggggguacacugggcccagcaccucaacucugaugggguggccaaaggcaaggagggcugggugccucaaccuccccacaugccccagcucucugcaugggcugucaggauccauaggccaagaacuaagcuagacccacaccuucccuuuuuuuuuuuuuuuuuuuuuuuucugcuuuugagacagugucucccucuguugcccaggcuggaguacaguggugcaaacaugguucauugcagccuugaacuuuugggcucaaaugauccuccugccucagccucccauguaggugggaccacaggcacaggccacaacuggcuaauuuuuugauuuuuuguagagacaguaucucaguuuguugcccaagcuggucuugaacuccugagcucaagugauccucccaccucagccuccuaaagugcugagauuacaggugugagccgcugugccuggcuccuuucaaaucucuagcagcaaaacauugcuuuucccgaugaaagcauacagacucgguguaggaaacagaguagcugggacuaaauaaauaaaauaaaauaaaaagaugauaggccaggagggcucucccuuuaugaauggaugaaugcagguaccaggggugguuccugacgaaagggugaguguggucaccuccugcccucccaggcaugugcucccuugcacgugaugcagaaggcaacagggagcaagaaggcccucaccagaugcggccccucagccuuggacuucccagccuccagaaccaugagccaaauacacuucuauucuuuauaaaucagugugugguauucuguuacagcagcacaaaauggacuaagacgccccacagcugugccuuugggaagcuguggcuauuucaggcugguucccucucuucaggccauaaugacgggggguaucugcccccuuucuucccugggcccugcggggaccauagggcccagccuggcucuccagcuggguugacccaccuagccugugccugguucauucacuuuuccacccuuucuugggcaccgccgguucuuggguauuucaggcgugugucaggccuggcacugugaacgaggcuggcagggucuccuauggccaaacgggacggugggcaguaagcacauagugacacagagcguuacucuaucacaggugugacggggugcguggcuuuucgcccucaccaugccgcagccgucuggccgggaggguugugaauggaagaggcaguggcccgccugccacccucagaccacagggcagcucuccaacagagccguagucuccccugggccucccaccccacucugcccuuuccugcugccccugcagggccucucuuccuccuccagcgcagccaggccuugagugacugugauucugacacugugagcgcaucaucuggugcccagaaauagaagcaaacggcaccaucacucaaggcugauuccgcccacauggcccuguccagucgaccaguugacucaaggagggcaaggagaccccugugaggggaaagguccacccagcaggaggcucaggggcaagagccggggagcuggugggagcugcacugcccuggaccugcuaugugcacguuucagggaggucacucagccuccacuggccuccacucacuaggaucacccagggcgcacucaggcuccagaaagagaccggcuucaaggucggccacuuguggacagcaaaaccucggugugucuaucccccagagcucccugccauggauacgcugggaugccaaggggccugcucugaugcuuguguauagcagacacuugguaauggacccccgggaccaugucagaggacaccagggcuuguccaccaccccucacgcucuuccgucccaaccagcuccacuuuccgcucuuugcacaggguuggggccugaaugucugaaccccccaugcaggaagcacagcuguccccggggcccugcuguccuggaggcuucccggcccucagagggcaacaagaacccaccucgaggcccacccuucuccccuagcccaggucccucgggguuggugguggccagggaaccagagugcuggaggcucccagaggccaggcaggagccagggcuuucuuggagaagagcugcugccauccuggaagauuuggaaucaucuccuccugaggccucugaaaauuagaacaucacuugucugccagcagcuaugugcacugcgggaagaggggcagcuggggugaccuaguguggcccuuuguggcuuugggcugcuuucccccugaggacgcacucugugggaccagcucagagcagggcagggucuuuggggaguuggggcuagugggguaggggugggaggugaaggcugugggcucagcuguucuaaagcaaggaacaaggacggggcuucugggaugcccugcaggcugcgaagggcuggguuugugggcagaugucucucuccggcuggguugggaggaggggucccagugcuccugggcugggaagucaauccugcuucucaucccccauucuggcuuccggaagguugggagccagccauauacugcccagggaguguguaaaucggucugaacuucccgaagggcauuuggcuucggaaucagaacucuccuccacgugucucccuuggacucagcucuuccccuugcaggaauaucuccuugggaaaucguuagggaugugggccaugauucauggcccgggauguucacugcagcauuguuuauaacaccgaaaaacgugaaacgacccagcgcccuucaagagacagacaggacaaacuguggccuaaucuagacaccagagcaugcuguggccacugcagaugauaaggcccauguauauuuauagcccgacuauaucagaaagccaugggguauguuaaguggaaaaggccacuuauaaaauaggauuuccaguaggaugccaucuucauaaaauaagauauguauguaagcaaacgugcuuauauacagagaaaaaaaucuagaagcuacugcucuaaaugcuaacaaugcuucuugcugggcaagaggauuaggggugauuuuuacugacuucuuguaauucugcacuuuaaaaucuuucuugccacaagcacgcauuauuugugcacauuuuuaaaaaguuauuuuuacaggcuaggcacaguggcucacgccuguaaucccagcacuuugggaggcgguggcaggcggauagcuugagcucaggaguucgagaccagccuggccaacauggugaaaccccgucucuacuaaaaacacaaaaauuagccaggugugguggcaggcaccuguaaucccagcuacccaggaggcugaggcaggagaaucacuugaacuugggggacagagguugcagugagcugaggucgcgccacugcccuccagccugggugacagagcaagacucucuucagaaaaaaaaaaaaaaaagacuccaccugcuaaagccagcucucccuaucuuugaagaccaguggugugcaaagcacucaggaucaucaauagaaagacugauggcgcugguuauucacucugcugagcaccagguccugcuaggagcaggucccagggacaugaaaucacuagcugugcuggugggcaaugcugauccagacccugccuacuggcaccacaaacuauugcauuucucuugcauccgcuguguggacagcugccagggcaguguauuaaggggcccugaccuggccuggggguggccaaaggccccccugagggacugacuguugcacugaggcccacugagaugcugagaaaggaggcuggggagggaaccccucuacuuccgaggagguagcaugugcgguuucccacaggaggguaucugagcgaagauuugggaucagccuaaauaccccucaguuaggaacaggcuagacaagccucguggagaggcugucaccuaaauugucccugagagcaagagccagagggcaggggaugggagagcugccagaacagauuaucuggagcaucugaaccccucaugcuggugcgagggacauggaggguccagaucaggauuccaggugggagggccacagcugugagagugaggccaaaccgggcaaaacacagccugagaaacacaucacacauuagcauucgcacggggaaaaauccaggggcacgugacccaagcugcggcagaggcucuuccugggagaggguuuaagggagaggcucacuuucuucuugaucuagccuuguaaucauugcauuuuuucuuacuacaagaauguguaggcugggcaccguggcucucgccuauaaucccagcacuuugggaagccaagaccggaggaucacuugaggucaagaguuugagaccagccuggccaacauggugaaagcucaucucugaaaaauuagccaggcaugguggcaggcgccuguagucccagcuacuugggaggcagaggcaggagaauugcuugaaccugggaggcggagguugcagugaaccgagaucgcaucacuuuacuccagccuggugacagagcgagacucugucucagaaaacaaacaaacuaaaacccccaaaacgaaacaaaaaacaaacaaaaaauacccaaaaccacaagagauaccaccucauacccauuaggauggcucugauugaaaaaccagauaaugaguguuggugaagauguggauauaugggagcccuugggcauugcugggggaauguaaaaucacgcagccgcugugggcaacaguaggacagguccucaaacaagucaacacaaaauuaccuugugauccagcagcucgauuccgaguauacaaccaaaauaacugaaagcaggggcucaagaagaugcauauacaccugugcgcacggcagcguuacucagaacagcuaaaauguggaagcaaccgaaguguccaugggugcacgaauggauacacgaaaugugguccauccuguaacugagcauuauucagccuuagagaggaaggaaaugccggcgcccgcuacagcauggauggaccucgaggauaucaugcuaaaugaaaucagccagccacaaaagacaaauacaguacgauuccacuuacuugaggucccuagaacagucaaauccacagagacagaguguagaauggagguugccaggggcugggggaaggggaguggggagucagugcuuaauggggacagagcuucuguguuuuaagaugaaagaugaaaagaguucuggagauggaugguggugauggcugcacaacagugugaauggacucaaugccacugaacuguacacuucaaaugacuacaaugaucaauuuugugugauguauagcuuaucacaauaaaaaaugacauaaaaauguaguuuucauagccaggcgugguggcucacuccugugaucccagcacuuugggaagcugaugcagguggaucaucaggucaacaguucaagaccagccuggccaacauggugaaaccccaucucuacuaaaaauacaaaaauuagccagucgugguggcgggcaccuguaaucccagcuacucgggagggugaggcaggagaaucacuugaaccagggaggcagagguugcugugagccaagaucacagcacugcaguccagccugggugacagagcgagacuccgucucaaaaaaaaaaaaguaguuuucauauucaggaaaaucucaauaaagauacuuuuuuuuuagacagagucucacucugucgcccaggcuggagugcaguggugcgaucucagcucacugcaagcuccgccucccggguucaugccagugagccaagaucacaccacugcacuccagccuggagacagagugagauuccgucucaaaggaaaaaaaaaagauacuuuuauaggccagcacaguggcucaagccuguaaucccagcacuuugggaggccaagguggguggaucaccucacgccuauaaucccagcaguuugggaggccgagguggguggauuaccugaggucaggaguucgagaccagccuggccaacauaacgaaaccauguuggagaauugcuugaacccgggaggcggagguugcagugagccaagaucuuaucacugcacuccagccagggcaacagagacagacugugucucaaaaacaaacaaacaaacaaacaaacaaacaaacaaaaagauacuuucauaaaggacauagaucaaggaacaagaccagaggcauuucccaccacaggacaggcccaugaggaaacaaggaugggcuuagugaacugggaugggccuggucaccugucaccugucaccuggcucccuucggaucaucaagcugggugcugcucgggagggagaaggggacagguggucucaaggcaucuagagcuuggaagguaccuggcaggaggcugguccuggacuucugacaaugaugacggugauaaugaugaugauaaucauugcuacuuaaccguuaaccaacaucaguaagugccaagcacuucaugugugauucaucagggagauuucccaacaacccaccugacagaugaagaaacugaggcucagagaggcaaagucacuugccugaguucccacagcagggcugggauuugcacucagguccggcugccuguggaguccaaacuuuugccugcugcuaagaccccuucuggcucugagcuuucuagagucuugacagugugcacuaggagaggggcaagcagggagggcaugggacugcuugccaagcagggagcaugcagagaacuuccccaggcccagcaggacccuuccuaggccucguagcugcagcucccauuucccaagcucccaagucugccucuucagagccaaguggaacccaggucccaacugcaagcucggaggucuugcucccagcccagagacugccccuggggguuagcugagugccacggggccagagcgggugggcagggcuagguagggcucccucccccuucaguauugcagugaugucaccguguggcauggcacccaccaugccaaaugcuuugccaucucccuucacaucccugccacaucccccucagcccccagauagggaaacugaggcucagagacaggaacugacuugagcaugugcguacagcaaguaagggucagagcagggaccuggacaauagccagucucuccccagagccugugcuccaggguugaagggugcccuccaaagacaaaaggacagauggaaccugcagcgugugcucagugggcagucugcuuuccccggggcaggggacugugggaccuuccuuccuggcaggucagaccagagcugcaggauuagagccugccuuggccauuugcugcaauuuucucccaccaagccgaggucugggcuggcauccccacagagugaccucgggguccccagacccacccggccugcucuguggccuaugcugaaugccugacuugugccaggcccuauguccccauggccucaacaccuggauaugaagacagucaaccuccucccagaucauuccccuccgcaaagcacacacgcuccaggagugcagugaacacgggugauaugcccgaccugcagccccacggugagcagcgaggaguggggggguuugcagucacggggccuuggauuuacuuccugaaccuaccgcuuauagcuguauggugggcaaguugcuugagcuuucugagccucaguuuacucaucuguaaaaugggcauauuaauauuuaccuugaaaggucaucgacagcuuuuuuacaucauaaaauacaggccguucaugccauugucuuugguacauaauaaagcucaauacaugauguuuuuaaagauuuuuaaaaaugucuaucacuucuguucaaggaggaaggcaacucaaaucuucaucuuuauccuguggggcaaacagcuuugugcccauggcagcuggcugcuggaaugagccugaagccuuaucuuaacaaguagguugcaaauuuuucaauguuuggggcaggggaaauguucuuaaaagcaaacauuccuguaaaaaaaaaacaaagcagagcuauuuuacuuggugaugugaggcagcuugcuugcauaccuccuaccacggggagcucacccccuuacuagagcauccacugacuguggguaaguugagaugcaccuccuuucuucucugauccucccccugcuggaagcuucacacagucugagcugguucccucucccucuccucugaaaacgcaaagcaaagcuagaguugcuccugguucugcuccuggcuccaucacugacuagcugcaggaccuuagaaccaucgucaccccaugccucaauuucccccucuuuaaauggggaauaauaacagcaccaagcuccauggguuauggugaagaucagaaguaaugauaugguuuaugcaaagcccuggaacacgguaagcacucaaccaaugacaucuucaucaccucccuugucacauggggaaagaaggugggaaggaagagauggggucaagggagcaggguugagagacagacuggaguguaugccuucccaccccaucuucugacagcaggcaaccuaccucucuaaaucccaacagucuucuugagccacguggcccugugugaaacuguggauaaugagagcagguucugccccuggaagcgccuggccuagugccucggccacuuugcucugucccucccucccacgcccauggcacagcaccuggaagagcagaggccugugugucagcuggagccagugcaaaucucaagcccugaggcugggccagguugcuuuauuuauaggaaccucaguucccuaaucuguaaaaugggcaugauaauggcaccaaccucgugagacuguuuauucaggaguaaaucauaaguuauuguaauguaaauaauuuaguaauaagaacaagaaaacuggccaggcacgguggcucaugccuauaaucccagcacuuugggaggccaaggcggguggaucaccugaggucaggaguuugagaccagccuggccaacauggugaaaccccaucucuacuaaaaauacaaaaauuagcugggugugguggugugcgcuuguaaucccagcuacuugggaggcugagguaggagaauugcuugaacccgggaggcggagguuguagugagcugaagguuguagugagccaagaucgugccacugcacuucagucuuacagccugggugacagagcgagacucugucaaaaaaaaaaaaaaaaaaaggaacaagaaaaccucgaagguggcagacccagccaucuccugcaugaaguauccaaugguuucugccuccccgagucccacccagagagcauagagccuccagacugagacuagagcagggagauacguguuuuuauuguaacuuccucuggaacugauguucuccgugguccaacccaaugcccuuuuggaacugagaccccuuguuaauguuugccuugccugagaccuccaccucacaugucccucaaaugauggccacaccgggaaagacaaggaaaucgaugcgggccuggcguggaggguggaagcuuccuggggcaccuuggggaccugguggugcccgaagggugggccggacgggggcugggcaucaccucuggguggagggaauggcuugccuccacaugggccccacguggcaccuggcacagggcggugcuaaucugcaagacauugguggcaaagacuuugcaaacaaacaaacccacaacuggccccccgaacccuucuccagugacucccccugggaaggagcagggaagaacuccagggggcugugaguggguggcagucccaggggaacucccuggguccccagacccuggggaagaagccugggcagcuuucccgguuccugaaccgaggcgggaggugcucauggggcagcucacgggaacagccuggcugggagcugucaaggagcgaggaccucagccguggggcaggagucaaacagugacaccccauuccaggaugcccaccagagcccugaccgucucccuugaggccaccgccucuggcccagccucccuucaagcugccucugggcagcggugccuuuugcugagcagguccuucucacagggccgcaauggccucugucuucauuuggcauguggcaggagagccucgucuaugcaucccuggcugucgcucccccacgccggagccugccuguuucuggggcacccuuccugccuaaccucauuagaccaucccagccgguuucugagggcugugcaggucccggccagggugggguugggcaggccaggcugccucccgaggggccugacagugaguggcgggcggcaggcacacucacccaggagcagauucaugagcaccuccuggccggccagugugcugcucuucaccaggcagaggauggugccuccgauccaggggaugccguggcccgugaugccgaugagcuugaccauggagcgggcacuggcccaggacgccgcccggccagcgcacacccccagccgcuuggacauacagauaucgauggccagcagggaguugaaggcgaugcccuugaaggagggguucagcugcaugcaguccuccucuggcagcugcugugacuggcgucgcucucuggccccgucaccagcaggugggggcugugcugaugggcccgaggccuuucugcccgagcugcggggcuccgggccccccuuggggggcugguucagggacaggaacucagcccgguugaggacguuguugcggucccgggcacgggcccggcucugggaagcuggcauggugaccucgcucaccccgagaaggccgaugccagcccggcuccaagggccuucuccccgaagacaagagcugcccccagagccgccaccguggcugccucccugccuucuccgccgcagcuguuaaauauaguguggagaguugcacauggcuguuuaucuccucugccacccagcuccaaggggacgucagugccagccgggcagccaaucgagcccuccaaugcggggccugcaccagcagagccuccgggaggugaggaguccacagcugcggccuggcugccucgggccugggcuauuuaaaucgg

SEQ ID NO: 13145 - RNA, 3019 nt, Homo sapiens
caaaugaccaagaaacgagggauguacaaccugagaaagcacguucagcuuuaucuuuuuaaacuuuuuuuauuuaaauaaggagaauucuuucauauggaaagagcuaguacaaucacauauuugaaaggagaaacaauagguacugaaccggagggaaagggcgagggugagugugccagcaccggccuggugaauccacgauucgauuucccauccaagguaaguuucccaaaauaccguauaaacaagcugcacauuacaccucuagccaucgucugcccuuucaaauaucuggucuacauggaaagacaaagaggaaaggccaaaacauaaacaaaaggaaacaaaaacaaaacacaacccucucaggaaccaaacaaaacccccaaauccuuuuuuacuacacaaggcaugaggucaaaagcuugaguacaguguccccuuuagaucacgggagaaaggcguccacacagagccuuagcaggaauuuccacucugaggcuucagaacaugcugaagauggggcucugagggugccacuaccauccuggaggccaccaagugggguggaaacagugaagagcaggucucacaugcccgaagaccaccagccaacuacacauugguggcccugguggagcauggcugggcgacagcguccauccccaacacugagccacuccuguccuggaugacuuccugcuuagguccgucacauuucagaagagagcuggcuuucuggaagccuacguuucccauucaucacagaacacgacagagugcacacauccugguauccuuggucuucaaaggccauuuccagcagacccucuaacccaggcuuguucugcaggaagugaaaagggacaaaugaagauuugaggggcagccugcagcuacuuggcacaggggaaccaaauggcaagggagaaggcuccaccagagcugccaugcugccguagcaggccagaccacagcauggcugugcaccugugugugcucagcuuccagaagcugucacugaccaucgcgaaggcagauccagaagauaggagggugacagcacggcuggagagcacugaugucaacguuuaacaagguuccccagugucccuagaaguggcuggaaggaccacagcuuuggaacugaacugauuuucuugaaugugaaauaaagucaucuuuuguuuucccccuuaaggaaccuagagccagagugucuaugaauuccaaguuugaaaacaauaugaauguuuaaaaaaaaacaaaaaacgcuguggggagaagccaacaguuaagaaaaccaaaccaaaugcagcuggcauugaaguccccaguggguagaugggcaucugagauguauacccacacucuggacuucaucccacucuaguggaugguggacaauaccgcaaggccacugguggcugagcaacgagccgcauccccagugaccaaggcagagcugccagcgucaggagggcaacuuuaacaggcaaaagugaguggguucugaccccccaaucccuaccucagcagcaggaaagggaagugcuggucuccaccuguucccacuaaggccccgugguauccuggcagaagccucugcauguaucugcgcucugaggauggggguuugaaaacaaaauaagacccuacguccuacuaccuugagcuuggcucuaaaaccacgggaaaggaagagauauauugcaccuuaaaacaucucugcacuaagaacugcauuucauuagaccaaggagggguuggggcgcugggaggccugaggccugcccucagccccccaagucucauuuaaaaccugcaucucagcgaagagacugcagcucaggucacacacagguggugacugcaccgaacuucacaugcaauuuccuggccuuuccugcacagaauuaauucagacauuauauauaaauagagcagugaaacauuuacuucuuuuuuuuucaccuagaccuacaacaucaauacauauaaauaaauucuaguguuuuuuguuuuuuuauuuggggugggggaggagaaaggaaggaaauaccagguaagagaaaagggcuggagaacaggugaccuuuuuguuuuuauuuuuucucaaacagcaaguacugugggucugauaccagguucaccugaaggguacaucuuaacagcauccagaaggcuuucuuuugacaaaucacacgcaccaccgcaucaggugggaggggucuggccaugcggcucaaguguccagguggagaugaauguguggcucccgcaggccugaacucacccaggaauggcuuggcaaggagggccgguggggacagagagggcucaucccaggccccacaagcagccgcuugcagugggagaaggaaaagcagacaagaagcucagguagggaaugccuggaacugucgggugggcagccccuggggaagggacucaagcauaaaggcuugggauaaagagggaaaagaccaggugagggcaggaggggagcugcugaaagaugcaggugaacaguaaagcaccuuucaguaaaacugcccuuucccaggcagcucuggggugggcgcuguugguaggaggccguucucccgcuuccuuagaauugugagagcaguaagaaguuacuucagcaguuccuaagaugcuccuuccccauguucuacacuagacacagagcuuagagcccaagccugagcgcuguccugcacccgugagacgcugaaggcagccucugguggggggugcauccccggcccccuccucuagguguucugagccagccuccucuggaggaggagguagacgcucagugaccccuaagaacagcugagaaaccugaacuguccccuucccuuuccuuggaaugacagaaucuggagugauuuccuuguuucuuacuuaaaaacaagcccagcacacgauggcucacacaagccucuggcuggagaagcugcccucccggaggcugcgcaggcccuuuggaccuuggucagcccuc

SEQ ID NO: 13146 - RNA, 26098 nt, Homo sapiens
cugcccgucuggccccgcaggcucggugaaucgaacguugagcagggcgguggguggugcggagugccgagcggccucacccccaaccgucggcccagucggacgguuccgaggcguugccgggagccgggcgcggcucuguguggacucggagaaacgcggguacauuuggggacaccggggacgagagcccagcccggacuugggggaguccgucagugccggacgcgggucccuggcuugcggacgggcuggggccgggggcguccccgucuuuccggagcugggggcgggguucgggcccgggcagaugcggcguucgggcggccgagccccgaaguaagaacuccguggcgcgugcagcccuagggaggaagggcgugcugcgggugcagucucagggugaggacggagcuggggccgacgcagccucgggaguugguggacgggacaggugcggccuguggggaagaagggccggccagggagaugcggucugcaaggggagaggaggcacucccaggacagaugggaccuuuugggacgaaggcgcucaaggcagaugcagcucagggagggaagggcgcguccaggguagauggggccugaggagaccagcggggcgccaacggccagaugcggcuuuggugugagacagggugucccaggccugaugcagccucaagagaagcggagcucaagggaagaugaagccuggaggagaacgugggggcgcagggugcaaaugcacccuccaggcgagaaagggagcacccggggaugaugugccgcugggauagaaggcagggaggcacugggggcagaugcauccuugaggagagaugaggaggccccgaggcucggccagguuggggucccugggcuguaagcagcugagauggcacccaggagcugcccagggucagguagcuguggccgcacugugggcuucuggucgucggggagggaggggagaaacccuggcguuccuuagcaguguucucgcgcccaagacgugcucggcagguuuuguggaaugaguuguugaaaggagugaauguccaguccugagauccccugaauucccacccgaguucacugcuagugccccucaccccacaugucuaccugaaccaaggcuccaggaacuucggucuuucucagcagcccggcugugcugugguucuccucguguguccgggagccggguggcuggggaucccuucuguagccucucgugagcccucauggaccacggcuccucccuucuuuucuagggcgucugccugagcccgcuuuucuacaagauguggggauuuuugaagcgcccuguaguggugacggcugacaucaacuugagccuuguggcccugacugggaugggguuacugagccggcuguggcgacucaccuacccgcgggcugugguguaagcuaaaugacuccauucccagggugaaucuagaauuguacuuugugacaggaggcgcccuuacugaauagcauaaaugggagagugaaauccuggcuucuuggugauagguguuuuuggcagugagaggagagaccagucuguccccaggacagccccagcagaguacaccuuuuaggucuugccuucugagucuguaacaggugaaauuuggcccauuaaaggggugcaguagaggaaaaucugguugccagccuuaaguaacaguuuuaaagucuggacggcagaggauuaauggauuuggaaguaagucuucacuguugagagcacuuuuuagaauguguuuuugucauaaugggaagugauugcuguuauuauugaagggcucuuuauuaacugauuaauguguguauguguguguguguguguguguguguguguguguguguuuuugagacggagucuugcugugucgcccagguuggagugcaguggugccaucucggcucacugcaaccucugccuccuggguucaagcaauucucugccucagccucccgaguagcugagauuacaggugcccgccaccacacccagcuaauuuuuguauuuuuaguagagacgggauuucaccaucuuggccaggcugguauugaacuccugaccucaugauccacccaccugggucucccaaaguguuaggauuacaggcgugagccacuccgcccugcugcauguucuuuuuuguuuaacuuuuuauuauggaaaacgucaaacauauacaaaagcagggagacaaguauaaugaaugacccccccacacacaccaguauuuucauuacccagcuucaccuuaucaguucacagccaggccccucccugcagugguuuuuacuuugcagcaaauccuaguauucauagauaauucagcgguauaucuguaaaagaugaggauuuuuuuuuuuuuuuuggagacauaguuuuacucugucgcccaggcuguagugcaauggugcgaucgugauucuccuacuucagccucccgaguaccugggauuacaggcaccugccaccacgccuggcucauuuuuguauuuuuaguagagaagggguuucaccauguuggccaagcugaucuugaacuccugaccuugugauccaccuaccuuggccucccaaagugcugggauuacaggcgugagccaccgugccuggcugaggauucuuaaaaacaaaaaucacauaaccacaguugcauuaucaugccugagaaauugacagcaguuucuugguuaucuucaccucucccugauugaaaacauguuauugcaguugauucccacguuuuccuuucauacuugcagccguuucauugggucaucgcuagccacagacaugugcugcuggugggggcggggguggggggguuggguagguggguaagcaggauuagccuugcgucccaggaggucuuucagcagguuggcucauaguauccaccuaaaucaaacacaagggagagacagaaucuguaugggcaggcaugcugagugccagcugugcuuggugaauuccccaugucucugugggugggugaugcuguaugcaucuuaauauuuggggaugggaaacaauuggggcaaaagauccagccuuugcugaucacucacucaaagucauuuggaaacacauacacauuuauccucacaguuuuuguuuacaguuaagauucuaauugaauauaauauggguuguuguuuuuuuuucuaguuuugacgaaguauauuaugggcaguacaucucuuuuuacaugaaacaaaucuucuucuuggaugacagugggccgccauuuggccacauggugcuggccuugggagguaggagucaucaggagaguagccccuacccuucaggaccucaaauacauuuaaaacuuaucagugcauuucuuacaggcagaaaccaggucuuauuauugaugcaucuuguuuauugcuugccacaguacucuagaaauauuugcugaaugggauaguuacugauuaaucuucuguuucagguuauuuaggaggauucgauggcaauuuuuuguggaacagaauuggagcagguaaaagauaauuuucauuucccuuuuaaugugcgcagguuagaaugaagagauugugacuuuuguaaggauuaacaacuguggcuuuuuuuuuccuuucauaccuagucccacagaaacugugccuuauuaaucugaguccagaaaauaauaaauugguuggauacaaaugaaagacuucuggaaagucugguuaaaaucuuacuguucaguugcagucauuauuucagcccuugucguugguacacguaucacagagcgucugauugugaugaucgguuguacaugugaauuuuguccauugccacaauguuuuugaaaauagggaggguaggccgggcgcgcuggcucacgccuguaauccuggcacuuugggaggcugagacggguggaucaugaggucaggagaucgagaccauuauggcuaacauggugaaaccccgucucuacuaaaaauacaaaaauuagccgggcgugguggcgggcgccuguagucccagcaacucgggaggcugaggcaggagaagggcgugaacccgggaggcggagcuugcagugagaugagauggcgccacugcacuccggccugggggacagagcaagacuccgucucagagaaaaaaaaaaaaagaaaaaagaaaacagggaggguaaauauguauaaguaaggcgguaaauuuuagaauccuuaguccugucuaugcuucaugagaucggguuccaugacuaugcaaagcuaauuucaaagccuucacccauaguuuaugcacucugcugcugaugggguccccaguuuuguaaacgugcauuuuagagucugugaacaugacggcgcuaugugaaagcauagcugcaguacacagagauggugugugcacaguguagucagcucugcagugugguugcuuuuccagaauacaguagcaacgugccuguguggucccugcgccugcugccagcacucgcgggggccuugucgguccccauggccuaccagauaguguuggagcuccacuuuucucauugugccgccaugggagcugcucuguugaugcuuaucgguaagaccugcgccccugccugcucuugcugucaugcagggaagaacugacccuuuggcccggaagaucacaugggcuuggugggcgagcugcaccagaaagugcaucugguucauccaaauuugacgcugcaagucacccgcucccaggcugaccccgugguuaugggauugcugaauugugggaucagacucuuaucagcagucgggguauggcaguagaaaacugcccagaugcugcugcaaaguccaugcacacgugggcaccuccaucuccaaccaaucuugugaccaaaugauaacuuccccuuguuccaccaccucccaggccuuggccaauugagauggacucgugagucaguggauccucuucagagagggucuuccagcucacguuuaugaacagaugaaauuaaagcagaugaaaaguuagauuaggcugggcgcaguggcucacaccuauaaucccagcacuuuggaaggcugaggcgggcagaucacgaggucaggaguuugagaccagccuggccaacauggugaaacccugucuaaaaauaacgaaaaauacaaaaaauuagcugggugugguggcaggugccuguaaucccagcuacuugggaggcugaggcaggagaauugcuugaaccugggagguggagguggcagugagccaagacugcgccacugcacuccagccugggcaacagagcaagacuccaucucaaaaaaaauaaauaagccgggcacgguggcucacaccuguaaucccagcacuuugggaggcugaggcggguggaucacaaggucaagagaucgagaccauccgggccaacauggugaaaccccaucucuacuaaaaauacaaaaauuagcugggcaugguggcacccaccuuuugucccagcuacucaggaggcugaggcaggagaaucgcuugaacccgggaggcggagguugcagugagccgagauuguaccacugcacuccagccuggugacagaacaagacucugucucaaaaaaauaaauaaauaaaauuagccaggugugguggcaugcgccuauagucccagcuacucaggagccugaggcaggaggaucccuugagcccugguggucaaagcugcagugagccaugauggugccacugcacuccagccugggcgacagagcaagacccugacucaaagaaaagaaagagacaguagaaaaucaaaagagauguguauugggugaugacuguaugaggccuugugucuauagaauguuuuaacauucacaacagccccacacaguuguaucgcuucugaaguaaugccuuuuuucaugaguguuuuucauccucauacguuuucccuugcuaccuuaaaauugacauguguuuccucuuugaaacagagaaugcucucaucacucagucaaggcuaaugcuuuuggaaucaguguuaauauuuuucaaucuauuggccguguuguccuaccugaaguucuucaacugccaaaagcacagguauggaaaauggagugucuuccuaguuaacgagaacagagauucugggugguuuguugaucugagaugguccaguaccuuuuuuuguuucguuuugugagacaguaccuuuucauuuugaggaguugcuugcuaaauaucuuuuuuuuugagacggagucccugucacccaggcuggaguguaauggcgcaaucucggcucacugcaaccuccgcuucccagguucaagcaauucuccagccucagucucccgaguagcugagauuacaggcacacagcaccaugucuggcuaauuuuaguauuuuuaguggagacgggguuucaccauauuggccaggcuggucucaaacuccugaccucaggugaucuacccgucuuggccucccaaaguguggggauuacaggugugagccucugcgccuagugcuagauaucuuuugguccucuaauauuuuggggguuggcccuuggcuugugacuucauaaauacaucuucauuuuucuauaauuuaaacuaacaggacaacauuuucugggcaaaaagaaaaauucugcugggauggauacuuugggagaugggaauucuuucuuacugccccuguggcucagcauggccagccgacccagaaagauuucucugaagaauguggagcuucacuagccuuuuggaaaugugucugaacuauuucugucuccaucugcuuuguuuuuauuccagcccuuuuucucugagcuggugguucuggcuaacacugacaggggucgcuuguuccugugcaguggggugaguuugagccucuggucuugggcaguguccuccuccaucuccuuauguuuuccugucucauguuaacuccauuucugucaugucuuugcagcaucaaguacauggguguguucacguacgugcucgugcuggguguugcagcuguccaugccuggcaccugcuuggagaccagacuuuguccaauguaggugcugauguccagugcugcaugaggccggccuguauggggcagaugcagaugucacaggggguacuuggugaaaagacuccaauccucaauguuuuagaagcaggcaggccugggcagccucgccucuuggccucugcaggugccucuguaugggaggccagaguuucugucacuaacuuuuucuaagcucacaaugucuagagguggguacgcuuuuccacgcaguggaacaugacuuuucuuugaaucucuggcaggucuguguguucugucacuugcucgcccgagcaguggcuuugcuggucaucccggucguccuguacuuacuguucuucuacguccacuugauucuagucuuccgcucugggccccacgaccaaaucauguccagugccuuccaggccagcuuagagguaaguaagcagugggcaucguggccacuggagaaggaagaugauaguggacccagaguuuucuuacaaacacaucaagugaacauuagcacuugaaucaaaacaugaagaauccacauccauauuucuuuuuuuggugggggggauggagucuuacucugucacccaaacuccgccuccuggcuucaagcgauucuccuaccucagccucccaaguagcugguauuacaagcaccugcaaccacacccagcuaauuuuuuuguuuuguugguagagaugggguuucaccauguuggucagucuggucuggaacuccugaccucaagugauccgccugccucggccucucaaagugcugggauuauaggcgugagccaccgcgccuggcagcugggagcauuuuaaagucaagucuuacaaacccugggcaguuucacccgccuuaaggaccacacucaacugugaccuucauuccuaugaaccucgcagcagugguagaagguaucaguagagguggucaggacugugguuccugaagucagccaagccugccgacggccagugcuguagugcuguguguuucagcaaguuguuuggcucacccuagucuugguuuucucaucucuuagacagacaucaucauugcucuuaccucauuggaugcuuguaaggacugaauagggugcgcguggaaggcugaacugagugccuggcccagaggcagcauuugaucagacuuagugcucauuaugguucuauaauguaacgugaugugauuaaaugggagaucauuaccacuguuacaagaauggccaccagccuaaacaucaccccagagggaggaguggccaucgggaaggcuggcuuagggucauuuuucuuucugucucucacucaucaaccuucugcuucugucucagggaggacuagcucggaucacucagggucagccacuggagguggccuuugggucccaggucacucugaggaacgucuuugggaaaccugugcccugcuggcuucauucccaccaggacaccuaccccaugauguaaggugaugguuuuacuuugaagauaauuaaaugcuuuauuugcucguagauuugcuuaucuuagcaacuuucccuuucuuugaggaaguuuguuugcaggacagaaagaaguugagcagcccgggugcugauugccagugagcuucgugguucccggguguugcuggagggacuuggcguguggcagggcccagggucggccccagcucuguggcuguggcugaccucagcacugccugccugaaucaucugauuucggcuccuugucugugguaucuucauuuucccugaaaccccuugcuagguuguauuuguugaaaucugcuucccuuugcagaaacuuuaggagaaaggcgugugggcccgaucgaugacccacuuccagauacguuucuuucccuuucuuuucuuuuucucauaaauagacacagggucucacuauguugcccaggcuggucucaaacuccugggcucaagcaguuauccuaccucagccucccaaagugcucugauuacaggccugagccaccgcgccuggcccagauacaucucuuuguugacuucacacagauaugagaacggccgaggcagcucccaccagcaacaggugaccuguuaccccuucaaagaugucaauaacugguggauuguaaaggaucccaggaggugagugcagguccugugacuccagagcagagcucaccuccuggccuggccaggcgagacccugggaugcaguccugggcccccuucuuucccucccucacugacucuagucaccgucauggccuugaacaccagcucagugcugaguccaaggucagaggaauagaucaugagacccucagugagcagccugcucaguagcugcucugagaaguuuccaggcgagccucaaugccccgaccugugucccucucccuuccucauaaaaacaagaaccccccuccugcaaaaguagcaucaucuugcacacaucccagcuagaggugccccuugcucucauucccauauccaguccuguggauucugcccccaaacaaggucucuagcugucccggucacugucuccugaugguguccucccauugcugccugcccagcuccagcaccugcagcccgagugggcuuuuucuuuuuuuucuucuuauuuuuucgggggacagagucccacccuguugcccaggcuggagugcagugguacgaucucggcucacugcaaccuccgcuucccggguucaagugauucuccugccucagccucccgaguagauaagauuacaggcgcccaccaccacauccugguaauuuuuguauuuuuaguagagacgggguuucaccauguuggccaggcuggucuugaacuccugacaucaagugguccacccagcucagccucccaaagugcugggauugcaggugugagccaccacgcccggcccccucauacacuuucauugguggaaugcccuucagaaggauuccuuggcagucaugguacauuugucacuguaguguuuguagacaaauucagagcaaugcaggugugaugaccgcggguagaaucacauucggaaaaugaccuuugguuucagaaaagagcccaauuaaugucugugcuuugguuuccuguguucaccucaugugaggcacacauggguugggaggcagucucagccaugagaauucagagcugugccccuccggugcagcuguuaguucgaggggaccaggcucuguguggucccgacagcacugugucuuccaggcaccagcugguggugagcagcccuccgagaccugugaggcacggggacauggugcagcugguccacggcaugaccacccgcucccugaacacgugagugugcccgccgucugcucugcugcaccuguggguuuccucugugguucucuguucagaccaaaacgugagcccugccuugggccgcugcccccugucuacccaucaucugcauguguagcagcucuuagaccuacauuugaugccgggaggggacccaggccuggccgcggaagggagcgggguuaagaggaagcaggggcucugugaggacuggacagaagcaccuagcacagcccauccuaggagagcucagggccccguggaugaguguacaaggacaggcugggaauguugacccgcuuucuaugcagagaauggaguuugggcacaccuccuuaaaguggucaagcuuaaaguaugagugaguccaagaagccuggaagcucgggcacgaguggagccgugaaggcuucuuccuucucaguccuucguccuuguccgacuugccuucccguggugcugggcacaguugcucacacccuccuccuuccucccugacugcucucuccaccgccuccuuuuccucuguugcucucagucucugagggcccuccggccuugcugccucugcacaggcccagucccggggcuaccucuccuggacuuccacccggcugcccggggcucaccuccagcucuccacgacucccagcuccacaggggcggucucuggcccuggcuuuucugguucucccuggaaagggcccaguagcugaggcaucaccugacuccuuccccuccccucccauugcauguugauuccauugggagauccuguuucucaaccuucagaaccagcccuggguagggguccuuccuucucccucuacucccaccuccuggggccugaccucucuaccucgcagcagccuguccggccugcggaccgugcacaacccacuugcguuguuccucugugcucagugacucccgucacccgccaaggucccuggugacccugacacacuucacccccgccacccuggcuccccccagcccugaaacaaccaccugcgggccccuugggggcuucacacuugcucccucugcgagaauguucuuggacuuggcucccccauggccccucuauguaggggucugcugggaugucacugcauccaaaagugccuccugggugcugucccccaccauuuguuuuauuaguggcacuccuacaggugcacgcucugcccaccggcaugauggcuguuucccagagggcugugagggccuugucuuguucacagcuggguggcugcuccuagacagugccaggugcauggugcgguaccacaugguuacugaguguguggauuaagaggaaguggguguuccugaccgggcgugcuggcucacaccuguaaucccagcacuuugggaggccaaggugggcagaucauuugaggucaggaguuggagacaagcugggccaacauggugaaaccccgucucuacuaaaaauacaaaaauuagccaggcaugguggcaugugccuguaaucccagcuagacaggaggcugaggcaggagaaucgcuugaacccaggaggcagagauugcagugagcugagaucgcgccauuugcacuccagccugggugacagagugagacuccaucucaaaacaaaaaagaaguggguguucguuaacauugagguugauagccuuuucucccagcuuaucugcugcguccccaggccagcugggcgcaggggcgggcagcucagcccugcaaguuguagcauugguacugccagcuggcaucgcagcaguaccggaucgggccugggcgcacgguuccuuccucugaaacuugguucgcucgucuaacagguggaagguuccacagcagaguguccuuuucuuuuggagauguucccacagggccuccugccuguuuaguguccacucccaucgccgagccucaagaccuccguccucaguagcagcaacucaugggacugggccaccccuuauggcugagccggcuuuguuucugaaaagcaaccuuuuccugccugaaagauuuaguaauugccuuccagaggaguucaaggaauuuucugaaaucucggucuugguuuuccaggcaugauguugcagccccccugagcccccauucacaggaggucuccugcuacauugacuauaacaucuccaugcccgcccagaaccucuggagacuggugaguaaggcugcggcuauagcagccacaaccgucaguaaugaacacucccucacacggagcacuuccucacccggagcacucccuaacacagagcacuuccuaacagaacacuucaucacacggagcacuuccucuaacacggagcacuuccucuaacacaggacacuuccucacacggaacacuuccucacacggagcacuuccuguaacaggacacuuccucacacggagcacuuccucuaacauggagcacuuccuguaacacaggacacuuccucacacggagcacuuccucuaacacaggacacuuccucacacggagcacuuccucacagggagcacuuucucuaacacaggacacuuccucacauggagcacuuccucacauggagcacuuccucacagggagcacuuccucacacggaacacuuccucuaacacaggacacuuccucucacacucacacggagcacuuccucuaacacaggacacuuccucacacggagcacuuccucacacggagcacuuccucuaacacaggacacuuccucacacggagcacuuccucacauggagcacuuccucacagggagcacuuccucacacggaacacuuccucuaacacaggacacucucacacucacacggagcacuuccucuaacacaggacacuuccucacacagagcacuuccucacacggagcacuuccucacacggaacacuuccucacacggaacacuuccucacacggaacaccuccucacacggaacacuuccucacacggagcacuuccucacacggaacaccuccucacacggagcacuuccucacacggagcacuuccucuaacagaacacuuccucacacggagcacuuccucacagggagcacuccaucacacggagcacuugcucacacggagcacuuccugacauggaauguuugaaacugccguugagaauaaucauuuuuccuuuuuuucaguuuacccaguugagguuggauauuuagaauaauucugauucagauguaaaguuacauaaguuuuauucguacauaaagucacagauguuuucacagggaaccgaugcgucuuccuugguggaacuggggaaccuggugguuuccugcaucagaggccuguguucacugagauucuaaaugcuuuguguuugcuccauguugggugccaggugcgcuugaggcucugccaggugaaaguucucccaaccuguuuagccucaggagcagguccugaacacaggacacgagcuccagccaccccucugccaccaugauccaggagaaauuccauuucucaggauuucccuggggacaggcuuagccgugagugcgggggauguuccugaggcgcugggucuguggucaccuuuccuuccagcgaccagggccaccugcuccccuuacggaaucgggucuccugggaaagguuccauaaaaagucuucuguuacuggaccauguugccaucugaaucuaaggacauggacacuaaaugcagcccagccccaugaccacagugaaggcacugggcuuauuuccauagugaggucacacccccccuucuagcuucccacuggcuucagcgcuuucugccuacgcaggcucagcccuguuucgcuugacagaguuagcaccacguccucauggccagcccucacagcaaagccagguaucugcugauguucuuuuuuuuuuuuugcgacugggucucacucugucacccaggcugaagugcaguggcgugaucuuggcuuacugcaguguuggccucccaagcuuaggugauccucccaccucugccucuugguauuacagguuagccaccaugccuggccccuguuaauuuugaauauuuaauuuuuaaaauauuuuuucuauuccaggacagucugauuuuuaaaauuuuuuguggagauggggucuugcuauguuguccaggcuggucuugaacuccuggacucaagccguccucuuaccucagccucccagagucgcugggaugacaagugugagccacugcuccagauuggcuguuccauuuuugugcagagugcgccccucugccccacucgccgucucugugcucugcauaucugugugcguucugcauuuccauccccgcccccccacaguccuucccugacgugagugcugugccccuucucacgggcacccuucucuguccuuucugauggccccuuuggcaccaggagcccacauuucaggugucugaaguucauagaacaaggaaggagggagcaugcgugaggugugcgcgcccggccugcggcauggaccgcggccaggccuccucaugccugcuccugccuagcuucuuggguucucugguugugacaguaugggaaaaugacagucaugugaugucauggggucauugugaggcuccaguaugucaggcugugacaaggcaaagugccuuucagauguuaguugucuuuuuuauuacucgaugcgaggaaaucucuaagcugugucuggcagggacagugucuggccuucaucugagcugucugcgaguccugccagauagggacugagacuugcucacuuuuuggccagggcucugagcccuaugaauaggcuuugcagagaggcacgaagaacaucaggcuuuguauuuucugugaggaggccucuuguacggccuuggcgaggaggagggugcacuuccccagcgacccucggagcagcccggggugcugugggcauugggaaggaaggccaguaccagccccuuauagcuucccucacuuggggacuugucccuuugucucaggcucaagucaguaucauuguuuggugacaggucuuuauuuuuacauugaaggaaauuugaaaaggaaugaaauaauccuugagaugucuuuuugcaggaaauugugaacagaggaucugacacagacgucuggaagaccauccucucagagguccgcuuugugcacgugaacacuuccgcugucuuaaagguaaggacacuguccguggcuuggccuguccugagcugugggcuccagucuguuucccaagccccucaggcuucaccgccucucugcaggcggaacgcuucauuugagucaucauggcuuccucuuacacugagggagggcggcuuuuguaacuucucaggauggaaucccaaugugaaucucccacaaggggcaccugcugacagcgugacccgggcagggguuccccuuccaacccaaguggacacgggagccacggccuucccaucacgcccuuuacucuccugcggugucaccagcugagcggggcucaccucccugacuggggguaucggcaacuggagaucgucggggagaagcugucccggggcuaccacgggagcacgguguggaacguggaggagcaccgauacggcgcgagugaguccgcggcguggcuuccgccgcuccuggaauguacuuucagcugcucaauauuugauaacaccccagaguucucauuuuggugggaagggaacugagcacauucuccaugcucgguggcaggucaucucccucccugcacccugcacucagcugcugcaguaauaacucaagacgcuucuuccgaggugucgcuggaaggcaaccaguuuauccccgugcaaguggagcuuucucagggucgaaaucaccucauuugaccgggcagucuugggugugguggggaaagcuaaguggaaugaugcgguucgauaaggggucuuuguuagaaaggcaggaagccagcuuuuugcugcacugacagcuucugcucugagcucuugaccuugugcuacuucuaucuguuaugcccuugucuguucugccaggccaggagcagagggagcgggaacgggagcugcacucaccugcgcagguggacgucagcaggaaccucagcuucauggcgagauucucggagcugcaggugaggagcggccaggggaagcuggccuagcucgcugagcauugacuccucagcagggaggccugggggcugcacaggacucaaaccagagucaggcuuugacgcuggagcuacaggcucacaacagaaugagugucuccucucuccaguguaagggacugugugugacaccccuggcccacaccuuguggcccuguggucaggaauaauagggacccaggagguucugcaacaucgccagggugucuuaaggcccccaggcagcgaaaugggccacacucaacagagcccaagagaagucacaaucagaaacucacggucacaaaucugaacgugaccuuagagagcauucagcccaaucacuucgucuacagaggagguaacuggagcacauaggguggggcgacccucccaaggccacauucagggcuggaauccagguucucaucaugcugccuccgaugcaugauccgaaugaacuugagcugggccaguccacgugcaaggggcagcaguguacuccuuugaccaaauccacgcacagcgggaggcaucccccauccucaaucucagaggccucugcuuuguuccaguggaggaugcuggcgcugagaagugaugacucggaacacaaguacagcuccagcccacuggagugggucacccuggacaccaauauugccuacuggcugcaccccaggaccagcguaagcgagcgaugcugacagcugacagucauagauucauccuguuucuugagaauuccuugcauuaagagcagccgcugcacccuagaaagugcuggguuucucccaagcuuuuccugacaaaggccugugacuugguuuucucuaaacgcuuuggcaaccuggagccaggaguagggguguggcaugugugccuguugaaggaaacccggcuugauugcuuuuguggagacacauuguuccccuuuuccuggcgaaagugguuuuaagauauucccauucaauuuuccguguggcaccuggugguggagcuuaccggugcuuugcugaugugcgugccgucucuccacccggcagagugaaagcauugguaggccgggcgcacagucagcgccccauaaauauucacugaaugggcagacgcuggaaaugcccaccuuuuuccuccucccucagaggcggguaggucggcucagcaugugcacugaaggcagaggcucaggcccagaggccgccccaccccgagcucugagcgcacuuugcauucuccuccguggacagcgcugcuguuacaaaguggagucaucugcucccaauuuucaguuuccaauuacaaaauugagagcaucagugcuguguguguguguguaugugagagagaaagagagagacggagucuugcucugucauccaggcuggaguacaguggcgugaucuuggcucacugcaaccuccaccucccagguucaagcaguucuccugccucagccuccaaguagcugguauuacaggugcccaccgcaaugcccagcuaauuuuuguacuuuuuaauagagacgggguuucgccacguugggcaggcuggucucaaacuccugacuucaggugaucugcccaccucagcuucccaaagugcugggauuacaggcaugugccaccacacccggcuggcaucagugcuuuuaaugaaaggucugaguaggagcagaccuguccacaguaguaguaaggccuaguggaugcuaggcugugccuggcguuuuuucacucugcuaaaguagugcgugcaucugaauuccuuuccuguguucucuucucuucccucccugagcagagggcagguggcuaacagcaucucccauguucccuuaggcucagauccaccuacuuggaaacauagugaucuggguuucgggcagccucgcucuggccaucuacgcccugcuguccuugugguaccugcuccgacggcgaagaaauguccaugaccucccucaggguuaguaccucucccacauggcuuucuuucuuuuuaauauagacauggggucuugcuguguuguccaggguguucuugaacuccugggcuuaagcgauccuccugccucggccucccauagugcuaggauuacaggugugcgcugagcauucaccgccucaagugacaaaccgacuucauaggaaccuaccccuuaacgcggccucuuuguuucuguauuguggaaucuuaaauuauguuugucucccaagagacaaaauguuaaguucccauguugcguuagaggugucuccagucgagugcagcguauugggcaggaauugcccucuuggucccauguugcccguaugcgcuggaaauggcuggguaacacaggcagccaggccgggcgcgguggcuuacaccuguaaucccagcacuuugggaggccaaagugagggagucaccugaggccaggaguucaaaaccagccugggcaacauaguaagaacccucucucuaaaaaagcaaaagagagagaagacccggccugugggagcagcagagucgguguagcucgagcccuuuccuauagaugccuggcugcgcugggugcuggcuggggcgcugugugccgguggcugggcagugaacuaccucccguucuuccugauggagaagacacucuuccucuaccacuaccugcccgcacucaccuuccaaauccuucugcucccugugguccugcagcacaucagcgaccaccugugcagguacgggggcugcggagacaguggcuggaccgggcagcagcccucugcugggaagcccaugcgcagcaaacacauggggugcagcgaaccucacccauuucacguuacacugacauccuccgggucccuccggggaaugggugagguucagaagagaugcccagaugaggcacugcaggaacccagagggagaagucgcggcugacagagaugaaagcggaguggguggggagacggggaggggaugaagagauguggguggccuggaggauucgggagcagggagcaaggcccaggagccuggggugucagaaacggcagcugguuauggucggguuguguggugugguggagagaacccaagaaagcuucuaaaccagaguguguuuggagguuggagcagagggcgagggccucccgguuucaggaagccacacaagggaggaccguggguuugggaccaguccucuggcaucuguguggagguggcccagccacuguggaggccugaggagucaucagggggccccucucagugcauccaggugggagauggucauggguggcaggagacaagacacagaaaccugaaggcagaaccccaggccucggggggugaccguguggacagcagaugccaagagggugccgggcagggaagccgcaguggucagccacccucccccacgcugcucugaccucugcaggucccagcuccagaggagcaucuucagcgcccuggugguggccugguacuccuccgcgugccacguguccaacacgcugcgcccacucaccuacggggacaagucacucucgccacaugaacucaaggcccuucgcuggaaagacagcugggacaucuugauccgaaaacacuagaacaagaguguggcaaagaacacccgugcuggggucgggaugagguugaagggucuuggucaauguacguaaugagcagggugggccccacgcugggaggacacgggcugggcugagcagggccucuaguggaacacaugggggucucauugaaaagcucucugaugagcaccuccuuuugugcaaaguuaauuuuuucucgacaauaaagauauuccgugucuuuaccccugaacuaagacacagggaguauuucagaggccagcguaggagucauugacaacaaaaagccgagaacccagggccagcaguggagccucagcagaccagggccugguccuugcuaacugcugcaggguggaguuugaucuggcagacccgauccuccuucaugaacacccagcaaccugagcaagucccggcccugcccucagcgagcccggcaggcguccugggacagcucaguguuggagggccaccugaaccacgagccagggcuggggcuugcaugucauugucuaugacagcgucaagacuggcccuuggcaccgugcuguguggaaacccuccccucugagacuccacugagacguggcugagugaaaucuuccucgucaguggucaaggugugucauccauacagcuccaugccuuugucuuuuuuaaauguaauuaaaaaaggaaccaacuggcguuuguaguugguguuuguuauuuauugauucucccuccaaaggggccuaagcucgacaaaaccguuacaguugucagaacccagccacagggcucagcccccuucccccacgucacgucugcaucacuacugugggugagccuggacggacgggggcuggggcugcccauggcagcggcaagggaugcuuuccagagacagccaccacgcaggagggaggaucaccccaggcaacccagacacggguguucacaugugaggcugugagcuccacauagcacaaaggaggcuugcugacuuugggcggccaugucugcugggaccugggugauccagugcgugccacagccagaagcaccauucccugcauauggccacuagccacccuggggugggacagccugucuagacagacagcaccuugggggcuccccugagggucagugagggccugaccccaggcaggacugcguggacgcuguucuccagccgggacagaccuggccuccgcugccuucugcccuacugcaugggcucccagccuggccccgcacaagccugggugugaugcugggugcuuccagggcauccgccucgcuucucugccuuuaaggcacaagcaaggggggaaaacaucccucaguggcuccccauauccguguaggccacgcuggacugcaaaccacugggucaugaaauuagguuuguaggccacaaccagccuuguguuaugaaacagaaaacagaaaacaugaggacauguaacauguaaaaaaggaaaguacuuguucacaaaacuuuugaguuaugugugugaguguguaagaaccagaucagacuggaaaaaacucucucccacuguggguucacugucaacaaaacaucaggccagccagugucuaggcugucuccucaauuuccccaauaaugugccucacauuccucacagaagccucccaggcuuccugcacauucuguggcauuucucagugaccuagagggaucuuuaaaccgcaacgagccuaaguggcugaaaaccucaggaacgccugucagugucccagcaaguugagucugagugacacaucugaguuuccacuccugagugaggaaggccucgcugcuaacacuccccuggggugcgccgagaggaagcagugggugugggugggcguccccaggcucagucccugaacacacaugccgggcgggagaccugcccugaggcucggcagccccucaguggggucugcugcuggacuccaaaugugaccguuugccagaggucagcaucccagggugguccccuggcucagaaaagguccgcuuguagcuccgcccauuggacccuccucggugccauuugcagaugucaccauucagaauguccuggaugugcugcacgaucagguugauggcaacugcgccaagagacagacaagcagcggguuagccgcauccauccuccguggagaccgccccuccccgcagcacucggccaggagugagcgcccaaccucugcccugaggcacagccugcggcgaggggcaucgagucaaaucucagcagacagaaacaugcaucaggacacagcaaaauaagacuucuuagcuuggucuuccaggaauuuauguuagagucugcuuaaaguacuuucugcuaacagauuugaauauacauauauauauguuuuaagaaacagguucuuacuuuacugccuaggcuggagugcaguggcccaaucacagcucacugcagccucaaccucccaggcucaagcaauccucccaccucagccuccugaguagcugggaccagaggcacaugccaccaugcccaaauaauuuuauuuuuuguagagaugggguuuugcuauguuccccaggcuguugaacuccugggcuccagugaucccccugccucagccucccaaagugcugggauuaccagugugaggcaccgcgcccagcuacauacauuuuuaagcauauuuuaacccugugccgcagaucaacacuggcaggccgcgugcgcaggggagugcucaguaacugcacacugguggaacugucccugccucaagcucugggaggggcggggggacagcccagcaggccagcuucuuacccauauuguccacuccucgcgggaugaucacaucggcauacuucuuugucuguaaggcacaaggggggguguuccugugaggacuuuuccuucaaaggugauuuuaagaugcucagaaacagaugcaacagcaggaggggcggcccuggggugcucagaggugcuggugucaucggcaaaugggggacacagacucagucaucagccaggugugagaggccaugauccaagaagugaggcagaaagugcagcugaggcagccaaaagaaagugccucuuccaguguccccauuccaucacagaagacagcccccuuccaguguucccacuccauuacaggagacagcuggcuacgcuaacgacucaauucacugggccaagcuaaguguggcacuucuacaaagugugacauuguuccucuggaaucaugaagcuucugcaaauacccuggcacagcaacaggacagccgccgccgugcauaauuacugcaggcagagacgcugaugguaacuuacucccucauccaaccacucauuggcucaaugcugacucucauucccugucagaugcucugcugcugaggaaggacaaggauggagauauaucaggaaaugcagggcugcuggggaggguccgcagccagaugguggggguugggggguggcuuuagggaaggggaagcagccuggagaacauggcugaaucagacaaagcugagggaagagggagggcagggucugggccgaaggacggaacuuggaacggugcgugcugcuggcguguggauuugggucaagaaggcggcagaagagacaagcugcaagaggcagacagggaccaaguccuggggacagcugugucugcaguuggugggaccccaucucaugaaagcacgagcgcaagggcgagggcugcuuucuauucuagucugauagucugacgggcuggaggaguccgggagagcugacaggggucuuaaccgccagcagggaugggccugaauacaguugggaaauaccuacgggguccaggcagaggacugcacaagccacucaacaugaaggugaaggaaaaggaggcucaagaacggcucuggguggggcuggggccgggugcgguggcucacgccggugaucccagcacuuugggaggcugagguggguggacugcuugaggccaggaguuugagaccagcccagccaacauggcaaaaccccgucugugcaaaaaaaaaaaaaaaaggaaaaauuagccaggcgugguggugcgugccuguagucucuggcuacucaggagccugaggugggaggaucacuugagaguggaagguggaggcugcagugaagcaagaucucaccacugcacuugggccuggguggcagagggagacccugucucaaaaaacaagcaagcaaacaaaccaaccaaaaacaucucuggggccugggcccagaacauagcaggugacagcacuuccucuacucaggucgcugaggcagauuugauauccagaguuuuacugcgaaucaccuacuuuuugccaaauaucuuucugugaaugagagacuaaaacaaguuaacuuuacuuuuaaaauuauauuuuagaaauuucagacagcaugaaugcaaaaaaaaacaaaaguuuucuuuauauagcagccaauaggccaggcauaguggcucacaccuguaaucucagcacuuugggaagcugaggugggaggaccacuagaucccaggagauggagaccagccugggcaacacagggagaccccaucucuacaaaaaauuuaaaaauuaaccgagcaugguggugcacgccugugggcccagcuacucggguugcugagguggaaggaucgcuugagcuuaggaggucaagacugcagugagcugugauugcaccacuguacuccagccugggcaacagagcaagacucugccucauuaaaaauaaaauuuaaaaaaaggccaggcacaguggcucaaucccagcauuuugggaggccaaagugggugggucacuugaguccaggaguucgagaccagcccagccaacauggcaaaaccccaucuccacuaaaaauacaaaaauuagcugggugugguggcguacgccuguaaucccagcuacucggaagggugagacaggagaauugcuuaaacuugggagguggaguuuggagugagccgagaucgugccauugcacuccacccuagacgacaaaaagagacccuaucucaaaaaaaaaaaaagcagcagauagaacuuacuuguccuacauuaucaaaggcaggaaucuugguuucaguuccuuugugcuguauuuuuaccuuaacaggcaaaauguucccgugcaaaacacucccauuugaguagagccacgagucccaccaagccagaaacacaagauggagaaauggagaaaagacaggugggugugcagcggggaguuccugcucucugcgagccagcugggaucugggcacagcgcucacuccaagauuucagagcacuggcccagagcagccuggggucacagacccuggaggagcagcucugaagcaccuucugagggccagaucccggccuuggcagugaacagacuaaagugcuccugggcuuccccacucugcggggaauaagcacccaggacgugucagaugaugguaagugccccggaaaaaggaagcaggcagagaggcuggcgcugggugcagaggguuuucaguguugaauggggacgcugggcaagggccugaggcagggaggaagcggccagugugaaugugggggagauauggggcuuuuuuaggcagagggaggagcaggcacagagaauguuuuuacagcugagaacuacucccaggguauguggccauaaugagccaaauucuucuccuuuuuuucaaucagaucacugucacccagcacuaagcccucucacaguacugggucccauguguccuugugaaaggggaaaaugggcucugaagcagcgagcacagguaccggcaggcagaacuccucgaaggccggcuucacgaaggugguguacugcgucagaaucugcuccag

SEQ ID NO: 13147 - RNA, 26098 nt, Homo sapiens
cuggagcagauucugacgcaguacaccaccuucgugaagccggccuucgaggaguucugccugccgguaccugugcucgcugcuucagagcccauuuuccccuuucacaaggacacaugggacccaguacugugagagggcuuagugcugggugacagugaucugauugaaaaaaaggagaagaauuuggcucauuauggccacauacccugggaguaguucucagcuguaaaaacauucucugugccugcuccucccucugccuaaaaaagccccauaucucccccacauucacacuggccgcuuccucccugccucaggcccuugcccagcguccccauucaacacugaaaacccucugcacccagcgccagccucucugccugcuuccuuuuuccggggcacuuaccaucaucugacacguccugggugcuuauuccccgcagaguggggaagcccaggagcacuuuagucuguucacugccaaggccgggaucuggcccucagaaggugcuucagagcugcuccuccagggucugugaccccaggcugcucugggccagugcucugaaaucuuggagugagcgcugugcccagaucccagcuggcucgcagagagcaggaacuccccgcugcacacccaccugucuuuucuccauuucuccaucuuguguuucuggcuuggugggacucguggcucuacucaaaugggaguguuuugcacgggaacauuuugccuguuaagguaaaaauacagcacaaaggaacugaaaccaagauuccugccuuugauaauguaggacaaguaaguucuaucugcugcuuuuuuuuuuuuugagauagggucucuuuuugucgucuaggguggagugcaauggcacgaucucggcucacuccaaacuccaccucccaaguuuaagcaauucuccugucucacccuuccgaguagcugggauuacaggcguacgccaccacacccagcuaauuuuuguauuuuuaguggagaugggguuuugccauguuggcugggcuggucucgaacuccuggacucaagugacccacccacuuuggccucccaaaaugcugggauugagccacugugccuggccuuuuuuuaaauuuuauuuuuaaugaggcagagucuugcucuguugcccaggcuggaguacaguggugcaaucacagcucacugcagucuugaccuccuaagcucaagcgauccuuccaccucagcaacccgaguagcugggcccacaggcgugcaccaccaugcucgguuaauuuuuaaauuuuuuguagagauggggucucccuguguugcccaggcuggucuccaucuccugggaucuagugguccucccaccucagcuucccaaagugcugagauuacaggugugagccacuaugccuggccuauuggcugcuauauaaagaaaacuuuuguuuuuuuuugcauucaugcugucugaaauuucuaaaauauaauuuuaaaaguaaaguuaacuuguuuuagucucucauucacagaaagauauuuggcaaaaaguaggugauucgcaguaaaacucuggauaucaaaucugccucagcgaccugaguagaggaagugcugucaccugcuauguucugggcccaggccccagagauguuuuugguugguuuguuugcuugcuuguuuuuugagacagggucucccucugccacccaggcccaagugcaguggugagaucuugcuucacugcagccuccaccuuccacucucaagugauccucccaccucaggcuccugaguagccagagacuacaggcacgcaccaccacgccuggcuaauuuuuccuuuuuuuuuuuuuuuugcacagacgggguuuugccauguuggcugggcuggucucaaacuccuggccucaagcaguccacccaccucagccucccaaagugcugggaucaccggcgugagccaccgcacccggccccagccccacccagagccguucuugagccuccuuuuccuucaccuucauguugaguggcuugugcaguccucugccuggaccccguagguauuucccaacuguauucaggcccaucccugcuggcgguuaagaccccugucagcucucccggacuccuccagcccgucagacuaucagacuagaauagaaagcagcccucgcccuugcgcucgugcuuucaugagauggggucccaccaacugcagacacagcuguccccaggacuuggucccugucugccucuugcagcuugucucuucugccgccuucuugacccaaauccacacgccagcagcacgcaccguuccaaguuccguccuucggcccagacccugcccucccucuucccucagcuuugucugauucagccauguucuccaggcugcuuccccuucccuaaagccaccccccaacccccaccaucuggcugcggacccuccccagcagcccugcauuuccugauauaucuccauccuuguccuuccucagcagcagagcaucugacagggaaugagagucagcauugagccaaugagugguuggaugagggaguaaguuaccaucagcgucucugccugcaguaauuaugcacggcggcggcuguccuguugcugugccaggguauuugcagaagcuucaugauuccagaggaacaaugucacacuuuguagaagugccacacuuagcuuggcccagugaauugagucguuagcguagccagcugucuccuguaauggagugggaacacuggaagggggcugucuucugugauggaauggggacacuggaagaggcacuuucuuuuggcugccucagcugcacuuucugccucacuucuuggaucauggccucucacaccuggcugaugacugagucugugucccccauuugccgaugacaccagcaccucugagcaccccagggccgccccuccugcuguugcaucuguuucugagcaucuuaaaaucaccuuugaaggaaaaguccucacaggaacacccccccuugugccuuacagacaaagaaguaugccgaugugaucaucccgcgaggaguggacaauauggguaagaagcuggccugcugggcuguccccccgccccucccagagcuugaggcagggacaguuccaccagugugcaguuacugagcacuccccugcgcacgcggccugccaguguugaucugcggcacaggguuaaaauaugcuuaaaaauguauguagcugggcgcggugccucacacugguaaucccagcacuuugggaggcugaggcagggggaucacuggagcccaggaguucaacagccuggggaacauagcaaaaccccaucucuacaaaaaauaaaauuauuugggcaugguggcaugugccucuggucccagcuacucaggaggcugaggugggaggauugcuugagccugggagguugaggcugcagugagcugugauugggccacugcacuccagccuaggcaguaaaguaagaaccuguuucuuaaaacauauauauauguauauucaaaucuguuagcagaaaguacuuuaagcagacucuaacauaaauuccuggaagaccaagcuaagaagucuuauuuugcuguguccugaugcauguuucugucugcugagauuugacucgaugccccucgccgcaggcugugccucagggcagagguugggcgcucacuccuggccgagugcugcggggaggggcggucuccacggaggauggaugcggcuaacccgcugcuugucugucucuuggcgcaguugccaucaaccugaucgugcagcacauccaggacauucugaauggugacaucugcaaauggcaccgaggaggguccaaugggcggagcuacaagcggaccuuuucugagccaggggaccacccugggaugcugaccucuggcaaacggucacauuuggaguccagcagcagaccccacugaggggcugccgagccucagggcaggucucccgcccggcauguguguucagggacugagccuggggacgcccacccacacccacugcuuccucucggcgcaccccaggggaguguuagcagcgaggccuuccucacucaggaguggaaacucagaugugucacucagacucaacuugcugggacacugacaggcguuccugagguuuucagccacuuaggcucguugcgguuuaaagaucccucuaggucacugagaaaugccacagaaugugcaggaagccugggaggcuucugugaggaaugugaggcacauuauuggggaaauugaggagacagccuagacacuggcuggccugauguuuuguugacagugaacccacagugggagagaguuuuuuccagucugaucugguucuuacacacucacacacauaacucaaaaguuuugugaacaaguacuuuccuuuuuuacauguuacauguccucauguuuucuguuuucuguuucauaacacaaggcugguuguggccuacaaaccuaauuucaugacccagugguuugcaguccagcguggccuacacggauauggggagccacugagggauguuuuccccccuugcuugugccuuaaaggcagagaagcgaggcggaugcccuggaagcacccagcaucacacccaggcuugugcggggccaggcugggagcccaugcaguagggcagaaggcagcggaggccaggucugucccggcuggagaacagcguccacgcaguccugccuggggucaggcccucacugacccucaggggagcccccaaggugcugucugucuagacaggcugucccaccccaggguggcuaguggccauaugcagggaauggugcuucuggcuguggcacgcacuggaucacccaggucccagcagacauggccgcccaaagucagcaagccuccuuugugcuauguggagcucacagccucacaugugaacacccgugucuggguugccuggggugauccucccuccugcgugguggcugucucuggaaagcaucccuugccgcugccaugggcagccccagcccccguccguccaggcucacccacaguagugaugcagacgugacgugggggaagggggcugagcccuguggcuggguucugacaacuguaacgguuuugucgagcuuaggccccuuuggagggagaaucaauaaauaacaaacaccaacuacaaacgccaguugguuccuuuuuuaauuacauuuaaaaaagacaaaggcauggagcuguauggaugacacaccuugaccacugacgaggaagauuucacucagccacgucucaguggagucucagaggggaggguuuccacacagcacggugccaagggccagucuugacgcugucauagacaaugacaugcaagccccagcccuggcucgugguucagguggcccuccaacacugagcugucccaggacgccugccgggcucgcugagggcagggccgggacuugcucagguugcuggguguucaugaaggaggaucgggucugccagaucaaacuccacccugcagcaguuagcaaggaccaggcccuggucugcugaggcuccacugcuggcccuggguucucggcuuuuuguugucaaugacuccuacgcuggccucugaaauacucccugugucuuaguucagggguaaagacacggaauaucuuuauugucgagaaaaaauuaacuuugcacaaaaggaggugcucaucagagagcuuuucaaugagacccccauguguuccacuagaggcccugcucagcccagcccguguccucccagcguggggcccacccugcucauuacguacauugaccaagacccuucaaccucaucccgaccccagcacggguguucuuugccacacucuuguucuaguguuuucggaucaagaugucccagcugucuuuccagcgaagggccuugaguucauguggcgagagugacuuguccccguaggugagugggcgcagcguguuggacacguggcacgcggaggaguaccaggccaccaccagggcgcugaagaugcuccucuggagcugggaccugcagaggucagagcagcgugggggaggguggcugaccacugcggcuucccugcccggcacccucuuggcaucugcuguccacacggucaccccccgaggccugggguucugccuucagguuucugugucuugucuccugccacccaugaccaucucccaccuggaugcacugagaggggcccccugaugacuccucaggccuccacaguggcugggccaccuccacacagaugccagaggacuggucccaaacccacgguccucccuuguguggcuuccugaaaccgggaggcccucgcccucugcuccaaccuccaaacacacucugguuuagaagcuuucuuggguucucuccaccacaccacacaacccgaccauaaccagcugccguuucugacaccccaggcuccugggccuugcucccugcucccgaauccuccaggccacccacaucucuucauccccuccccgucuccccacccacuccgcuuucaucucugucagccgcgacuucucccucuggguuccugcagugccucaucugggcaucucuucugaaccucacccauuccccggagggacccggaggaugucaguguaacgugaaaugggugagguucgcugcaccccauguguuugcugcgcaugggcuucccagcagagggcugcugcccgguccagccacugucuccgcagcccccguaccugcacagguggucgcugaugugcugcaggaccacagggagcagaaggauuuggaaggugagugcgggcagguagugguagaggaagagugucuucuccaucaggaagaacgggagguaguucacugcccagccaccggcacacagcgccccagccagcacccagcgcagccaggcaucuauaggaaagggcucgagcuacaccgacucugcugcucccacaggccgggucuucucucucuuuugcuuuuuuagagagaggguucuuacuauguugcccaggcugguuuugaacuccuggccucaggugacucccucacuuuggccucccaaagugcugggauuacagguguaagccaccgcgcccggccuggcugccuguguuacccagccauuuccagcgcauacgggcaacaugggaccaagagggcaauuccugcccaauacgcugcacucgacuggagacaccucuaacgcaacaugggaacuuaacauuuugucucuugggagacaaacauaauuuaagauuccacaauacagaaacaaagaggccgcguuaagggguagguuccuaugaagucgguuugucacuugaggcggugaaugcucagcgcacaccuguaauccuagcacuaugggaggccgaggcaggaggaucgcuuaagcccaggaguucaagaacacccuggacaacacagcaagaccccaugucuauauuaaaaagaaagaaagccaugugggagagguacuaacccugagggaggucauggacauuucuucgccgucggagcagguaccacaaggacagcagggcguagauggccagagcgaggcugcccgaaacccagaucacuauguuuccaaguagguggaucugagccuaagggaacaugggagaugcuguuagccaccugcccucugcucagggagggaagagaagagaacacaggaaaggaauucagaugcacgcacuacuuuagcagagugaaaaaacgccaggcacagccuagcauccacuaggccuuacuacuacuguggacaggucugcuccuacucagaccuuucauuaaaagcacugaugccagccgggugugguggcacaugccuguaaucccagcacuuugggaagcugaggugggcagaucaccugaagucaggaguuugagaccagccugcccaacguggcgaaaccccgucucuauuaaaaaguacaaaaauuagcugggcauugcggugggcaccuguaauaccagcuacuuggaggcugaggcaggagaacugcuugaaccugggagguggagguugcagugagccaagaucacgccacuguacuccagccuggaugacagagcaagacuccgucucucucuuucucucucacauacacacacacacacagcacugaugcucucaauuuuguaauuggaaacugaaaauugggagcagaugacuccacuuuguaacagcagcgcuguccacggaggagaaugcaaagugcgcucagagcucgggguggggcggccucugggccugagccucugccuucagugcacaugcugagccgaccuacccgccucugagggaggaggaaaaaggugggcauuuccagcgucugcccauucagugaauauuuauggggcgcugacugugcgcccggccuaccaaugcuuucacucugccggguggagagacggcacgcacaucagcaaagcaccgguaagcuccaccaccaggugccacacggaaaauugaaugggaauaucuuaaaaccacuuucgccaggaaaaggggaacaaugugucuccacaaaagcaaucaagccggguuuccuucaacaggcacacaugccacaccccuacuccuggcuccagguugccaaagcguuuagagaaaaccaagucacaggccuuugucaggaaaagcuugggagaaacccagcacuuucuagggugcagcggcugcucuuaaugcaaggaauucucaagaaacaggaugaaucuaugacugucagcugucagcaucgcucgcuuacgcugguccuggggugcagccaguaggcaauauugguguccagggugacccacuccagugggcuggagcuguacuuguguuccgagucaucacuucucagcgccagcauccuccacuggaacaaagcagaggccucugagauugaggaugggggaugccucccgcugugcguggauuuggucaaaggaguacacugcugccccuugcacguggacuggcccagcucaaguucauucggaucaugcaucggaggcagcaugaugagaaccuggauuccagcccugaauguggccuugggagggucgccccacccuaugugcuccaguuaccuccucuguagacgaagugauugggcugaaugcucucuaaggucacguucagauuugugaccgugaguuucugauugugacuucucuugggcucuguugaguguggcccauuucgcugccugggggccuuaagacacccuggcgauguugcagaaccuccugggucccuauuauuccugaccacagggccacaaggugugggccaggggugucacacacagucccuuacacuggagagaggagacacucauucuguugugagccuguagcuccagcgucaaagccugacucugguuugaguccugugcagcccccaggccucccugcugaggagucaaugcucagcgagcuaggccagcuuccccuggccgcuccucaccugcagcuccgagaaucucgccaugaagcugagguuccugcugacguccaccugcgcaggugagugcagcucccguucccgcucccucugcuccuggccuggcagaacagacaagggcauaacagauagaaguagcacaaggucaagagcucagagcagaagcugucagugcagcaaaaagcuggcuuccugccuuucuaacaaagaccccuuaucgaaccgcaucauuccacuuagcuuuccccaccacacccaagacugcccggucaaaugaggugauuucgacccugagaaagcuccacuugcacggggauaaacugguugccuuccagcgacaccucggaagaagcgucuugaguuauuacugcagcagcugagugcagggugcagggagggagaugaccugccaccgagcauggagaaugugcucaguucccuucccaccaaaaugagaacucugggguguuaucaaauauugagcagcugaaaguacauuccaggagcggcggaagccacgccgcggacucacucgcgccguaucggugcuccuccacguuccacaccgugcucccgugguagccccgggacagcuucuccccgacgaucuccaguugccgauacccccagucagggaggugagccccgcucagcuggugacaccgcaggagaguaaagggcgugaugggaaggccguggcucccguguccacuuggguuggaaggggaaccccugcccgggucacgcugucagcaggugccccuugugggagauucacauugggauuccauccugagaaguuacaaaagccgcccucccucaguguaagaggaagccaugaugacucaaaugaagcguuccgccugcagagaggcggugaagccugaggggcuugggaaacagacuggagcccacagcucaggacaggccaagccacggacaguguccuuaccuuuaagacagcggaaguguucacgugcacaaagcggaccucugagaggauggucuuccagacgucugugucagauccucuguucacaauuuccugcaaaaagacaucucaaggauuauuucauuccuuuucaaauuuccuucaauguaaaaauaaagaccugucaccaaacaaugauacugacuugagccugagacaaagggacaaguccccaagugagggaagcuauaaggggcugguacuggccuuccuucccaaugcccacagcaccccgggcugcuccgagggucgcuggggaagugcacccuccuccucgccaaggccguacaagaggccuccucacagaaaauacaaagccugauguucuucgugccucucugcaaagccuauucauagggcucagagcccuggccaaaaagugagcaagucucagucccuaucuggcaggacucgcagacagcucagaugaaggccagacacugucccugccagacacagcuuagagauuuccucgcaucgaguaauaaaaaagacaacuaacaucugaaaggcacuuugccuugucacagccugacauacuggagccucacaaugaccccaugacaucacaugacugucauuuucccauacugucacaaccagagaacccaagaagcuaggcaggagcaggcaugaggaggccuggccgcgguccaugccgcaggccgggcgcgcacaccucacgcaugcucccuccuuccuuguucuaugaacuucagacaccugaaaugugggcuccuggugccaaaggggccaucagaaaggacagagaagggugcccgugagaaggggcacagcacucacgucagggaaggacugugggggggcggggauggaaaugcagaacgcacacagauaugcagagcacagagacggcgaguggggcagaggggcgcacucugcacaaaaauggaacagccaaucuggagcaguggcucacacuugucaucccagcgacucugggaggcugagguaagaggacggcuugaguccaggaguucaagaccagccuggacaacauagcaagaccccaucuccacaaaaaauuuuaaaaaucagacuguccuggaauagaaaaaauauuuuaaaaauuaaauauucaaaauuaacaggggccaggcaugguggcuaaccuguaauaccaagaggcagaggugggaggaucaccuaagcuugggaggccaacacugcaguaagccaagaucacgccacugcacuucagccugggugacagagugagacccagucgcaaaaaaaaaaaaagaacaucagcagauaccuggcuuugcugugagggcuggccaugaggacguggugcuaacucugucaagcgaaacagggcugagccugcguaggcagaaagcgcugaagccagugggaagcuagaagggggggugugaccucacuauggaaauaagcccagugccuucacuguggucauggggcugggcugcauuuaguguccauguccuuagauucagauggcaacaugguccaguaacagaagacuuuuuauggaaccuuucccaggagacccgauuccguaaggggagcagguggcccuggucgcuggaaggaaaggugaccacagacccagcgccucaggaacaucccccgcacucacggcuaagccuguccccagggaaauccugagaaauggaauuucuccuggaucaugguggcagagggguggcuggagcucguguccuguguucaggaccugcuccugaggcuaaacagguugggagaacuuucaccuggcagagccucaagcgcaccuggcacccaacauggagcaaacacaaagcauuuagaaucucagugaacacaggccucugaugcaggaaaccaccagguuccccaguuccaccaaggaagacgcaucgguucccugugaaaacaucugugacuuuauguacgaauaaaacuuauguaacuuuacaucugaaucagaauuauucuaaauauccaaccucaacuggguaaacugaaaaaaaggaaaaaugauuauucucaacggcaguuucaaacauuccaugucaggaagugcuccgugugagcaagugcuccgugugauggagugcucccugugaggaagugcuccgugugaggaaguguucuguuagaggaagugcuccgugugaggaagugcuccgugugaggagguguuccgugugaggaagugcuccgugugaggaaguguuccgugugaggagguguuccgugugaggaaguguuccgugugaggaaguguuccgugugaggaagugcuccgugugaggaagugcucugugugaggaaguguccuguguuagaggaagugcuccgugugagugugagaguguccuguguuagaggaaguguuccgugugaggaagugcucccugugaggaagugcuccaugugaggaagugcuccgugugaggaaguguccuguguuagaggaagugcuccgugugaggaagugcuccgugugaggaaguguccuguguuagaggaagugcuccgugugagugugagaggaaguguccuguguuagaggaaguguuccgugugaggaagugcucccugugaggaagugcuccaugugaggaagugcuccaugugaggaaguguccuguguuagagaaagugcucccugugaggaagugcuccgugugaggaaguguccuguguuagaggaagugcuccgugugaggaaguguccuguguuacaggaagugcuccauguuagaggaagugcuccgugugaggaaguguccuguuacaggaagugcuccgugugaggaaguguuccgugugaggaaguguccuguguuagaggaagugcuccguguuagaggaagugcuccgugugaugaaguguucuguuaggaagugcucuguguuagggagugcuccgggugaggaagugcuccgugugagggaguguucauuacugacgguuguggcugcuauagccgcagccuuacucaccagucuccagagguucugggcgggcauggagauguuauagucaauguagcaggagaccuccugugaaugggggcucaggggggcugcaacaucaugccuggaaaaccaagaccgagauuucagaaaauuccuugaacuccucuggaaggcaauuacuaaaucuuucaggcaggaaaagguugcuuuucagaaacaaagccggcucagccauaagggguggcccagucccaugaguugcugcuacugaggacggaggucuugaggcucggcgaugggaguggacacuaaacaggcaggaggcccugugggaacaucuccaaaagaaaaggacacucugcuguggaaccuuccaccuguuagacgagcgaaccaaguuucagaggaaggaaccgugcgcccaggcccgauccgguacugcugcgaugccagcuggcaguaccaaugcuacaacuugcagggcugagcugcccgccccugcgcccagcuggccuggggacgcagcagauaagcugggagaaaaggcuaucaaccucaauguuaacgaacacccacuucuuuuuuguuuugagauggagucucacucugucacccaggcuggagugcaaauggcgcgaucucagcucacugcaaucucugccuccuggguucaagcgauucuccugccucagccuccugucuagcugggauuacaggcacaugccaccaugccuggcuaauuuuuguauuuuuaguagagacgggguuucaccauguuggcccagcuugucuccaacuccugaccucaaaugaucugcccaccuuggccucccaaagugcugggauuacaggugugagccagcacgcccggucaggaacacccacuuccucuuaauccacacacucaguaaccaugugguaccgcaccaugcaccuggcacugucuaggagcagccacccagcugugaacaagacaaggcccucacagcccucugggaaacagccaucaugccggugggcagagcgugcaccuguaggagugccacuaauaaaacaaauggugggggacagcacccaggaggcacuuuuggaugcagugacaucccagcagaccccuacauagaggggccaugggggagccaaguccaagaacauucucgcagagggagcaagugugaagcccccaaggggcccgcaggugguuguuucagggcuggggggagccaggguggcgggggugaagugugucagggucaccagggaccuuggcgggugacgggagucacugagcacagaggaacaacgcaaguggguugugcacgguccgcaggccggacaggcugcugcgagguagagaggucaggccccaggaggugggaguagagggagaaggaaggaccccuacccagggcugguucugaagguugagaaacaggaucucccaauggaaucaacaugcaaugggaggggaggggaaggagucaggugaugccucagcuacugggcccuuuccagggagaaccagaaaagccagggccagagaccgccccuguggagcugggagucguggagagcuggaggugagccccgggcagccggguggaaguccaggagagguagccccgggacugggccugugcagaggcagcaaggccggagggcccucagagacugagagcaacagaggaaaaggaggcgguggagagagcagucagggaggaaggaggagggugugagcaacugugcccagcaccacgggaaggcaagucggacaaggacgaaggacugagaaggaagaagccuucacggcuccacucgugcccgagcuuccaggcuucuuggacucacucauacuuuaagcuugaccacuuuaaggaggugugcccaaacuccauucucugcauagaaagcgggucaacauucccagccuguccuuguacacucauccacggggcccugagcucuccuaggaugggcugugcuaggugcuucuguccaguccucacagagccccugcuuccucuuaaccccgcucccuuccgcggccaggccuggguccccucccggcaucaaauguaggucuaagagcugcuacacaugcagaugauggguagacagggggcagcggcccaaggcagggcucacguuuuggucugaacagagaaccacagaggaaacccacaggugcagcagagcagacggcgggcacacucacguguucagggagcggguggucaugccguggaccagcugcaccauguccccgugccucacaggucucggagggcugcucaccaccagcuggugccuggaagacacagugcugucgggaccacacagagccugguccccucgaacuaacagcugcaccggaggggcacagcucugaauucucauggcugagacugccucccaacccaugugugccucacaugaggugaacacaggaaaccaaagcacagacauuaauugggcucuuuucugaaaccaaaggucauuuuccgaaugugauucuacccgcggucaucacaccugcauugcucugaauuugucuacaaacacuacagugacaaauguaccaugacugccaaggaauccuucugaagggcauuccaccaaugaaaguguaugagggggccgggcgugguggcucacaccugcaaucccagcacuuugggaggcugagcuggguggaccacuugaugucaggaguucaagaccagccuggccaacauggugaaaccccgucucuacuaaaaauacaaaaauuaccaggaugugguggugggcgccuguaaucuuaucuacucgggaggcugaggcaggagaaucacuugaacccgggaagcggagguugcagugagccgagaucguaccacugcacuccagccugggcaacagggugggacucugucccccgaaaaaauaagaagaaaaaaaagaaaaagcccacucgggcugcaggugcuggagcugggcaggcagcaaugggaggacaccaucaggagacagugaccgggacagcuagagaccuuguuugggggcagaauccacaggacuggauaugggaaugagagcaaggggcaccucuagcugggaugugugcaagaugaugcuacuuuugcaggagggggguucuuguuuuuaugaggaagggagagggacacaggucggggcauugaggcucgccuggaaacuucucagagcagcuacugagcaggcugcucacugagggucucaugaucuauuccucugaccuuggacucagcacugagcugguguucaaggccaugacggugacuagagucagugagggagggaaagaagggggcccaggacugcaucccagggucucgccuggccaggccaggaggugagcucugcucuggagucacaggaccugcacucaccuccugggauccuuuacaauccaccaguuauugacaucuuugaagggguaacaggucaccuguugcuggugggagcugccucggccguucucauaucugugugaagucaacaaagagauguaucugggccaggcgcgguggcucaggccuguaaucagagcacuuugggaggcugagguaggauaacugcuugagcccaggaguuugagaccagccugggcaacauagugagacccugugucuauuuaugagaaaaagaaaagaaagggaaagaaacguaucuggaagugggucaucgaucgggcccacacgccuuucuccuaaaguuucugcaaagggaagcagauuucaacaaauacaaccuagcaagggguuucagggaaaaugaagauaccacagacaaggagccgaaaucagaugauucaggcaggcagugcugaggucagccacagccacagagcuggggccgacccugggcccugccacacgccaagucccuccagcaacacccgggaaccacgaagcucacuggcaaucagcacccgggcugcucaacuucuuucuguccugcaaacaaacuuccucaaagaaagggaaaguugcuaagauaagcaaaucuacgagcaaauaaagcauuuaauuaucuucaaaguaaaaccaucaccuuacaucaugggguagguguccuggugggaaugaagccagcagggcacagguuucccaaagacguuccucagagugaccugggacccaaaggccaccuccaguggcugacccugagugauccgagcuaguccucccugagacagaagcagaagguugaugagugagagacagaaagaaaaaugacccuaagccagccuucccgauggccacuccucccucuggggugauguuuaggcugguggccauucuuguaacagugguaaugaucucccauuuaaucacaucacguuacauuauagaaccauaaugagcacuaagucugaucaaaugcugccucugggccaggcacucaguucagccuuccacgcgcacccuauucaguccuuacaagcauccaaugagguaagagcaaugaugaugucugucuaagagaugagaaaaccaagacuagggugagccaaacaacuugcugaaacacacagcacuacagcacuggccgucggcaggcuuggcugacuucaggaaccacaguccugaccaccucuacugauaccuucuaccacugcugcgagguucauaggaaugaaggucacaguugagugugguccuuaaggcgggugaaacugcccaggguuuguaagacuugacuuuaaaaugcucccagcugccaggcgcgguggcucacgccuauaaucccagcacuuugagaggccgaggcaggcggaucacuugaggucaggaguuccagaccagacugaccaacauggugaaaccccaucucuaccaacaaaacaaaaaaauuagcugggugugguugcaggugcuuguaauaccagcuacuugggaggcugagguaggagaaucgcuugaagccaggaggcggaguuugggugacagaguaagacuccaucccccccaccaaaaaaagaaauauggauguggauucuucauguuuugauucaagugcuaauguucacuugauguguuuguaagaaaacucuggguccacuaucaucuuccuucuccaguggccacgaugcccacugcuuacuuaccucuaagcuggccuggaaggcacuggacaugauuuggucguggggcccagagcggaagacuagaaucaaguggacguagaagaacaguaaguacaggacgaccgggaugaccagcaaagccacugcucgggcgagcaagugacagaacacacagaccugccagagauucaaagaaaagucauguuccacugcguggaaaagcguacccaccucuagacauugugagcuuagaaaaaguuagugacagaaacucuggccucccauacagaggcaccugcagaggccaagaggcgaggcugcccaggccugccugcuucuaaaacauugaggauuggagucuuuucaccaaguacccccugugacaucugcaucugccccauacaggccggccucaugcagcacuggacaucagcaccuacauuggacaaagucuggucuccaagcaggugccaggcauggacagcugcaacacccagcacgagcacguacgugaacacacccauguacuugaugcugcaaagacaugacagaaauggaguuaacaugagacaggaaaacauaaggagauggaggaggacacugcccaagaccagaggcucaaacucaccccacugcacaggaacaagcgaccccugucaguguuagccagaaccaccagcucagagaaaaagggcuggaauaaaaacaaagcagauggagacagaaauaguucagacacauuuccaaaaggcuagugaagcuccacauucuucagagaaaucuuucugggucggcuggccaugcugagccacaggggcaguaagaaagaauucccaucucccaaaguauccaucccagcagaauuuuucuuuuugcccagaaaauguuguccuguuaguuuaaauuauagaaaaaugaagauguauuuaugaagucacaagccaagggccaacccccaaaauauuagaggaccaaaagauaucuagcacuaggcgcagaggcucacaccuguaauccccacacuuugggaggccaagacggguagaucaccugaggucaggaguuugagaccagccuggccaauauggugaaaccccgucuccacuaaaaauacuaaaauuagccagacauggugcugugugccuguaaucucagcuacucgggagacugaggcuggagaauugcuugaaccugggaagcggagguugcagugagccgagauugcgccauuacacuccagccugggugacagggacuccgucucaaaaaaaaagauauuuagcaagcaacuccucaaaaugaaaagguacugucucacaaaacgaaacaaaaaaagguacuggaccaucucagaucaacaaaccacccagaaucucuguucucguuaacuaggaagacacuccauuuuccauaccugugcuuuuggcaguugaagaacuucagguaggacaacacggccaauagauugaaaaauauuaacacugauuccaaaagcauuagccuugacugagugaugagagcauucucuguuucaaagaggaaacacaugucaauuuuaagguagcaagggaaaacguaugaggaugaaaaacacucaugaaaaaaggcauuacuucagaagcgauacaacuguguggggcuguugugaauguuaaaacauucuauagacacaaggccucauacagucaucacccaauacacaucucuuuugauuuucuacugucucuuucuuuucuuugagucagggucuugcucugucgcccaggcuggagugcaguggcaccaucauggcucacugcagcuuugaccaccagggcucaagggauccuccugccucaggcuccugaguagcugggacuauaggcgcaugccaccacaccuggcuaauuuuauuuauuuauuuuuuugagacagagucuuguucugucaccaggcuggagugcagugguacaaucucggcucacugcaaccuccgccucccggguucaagcgauucuccugccucagccuccugaguagcugggacaaaaggugggugccaccaugcccagcuaauuuuuguauuuuuaguagagaugggguuucaccauguuggcccggauggucucgaucucuugaccuugugauccacccgccucagccucccaaagugcugggauuacaggugugagccaccgugcccggcuuauuuauuuuuuuugagauggagucuugcucuguugcccaggcuggagugcaguggcgcagucuuggcucacugccaccuccaccucccagguucaagcaauucuccugccucagccucccaaguagcugggauuacaggcaccugccaccacacccagcuaauuuuuuguauuuuucguuauuuuuagacaggguuucaccauguuggccaggcuggucucaaacuccugaccucgugaucugcccgccucagccuuccaaagugcugggauuauaggugugagccacugcgcccagccuaaucuaacuuuucaucugcuuuaauuucaucuguucauaaacgugagcuggaagacccucucugaagaggauccacugacucacgaguccaucucaauuggccaaggccugggaggugguggaacaaggggaaguuaucauuuggucacaagauugguuggagauggaggugcccacgugugcauggacuuugcagcagcaucugggcaguuuucuacugccauaccccgacugcugauaagagucugaucccacaauucagcaaucccauaaccacggggucagccugggagcgggugacuugcagcgucaaauuuggaugaaccagaugcacuuucuggugcagcucgcccaccaagcccaugugaucuuccgggccaaagggucaguucuucccugcaugacagcaagagcaggcaggggcgcaggucuuaccgauaagcaucaacagagcagcucccauggcggcacaaugagaaaaguggagcuccaacacuaucugguaggccauggggaccgacaaggcccccgcgagugcuggcagcaggcgcagggaccacacaggcacguugcuacuguauucuggaaaagcaaccacacugcagagcugacuacacugugcacacaccaucucuguguacugcagcuaugcuuucacauagcgccgucauguucacagacucuaaaaugcacguuuacaaaacuggggaccccaucagcagcagagugcauaaacuaugggugaaggcuuugaaauuagcuuugcauagucauggaacccgaucucaugaagcauagacaggacuaaggauucuaaaauuuaccgccuuacuuauacauauuuacccucccuguuuucuuuuuucuuuuuuuuuuuuucucugagacggagucuugcucugucccccaggccggagugcaguggcgccaucucaucucacugcaagcuccgccucccggguucacgcccuucuccugccucagccucccgaguugcugggacuacaggcgcccgccaccacgcccggcuaauuuuuguauuuuuaguagagacgggguuucaccauguuagccauaauggucucgaucuccugaccucaugauccacccgucucagccucccaaagugccaggauuacaggcgugagccagcgcgcccggccuacccucccuauuuucaaaaacauuguggcaauggacaaaauucacauguacaaccgaucaucacaaucagacgcucugugauacguguaccaacgacaagggcugaaauaaugacugcaacugaacaguaagauuuuaaccagacuuuccagaagucuuucauuuguauccaaccaauuuauuauuuucuggacucagauuaauaaggcacaguuucugugggacuagguaugaaaggaaaaaaaaagccacaguuguuaauccuuacaaaagucacaaucucuucauucuaaccugcgcacauuaaaagggaaaugaaaauuaucuuuuaccugcuccaauucuguuccacaaaaaauugccaucgaauccuccuaaauaaccugaaacagaagauuaaucaguaacuaucccauucagcaaauauuucuagaguacuguggcaagcaauaaacaagaugcaucaauaauaagaccugguuucugccuguaagaaaugcacugauaaguuuuaaauguauuugagguccugaaggguaggggcuacucuccugaugacuccuaccucccaaggccagcaccauguggccaaauggcggcccacugucauccaagaagaagauuuguuucauguaaaaagagauguacugcccauaauauacuucgucaaaacuagaaaaaaaaacaacaacccauauuauauucaauuagaaucuuaacuguaaacaaaaacugugaggauaaauguguauguguuuccaaaugacuuugagugagugaucagcaaaggcuggaucuuuugccccaauuguuucccauccccaaauauuaagaugcauacagcaucacccacccacagagacauggggaauucaccaagcacagcuggcacucagcaugccugcccauacagauucugucucucccuuguguuugauuuagguggauacuaugagccaaccugcugaaagaccuccugggacgcaaggcuaauccugcuuacccaccuacccaacccccccacccccgcccccaccagcagcacaugucuguggcuagcgaugacccaaugaaacggcugcaaguaugaaaggaaaacgugggaaucaacugcaauaacauguuuucaaucagggagaggugaagauaaccaagaaacugcugucaauuucucaggcaugauaaugcaacugugguuaugugauuuuuguuuuuaagaauccucagccaggcacgguggcucacgccuguaaucccagcacuuugggaggccaagguagguggaucacaaggucaggaguucaagaucagcuuggccaacauggugaaaccccuucucuacuaaaaauacaaaaaugagccaggcgugguggcaggugccuguaaucccagguacucgggaggcugaaguaggagaaucacgaucgcaccauugcacuacagccugggcgacagaguaaaacuaugucuccaaaaaaaaaaaaaaaauccucaucuuuuacagauauaccgcugaauuaucuaugaauacuaggauuugcugcaaaguaaaaaccacugcagggaggggccuggcugugaacugauaaggugaagcuggguaaugaaaauacuggugugugugggggggucauucauuauacuugucucccugcuuuuguauauguuugacguuuuccauaauaaaaaguuaaacaaaaaagaacaugcagcagggcggaguggcucacgccuguaauccuaacacuuugggagacccagguggguggaucaugaggucaggaguucaauaccagccuggccaagauggugaaaucccgucucuacuaaaaauacaaaaauuagcugggugugguggcgggcaccuguaaucucagcuacucgggaggcugaggcagagaauugcuugaacccaggaggcagagguugcagugagccgagauggcaccacugcacuccaaccugggcgacacagcaagacuccgucucaaaaacacacacacacacacacacacacacacacacacacauacacacauuaaucaguuaauaaagagcccuucaauaauaacagcaaucacuucccauuaugacaaaaacacauucuaaaaagugcucucaacagugaagacuuacuuccaaauccauuaauccucugccguccagacuuuaaaacuguuacuuaaggcuggcaaccagauuuuccucuacugcaccccuuuaaugggccaaauuucaccuguuacagacucagaaggcaagaccuaaaagguguacucugcuggggcuguccuggggacagacuggucucuccucucacugccaaaaacaccuaucaccaagaagccaggauuucacucucccauuuaugcuauucaguaagggcgccuccugucacaaaguacaauucuagauucacccugggaauggagucauuuagcuuacaccacagcccgcggguaggugagucgccacagccggcucaguaaccccaucccagucagggccacaaggcucaaguugaugucagccgucaccacuacagggcgcuucaaaaauccccacaucuuguagaaaagcgggcucaggcagacgcccuagaaaagaagggaggagccgugguccaugagggcucacgagaggcuacagaagggauccccagccacccggcucccggacacacgaggagaaccacagcacagccgggcugcugagaaagaccgaaguuccuggagccuugguucagguagacauguggggugaggggcacuagcagugaacucgggugggaauucaggggaucucaggacuggacauucacuccuuucaacaacucauuccacaaaaccugccgagcacgucuugggcgcgagaacacugcuaaggaacgccaggguuucuccccucccuccccgacgaccagaagcccacagugcggccacagcuaccugacccugggcagcuccugggugccaucucagcugcuuacagcccagggaccccaaccuggccgagccucggggccuccucaucucuccucaaggaugcaucugcccccagugccucccugccuucuaucccagcggcacaucauccccgggugcucccuuucucgccuggagggugcauuugcacccugcgcccccacguucuccuccaggcuucaucuucccuugagcuccgcuucucuugaggcugcaucaggccugggacacccugucucacaccaaagccgcaucuggccguuggcgccccgcuggucuccucaggccccaucuacccuggacgcgcccuucccucccugagcugcaucugccuugagcgccuucgucccaaaaggucccaucuguccugggagugccuccucuccccuugcagaccgcaucucccuggccggcccuucuuccccacaggccgcaccugucccguccaccaacucccgaggcugcgucggccccagcuccguccucacccugagacugcacccgcagcacgcccuuccucccuagggcugcacgcgccacggaguucuuacuucggggcucggccgcccgaacgccgcaucugcccgggcccgaaccccgcccccagcuccggaaagacggggacgcccccggccccagcccguccgcaagccagggacccgcguccggcacugacggacucccccaaguccgggcugggcucucguccccgguguccccaaauguacccgcguuucuccgaguccacacagagccgcgcccggcucccggcaacgccucggaaccguccgacugggccgacgguugggggugaggccgcucggcacuccgcaccacccaccgcccugcucaacguucgauucaccgagccugcggggccagacgggcag

SEQ ID NO: 13148 - RNA, 7374 nt, Homo sapiens
gagauggcuucggcgggaggcgaagacugcgagagccccgcgccggaggccgaccguccgcaccagcggcccuuccugauaggggugagcggcggcacugccagcgggaagguaaggggccgagcgggccggggucucgccucucgccggugccuacgggcggcccgguccagagaggagaccccagccccggccgaggggcccccugccaggcaggggcagggcgcgggagcgaaggggcugcaggccgcgaugggccggggcgggcuggggcgggcgagggguuggggcgcugggccucggggcucccccacagccucuccgccggccgggcuccucggagccccaaguccgugcuaaccccguugggcccccgcggcccuuccgcugagaccauccacaccuguugguguccucccgccuuccgagcauaccccccagggggcgggugggucagugucuccagaagccggccccgugccugucacaggacgagcgguuccaggcgggaaucccgcuucugugucuccagucgaccgugugugagaagaucauggaguugcugggacagaacgagguggaacagcggcagcggaagguggucauccugagccaggacagguucuacaagguccugacggcagagcagaaggccaaggccuugaaaggacaguacaauuuugaccauccagguaaaucgcgagcccaacgauguggggagggcagaccccauucugggcggccgcuaaccagcugcgcuugggcccaagguuggauggaugcagacccgcuugggcuguucccccaacucgccacgcagccugcaguggaguuggcugcacagugaagucaggggaacuuugcugaguucucugggcccugaguguccccccaggagcgugguuggagccagucaggaagccuguugcacuguggggagcccugcccugcccugccacaacugugauccuggagaaauccucccaucuucccuucccacguuggggccuuuagggcccuccacacacaccucugcccacugugcccucccgugcuuuggggcaaaguccucagagaggccagugugggaggcgguagguaaacuagugcugguggcuugaagcuccgggccagguaaacgggcagaugcggcagggagacaccugccacugcuagaagauuccacccuggcuggcuggcauggucagccuuuucccaaggacuugugggaagaaggccugcaaagccgcagucuaaccaguuagucccagaaagagagagaagcagaggcccagccuacccaccucccaggaagagcugaucagaaaaccccuguguuccggcaucucaggggcacagagcuugggcaguggcacagcccgagaacagcaaggacagggucauccuguggucugcagggcugcagagggcacuguugcuaccaaacauacacugccguaguccuagucuaccugugcuaggguucucgguguccccagcacccagcugugcugaccccagagcagagaggguucccugcuguccgcugcacgagggcaucugccugucuugccuuugucuccaacccugcagaugccuuugauaaugauuugaugcacaggacucugaagaacaucguggagggcaaaacgguggaggugccgaccuaugauuuugugacacacucaagguaagcaggugguucuagggagggccgaggagaggggccagcuaggacguccccucgggcucacacagaccugccuggcggcaggccucccccgguugguuucugugggucccccaccccuucccacagucagugucccugcaauggaagcugacuguguguguggccuggagacccugugucugcagcagagccccuuuccccgugcgccccucagguuaccagagaccacgguggucuacccugcggacgugguucuguuugagggcaucuugguguucuacagccaggagauccgggacauguuccaccugcgccucuucguggacaccgacuccgacgucaggcugucucgaagagguaaggcggccgcgggccuccgugccugccuggccgaggcuggcggcagguccugaggucugaagcacgccugccccuugccgcugcaguucuccgggacgugcgccgagggagggaccuggagcagauucugacgcaguacaccaccuucgugaagccggccuucgaggaguucugccugccgguaccugugcucgcugcuucagagcccauuuuccccuuucacaaggacacaugggacccaguacugugagagggcuuagugcugggugacagugaucugauugaaaaaaaggagaagaauuuggcucauuauggccacauacccugggaguaguucucagcuguaaaaacauucucugugccugcuccucccucugccuaaaaaagccccauaucucccccacauucacacuggccgcuuccucccugccucaggcccuugcccagcguccccauucaacacugaaaacccucugcacccagcgccagccucucugccugcuuccuuuuuccggggcacuuaccaucaucugacacguccugggugcuuauuccccgcagaguggggaagcccaggagcacuuuagucuguucacugccaaggccgggaucuggcccucagaaggugcuucagagcugcuccuccagggucugugaccccaggcugcucugggccagugcucugaaaucuuggagugagcgcugugcccagaucccagcuggcucgcagagagcaggaacuccccgcugcacacccaccugucuuuucuccauuucuccaucuuguguuucuggcuuggugggacucguggcucuacucaaaugggaguguuuugcacgggaacauuuugccuguuaagguaaaaauacagcacaaaggaacugaaaccaagauuccugccuuugauaauguaggacaaguaaguucuaucugcugcuuuuuuuuuuuuugagauagggucucuuuuugucgucuaggguggagugcaauggcacgaucucggcucacuccaaacuccaccucccaaguuuaagcaauucuccugucucacccuuccgaguagcugggauuacaggcguacgccaccacacccagcuaauuuuuguauuuuuaguggagaugggguuuugccauguuggcugggcuggucucgaacuccuggacucaagugacccacccacuuuggccucccaaaaugcugggauugagccacugugccuggccuuuuuuuaaauuuuauuuuuaaugaggcagagucuugcucuguugcccaggcuggaguacaguggugcaaucacagcucacugcagucuugaccuccuaagcucaagcgauccuuccaccucagcaacccgaguagcugggcccacaggcgugcaccaccaugcucgguuaauuuuuaaauuuuuuguagagauggggucucccuguguugcccaggcuggucuccaucuccugggaucuagugguccucccaccucagcuucccaaagugcugagauuacaggugugagccacuaugccuggccuauuggcugcuauauaaagaaaacuuuuguuuuuuuuugcauucaugcugucugaaauuucuaaaauauaauuuuaaaaguaaaguuaacuuguuuuagucucucauucacagaaagauauuuggcaaaaaguaggugauucgcaguaaaacucuggauaucaaaucugccucagcgaccugaguagaggaagugcugucaccugcuauguucugggcccaggccccagagauguuuuugguugguuuguuugcuugcuuguuuuuugagacagggucucccucugccacccaggcccaagugcaguggugagaucuugcuucacugcagccuccaccuuccacucucaagugauccucccaccucaggcuccugaguagccagagacuacaggcacgcaccaccacgccuggcuaauuuuuccuuuuuuuuuuuuuuuugcacagacgggguuuugccauguuggcugggcuggucucaaacuccuggccucaagcaguccacccaccucagccucccaaagugcugggaucaccggcgugagccaccgcacccggccccagccccacccagagccguucuugagccuccuuuuccuucaccuucauguugaguggcuugugcaguccucugccuggaccccguagguauuucccaacuguauucaggcccaucccugcuggcgguuaagaccccugucagcucucccggacuccuccagcccgucagacuaucagacuagaauagaaagcagcccucgcccuugcgcucgugcuuucaugagauggggucccaccaacugcagacacagcuguccccaggacuuggucccugucugccucuugcagcuugucucuucugccgccuucuugacccaaauccacacgccagcagcacgcaccguuccaaguuccguccuucggcccagacccugcccucccucuucccucagcuuugucugauucagccauguucuccaggcugcuuccccuucccuaaagccaccccccaacccccaccaucuggcugcggacccuccccagcagcccugcauuuccugauauaucuccauccuuguccuuccucagcagcagagcaucugacagggaaugagagucagcauugagccaaugagugguuggaugagggaguaaguuaccaucagcgucucugccugcaguaauuaugcacggcggcggcuguccuguugcugugccaggguauuugcagaagcuucaugauuccagaggaacaaugucacacuuuguagaagugccacacuuagcuuggcccagugaauugagucguuagcguagccagcugucuccuguaauggagugggaacacuggaagggggcugucuucugugauggaauggggacacuggaagaggcacuuucuuuuggcugccucagcugcacuuucugccucacuucuuggaucauggccucucacaccuggcugaugacugagucugugucccccauuugccgaugacaccagcaccucugagcaccccagggccgccccuccugcuguugcaucuguuucugagcaucuuaaaaucaccuuugaaggaaaaguccucacaggaacacccccccuugugccuuacagacaaagaaguaugccgaugugaucaucccgcgaggaguggacaauauggguaagaagcuggccugcugggcuguccccccgccccucccagagcuugaggcagggacaguuccaccagugugcaguuacugagcacuccccugcgcacgcggccugccaguguugaucugcggcacaggguuaaaauaugcuuaaaaauguauguagcugggcgcggugccucacacugguaaucccagcacuuugggaggcugaggcagggggaucacuggagcccaggaguucaacagccuggggaacauagcaaaaccccaucucuacaaaaaauaaaauuauuugggcaugguggcaugugccucuggucccagcuacucaggaggcugaggugggaggauugcuugagccugggagguugaggcugcagugagcugugauugggccacugcacuccagccuaggcaguaaaguaagaaccuguuucuuaaaacauauauauauguauauucaaaucuguuagcagaaaguacuuuaagcagacucuaacauaaauuccuggaagaccaagcuaagaagucuuauuuugcuguguccugaugcauguuucugucugcugagauuugacucgaugccccucgccgcaggcugugccucagggcagagguugggcgcucacuccuggccgagugcugcggggaggggcggucuccacggaggauggaugcggcuaacccgcugcuugucugucucuuggcgcaguugccaucaaccugaucgugcagcacauccaggacauucugaauggugacaucugcaaauggcaccgaggaggguccaaugggcggagcuacaagcggaccuuuucugagccaggggaccacccugggaugcugaccucuggcaaacggucacauuuggaguccagcagcagaccccacugaggggcugccgagccucagggcaggucucccgcccggcauguguguucagggacugagccuggggacgcccacccacacccacugcuuccucucggcgcaccccaggggaguguuagcagcgaggccuuccucacucaggaguggaaacucagaugugucacucagacucaacuugcugggacacugacaggcguuccugagguuuucagccacuuaggcucguugcgguuuaaagaucccucuaggucacugagaaaugccacagaaugugcaggaagccugggaggcuucugugaggaaugugaggcacauuauuggggaaauugaggagacagccuagacacuggcuggccugauguuuuguugacagugaacccacagugggagagaguuuuuuccagucugaucugguucuuacacacucacacacauaacucaaaaguuuugugaacaaguacuuuccuuuuuuacauguuacauguccucauguuuucuguuuucuguuucauaacacaaggcugguuguggccuacaaaccuaauuucaugacccagugguuugcaguccagcguggccuacacggauauggggagccacugagggauguuuuccccccuugcuugugccuuaaaggcagagaagcgaggcggaugcccuggaagcacccagcaucacacccaggcuugugcggggccaggcugggagcccaugcaguagggcagaaggcagcggaggccaggucugucccggcuggagaacagcguccacgcaguccugccuggggucaggcccucacugacccucaggggagcccccaaggugcugucugucuagacaggcugucccaccccaggguggcuaguggccauaugcagggaauggugcuucuggcuguggcacgcacuggaucacccaggucccagcagacauggccgcccaaagucagcaagccuccuuugugcuauguggagcucacagccucacaugugaacacccgugucuggguugccuggggugauccucccuccugcgugguggcugucucuggaaagcaucccuugccgcugccaugggcagccccagcccccguccguccaggcucacccacaguagugaugcagacgugacgugggggaagggggcugagcccuguggcuggguucugacaacuguaacgguuuugucgagcuuaggccccuuuggagggagaaucaauaaauaacaaacaccaacuac

SEQ ID NO: 13149 - RNA, 720 nt, Homo sapiens
auggacaggcuuuccuuuccgucuggcggcagccaucagguaagccaagaugggugcauacaaguacauccaggagcuauggagaaagaagcagucugaugucaugcgcuuucuucugaggguccgcugcuggcaguaccgccagcucucugcucuccacagggcuccccgccccacccggccugauaaagcgcgccgacugggcuacaaggccaagcaagguuacguuauauauaggauucguguucgccgugguggccgaaaacgcccaguuccuaagggugcaacuuacggcaagccuguccaucaugguguuaaccagcuaaaguuugcucgaagccuucaguccguugcagaggagcgaguuggacgccacuguggggcucugaggguccugaauucuuacuggguuggugaagauuccacauacaaauuuuuugagguuauccucauugauccauuccauaaagcuaucagaagaaauccugacacccaguggaucaccaaaccaguccacaagcacagggagaugcgugggcugacaucugcaggccgaaagagccguggccuuggaaagggccauaaguuccaccacacuauugguggcucucgccgggcagcuuggagaaggcgcaauacucuccagcuccaccguuaccgcuaauauaaguaaagucuguaaaauucauacuuaauaaacaauuuaggacagucaaaaaa

SEQ ID NO: 13150 - RNA, 672 nt, Homo sapiens
uuaauagcuugucauuuucaaguucauuuuuuauucauauuuauguucaugguugauuguaccuucccaagcccgcccagugggaugggaggaggaggagaaggggggccuugggccgcugcagucacaucuguccagagaaauuccuuuugggacuggaggcagaaaagcggccagaaggcagcagcccuggcuccuuuccuuuggcagguuggggaagggcuugcccccagccuuaggauuucaggguuugacugggggcguggagagagagggaggaaccucaauaaccuugaagguggaauccaguuauuuccugcgcugcgaggguuucuuuauuucacucuuuucugaaugucaaggcagugaggugccucucacugugaauuuguggugggcgggggcuggaggagagggugggggacuggcuccgucccucccagccuucugcugcccuugcuuaacaaugccggccaacuggcgaccucacgguugcacuuccauuccaccagaaugaccugaugaggaaaucuucaauaggaugcaaagaucaaugcaaaaauuguuauauaugaacauauaacuggagucgucaaaaagcaaauuaagaaagaauuggacguuagaaguugucauuuaaagcagccuucuaauaaaguuguuucaaagcug

SEQ ID NO: 13151 - RNA, 7860 nt, Homo sapiens
guguguauaaaaaagugauaugucuuuaauuuaaaauuaugacccggaaauaacuagucaguuuaagugauccagacuuccucuucauacccaaauggaacagacacaauauuggcucagauuuccaaccccagaaaaaaaccaaaccaaguccucaggaagucccugcagcgaccuugcuggggccaucagaccgcacagaguggaggugcccaagcugcuaggcugcucuuaauccagccacacugagaagagcuuuccuucuaccagcaacucccucgcuggguccgauaucccccuucaccucccuuuuagcuggcacugcacgaaugccuccacagagaggcugacaguacagcagucaccucccagcugucuucggugcaucuucagggccaccuuccuguggucacaauagaggaguugagcauucuaaacguucgugcccaggagggcagcgucuucucuuuuuagcugaggucuggagcccugaguuguaaccauuggucauauguggcugaggcaccgacagcaaaucgccaaacuugggaaacgaucuggggagaugcaagggccuugguaauugauggugagucugaaaaugaaacagacaaauggcaucuggguaaaauccuuacagacaucucagaagagaaaguguaaagauggaacagggaacagcaccuccuucagcacuccaaggcucugccugcucuucccugagcauagaauccaaagggucccauuuguuuuuuugguuuuuucuuuguuuuuuuuuugagacagagucucgcucugucgccaggcuggagugcagcggugcaaucucggcucacugcaaucuccgccuccuggguucaagcgauucuccugccucagccucccggguagcugggacuacaggcgugugccaccacgcccagcuaauuuuuguguuuuuaguagagacgggguuucaucauguuggccaggauggucuugaucucuugaccucgugauccacccgccucggccucccaaagcgcugggauuacagacuugagccaccucgcccggccagggucccacuucuuaggucagcuucgccuuuuccuccuccuacguucagggucaauuauggcuuuggauucacucagcuacucagagggagucucaagagaacagaaggcacugagcgguguggcaggggaagaguccagcaugugaugcucagcagggcuuuuuuugcacugaauuuuggaaauguggagucagcagagaggaaaggaggauggguguggccacagggcagccuuccuggaggccuuccuaggagggguucacacacagaauaaauacaacuggcuggaugcaagccuccgcacaaagccaacaggucacucagacccacugcaguggggcagcaagcuuccacacuaguuggcuuucucaaaaauuuacagcauccaaagcuugaccugagucaaaagcucuagggacaaaccaccaaagggcugcccagagaugcuguugaaaaccagagaguggccaaaccguccccaccauacacagcauuccugagccagacuggcugcacacugcauguauuacggaggcgucccagcacacuaccuaacaagggccugcgcugugccugggguggggucgggggagagcacaacagucauuggaguccccugagaacugaggcacagugaggagaaaagggugggguuuccuccucagucacacuaccucccaaaggaggaagauauuauugcucaacugccagcaucagugacauuacccuacucgaaaggauggcaccugggguugggcagcucaguagagacccaggcugggugacggcccccagugacagcccguuguguuguuccuuacaguuguccaagaccaaggcugggucaugucacaagcccggggucaugacaacacaugucccaucacaugcacacgugacccccugcuaaccaaucuucuggaucuuagcaaggcagcucaaguagggggaguaugaguuugggucccaggagcccaacaaauuccucuucucaaaaacagugcaaccccuaagcguuuauuaaagagggagcugugcacguggccggucuaaggccaaggccaaucacaggacccacuuacaaguccauggaguuuucaucccaucauggcagaaggcuggccugaccccugcccucacuggaugaugcugucuggcugcccauucugggccaccugcccagggucagaggcgggggccggguuagcuguguugcucugcagguagcggcggaaaucuuugaucauaggccggaggaccuggaugaggacgcucagggcagccugugugcccuccauggccugggccuggcgcuccugggcacaggccugcacuuccugggagcggcggaucaucugcaguaggucguucugcuguuccaggugcugugcgaucuccuucacaugcagguuggugacccgcugcuccuguaucagcuuggcggaguugagagcaaugcggcucuugagcgcuugcggcuugaccgacgugucugcaugcugggccaucauguccacaggggucucugguggcagaggugggggcgccucagccgugcaguacuccaccacgcccuccuccagcgugugauagguggucucuguggggacugcacaguagaaagaacagaggccaagggaggucacuuucuggaaggaauaaagcuggcuguaugggguggggaggaggccauaaaguccuguccuggagggacauaaaggggaauccaggccuccccuggcugcauagcuauucacauauaaaucuagaaucuaagggguucagaauuuuuuuuuuuuuuuuuuuuuuuuuuuugagacggagucucguucugucgcccaggcgggagugcuguggcgcgaucuccgcucacugcaagcuccgccuuccggguucacgccauucuccugccucagccucccgaguagcugggacuacaggcgcccgccacugcgcccggcuaauuuuuuguauuuuuaguagagacgggguuucaccguggucucgaucuccugaccucgugauccgcccgccucggccucccaaagugcugggauuacaggcgugagccaccgcgccuggccgggguucagaaucuuaaucuacuugguaaucaaagggccagcccuggaucuggcaaaagcaaagauguugaucauaauacuagcaaaacuuuuagagcaacuacuacaugucaggcacuuuguacucauuagcucaacaaauccucaaaaugacaccaagagguuggugcugucaucuucauuuuucagagaugaggaaacagacugagaaauguagaaugacuugcuaaggucacagagcucauucagcagagccaagaggcaaacccaggucuccccaacagcagagcccgaugugcuccugaccuccacgcugggcugcuccuagcuaagaaaggcacccccggccgggcgcgguggcucacgcuuguaaucccagcacuuugggaggccgagguggguggauuaccugaggucaggaguucgagaccagccugaccaacauggagaaaccucgucucuauuaaaaauacaaaauuagccgggcaugguggcgcaugccuguaaucccagcuacuugggaggcugaggcagcagugagccgagaucaugccauugcacuccagccugggcaacaagagcaaaacuccaucucauaaaagaaagaaagaaagaaaggcaccccagaggcugggucacaugcucucugugguaccaugcagcaggcaucuugggugggacucuacacacgcucuuugcagccacauuaguccuaccuccuuugaugcuuucugcuuuuuuuuuuuuuuuugagacggaguuuugcucuuuugcccuguuacccagguuggaguucaguggcacgaucucggcucacugcaacuucugccucccagguucaagugauuguugugccucagccucccgaguagcugggacuacagucgcccaccuccaagccuggguaauuuuuguauuuuuaguagagacaggguuucaccauauuggccaggcuugucucgaacuccugaccuccacugaucugcccaccucagccucccaaagugcugggauuacaggagugagccaccaugccagcccuuugaugcuuucuugacuugacuuccuaggccccuauggcgaagcagaaaaggaggugggaauggggcagcaguagcuaaaguacccagucaaugucucccugucugucaucaucugggucaauccgauacuuaaacauccuuccuguuccagaacagcaucugaccuagacccguguuugucccccuuaccccaccccaguguauucuugagaaauacgcauugugaggggauggcacucgcacauccacccaacucccccaacccccacugagaaucacugaaugauccagcucacggucaucacaaacgagcagagguaacagggcacaaacucuucuuugaacuaaaaaauccaaccaaaguuaguucuguugucauuccugagaaccacggaaaggauccuggcugggcuguaugggccuccgcgcaugugggagaggucaagcuccuccacccuucaacgccaaugucagcuauguguccuuaugccaccaagaagcccccuuccucuuccggggccugagguuuucccaacugauggcgaagcuauuccuauaugugucaucucuguccuacuagaacauaacuggccuguauuuuagacaacuugguaaucccagugcccagcacaggguuugguacagaauaagugcuaauguuugaugaaugaaugaaugaaugaauggaguagauuaacaccaggaaccaugaggcuccugagcagcaccugaugaaagaucccccacacugaaaacagaauccagaaucguugucucacuugggcaguauuauucccaucaauuuuuucaacaaauauggccuggcugucuacuacaagccgggcccugugaaaaguccuguggggauacagacacggucucuuguuuucaaggaccacccaguucggcaaguggagguaagucauggacaaacaugguggcaaugcucaguggcgagcuauccagcacgucagaaguccagcccacgugcugaggaagucccaaagagagcaagaucacuucugucugggugcugcucuuggaaggccucauggucuuccaagacccccaucugaccucugacccuuggcagccaaccuuccccaggccaccccagagcuugcuggcccuucccacuuaugcacgccgccugggcaggagaggucacucacucugugucagggugaccguggcugcggcugcgguggccgaggguccgagggccacaggguggaucucuguggugcugggcaggcugaugaugguggccucgcccagcagguugcagauacguuguugcaugggggucagcagcacuggggcuacagcugggccaccgccaccacugccaccgccugucccaggccccccagcuccguccuccucagugggccccggcgccucaccacccuccacggcggcccggaccugggcaaccuugcgacggaccucggucuugaggucagaccacuucuucuugaccucaggcagcucucugcggcagguggccacggcguugacccuucucaggaugccgugccaggccgcacucuuggcggccagggguaccccggcguugaagugguucaccagcaggugcuucuucagcuccagcuccuccacgaugaucuccaccucccgcucugagaaguucaucuuccuuuucuuggcugggacggccauggccucuccccuccccucuuuuuaaagaaauuauaauccccucaagcgccccaauuccccuucucuucuuccucagccucgccccucacccacccccuacaggggauaggccaggcuugcucgaggccaagcacuaggccuuugguaaccccccucgcuacgcaaagugcguagggcccagccccgaccggcccggccgcugccagccagcagcguaauggcuuccugaaucugccucuuccgccgaggugugcggagauccgcccacuuccccucuucccgccucccagcgcuucuccgggaaaaccggccuucccgguugguagcugcucaaauaucacgucgaucacugguucuuucgaucugucgcucagcuaaagagcacgccugcuuacuguaauucgccugaucauuggucuaaaauuguguccgucgcccagagggccccgcccaccuaaccuuuauucacuuccauuggaaaaucauucugucguucaauugucaguauuacgacuauuaagccguuaaauucagcuauuuuauuggugguuuagggaguuagauuaccaaaacccugcuuccugaggauacuuagugcuuucggccgugacccaugggucaauuaacuuuuaauuccucccaccggcacaaacucugccucgcaacugcaguucacaaaugcucucacacaaauccuguuucccacuggaggcuacgaucucuccguacacuaccgcuccucccauccuuaagaucccgcagucuaaacagaguuaguucaucaauggaaacuggacacggggccuuccgccugccaaucacauuacucaugccuaucgcugcgugauuuucucucucuuggcccccggcucagccaauccccgccucccucaguuugaaucggccccaggcggagccgggugaccccgcccaccccauugauccggguaguccguggcgcgugggcuguccuuagacaggcuccgccccucccuccuccccauccgagccugugacuggccuucggugcgcccgggcguggccggcgaagcggggcgcggaggggcggggcucccggaagccgccccuuccgccagcuugccggcgucuccgagcccgcgcucccagcugcagagcgccuggcuugccucccgcgcggucaccgccggcccgccgcccccgcucccgcccgcgcccggagccccugccucgcgcccgauggugagcaguguguugugccgcuguguggccuccccgccgccggacgccgccgccaccgccgccucuucgucugccucaucgccggcguccgugggggaccccugcggcggcgcuaucugcgggggcccggaccaccggcugcgccuguggagacucuuucagacgcucgacgucaaccgggacggcggccugugugucaacgaccuggcgguggggcugcggcgccugggacugcaccgcaccgagggcgagcuccagguaggcugcgcgcguccucagcacuggcggggagggagccccucgagggccgggugacaggucucgggggacggccccuugggcugggcggaacccccacuguccagaggaagggugcccccugacucacugagggacaccccacuuaugcccuggugggagcggggcuccuuccugacuucuuugggugcuugagccggguucuucguggacacaggugggcauccuaugggcuuucugaugggcgaaaagcccuuucuugcccagaguagaaggccaggucucaggagugugccuuugucaccuccugaccucaaggccaagcuggacgcucccuucacccaaggauggguucauccaucaguccccagcagcacccccuccuuucccucucguuuccaugccagccgugggcccugaucugguuccucucaggaacaugugggaguugaaaaaaaaauugguauugggguuucaggcugauccguguggacguuggcggcgaagacug

SEQ ID NO: 13152 - RNA, 18428 nt, Homo sapiens
uggaaagauugggacuccguguaaagucuacauggggagcagaaagccgugcgugggcauggggauaugggaauauggcacccauccaaccccaugcaaaggcuucugggaaccuggguccaggcagagguuuuuuuuuuuuuuugagacagagucucacucugucacccaggcugcagugcaguggugcagucuaggcucacugcaaccucucccucauggguucaagcgauucuccugccucagccuccugaguagucgggauuacaggcgcauaccaccaugcccagcuaauuuuuguauuuuuaguagagacaggguuucaccauguuggucaggcuggucucgaacuccugaccucaugauccacccaccuuggccucacaaagugcugggauuucaggugugaaggugugagccaccgcaucuggccuuccuugugguuuuuuuguuuguuuguuuuguuuuguuuuuuugagauggagucucacucugucacccaggcuggagugcaguggugcaaucucggcucauugcaaccccugccuccccucaggagugugagccagggugaucucccacuccugaccucaaggguucaagugauucucgugccucagccucccgaguagcugggacuacaggcacuugccaccaugucuggcuaauuuuuguauuuuuaguagagacaggguuucagcauguugcccagguuggucuugaacuccuggccucaagugauccacccaccuuggccucccaaagugcugggauuacaggcgugagccaccacacccagccccagcagagguuucgagguagaauuucucccagaaugcuguggcucuucugucuguccacuggggagggggaggucaguaagaggugcaucaggagggggucgguuccccagggggauguucaguggagcaucaggaggugggacucuggugggccuaguccccaacuccucaaucucucacccccucagugggacccaguggagacuggcccacucauugcuaaagugagcuuccugaagccccucucaucacagcccucugcccugaaaccuucacuggcuccccauucacuggccagcuccaaacuuacagacuugucuggcguuugaggccuuccugcaccuccaucugcaccugcaccccucucccgggugccuuagugaggcuggugcuuccucaucucugugcagagggccuuacccccaccccuccuugggagggggcgccucccaccagcugcaaaccuaugaguggcagccgcuccucucugggcuucccguccagcuguuuccugcauccauuuguuuccugcggaugcucagugguucccacugagcucagccccaccagccaggcucccuggggcaauccccaaucccacuacgugcugacugguggguccacaugugaacuucagagugaggaggcccuggcacaucuccugcaaccgccaugccagcuuguuuucaagccuuggaauuuuuuucccuucccuucccuucccuucuuuucuucccuuccuuuccuuuuuagacggugucuugcucugucacccagacuggagugcaguggcaugaucucagcuuacuguaaccucugcccccugguucaagcaacuaggauuacaggcgugcaccaccacacccagcuaauuuuuauauuuuuaguagaggugggccagggugaucucacacuccugaccucaagugagcugcccgccucggccucccaaagugcugggauuacaagcaugagccacugcgccuggcuggaauuuuuucuuuaaccaaaauauuuucauuuuaauuuuguuccuaaaugucacaagcuacaaaauauuuuuaaaaaauuuuuuaauuaguuucauuuuuauauguuucuguuuuuagauuuuuuuuaucauaaaacaaauaauacaaaugauauaagauagaaagggaggguauugccgaguccuauuaggguauaaucuuccagaucuuuccuccaugcaauuuuuucuuuuucugagacaaggucaugcucuguggcucaggcuggaguacacuggugugaucacgguuuacuguagccuugaucuccuggacuugagcaauccucccaccucagccucccaaguagcugggacuauaggcaggcaccaccauacuuggauaauuaaaacuuuuuuuuuuuuuuuuguagagacagggucuugcuauguugcccaggcuggucucaaacuccugggcucaagugauccuccugccucagccucccaaagugcugggauuacagaugugagccacggcgcccaggcuucaugcaauucuuuuuucuuucacuauuccaguuuuucucucccuuucuuuuuuuucuuuccuuagguuauaccugggaaauaaaauucugaaacguuaauauuccagaauugguagaaaauccauaguucacaugcaaauaaaacggauacuuaaaauugauuuuuuaauuuuaaaaauuuauuuauuuuauuuuaaaaauugugguaaaaaacguguaacauaaaauuaaucaucuuaacaauuuucacacucuguuuuggauaacagagcuccaaaacuuugucauuuugcagaucugagacucuguacccauuaaacagcaauucuuccuuccucauucucucccagcuccuggcaaccaccauucuacuuuuuuuucuaugaguuugacuccuuuagauacuucaauguaaaggaaucauacaguauuugccuuuuugugaugggcuuauuucacuuacauaauguccccaagauuuauccauguuaaaguuauuuuuuaauauauauaaaguaauagacgcuuguuguauggaaaagcaaaaaugcuuggguggcugggcacuguggcgcgcaccuguaaucucagcacuuugggaggccaaggcaggaggauugcuggagcccaggaauuuuaggcugcggugagcuauaauuuugacauagcgcuccagccugggcaacaaagugagacccugucucuuuaaaaaaaaaaaaaaaaaaaaaaaagcguggggggcugggcacaguggcucacgccuguaaucccagcacuuugggaggccgaggcaggcagaucacuugaggucaggaguucgagaccaaccuggccaauauggugaaacccugucucuauuaaaaauacaaaaauuagccgggcguaguggcacgugccuguagucccagcuacuggggggucuugagaaucgcuugagcccagaaggcagagguugcagugagccaagauuguggcacugcacuccagccugggcaacagagcaaguauccgucucaaaaaauaaauaaauaaaauaaaauaauaauaauaauaauaaaaugccggcuaggcacgguggcucacgccuguaaucccagcacuuuuggaggccaaggccagcagaucaucugagguugggaguucgagaccagccugaccaacguggaggaaccccgucucuacuaaaaauacaaaauuagccgagcguaguggcgcaugccuguaaucccagcuacucaggaaggcugaggcaggagaauugcuugaacccgggaggcagagguugcggcgaauggagaucacgccauuacgcuccagucuuggccacaaaagcgaaacuccaucucaaaaaaaaaaaaaaaaaaaagaaaaaagaaaaagaaaagccuggggaagccuuuaaguaggaaguggaagugucaucuccagccaggcggucauaggcacacaccugccuucucuguccuguuucauuucacccacucuaagauguugucaguuugauuguaagacaauguaauuuuaacuuuguagaguuacggugcaaaaaaaaaaaaaagucugagaauauauuuuacacacacacacacauuugcauguuuagagucuuuuuuaaauuuacuacuuuuauuuaaaaaaaaauaggggccgggcaugguggcucacaccuguaaucccagcacuuugggaggccgaggcggguggaucacgaggucaggaguuugagaccagccuggccaacauggugaaaccccgucucuacuaaagauacaaaaaguuagccgggugugguggugcauggcuguaauccuagcuacucaggaggcugaggcaggagaaucgcuugaacccaggaggcggagguugcagugacccgagaucacaccauugcacuccagucugggcgacagagugagacuccaucucaaaaaaaaaaaaaagaaaagaaaauacagacagugucucacuauguugcccaggcuggucuugaacuccuggccucaacugauccuccuguaucggccucccaaaguacugggauuacaggcgugagccacugcucccagccuccagucauuuuuaugcaggugggaucagaagagugcaguggggcuuuuugccuauuucuuuuuuuuuuuuuuuuuuuuuuuuuuugagacagaguuucgcucuucuugccuuguugcccagucuggagugcaauggcgugaucucggcucaccgcaaccucugccuccuggguucaagcuauucuucugccucagccucccaaguaggugggauuacaggggcgcaccaccauguccagcuaauuuuuauuuuuaguagagacgggguuucaccauguugaccaggcuggucucgaacuccugaccucaggugaucuacccgccucaggcucccaaaaugcugggauuacaggugugagccaccgcgcccagccuuuuugccuauuucuuaccaaugcuaugggugucugaagccucuugucccauuaaccacaaacaacuuggacuuccuuucucacucagacccuaugggaaaguugcuaacuccucacccaccguggcugugccaucaucccagugagucccugcuggcacuuuaaaacuuuccuaugcaaauuugugcccacauguuuccuugaaacaaauuucuuaaaguagaagggcgcauuugaagacuguguguguguguguguguguguguguguguguguuuuauuuuuagagacgggaucucguuauguuucccaggcugguguuagaauuccugggcucaagugagcucaagugauccucccaccucguccuccugaaguggugggguuaacaggagugaccauuaugcccgguccauuugaaauuuugauuuacuuugucaauugcuuuccccaaaggugccaaugcacacacccuugagagggccuuucaaacagcuucuaaugcaacaccucugaccccacugcaccugcccccccacagauggggaaacuaaggucccaagaaguaaggacuuaucugacaucacagguagcagagacccaggccuccuggucuccuggcugcugugguugcugaggcaccaccacugaagguggucucaaucuccugguagucucacucucuugcucaaauaccuccuauggcucccuagggccuauaauacaaauuccaaguucaacccaccucaccaucuggggcugcugccugggcucccaucccugcccggcuacaucacugagcaccuacuacuaugugccagucucccugcaaaacgcuggauaaacacguggcuuucuaccagggaaccucccgcaagguauuugacaugcucgccucccguucucugcugugucuaaggauucacagaugcggcuggagucugcugcuuagcacagugagugcucauuaugggagcuauucuucuuaucaagaccgcaaauccccucucuggcuauccacagccuucugaaugucccgggcaacuccaggggagcagggcugguuuucuauaaucuucuaccuuacuggguggucuuugggguccuggcggguuccagucccagaggagcucgaagggucccucccaacaggggaagaggagucccaggugggucucggccagggccucugggcaggcucugagggcgggcuuggggacuguggccagcaaagccccugagucgaugccucagcccucucgcucccuggucuggccucucucuggcaccaaugcgcugugggauuuugcggaaagagccgcucuucucugagccucaguuucuccagcuaucauagggaaagccuggccuuguacccuggaguguaccuugagcacagucgggguaucgcaauggaaaacucuuggcaaacuguaaaguguaguucgcgugugugggcacagccaccuggggguccacggugcggggcacacggugccgggugcggugucgccgcgcacccgggcucgggcucggucccgccccgcuucccggucccugguccgcucucccucccuccuucccgcccucccugccuucgggaacgccggcucccggcaugccgcgcgcugacagccuuauaaauagucgccuuugccggccgccgcgaggacgggcagggcacgcacuggccccggcgcccacccgcaccccuccccaggucagugcgugcccgcgcgugucugggggggcgccucugcggggaggggcagcggcaccgggggagggcgggggcgugcuggugcggggcucccugggggcugugcggcuguguauccgugguugugauccguguguguuugcguggcuguguuccccgggcgcuggggaucugugccucgcugccugugccuuuguggauccgugcgugugugugcguguguguuuguguguguugcagccccuuccagccuccgagauagucaccccuuuguucuggcuggcacucccggggcuccaggucacugcccuuggcaugucccagcuugggcccagagagggagagcuguggccuggcucccugccccagaggaccuggacaggggcagccucugugcuccguagggcuaucgugucacuccacuucuagugcugggugcauuggagaacacccccuggaugcucagagcuugcccuagccuccugaccagggccagcgcuuggggccuucccacagcacugcucaguggccgccugguacuccucagcagcagcaggacaggcccagagaggggacaccaacugcccaaggucacacagcugagugauggagcugggauucgaacccuagucaguugccacccacugggaaccgacuacguugggucagaagcugggagaccugggcuugccuuggccuugucuugugauugggguuaagucaccgucccucugggcuucggccccacaggccccuuagcagaccauccagucauauuaggagucgcuggggccuugacccaggggccuuauaaggccugggugcuuagcccguaacccaacuccauccuagaccccuguccucugugaggccuccucacgacccaaguuauuuuggaucaaggaaguggcaggugccaucagggcggagggggcuuagauuaccaggaggggggcggggcagggcggggucgaggccacuucucagggcuucacugugguugucccuggcccaggacgcucccccucccaugggcagcugcugaggggcacuuggcagcuccuacccccgcugaagcacacucagcaggaaaaguggcugccacuccugccuggggcagcaggggcaucagcaaagccacuucagcugcuacugggugccaggcccagcguagcagaaacucagggccgaguuggacccuagcuggcccucgaaccagucuguccuccuccccaugccucaguuuccucccaagauggcagugaggauggaacgaggcuccccagcccugugcucagcccaugccaggcccagucaaugggaucccaggcccgcagcacagaagaggggcccaguacagcgugguugugcagugcagggcagguuuccaggaggcaccugccagugugggaguggagggcagaguccaggaaggcuuccugaaggagguggcaccugagcugagucccacacaauagcaagguggggaaaggcauccaggcauuggguacaacaucugccaguggcagcugauaggguugcagagggcagcagaggucagcucaccgggaccuauccacuaugucaaggggcccaggcuuugucugggagccgagagggccacacaugcaagguuguaagcgggugugugauguggucugauacuugccagagaaaauccugcaaauugcguggcaggguguggaggcuucaaggcccauguggaggcgggggcaguggcccaggccccuuacuuagcacaggacauaguggugaggagacagacggagagagccuggggaggggaggguugggcagugggugugcagggcuguggagaggagagaggagccuucacacugacucagccuguggcuuggccauaggggccuggagcugggacuuggggagggcuguucagagccugagaagccuguggggcuucuggggccugucucgggggcauggaugucuggggcuggagagaaaggccugggcugccugcacagggauggggguccuuggagccugaagccaaguagagaggguggugugggugccuuggguggaggucccggugcggguggggucgcuggcuggaggucaaggcuggaggggaguguggcuguggugguugcgaguggccuuggggagggcugguggcugggagugaagaaguggaggccaaagguguccagagggcaguucugagauaggggggcgagguaggggagguccugggggcuguggcagcacaggguggggucgcaggugugauugggcucaugggcaggcugagggcaaggugggggcaguaaagccagguccucaaagggugggggugcaggggacaugcguggggcugguuguugggccuguagaggugaagagccugggaccgccucacuuugacaacuguaaagggcuguguucaugcgagcggcuccuguagauuccuucaccccaggccucugucccuuagaggauccccauccaaaccucaucccagacacacauaguuccuggccaccucccaccuccuggcagcuucccucuggcccuggggagcguugucaaggugucugggcagacgcuggcccugcgcccuguuuucugggaguuucgaggggagcagcucugcaguuguguggccgcuguuuaugucccucggugccauccucacugucccagccccuccagcgggaacccagguggaugggagggggcuacugcccuucugugacaggugaggccauggaggccagagaggaaaggugacuuuuccaaggucacuuucccaagguggcuuucucagggaagggguccugggccuucccugcccccagcagcccccucugcccucagacugcaugucgggccuggcacacaccaguugccuuggguguggcuuaguggaaggugagucagggugaggaggaaaaucccuccccaaccugugcccuugucuuacagagcacugacacggcucccgggaccucggcaggauggaagguaugagccuccucuccuuuugcccauugccugggccucagugugccugacuauuaagggggugcgcucucagggagacauucugggagggguuggaggaggcucuggggcugccggagggggccuggcugggagccuccaguauccuccucuggccucucacgggaugugccagcuccaagauuaauuuuagacgugacgaggccuccccaaggcuccugagggccccagcgcacacccccuaugcuggguuuauagagcugagacccugccccauggagaggccacagauacacaaaacaccaggucuaaugaggacaaggcaauuccccguaccucuccgggacucaguuucccuaucauccagugagggugggccuugaggaagucuuggacccuccuaguuccuaugggcugggacuuagagggagacacgggcaggcagagaguccagaacgggcccgcccucagcugcuggcagcaccauccguccaguuccuggcacugugccuuggccugggcagcucuuaaagacacccagcgggccugcugcugcugcugcugcugcucugccugagcuccaaauaucaacagccauagggcugcggccacugcacccccgggauaggggcccacaggaggagcccuucuugacagcuccuguagggcuccagccuuauggcugggagggccccugggagccgcccagcccaccuccucccuggggaaggggcagagaaccagagaggggcaggccuuuccuaagucacacagcaaggugggauacagccugguccucuauuucccugggaagcgggggagccugaaagcccaguggggagcuuggguucugguuuugguucugacaucccuugagcaggccuucccucucucgagcucaguuucccucugcccaguggggcuguggccuugcugggaucuaacagcaggcgggacgagacagagguuggagccaagcucaccgcccucucugggcaagaguuccacaugcccaccacagcccuccaccccggcaacugucuccauggcaacauauguugugguugcuaagcccccacugccgggggaggcgggugaugggccggcccagggccugagaggggaagggcagggugcacaggagacacggcaggacgggaccaugggcugcugcuccucgagugacccccgcagagaagacgaucugagagccagaggugaccggccccgggguccaggcacccacagggaggcgccaugagggcuggcggcccagcccgcuggcuguguggagaguacuuagccuuuaggcuuuugccucugcccgucuggcugccuggagcacccucucuucccugaccucucccaggcuccgagcucacucacaucccugcugacucugggcugugacuugucugccucccugacaggagcgccagcggugucugucccuccgccuggggcccagcacaggccugggacuccagaggugccucuggcuguggguccagcgagugacugagcccugcuccccuuuucucucccgcagagaagcugaagaaaaccaagaucaucuuuguggugggugaguugcgggcaggcggguggugcagcaagggucuucacuggcacuggagggagcccgggccuggggcugcacccugggcucugccccucccucucugggagacccuggcagccccuguuccuccugggacccugugucucgggguuuaugaaugggugggcguuugcaggugggccuggcucagggaagggcacccagugugagaagaucgugcagaaguauggcuacacccaccucuccaccggggaccuccugcgguccgaggucagcucaggcucggccaggggcaagaagcugucggaaaucauggagaaggggcagcugguuccacuggugagugggcccugguggggugagaggcaggggaugacaguagcccugagugggugucccaccagcagcaaagcccacggcacacaggcaaagcugaccguaaccgcccccggcuccaaacccuucugugguuccccauugcccuggacagaaaguuccuuccagaagcucccaagaccuugcaggacucugcccugcccccaacucucucccuucccuccauccuucagccacccuggccucuguccccucagacuagccauacuccuuccagccuggaauauucuuuccucuucagcuuucagacuucccuaacuccccagauuuggccuaagaccuccccccccaauuuucuacuccagaagccccacuucucugcccguacaaccugugccaugcuuagaaauggagaaaucaucuguggaaugugucuguccccucaccagccccugagcuccccagggcagggaaggccuaauugguccauggccguguccucgggacccaggacagcaccuggcuggaaggagggucucagugaauacuguugagugaaugcaucauucauucauucauucacucaguccaggucuccacaauuccgaggaagcuuccuggagggggaggcuuguuugggacauuuguguuggggagagggcauuucagguggcaggagcagcgugagcagaggcugggagaagggauggggaggagaggcucauggccccuuccuccuuugcugugccccaggagacaguguuggacaugcuccgggaugccaugguggccaaagucaauacuuccaaaggcuuccugauugauggcuacccgcgggaggugcagcaaggagaagaguuugagcgacggguaaggcacugacccaaguggggauccuggugggcuggggcaggauaagacucccauccccaugggcgggccugcgggggcugugaugcaggucagaguucugagcagaggcugauucauggagugugggugaggaggaaaaccaggaagacuuucuggaaguguagaagaaaauguguagaaggggaagcgccaggaggggcaguugccaaaccugggcucagauuccagcucaacggcuugagaucuugggccagucauucugccuccugaaccucaguuuucccaucugcaaaaugcagggagugggaggaccaggucacagcugccuuaagggacaguguggggacuggagaggaugugcccuuccagugugggccuuggcucccuauaaacacacagaggggcagggaacagcacuggcagggcuggaaaggcaaggccaguguggggagaacagaauaugugggcaggacaacaagggagguuccagccuggcuggaggcugcaaaugccauaaagggacaucagucuccuuccaggggucaugaggagccuggcuggaaagagcaggccuggaaaaugauggcccugagcuuccuagcacgagcauccugcagauacaccuuccccaggauggggcaccccacacacgcacacacguggacgcuugcacauacacaugcacaagccccacaaguucauacacacaaggccaggggcaugugcacacaugcacacacacggcaguggauacugcacuccugcacaugcaugucacggacgcagcacacauaugcaggaaugcacacgugcucgcacacauggcccugugcacacacauacacuuuuaccucggugucacaaggcuguaugggagaaauaaacgggacugcaagggccuaggagggagaggucggcaagggcuagggggagccuaaccagcauccuggugggcuggggcaggauaagacucccauccccaugccccauucccaugccccauucccaugccccgucuccguagggccuucugggcuuccguagcuuccagccucaucuggggauaggaggccauauuuucugaccucugaguggcugcaugaguggcugcaagaccucaggaaagugucuaccccacucugccccucaccuucccuaucugaaauggggguuagcuggauuccuucagaccucagaccccugacccuguguuaggugccacaguucugaaagauguccuggccuggcucacacauaccagcugugugguaccaccugugacccucagggccacaucuagaaaauagaguuaaugaaagucggccgggugcaguggcucacgccugagauccuagcacuuugggaggccaaagagggcagaucacuugaggucagggucaaaaccagccuggccaacauggugaaaacucauguacuaaaaauacaaaaauuagccaggcaugguggcgggcgccuguaaucccagcuacucaggaggcugagacacgagaaucauuugaaccuggcuggacggagguugcagugagccaagaucacgccauugcacucaagccugaacaacagaaugagacuccgucucaaaaaaaaaaaaaaaaaaaguccccacccuuccagggcuguuguaggugccgcugagggccgcaggcucagcccuggucccaucccugcuguggccuccagguguccgggcagcuggucuucuuggcucuggacaccagggggcgccagggcuucaccgaaggagggagggucagccuggaaguguggccggcucacacccaaagcuuuucuggagacuggcagugcccguuguggacuccccgggcuagauguccauuguccugacagggagacugaggccccacagccagaaucucaagcccagaggcugagcuggcucucccagauuuaccaccucugcuggguguguguaaagagccuacugugcuugguccuggagacccagaugaaccagagacugugagucugugcccuggaggagcucagcagcugauggaugaugauggggggugggugaccuugaaguugaggucagacugcugcauccaggcccagccuuugcccccaugguaaucuguaagguagaagcagccgcugggugguacggagucaucucccugaaggcagcugacgcugucacccugaauccuuaacuacggaggagcuagggaugagcgcuaggauggguaucgcaggcgaggacaaagggcuugccccaggucacacagcugaacagaggcaggggugagccuggguccaggucagucugacgccggaggucaggcugcuucucgccucuguccagcuguguggccuuggacaagccucuugguuacacagcuggacagaggcacgaaacagccugaccugagaggcagugccccaaggccuugacagggguccagggccaaagcugcgcagaaacccuugggggcuggcccaggcaguuggaagcaggagacaggguuugaaggucccaaucccauuccuaaagcuguggcagucaugggugacucugggguggcucugcccucccaaccaggcagcugugguagcuggauugagcgaggcaggggcugcagaaccuuauuccucuugccuuuccaaggcgucccauggaugacauggaugacaugcuguuccaaugacacggacauugcucagaaccccccaggacucagcagccccucaccccuucccucaucccuuguuccuuugucaaaggaccccagaauugugagacaagugccucccugcccucaggggcccuugggagaccugcuuaaggaaagauaaaggcgcuggaagagccuguuccaggaggcggggaguacuggggggcgggggguggcaucagagagacugcccugaggaagugagcuucgcacugaaaccugaugcuugguauugaggugaaggcgaguuaggaucaggcucgggggagagggcuccuagcagagggaacagcaugagcacaggucuggcauggaaggagguugaugagagccuagagcagagagagucaggcucucucagucuggcaaguaguguggacuuucuccugagggcacuggggagccaugguguagguuugagcaggggaguggcaggaaagauugguuuuaggaaggucuuucaggcugccuuggggaagggauugaaggucugaggggguaucuacuggggcuucauagaugggaagauggggaggagauggcccuagggggcaggaauggggucccugugacauggugcccgccugcagauuggacagcccacacugcugcuguauguggacgcaggcccugagaccaugacccagcggcucuugaaacguggagagaccagcgggcguguggacgacaaugaggagaccaucaaaaagcggcuggagaccuauuacaaggccacagaaccugucaucgccuucuaugagaaacguggcauugugcgcaaggugggccccgcgggcccaggggcagcuccgggaagaacggguuccuauguggcuccgccucagcucacuguguggccucaggccagccccucucucugggccuugguuuccccacugguucaaugaggggcugcugucaauuagguugggcucggggaggcaggccuggucucuggggccugccauggugaggcccaccccacuccaccuggugacucagcccucacggcccaucuccccacaggucaacgcugagggcuccguggacagugucuucucccaggucugcacccaccuggacgcccuaaaguagcaacgcuggagccgcuuccccagcucagagccccgccccaccccguccugauucgagguccuccuggccugagcgcagcgccuccacccugcccugcugagcacagacggaggaagccgcuuauccuguuuucauggacagcugagcacuaaaggaauuucuaaggacauuugguuuuacugcuuuuucucugcuuccaguuggaguugauucaugugcuugugccuaccuggccgcaaguccccagccccucaacccuccguuccuccucagccucccuuugccagccaccccuccucuagcucuggugggaggcccggggcccuuccucgcacagggcaugccuggccugaggacccggcgcugaguggcggggccccugcuccgaggggcucauguucaggcagaaccggucccagccugggcuccucugcaucuugcucuguggccuuggcccugacccccaucgcucugagcauauguuccaugccuggcccuugccggggccuggacugcacaggcagcaaggucauggucugaguggggcuuccugggcaguuggggcggcccacgccagcuggcccaguggguagugaauuggcuuccuugacgcgagaggcucugagggucugaaaagggcaucucaauggcauggguggguggggagucagucaugucacugaaauugaaugggggaggcccaaugagguggcucaugccuguaaucccagcacuuugggaagcugaggcaggaggauccccugaggucaggaguucgagagcagccuggccaacauggcaaaaccccuuauuuacuaaaaauacaaaaauuagccgggcaugguggcaugugccuguauucccagcuacucaugaggcugaggcaggagaauggcgugaacccgggagguggagcuugcaaugagccaagauugcgccacugcacuccagccugggugacagagcaagacuccgucucaaaaaaaaaaaaaaaaaaaaagaaauugaauugggggagucauggucaggggugagaccugaaggaccucccccuguguggcccuggacacagcccacccucugugagccguuuccaauucuaaaacagacucaaugucccccucacccccaccucaaggucaggaugagaacacacugagugaggaguggacgcuguccauugccacggccaugagggcuggagaccagaacagcauggcccgaagcgugcggggccccggaugacuuggggacaccccagaauccccuggggagaacccuuccugcgcgcuuucauuuuuugaccucaucacugagaaaggcucaauuuggugcucacguguccuuaacaccugaucuggcccaagcugggcucccuuuaagccaagagagccucuuguggaccccgccugcccgaaugaaauccgaacaguuggggcuguucauggcaaguggggcugguuuuucauuuccauugguuauuuaaaguuuccuuuaaaauaaacgauuuuaaguuauaaaaggugaaucuauugaaagaagaacaugaaagaaauaaacaggaguucagcggagcuagcagaagacaaggcauguagggggagccauucugucccagggaaguuguggaggguaggggcuguguggaggccucugcagcugguccucgguuuuccgcaucggcagaaaacugauggggcacgcagggacaccgcaggcuccagguccuggguccugcaucugucaaaccagauucacacacacacacucacacacgccagcgcgcgcacacaugcacucacacauacacacugauccacacacuugcacucccacacacgcaugcacacacacuuuuacacacacgcaugugcacacaaaccacucauccauacacacauuuacacagucacccacacgcacucacacugacccagacacuugcacucccacucacacaaacacacuugcacacacacucauucacacacauuuacacaugcacacauucacacacuuguacacacaaaccacucacauucacacacaucugcacacucacagucaugcagugcacacaccacacacgugcacacaaaccacucacauucacucuuacacgcacacacacucacugucucacacauccauucugucucaggaugaagacaaaguaauaaagauaaggaggcgguuugguggggggguccuaguucuuucucaucuaccuuaucuuuauuuugaucacagcuucauucauccgggugagucccaguuugugaaaccuaagcugauucaaauugucaaacgauucaccacagaauca

SEQ ID NO: 13153 - RNA, 3815 nt, Homo sapiens
cgccgggaguugcaguucccgggcgaggcaguugacugccccacaacgagcucgggccucacccggauggcggcugcgacgcgcggcugccggcccuggggcucgcuccucgggcugcucgggcuggucucggccgcggccgccgccugggaccuggcuucccugcgcugcaccuugggcgccuuuugcgaaugcgacuuccggcccgacuugccgggugaggcgccagggagcccggagcgaggggcgggcggacgcgggcagacgcgggagcgcugggagcccugggagcccggcuggcgccggccagagaagcugaggacccagagggugggaccgaggggcggggcccgcagacuugggaggguggaggguacccguugagguccaggaggcccugccaaccuggagagaggccucagccagcagaacccuugguggaaguucuugggccuccccggaauggccuggccgucaaaggagaagugcagugcgccuuggggaugggcggggucugcggcugaccccguugacagcucgcauuuagagcugagugcaaucuagaggaccgccuggugggggcgcugccgagcugaaucaggcccgaagguggcucuuuuccgccacagaccccaagguuugcgugccaugugcauaggcagcuuggacaaacguaaggacacaggagucccagaccagguuccagacaugauguucuccuugaaccucugccucggugggauguguccucaccauccuccuguggcccuaggucuggagugugaccuggcucagcaccuggccggccagcaucuggccaaggcgcugguggugaaggcgcugaaggccuuugugcgggacccagcccccaccaagccgcugguccucucccugcacggcuggaccggcaccggcaaauccuaugucagcucccugcuggcgcacuaccucuuccagggcggccuccgcagcccccgcgugcaccacuuuucucccguccuccacuucccccaccccagccacaucgagcgcuacaagguaggcuggaugcguccuugaccacuguucucaccauggggugccacccuagggaguaaguccugagcccagacaggggagucaccugcuccaggccacacacggcugcagccccagcccucaggacccauccugcacagaacuugggaaggugucauucuaccuggcagggaguacuuugauuccuuggggcaguaaggaacccuggcaguaccuacaugccaggguuguugugagggacaugagauuauaccauugcagauaucauuuauggagcaccuauguuugucagauaaucugcacuguugucuugcuggaaaucagccccaauuuguggcucagaggaagcaucaggaaauauuggcucuuacuacuacuguuguugauugcaggguacccaccaggcugaucaguuucagccgucaacacugcuguguaguuucagggagcaggaaggagccuuccccuuuuauagaaagcagcaagugucguggaaggagcucugaacagggaagugggaggcuuggguuugagucccuguucugacuggcugugugacuuugggcaagucucugccccaaucugggauacaguuucaccaucagucucacuaagagguuggugcucucuggaagaccacauccuucccuagaaaggagauuaguuuugguuugggaagaggucugguguugggggaguuucuccagcuccccuggaacuccugucucuccccuacagaaggaucugaagagcuggguccaagggaaccucacugccuguggccgcucccucuuccucuucgaugagauggacaagaugcccccaggccugauggaaguccugcggccuuuccugggcuccuccugggugguauacgggaccaauuaccgcaaagccaucuucaucuucaucagguggggcccggcuuugcagugggcacagugggggggccacuucucagagguucagcucuacagccuuagccugugcucccagcagaauccaguuccccaugggcuuagcugggcuuucccagugcccuccgccacucucagagaugacauugucauuccgccugguugauuucccuuuggacauucucagcaaauucugggcucagucuuuuugaucgccacuucuuuguggaagcccugccaggucaagaaguuuucccucuuuuguggugaggaggacacaggccugggaaaaauaggaacagaguucuuguccuuuagucccagcucucagaauccucgcuguguuuccucaggcagcauggcuccgccucucugagccucugucucugcuucugaacagcggggccaauaaugaugccccgaugccuuccuggaaguucagugagggaaagucaguugagggacacaaaaguguuuuguaaacuauaaaguacguggcauguguaggugaauuacaggggccauggauguggacaccauggagggggaaguggagcguuuucaguggaguuggcuccuccccgcacugagccauguuccuaugucagguggcagcggggaagcgaggguccaauccugcccugcgcuaguccucaucugagucucagccugggucccccaugguuuuagcaacacggguggcaagcagaucaaccagguggcauuggaggcguggcgcagccggcgggaccgcgaggagauccuccugcaggagcuggagccggucaucucccgcgcggugcuggacaacccgcaccgugagucuggcucagcagcccccucccgggcagcuucaccccacacccaggggccaggcucucccggggucucaugcuuugcccacugacccggcaguucugagccuggcuuuggcacucccagcuuugugacuuugggugagccuuacagccccugaguccuacacccagaaggcggcugagggaacugaggccagcauuuuuccuccugccccuggggguuuggggccggcuucuccccucuugugaagcacaaaguccccuccccaccuacccuuccugcagauggcuucucaaacucgggcaucauggaagagcgccuccuagacgcaguggugcccuuccucccgcuccagcggcaccacguccggcacugcgugcucaacgagcuggcccagcugggccuggagccaagggaugagguuguccaggcugugcuggacagcaccaccuucuucccugaagacgagcagcucuucuccuccaacggcugcaagaccguggccucccgaaucgccuucuuccucugacucucugagugguguccucggccccccugauggccaggccaugcaggaaaggccaggggccucugucacaggaacccagagcaccaagugagaugaacggagugucggcuaggccacgggacagauggccaggaagggcccuggccucuaaacuggcucgagagcaucuuggccccggccaccuuccccagggaaaccccuggucaccccagaaccucacugagccuugaccucccccugcagccugagccuucuuacugugaauuauaacucagggacuguggcucguggcggugcucccuccucagucugccacccuugccccuugccuccuuggucgggcaccauaccuccuccccuccaccccacacccuguguccauaucaagccagguggagccuucucaguuuccagaaauggagggacucaagcugccacuugggccugguuuuagauguuuuuaauuuuguaaaagaaaacaaguauaauaaacucagcugugggaccagagg
